US011252965B2

(12) United States Patent
Scheel et al.

(10) Patent No.: US 11,252,965 B2
(45) Date of Patent: Feb. 22, 2022

(54) RNAI INSECTICIDE MATERIALS AND METHODS

(71) Applicants: Indiana University Research and Technology Corporation, Indianapolis, IN (US); University of Notre Dame du Lac, South Bend, IN (US)

(72) Inventors: Molly Duman Scheel, Granger, IN (US); David W. Severson, Cassopolis, MI (US); Kathleen Eggleson, South Bend, IN (US); Na Wei, South Bend, IN (US)

(73) Assignees: Indiana University Research and Technology Corporation, Indianapolis, IN (US); University of Notre Dame Du Lac, South Bend, IN (US)

( * ) Notice: Subject to any disclaimer, the term of this patent is extended or adjusted under 35 U.S.C. 154(b) by 0 days.

(21) Appl. No.: 16/316,847

(22) PCT Filed: Jul. 13, 2017

(86) PCT No.: PCT/US2017/041919

§ 371 (c)(1),
(2) Date: Jan. 10, 2019

(87) PCT Pub. No.: WO2018/013801

PCT Pub. Date: Jan. 18, 2018

(65) Prior Publication Data

US 2019/0297879 A1 Oct. 3, 2019

Related U.S. Application Data

(60) Provisional application No. 62/361,704, filed on Jul. 13, 2016.

(51) Int. Cl.

| | |
|---|---|
| ***C12N 15/113*** | (2010.01) |
| ***C12N 15/81*** | (2006.01) |
| ***A01N 57/16*** | (2006.01) |
| ***A01K 67/033*** | (2006.01) |
| ***A01N 25/00*** | (2006.01) |
| ***A01N 25/02*** | (2006.01) |
| ***A01N 25/10*** | (2006.01) |
| ***A01N 63/60*** | (2020.01) |

(52) U.S. Cl.

CPC .......... *A01N 57/16* (2013.01); *A01K 67/0333* (2013.01); *A01N 25/00* (2013.01); *A01N 25/006* (2013.01); *A01N 25/02* (2013.01); *A01N 25/10* (2013.01); *A01N 63/60* (2020.01); *C12N 15/113* (2013.01); *C12N 15/81* (2013.01); *C12N 2310/14* (2013.01)

(58) Field of Classification Search

CPC .... A01N 25/006; A01N 25/02; C12N 15/113; C12N 2310/14

See application file for complete search history.

(56) References Cited

U.S. PATENT DOCUMENTS

| | | | | |
|---|---|---|---|---|
| 8,759,306 | B2 | 6/2014 | Kaletta | |
| 8,841,272 | B2 | 9/2014 | Zhu et al. | |
| 8,933,042 | B2 | 1/2015 | Raemaekers et al. | |
| 9,290,764 | B2 | 3/2016 | Kaletta | |
| 2005/0255487 | A1* | 11/2005 | Khvorova .......... | C12N 15/1048 435/6.11 |
| 2012/0053231 | A1* | 3/2012 | Paldi ...................... | A61K 31/00 514/44 A |
| 2019/0037854 | A1* | 2/2019 | Chiu ...................... | A01N 63/30 |

FOREIGN PATENT DOCUMENTS

WO 2015170324 A2 11/2015

OTHER PUBLICATIONS

Seok et al., (Mol. Cells 2016; 39(5): 375-381) (Year: 2016).*
Jackson et al., (Nature Biotechnology 21(6): 635-637, 2003) (Year: 2003).*
Pertea et al (bioRxiv 332825; doi: https://doi.org/10.1101/332825, 2017, 21 pages) (Year: 2017).*
GEnBank NM_007158.3, 2004 retrieved from, https://www.ncbi.nlm.nih.gov/nuccore/NM_007158.3 (Year: 2004).*
GenBank AW025184, 2011 retrieved from https://www.ncbi.nlm.nih.gov/nuccore/AW025184.1 (Year: 2011).*
GenBank NM_018913.3, 2020, retrieved from https://www.ncbi.nlm.nih.gov/nuccore/NM_018913.3 (Year: 2020).*
NCBI XM_021838825.1 (Year: 2017).*
NCBI XM_039576472.1 (Year: 2021).*
NCBI XM_035931293.1 (Year: 2020).*
Extended Search Report issued by the European Patent Office, dated Jul. 13, 2020, for European Patent Application No. 17828458.4; 9 pages.
Keshava Mysore, et al., "Chitosan/siRNA nanoparticle targeting demonstrates a requirement for single-minded during larval and pupal olfactory system development of the vector mosquito Aedes aegypti", BMC Developmental Biology 2014, 14.9, http://www.biomedcentral.com/1471-213X/14/9; 16 pages.
Keshava Mysore, et al., "SiRNA-Mediated Silencing of doublesex during Female Development of the Dengue Vector Mosquito Aedes aegypti", PLOS Neglected Tropical Diseases, Nov. 6, 2015; 21 pages.
Keshava Mysore, et al., "Disruption of Aedes aegypti Olfactory System Development through Chitosan/siRNA Nanoparticle Targeting of semaphorin-1a", PLOS Neglected Tropical Diseases, May 2013, vol. 7, Issue 5; 12 pages.

(Continued)

*Primary Examiner* — Richard A Schnizer
(74) *Attorney, Agent, or Firm* — Faegre Drinker Biddle & Reath LLP

(57) ABSTRACT

The present invention provides a novel class of insecticides for control of disease vector insects, particularly mosquitoes. These insecticides prevent maturation or development of larvae into adult insects using interfering RNA (iRNA). The present invention further includes compositions comprising iRNA and methods of controlling, reducing, or treating an insect infestation with the iRNA or compositions described herein.

14 Claims, 7 Drawing Sheets

Specification includes a Sequence Listing.

(56) References Cited

OTHER PUBLICATIONS

Xin Zhang, et al., "Chitosan/Interfering RNA Nanoparticle Mediated Gene Silencing in Disease Vector Mosquito Larvae", JOVE Journal of Visualized Experiments, Mar. 2015, 97; 11 pages.
Clemons, A, Haugen, M., Severson, D., and M. Duman-Scheel (2010). "Functional analysis of genes in Aedes aegypti embryos." Cold Spring Harb Protoc 2010(10): pdb prot5511.
Kumar, A, Wang, S., Ou, R., Samrakandi, M., Beemtsen, B.T., and Sayre, R.T. (2013). Development of an RNAi based microalgal larvicide to control mosquitoes. MW Journal. 4:6 (GCE Special Issue).
Kweka, E.J., Zhou, G., Munga, S., Lee, M.C., Atieli, H.E., Nyindo, M., Githeko, AK., and Yan, G. (2012). Anopheline larval habitats seasonality and species distribution: a prerequisite for effective targeted larval habitats control programmes. PLoS One. 7(12):e52084.
Merritt, R.W. (1992). "Feeding behaviour, natural food, and nutritional relationships of larval mosquitoes." Ann. Rev. Entomol. 37: 349-376.
Mumberg, D., Muller, R., and Funk, M. (1995). "Yeast vectors for the controlled expression of heterologous proteins in different genetic backgrounds." Gene 156: 119-122.
Mysore, K., E. M. Flannery, M. Tomchaney, D. W. Severson and M. Duman-Scheel (2013). "Disruption of Aedes aegypti olfactory system development through chitosan/siRNA nanoparticle targeting of semaphorin-la." PLoS Negl Trop Dis 7(5): e2215.
Mysore, K., E. Andrews, P. Li and M. Duman-Scheel (2014a). "Chitosan/siRNA nanoparticle targeting demonstrates a requirement for single-minded during larval and pupal olfactory system development of the vector mosquito Aedes aegypti." BMC Dev Biol 14: 9.
Mysore, K., E. Flannery, M. T. Leming, M. Tomchaney, L. Shi, L. Sun, J.E. O'Tousa, D. W. Severson and M. Duman-Scheel (2014b). "Role of semaphorin-1a in the developing visual system of the disease vector mosquito Aedes aegypti." Dev Dyn 243(11): 1457-69.
Dolan DNA Learning Center, Cold Spring Harbor Laboratory, Silencing Genomes (© 2006). "Creating an RNAi feeding strain." http://www.silencinggenomes.org/downloads/pdfs/mai_feeding_strain.pdf, accessed Jun. 2015.
Van Ekert, E., C. A Powell, R. G. Shatters Jr., and D. Borovsky. "Control of larval and egg development in Aedes aegypti with RNA interference against juvenile hormone acid methyl transferase." J Insect Physiol 70: 143-150. WHO (2005). "Guidelines for laboratory and field testing ofmosquito larvicides." http://whqlibdoc.who.int/hq/2005/who_eds_whopes_gcdpp_2005.13.pdf, accessed Sep. 2014.
Whyard, S., C. N. Erdelyan, A L. Partridge, A D. Singh, N. W. Beebe, and R. Capina (2015). "Silencing the buzz: a new approach to population suppression of mosquitoes by feeding larvae double-stranded RNAs." Parasit Vectors 8: 96.
Zhang, X., J. Zhang and K. Y. Zhu (2010). "Chitosan/double-stranded RNA nanoparticle mediated RNA interference to silence chitin synthase genes through larval feeding in the African malaria mosquito (*Anopheles gambiae*)." Insect Mol Biol 19(5): 683-693.
Mysore et al. "siRNA-Mediated Silencing of doublesex during Female Development of the Dengue Vector Mosquito Aedes aegypti," PloS Neglected Tropical Diseases, DOI:10.1371, Nov. 6, 2015, vol. 9, No. 121, e0004213, pp. 1-21.
International Search Report and Written Opinion issued by the ISA/US, Commissioner for Patents, dated Oct. 2, 2017 for International Application No. PCT/US2017/041919.
International Preliminary Report on Patentability, issued by The International Bureau of WIPO, Geneva, Switzerland, dated Jan. 15, 2019, for International Application No. PCT/US2017/041919.
Economou, Chloe, et al. "A Simple, Low-Cost Method for Chloroplast Transformation of the Green Alga Chlamydomonas reinhardtii" Pal Maliga (ed.), Chloroplast Biotechnology; Methods and Protocols, Methods in Molecular Biology, vol. 1132, 2014; 11 pages.
Singh, Aditi D., et al. "Oral delivery of double-stranded RNA in larvae of the yellow fever mosquito, Aedes aegypti: Implications for pest mosquito control", Journal of Insect Science, vol. 13, article 69, 2013; 18 pages.
Zhang, Xin, et al. "Chitosan/Interfering RNA Nanoparticle Mediated Gene Silencing in Disease Vector Mosquito Larvae", Journal of Visualized Experiments, Mar. 2015; 11 pages.

* cited by examiner

Fig. 7
UNITED STATES OF AMERICA
ONE CENT

RNAI INSECTICIDE MATERIALS AND METHODS

CROSS-REFERENCE TO RELATED APPLICATIONS

This application represents the U.S. National Stage of International Application No. PCT/US2017/041919, filed Jul. 13, 2017, which claims priority to U.S. Provisional Application No. 62/361,704, filed Jul. 13, 2016, which is incorporated herein as if set forth in its entirety.

STATEMENT REGARDING FEDERALLY SPONSORED RESEARCH OR DEVELOPMENT

N/A

BACKGROUND OF THE INVENTION

Mosquito-borne infectious diseases continue to be a serious global health concern. For example, malaria, which is caused by parasites transmitted by anopheline vector mosquito species, was responsible for 198 million clinical cases and over 500,000 deaths in 2013, per World Health Organization estimates. Media coverage of the ongoing Zika outbreak in South America, with its correlation to microcephaly in babies and Guillain-Barré Syndrome, both of which can require intensive medical intervention, have caused considerable alarm in the U.S. and worldwide, igniting renewed interest in combating mosquito-borne infectious disease. Viruses that cause Zika, chikungunya, yellow fever, as well as dengue, the most widespread and significant arboviral disease in the world, are spread by the bite of the vector mosquito in the genus *Aedes*, chiefly *A. aegypti* but also *A. albopictus*. Zika cases, which are linked to severe birth defects and neurological disorders, are currently occurring in many countries in the Americas, including Belize. *Aedes aegypti* and *Aedes albopictus*, the principle vectors of Zika virus, lay eggs in natural and artificial water-filled containers located within or close to human dwellings. Due to these significant health concerns, the World Health Organization recently designated Zika virus an international public health emergency (WHO, 2016). Furthermore, dengue, the most widespread and significant arboviral disease in the world, is a threat to >2.5 billion people in the tropics, including the southern continental United States, Hawaii, and Puerto Rico. Dengue has an annual incidence of approximately 400 million cases resulting in ~50,000 deaths annually worldwide (WHO, 2016). These statistics highlight the critical need to combat these viruses and their mosquito vectors. Given poor progress in vaccine development and distribution, mosquito control is the primary mechanism for disease control. However, the emergence of insecticide resistance and a lack of support for mosquito control programs compromise current strategies for managing mosquitoes (CDC, 2014).

Dozens of species in the genus *Anopheles* transmit protozoan parasites in the genus *Plasmodium*, which cause malaria. Multiple forms of encephalitis, dog heartworm, and West Nile virus are also transmitted by mosquitoes. Together, these mosquito-borne diseases kill over a million people, and sicken hundreds of millions, every year.

Given poor progress in vaccine development and distribution, mosquito control is the primary mechanism for disease control, but our existing arsenal for eliminating mosquitoes is not adequate. *A. aegypti* lay eggs in water-holding containers, including natural plant containers, as well as a variety of man-made artificial containers that collect rain water or that are filled with water by humans. Larvae hatch from the eggs and remain in the water-filled containers through the end of the pupal stage. During this aquatic phase, the immature mosquitoes are concentrated in defined water boundaries and therefore susceptible to control efforts, including larviciding. Larviciding, the application of microbial or chemical agents to kill mosquito larvae before they are reproducing adults that vector human disease, is a mechanism for larval source management (LSM) and is a key component of integrated *A. aegypti* control strategies (CDC, 2014). Temephos, a relatively inexpensive pesticide used globally, is one of the few organophosphates approved for control of *A. aegypti* larvae (EPA, 2001). Temephos attached to silica (sand) granules, the active ingredient in Abate®, has been used to treat large water containers that are too large to empty (BASF, 2014). However, after >30 years of heavy temephos usage, temephos resistant *A. aegypti* strains have been identified in many countries (Mazzarri and Georghiou, 1995; Saavedra-Rodriguez et al., 2013). In a recent reregistration eligibility decision, the EPA called for labeling changes to address risks that temephos poses to human and environmental health and also prohibited drinking water source treatment (EPA, 2015a). Methoprene, a growth regulator widely used for *Aedes* larval control, can be applied to water surfaces or delivered in slow-release briquettes (Rozendaal, 1997). Although methoprene does not pose unreasonable risks to human health, it is extremely toxic to other invertebrate species (EPA, 2000), and reduced susceptibility/resistance has begun to emerge (Marcombe et al., 2014; Lau et al., 2015). Due to the frequent development of pesticide resistance and growing concerns about the nontarget effects of pesticides in the environment, the current pesticide repertoire will soon reach its expiration date. Larviciding is also used as a method for controlling malaria vector mosquitoes. Although insecticide treated nets (ITNs) and indoor residual spraying (IRS) are the backbone for malaria vector control, there is increasing interest in the use of LSM for reduction of residual malaria transmission. Integrated control programs which included larviciding were successful in Tanzania, Sudan, and Mauritius, and the World Health Organization (WHO) recommended that larviciding, when used as a supplement to ITNs and IRS in sub-Saharan Africa, is cost-effective for malaria control in urban settings where vector breeding sites are few, fixed, and findable. Given the renewed interest in larviciding, frequent development of insecticide resistance, and rising concern for the non-target effects of pesticides, the current larvicide repertoire will soon reach its expiration date. The continued practice of larviciding will require generation of new environmentally safe larvicides. The development of new larvicides with minimal impact on the environment is therefore essential and urgent (Whyard et al., 2009).

Insecticide resistance is increasing, rendering some of the current insecticide options useless. Also, concern about the non-target effects of some pesticides (most notoriously, DDT), limits their practical utility. The current pesticide repertoire will soon reach its expiration date, and the need to develop a new generation of environmentally safe options is urgent.

Larviciding, the application of microbial or chemical agents to kill mosquito larvae in aquatic habitats, is therefore a key component of integrated *Aedes* and *Anopheles* control and disease prevention strategies (WHO). Given the increase of reported insecticide resistance to existing larvicides and the rising concern for negative effects of pesticides on non-target organisms, the current larvicide repertoire is faced with great challenges to sustainability.

New larvicidal agents are vitally needed to address emerging arthropod-borne infectious diseases such as Zika and to target mosquito populations. While a number of recent patents have suggested the use of RNA interference for controlling insect and other pests, generally describing use of RNAi, none have disclosed the new high throughput screen for the selection of larval-lethal genes in mosquitoes including the effective siRNAs that are conserved among different mosquito species but not humans or the specific sequences identified in the present invention. For example, U.S. Pat. No. 8,933,042 entitled "Methods for Controlling Pests Using RNAi" discloses the use of RNA interference for controlling pest infestations, and generally discloses mosquitoes in a laundry list of pests. U.S. Pat. Nos. 9,290,764 and 8,759,306 entitled "RNAi for the Control of Insects and Arachnids" discuss and disclose RNAi that target insects, including mosquitoes but do not discuss the screening for mosquito larva-lethal genes, efforts to design iRNA larvicides that target sequences conserved in multiple arthropod pests but not in non-target species, or the specific sequences as described herein. As the Anopheline genomes have only been recently reported, prior studies were not able to determine target sequences conserved between multiple different mosquito species (e.g. *Aedes* and *Anopheles*) (Neafsey et al 2015).

BRIEF SUMMARY OF THE INVENTION

The present invention provides at least one interfering ribonucleic acid (iRNA) able to target and silence expression of at least one gene required for maturation from larva to adult of at least one insect, preferably a mosquito. In some aspects, the at least one synthetic iRNA is able to target and silence at least one gene required for adult mosquito survival.

In another aspect, the present invention provides a DNA construct encoding and able to express at least one iRNA able to target and silence expression of at least one gene required for maturation from larva to adult of at least one insect, preferably a mosquito. In some aspects, the at least one gene is required for adult mosquito survival.

In another aspect, the present invention provides a host cell engineered to express at least one ANA able to target and silence expression of at least one gene required for maturation from larva to adult of at least one insect, preferably a mosquito. In some aspects, the host cell is a yeast cell.

In another aspect the present invention provides a mosquito larvicide composition for preventing and/or controlling mosquito infestation comprising at least one interfering ribonucleic acid (ANA) able to target and silence expression of at least one gene required for maturation from larva to adult of at least one insect and/or able to target and silence expression of at least one gene required for survival of an adult insect, preferably a mosquito, a host cell expressing the iRNA, a bacterial cell expressing the iRNA, or a yeast cell expressing the iRNA, and at least one suitable carrier, excipient or diluent.

A further aspect provides a method for controlling, reducing or treating an insect infestation comprising exposing; at least one insect to the at least one interfering ribonucleic acid (iRNA) able to target and silence expression of at least one gene required for maturation of the at least one insect from larvae to adult and/or required for survival of an adult insect, preferably a mosquito, or a composition comprising at least one iRNA in an effective amount to control, reduce or treat the insect infestation. In a preferred embodiment, the insect infestation is a mosquito infestation. In some embodiments, the at least one insect is an insect larva.

DETAILED DESCRIPTION OF THE INVENTION

Figure 1:
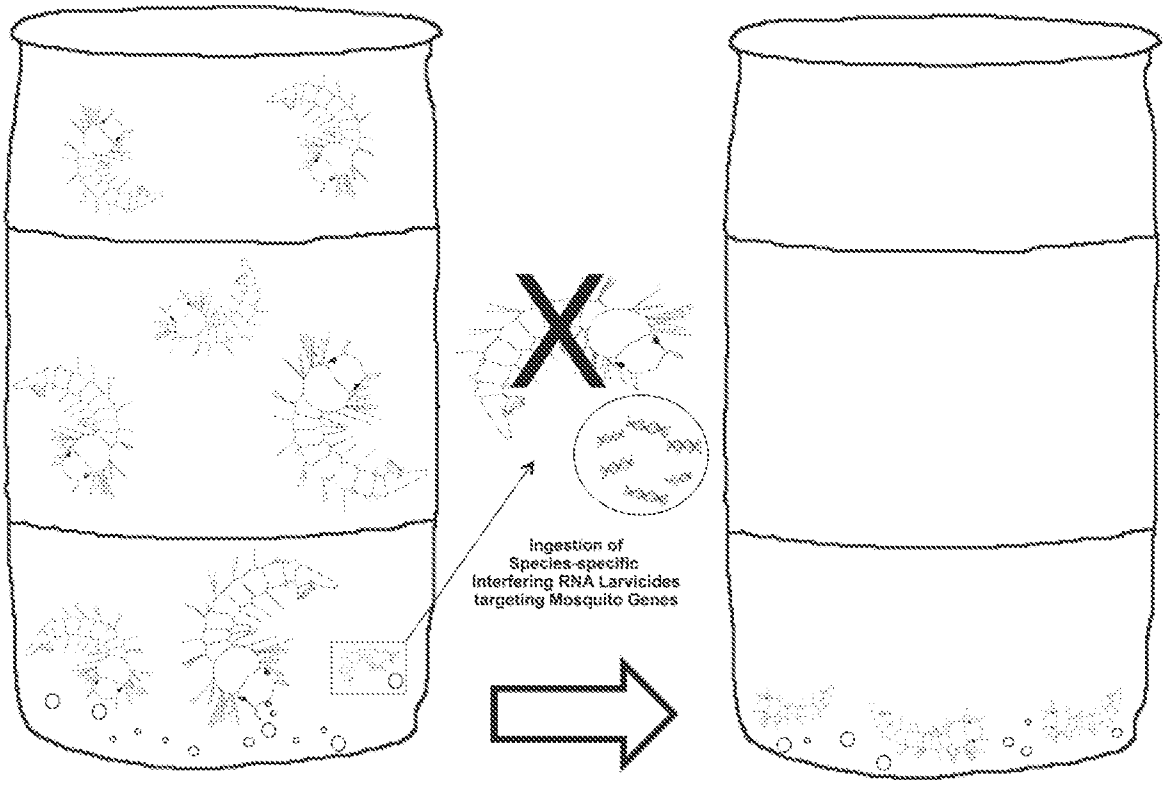
FIG. 1 is a schematic of the depiction of the present invention.

The present disclosure provides a new class of insecticides for control of disease vector mosquitoes. The insecticides target juvenile mosquitoes, preventing their maturation into reproducing adults that can spread disease-causing pathogens, and in some embodiments, the insecticide can also target and kill adult mature mosquitoes. The insecticides can kill mosquitoes at multiple stages of their development. These insecticides use synthetic small interfering RNAs (siRNAs) and their short hairpin RNA (shRNA) counterparts to selectively target genes in developing mosquito larvae and/or adult mosquitoes. The short length of this interfering RNA facilitates the design of insecticides that target multiple species of mosquitoes, but which do not correspond to sequences in the human genome or other non-targeted species. By identifying multiple interfering RNA target sites in mosquito larval genes, we have created an insecticide arsenal to combat resistance arising from point mutations in any one target sequence.

The present inventions provides a means for controlling mosquito infestations by exposing the juvenile mosquito to a interfering RNA sequence that suppresses or inhibits a gene required for maturation or development of the juvenile mosquito (e.g. larva) into an adult mosquito. Such means, as described herein, include, an insecticide or a larvicide, for example, iRNA, RNA constructs and compositions which result in the desired suppression or inhibition of a gene needed for growth, development or maturation. The targeted gene may also play a role in the survival of mature adult mosquitoes, allowing for the ability to target and kill mosquitoes at any life stage.

The present disclosure provided a high-throughput method of screening for larval lethal genes that can be used as a target for iRNA to suppress or inhibit maturation and development of larvae into adults. Larval lethal genes refer to target genes that result in the death or the inhibition of maturation of a larva to an adult in a target arthropod, for example, insects, preferably a mosquito. The method may suitably be used to screen for larva-lethal gene of arthropods, including insect species, for example, mosquitoes, filter feeding pest species, including, for example, members bellowing to the order diptera (fly), trichptera (caddisfly), enphymeroptera (mayfly), and the like. The method of uptake of the iRNA will depend on the particular species targeted. The siRNA can then be formulated into compositions for topically-applied or orally delivered formulations.

A similar screening for adult lethal genes is also provided. In one embodiment, genes identified as larval lethal are tested to see if they are also adult lethal. Adult lethal genes refer to target genes that are essential for adult mosquito survival and results in the death of mature adult mosquitoes.

The present invention provides at least one interfering ribonucleic acid (iRNA) able to target and suppress at least one gene required for maturation and/or growth from larva to adult of at least one arthropod, for example, an insect, preferably a mosquito species (e.g. larva-lethal gene).

In some embodiments, the at least one iRNA is able to target and suppress at least one gene required for survival of at least one insect at any life stage, i.e. larval and/or adult. Some iRNA are thus able to target the insect (e.g. mosquito) at any stage within the life cycle resulting in suppression of growth and/or survival.

In one embodiment, the screen for larval lethal genes for *Aedes aegypti* found genes that are expressed during all four larval instars. Thus, siRNA designed to target these larval lethal genes are able to target larvae at any of the four larval instar stages which has not previously been described. Further, in some embodiments, these larval lethal genes are also adult lethal genes required for adult mosquito survival, and thus are siRNA that can target mosquitoes at any life stage.

The term "iRNA" refers to ribonucleic acid (RNA) sequences and constructs that are able to operate within the RNA interference (RNAi) pathway by interfering with transcriptional or post-transcriptional gene expression resulting in reduced or inhibited expression of a specific gene. For purposes herein, the term "iRNA" refers to short interfering RNA (siRNA), short hairpin RNA (shRNA) and double stranded RNA (dsRNA) that operate within the RNAi pathway. In some instances, the iRNA in produced within a cell via a DNA construct that expresses said iRNA. The iRNA of the present invention are synthetic and can be expressed in a vector or host cell in which the iRNA is not normally expressed. For example, the siRNA may target an insect gene, e.g. a mosquito gene and be expressed by a exogenous vector or expressed in a bacterial or yeast cell that does not naturally contain the target gene or target sequence to which the siRNA binds. The iRNA may be modified in a manner that alters the iRNA properties in order to be exogenously expressed by the host cell, e.g. the siRNA or the complementary sequence use to express the iRNA may be modified at its ends or incorporated into an exogenous sequence in order to be able to be expressed in the target host cell. In some embodiments, the iRNA is operably linked to an exogenous sequence that allows for its expression.

siRNA, sometimes referred to as small interfering RNA, short interfering RNA or silencing RNA are short double-stranded RNA molecules of <30 base pairs in length, for example, about 19-30 base pairs in length that operate through the RNAi pathway. Each siRNA is unwound into two single-stranded RNAs (ssRNAs), one of which is incorporated into the RNA-induced silencing complex (RISC) leading to post-transcriptional gene silencing. SiRNAs can be generated in several ways. In some cases, long dsRNA is introduced to a cell, either by a virus, endogenous RNA expression (i.e., microRNA), or exogenously delivered dsRNA. The enzyme Dicer cleaves the long duplex RNAs into siRNAs. Another way to introduce siRNA into cells is to express shRNA from plasmid vectors. Alternatively, siRNA duplexes can be chemically synthesized, mimicking the structure of Dicer-processed products, are commonly used in research for gene silencing. Chemically synthesized siRNAs simply bypass the Dicer cleavage step. In some preferred embodiments, the iRNA are about 25 bp in length.

shRNA are artificial single-stranded RNAs having a secondary structure such that a portion of the RNA strand forms a hairpin loop. The terminology short hairpin RNA and small hairpin RNA are encompassed by shRNA. Expression of shRNA in cells is typically accomplished by delivery of DNA construct to the cell, e.g. through an expression vector. shRNA is transcribed under the control of RNA Pol-II or Pol-III promoters, and folds into a structure resembling a siRNA duplex. shRNAs are then processed by Dicer into siRNAs.

dsRNA refers to long double-stranded RNA molecules that are cleaved by the enzyme Dicer into short double-stranded fragments of about 20-25 nucleotide siRNAs.

RNA interference (RNAi) or Post-Transcriptional Gene Silencing (PTGS) refers to the biological process in which RNA molecules interfere or inhibit the expression of specific genes with complementary nucleotide sequences to the iRNA (gene-specific suppression of gene expression). RNAi results in the degradation of mRNA after transcription, resulting in no translation and protein expression.

"Gene suppression" or "down-regulation of gene expression" or "inhibition or suppression of gene expression" are used interchangeably and refer to a measurable or observable reduction in gene expression or a complete abolition of detectable gene expression at the level of protein product ("gene silencing"), and/or mRNA product from the gene. In some embodiments, gene suppression results in gene silencing, referring to the ability of the iRNA to target mRNA for degradation, resulting in no translation and therefore no protein expression. The ability of the iRNA to suppress or down-regulate at least one gene leads to the suppression or inhibition of the mosquito's growth or maturation or death of the mosquito larvae or adult mosquito. The down-regulation or inhibition may occur at the translational or post-translational stage of expression of the gene of interest by promoting transcript turnover, cleavage or disruption of translation.

A gene refers to a polynucleotide sequence that comprises control and coding sequences necessary for the production of a polypeptide (protein). The polypeptide can be encoded by a full length coding sequence or by any portion of the coding sequence. A gene may be an uninterrupted coding sequence or may include one or more introns contained between splice junctions. As used herein, a gene may include variants of the gene, which include, but are not limited to, modifications such as mutations, insertions, deletions or substitutions of one or more nucleotides. The target gene is the gene targeted for down-regulation or suppression by the iRNA of the present technology.

The reduction, inhibition or suppression of expression of the target gene results in the inability of the larvae to mature into an adult arthropod insect, e.g., mosquito. The target gene required for maturation and/or growth refers to a gene necessary for the survival, growth, or development of larvae into an adult and may ultimately result in larvae or pupae death. The gene may inhibit the ability of the larvae to develop into pupae, of pupae from developing into adults, or any intervening developmental step. In some instances, the inhibition or suppression of the target gene results in the inability of an adult insect to survive.

Down-regulation or inhibition of gene expression in cells of the mosquito can be confirmed by phenotypic analysis of the cell or the whole mosquito, for example death of the mosquito larva, pupa or adult mosquito (which can be quantitated, for example, as a % mortality). Suitably, the iRNA or compositions provide a % mortality of at least about 50%, alternatively at least about 60%, alternatively at least about 70%, alternatively at least about 75%, alternatively at least about 80%, at least about 90%, alternatively at least about 95%, alternatively at least about 98%, alternatively at least about 100%, and any and all numerical values and ranges in between.

Other methods of confirming down-regulation of the gene expression are known in the art, and include, but are not limited to, measurement of mRNA or protein expression using molecular techniques such as RNA solution hybridization, nuclease protection, Northern hybridization, reverse transcription, gene expression monitoring with a microarray, antibody binding, enzyme-linked immunosorbant assay (ELISA), Western blotting, radioimmunoassay (MA), other immunoassays, or fluorescence-activated cell analysis (FACS) and the like.

In some embodiments, the effectiveness of larvicide is characterized by the lethal concentrations (LC) for mortality and inhibition of adult emergence (IE). In some embodiments, the effectiveness of the insecticide is characterized by the lethal concentration or lethal dose (LD) for an adult insecticide.

The term juvenile mosquito, as referred to herein, refers to the stages of the mosquito life cycle before it becomes an adult but after hatching from an egg. Juvenile mosquito can refer to the larva or pupa stage.

Suitable target genes for use in the present invention include genes identified as larval lethal genes in one or more species of mosquito, as described herein. Larval lethal genes are genes that result statistically significant lethality when compared to a control siRNA treatment. In some embodiments, the larval lethal genes resulted in at least 50% mortality of larvae. In some embodiments, larval lethal genes result in at least 60% mortality, alternatively at least 70% mortality, alternatively at least 80% mortality, alternatively at least 90% mortality, alternatively at least 95% mortality, alternatively 100% mortality. Another suitable method to measure mortality is described in the WHO (2005) guidelines for larvicide testing, incorporated by reference in its entirety.

Additional suitable genes for use in the present invention include genes identified as adult lethal genes for one or more species of mosquitoes. Adult lethal genes are genes that result in statistically significant lethality when compared to a control siRNA treatment. In some embodiments, the adult lethal genes result in at least 60% mortality, alternatively at least 70% mortality, alternatively at least 80% mortality, alternatively at least 90% mortality, alternatively at least 95% mortality, alternatively 100% mortality. In some embodiments, the larval lethal gene is also an adult lethal gene.

In some embodiments, the iRNA inhibit gene expression and result in larvae death or inhibition of maturation of at least two insects, preferably at least two mosquito species, in some embodiments, at least three insects, preferably at least three mosquito species, in further embodiments, at least four insects, preferably at least four mosquito species, in further embodiments at least five insects, preferably at least five mosquito species.

In some embodiments, the iRNA inhibits gene expression and results in larvae death or inhibition of maturation of the larva and adult death of at least two insect species, alternatively at least three insect species, alternatively at least four insect species, alternatively at least five insect species. In preferred embodiments, the insect species are mosquito species.

Suitable targets of the present technology are insects, preferably mosquitoes, flies, caddisfly, mayfly and the like. Suitable mosquito species include, by are not limited to, mosquitoes found in the genus *Aedes, Anopheles, Culex, Ochlerotatus, Culiseta, Psorophora, Coquilletitidia*, and *Mansonia*. Suitable members of the order Diptera (fly), include, but are not limited to, for example, members of the families Nematocera and Brachycera. Suitable members of the order Trichoptera, include, but are not limited to, members belonging to the superfamilies Hydropsychoidea, Hydroptiloidea, Leptoceroidea, Limnephiloidea, Necrotauliodea, Phiopotamoidea, Phryganeoidea, Pryacophiloidea, Sericostomatoidea, Vitimotauiodeal. Suitable members of the order Ephymeroptera are known in the art, and include, but are not limited to, the superfamily Ephemerelloidea, Caenoidea, Baetoidea, Heptagenioidea, Leptophlebioidea, Ephemeroidea and the like.

Suitable mosquitoes that belong to the genus *Anopheles* include, but are not limited to, for example, *An. aconitus, An. albimanus, An. albitarsis s.l., An. annularis, An. aquasalis, An. arabiensis, An. atroparvus, An. coluzzii, An. arabiensis, An. balabacensis, An. barberi, An. barbitrosstris* s.l., *A. bellator, A. crucians, An. cruzii, An. culicifacies s.l., An. darlingi, An. dirus* s.l., *A. earlei, An. farauti* s.l., *An. flavirostris, An. fluviatilis s.l., An. freeborni, An. funestus, An. gambiae, A. gambiae* (Giles 1902), *An. introlatus, An. koliensis, An. labranchiae, An. latens, An. lesteri, An. leucosphyrus/lateens, An. maculates, An. maculipennis, An. marajoara, An. messeae, An. minimus* s.l., *A. moucheti, An. nili, An. nuneztovari* s.l., *An. pseudopunctipennis, A. punctipennis, An. punctulatus s.l., An. quadrimaculatus s.l., An. sacharovi, An. sergentii, An. sinensis, An. stephensi, An. subpictus, An. sundaicus* s.l., *An. superpictus, An. walker* and the like.

Suitable mosquitoes that belong to the genus *Aedes* include, but are not limited to, for example, *A. aegypti, A. albopictus, A. australis, A. cinereus, A. polynesiensis, A. rusticus, A. vexans, A. abserratus, A. atlanticus, A. atropalpus, A. brelandi, A. campestris, A. canadensis, A. cantator, A. cataphylla, A. connnunis, A. deserticola, A. dorsalis, A. dupreei, A. epacitus, A. exerucians, A. fitchii, A. falvescens, A. fulvus, A. grossbecki, A. hensilli, A. hersperonotius, A. hexodontus, A. implicatus, A. infirmatus, A. intrudens, A. melanimon, A. mitchellae, A. nigromaculis, A. provocans, A. solicitans, A. squamiger, A. sticticus, A. stimulans, A. taeniorrhynchus, A. triseriatus, A. trivittatus*, and the like.

Suitable mosquitoes that belong to the genus *Culex* include, but are not limited to, for example, *Culex annulrostris, Culex annulus, Culex pipiens, Culex quinquefascia-*

*tus, Culex sitiens, Cules tritaeniorhynchus, Culex vishnui, Culex univittatus*, among others.

Species able to transmit vector-borne illnesses, such as Zika virus, Dengue virus, malaria, etc. are preferentially targeted.

In a preferred embodiment, the at least one mosquito species includes *A. aegypti* (yellow fever mosquito). In another preferred embodiment, the at least one mosquito species includes *An. gambiae* (African malaria mosquito). In another embodiment, the at least one mosquito species includes at least one species from the genus *Aedes* and at least one species from the genus *Anopheles.*

In a preferred embodiment, the siRNA target sequences are conserved in multiple mosquito species but not conserved in non-targeted species. Through the identification and use of multiple larval lethal genes and multiple target sequences to each gene, the present invention is able to reduce, inhibit or eliminate insecticide resistance arising from a point mutation in any one target sequence. In other words, the siRNA of the present invention are designed to reduce the likelihood of producing insecticide resistant strains by combining multiple targets genes and multiple sequences within those target genes that are conserved among a number of species.

In some embodiments, the at least one mosquito species is *A. aegypti*. Suitably the iRNA targets at least one lethal gene of *A. aegypti*. Suitable lethal genes of *A. aegypti*, include, but are not limited to, the genes listed in Table 1, Table 5 and Table 6 and combinations thereof. For example, suitable target genes include, but are not limited to, at least one gene selected from the group consisting of Gene ID AAEL007292, Gene ID AAEL007298, Gene ID AAEL007548, Gene ID AAEL007546, Gene ID AAEL007554, Gene ID AAEL007563, Gene ID AAEL000032, Gene ID AAEL007876, Gene ID AAEL009273, Gene ID AAEL007718, Gene ID AAEL004874, Gene ID AAEL004756, Gene ID AAEL003517, and Gene ID AAEL014566, and a combination of any two or more of the foregoing. All gene sequences are incorporated by reference in their entireties.

In some embodiments, one or more iRNA targets a specific sequence within an *A. aegypti* lethal gene, for example, but not limited to, the specific target sequences found in Table 2 and orthologs thereof and combinations thereof. Suitable target sequences within these genes include, but are not limited to, the specific target sequences listed in Table 2 and Table 6, including, for example, CTAGCATCATCTTCCGACCGAACCA (SEQ ID NO: 1), GCACAAGTGGCATTGATAATCCTAT (SEQ ID NO:2), GTATCAGTCAGTATCAGAACCAGAA (SEQ ID) NO:3), CGCTGGTTCTGCTGAGAATCAACCG (SEQ ID NO:4), GGGAGAACAGCGACAGCAAGGAGAA (SEQ ID NO:5), GAACGACAATGCTGTATATTTGCGA (SEQ ID NO:6), CCACAAGCTGCGTCACTTCTACGAC (SEQ ID NO:7), CGAGGAGCTGAATGAGATTAAACCG (SEQ ID NO: 8), CGATGAGTCTGAAGAGATACGAATC (SEQ ID NO:9), CCTCCAGGCTGGATCGTTTGAGTTT (SEQ ID NO: 10), CGATGATGTCGGATGGGATGTCCAG (SEQ ID NO: 11), GAAGAAGTACCGTGTGGAAGTGGGA (SEQ ID NO:12), CACTGACAATGATCCGATAAAGACA (SEQ ID NO:13), GTACCTAGTCGATGGTCAATCAGAG (SEQ ID NO: 14), CATTGTTATTACTCACGATGTCAAG (SEQ ID NO: 15), GGAGAAGTGATGACCGTCATGAGAA (SEQ ID NO:16), GGACGTCATTGAAACGGATTTGCTA (SEQ ID NO: 17), GGAACTGCTAACCGATCAAGAGAAC (SEQ ID NO:18), CGTTATTACCATTACGGTAAATGGC (SEQ ID NO: 19), GGGAGGTGATAAGAAACGATGCTCT (SEQ ID NO: 20), GCAAGACAGATTTCGATAAAGATCA (SEQ ID NO:21), and combinations thereof.

In other embodiments, the at least one iRNA targets mosquitoes of the *Anopheles* genus (e.g. *Anopheles gambiae*). Suitably, the iRNA targets the at least one target gene as described in Table 3 and orthologs thereof. Other suitable target genes can be found in Table 6 and orthologs thereof. Suitable target genes include, but are not limited to, for example, a gene selected from Gene ID AGAP000891, Gene ID AGAP008903, Gene ID AGAP003014, Gene ID AGAP011489, Gene ID AGAP007987, Gene ID AGAP007596, Gene ID AGAP007254, Gene ID AGAP009777, Gene ID AGAP011133, Gene ID AGAP010510, Gene ID AGAP004548, Gene ID AGAP010265, Gene ID AGAP009978, and combinations thereof. All Accession No. sequences are incorporated by reference in their entireties. Suitably, iRNA can target the specific sequence within these *Anopheles* genes, for example, the target sequences within the identified genes may include, but are not limited to, the sequences found in Table 4 and Table 6, including, for example, AGAP008903: ATTGGTTCATCGAGCGTGAACGCAA (SEQ ID NO:23), AGAP008903:CCAGCACCAGCCAACGAGGAACACT (SEQ ID NO:24), AGAP003014:AGCTGAACGACAACCTGCTGCTCGG (SEQ ID NO:25), AGAP011489:GCTCGGTACGGTACAGTTTCACTGC (SEQ ID NO:26). AGAP007987:GCTCCATTCGGATCAATCACACATC (SEQ ID NO:27), AGAP007596: GCAGAACGGACAAGAGACAGAAGAT (SEQ ID NO:28), AGAP007596:ATGAACAGTATTTCGCTGAAGGAGA (SEQ ID NO:29), AGAP007254: GCAAGAGAAAGGATCGAAATCGATG (SEQ ID NO:30), AGAP009777:GTGCTGGATAGAATTGCATTTAAAT (SEQ ID NO:31), AGAP011133:GTACCAATTGCATTCGATAGAAGCA (SEQ ID NO:32), AGAP011133: CGTTCAATTTCTTGTGGCAAATGTG (SEQ ID NO:33), AGAP010510:CGACGAGTTCGAACAGGAAGACTGC (SEQ ID NO:34), AGAP010510:CCTACAAATACCTATGGATAGGAAT (SEQ ID NO:35), AGAP010510: ACAGCAGCTACTTCGTCGAGTGGA (SEQ ID NO:36), AGAP004548:GGAATGACTAGAATGGGAATTACTG (SEQ ID NO:37), AGAP004548: GCAAGAGAAAGGATCGAAATCGATG (SEQ ID NO:38), AGAP010265:GCGAGACGATCAATTTGGTCACTAC (SEQ ID NO:39), AGAP008903:GTAGGATTATGAACTCGCAAGATCA (SEQ ID NO:40), AGAP008903: GAACGAGAATCGTTGCAAATAAATA (SEQ ID NO:41), AGAP007987:CCTCCATCTCGATGCTGTATCTGAA (SEQ ID NO:42), AGAP007987: GGTCGACTCTGTCAGTGTACCAAAG (SEQ ID NO:43), AGAP003014:CCACCACTGCCAACAACAACAACAA (SEQ ID NO:44), AGAP003014: GAACCAGAAGGATGACGACTTGAAC (SEQ ID NO:45), AGAP007254: GCAAGAGAAAGGATCGAAATCGATG (SEQ ID NO:46), AGAP007254: GCAAGAGAAAGGATCGAAATCGATG (SEQ ID NO:47), AGAP000891:CCAACTGCATCGACTGTCTGGACCG (SEQ ID NO:48), AGAP000891:ATAGTACCGTGGACAGCAAGGAGCG (SEQ ID NO:49), AGAP011489:CGGTACAGTTTCACTGCGTGGCGAC (SEQ ID NO:50), AGAP003014: GGTGGACTATTACGGGCAACTTTGG (SEQ ID NO:51), AGAP003014:GTGGTGGACTATTACGGGCAACTTT (SEQ ID NO:52), AGAP008903:CATCGAGCGTGAACGCAAACTTGCA (SEQ ID NO:53), AGAP009978:

GAAGAAGGATGTTACGAATGTGCTA (SEQ ID NO:54), AGAP009978:GGAAGATGTT-TAATATCGTCGACAA (SEQ ID NO:55), AGAP009978: GGGAGTGGTTGCATGCGAATCACAA (SEQ ID NO:56), AGAP009978:CGAT-GAGCAAGTAAACGAACTGATC (SEQ ID NO:57) and combinations thereof.

It is predicted, and would be understood by the skilled person, that also orthologs of these target genes represent further targets for down-regulation in the control of other insect and/or arachnid species. Thus, arthropod orthologs of the nucleic acid molecules of the present invention are also contemplated.

Protein or nucleotide sequences are likely to be homologous if they show a "significant" level of sequence similarity or identity. Truly homologous sequences are related by divergence from a common ancestor gene. Sequence homologs can be of two types: (i) where homologs exist in different species they are known as orthologs, e.g. the α-globin genes in mouse and human are orthologs, (ii) paralogs are homologous genes within a single species, e.g. the α- and β-globin genes in mouse are paralogs. By "orthologs" is meant herein both types of homologs referred to above.

In one embodiment, the ortholog will share at least about 40%, 50%>or 60%>nucleotide-sequence identity with the nucleotide sequence of the genes as set forth in any one of Tables 1, 3, 5 or 6 (e.g. SEQ ID Nos: 58-217 and 247-275). Preferably, the ortholog will share at least about 70%, 75%, 80%>, 85%>, 90%, more preferably at least about 95% and even more preferably at least about 96%, 97%, 98% or 99% sequence identity with the nucleotide sequence as set forth in any one of Tables 1, 3, 5 or 6 (.e.g. SEQ ID NOs 58-217 and 247-275). Orthologs of the genes described herein can be found at vectorbase.org and are incorporated by reference in their entirety.

According to another embodiment, the invention encompasses target genes which are arthropod orthologs of a gene comprising, consisting essentially of, or consisting of a nucleotide sequence as represented in any of Tables 1, 3 or 5 (e.g. SEQ ID NOs 58-217 and 247-275). By way of example, ortholog may comprise a nucleotide sequence as represented in any of SEQ ID NOs 58-217 and 247-275, or a fragment thereof. In some embodiments, the orthologous sequence may correspond to the specific target sequences identified within the target genes, for example, orthologous sequences to any one of the target sequences listed in Tables 2, 4 or 6 (e.g. SEQ ID NOs: 1-57 and 218-275). In some cases, the sequences targeted by a synthetic siRNA to *Aedes* and *Anopheles* orthologous genes, for example, but not limited to, the genes listed in Table 6 may be perfectly conserved between the different mosquito species. In other cases, the two orthologous genes in *A. aegypti* and *A. gambiae* may both be required for survival and targeted by two different siRNA target sequences which are not perfectly conserved between the two genes or in other species bearing the same orthologous genes.

Suitably, the sequences and genes targeted by the present technology are specific to mosquitoes. Down-regulation or inhibition of target gene expression is "specific" when down-regulation or inhibition of the target gene occurs without resulting in any detrimental effects on other genes of the targeted organism or genes of other non-related organisms (e.g., humans, mammals, etc.). The targeted sequences selected were analyzed and determined to have little risk for targeting genes in humans. Methods of determining if sequences specifically target human genes are known in the art, and include, for example, assessing human risk empirically through toxicity testing on human cells in vitro and on animal models in vivo, and in silico methods to select only risk-reduced sequences for siRNA synthesis, as described in the Examples below.

The iRNA of the present technology may be a small interfering RNA (siRNA), a short hairpin RNA (shRNA), double stranded RNA (dsRNA) or RNA construct. In some embodiments, the shRNA is encoded in a DNA construct or vector which allows for expression of the iRNA within a target cell.

Some embodiments of the present disclosure provide a DNA construct encoding the iRNA, wherein the DNA construct is able to express the iRNA. Suitable DNA constructs will depend on the type of cell in which to express the RNA. In some embodiments, the DNA construct is a linear or a closed circular plasmid or expression vector. In some embodiments, the DNA constructs will be integrated into the host cell genome, for example, integrated in to a yeast or bacterial cell genome.

In some embodiment, the DNA construct is a suitable expression vector. Sequences that encode the iRNA of the present technology can be inserted into a vector under the control of a suitable promoter that functions in one or more microbial hosts to drive expression of a linked coding sequence or other DNA sequence. Suitable vectors are known in the art and selecting the appropriate vector will depend on the size of the nucleic acid to be inserted into the vector and the particular host cell to be transformed with the vector. Vectors may include one, but are not limited to, one or more of the following: a signal sequence, an origin of replication, one or more selectable marker genes, terminators, enhancers and/or a constitutive or inducible promoter allowing expression of exogenous DNA. Vectors can also include viral vectors and the like.

In some embodiments, the iRNA is produced by a host cell which can express the iRNA from a DNA construct or expression vector. Suitable cells, include, but are not limited to, a bacterial, algal or yeast cell engineered to produce or express the iRNA from the DNA construct. Other suitable host cells, e.g., microorganism cells or plant cells, are known in the art. In some embodiments, the host cell expresses at least two iRNA, alternatively at least three iRNA, alternatively at least four iRNA. In some embodiments, the host cell expresses from 1-10 iRNA.

In some embodiment, the host cell may be stably transformed to express at least one iRNA of interest. In further embodiments, the host cell may be stably transformed to express at least two iRNA, alternatively at least three iRNA, alternatively at least four iRNA, alternatively at least five iRNA. Suitable DNA constructs or vectors to express multiple iRNA from multiple sequences are known in the art. In some embodiments, the host cell may stably express from about 1-10 iRNA, suitably about 1-5 iRNA.

Stable transformants may be produced by incorporating the sequence of the iRNA into the host cell genome. Methods of forming stable transformants of host cells are known in the art.

In order to avoid introducing the replicating host cells or live microorganisms into the environment, host cells may be killed or inactivated (e.g. unable to grow and/or replicate) before being incorporated into the compositions of the present invention. Host cells are preferably killed or inactivated in a manner that maintains the ability of the host cell to act as a larvicide (i.e., the inactivation does not disrupt the iRNAs contained within said host cell). In some embodiments, the siRNA can be purified from the host cell before incorporating into the compositions. Suitable methods of killing or inactivating the host cell are known in the art, and include, but are not limited to, heat-inactivation, high pressure, plasma treatment at atmospheric pressure, sonication, low-amperage electric treatment, or dense phase carbon dioxide processing.

In some embodiments, the present invention provides a bacterial cell expressing the at least one iRNA described herein. Suitable bacterial cells are known in the art and include, but are not limited to, *E. coli, Bacillus thuringiensis israelensis, Lactobacillus* among others.

In some embodiments, the present invention provides a yeast cell expressing the at least one iRNA as described herein. Suitable strains of yeast are known in the art, and include, but are not limited to, *Saccharomyces cerevisiae* (baker's yeast), *Saccharomyces boulardii, Pichia pastoris*, among others. Yeast is an attractive food source for mosquito larvae, which makes it well-suited as a delivery system. Other advantages of yeast include relatively low cost of production, the capacity to produce interfering RNA through yeast cultivation, and the ability to pack and ship dried yeast in shelf-stable forms. Concerns about introducing live organisms into treated sites can be ameliorated by using heat-killed yeast, which retain larvicidal potency.

In one embodiment, the yeast cell is *Saccharomyces cerevisiae. S. cerevisiae* is a model organism that is genetically tractable and inexpensive to culture and can be engineered to produce interfering RNA in the form of short hairpin RNA (shRNA), which can be easily amplified through yeast cultivation. Yeast is both a strong odorant attractant and a source of nutrition for laboratory-bred *A. aegypti* larvae (Mysore et al., 2013). Moreover, dried yeast, a granulated form in which yeast is commercially sold, can be packaged and shipped, making it ideal for delivery to countries with extant *A. aegypti* populations and endemic virus transmission.

The present shRNA produced and delivered in *S. cerevisiae* can be utilized as targeted and efficient mosquito larvicidal agent.

In some embodiments, the host cell expresses at least two iRNA that target a single gene, alternatively at least three iRNA that target a single gene, alternatively at least four RNA that target a single gene. In another embodiment, the host cell expresses at least two iRNA that target two different genes, alternatively at least three iRNA that target at least two different genes, alternatively at least three iRNA that target at least two different genes, alternatively at least three different iRNA that target at least two different genes.

In one embodiment, a host cell, e.g. a yeast cell expresses at least two iRNA that target a single gene. In one embodiment, a host cell expresses at least three iRNA that target a single gene. In one embodiment, a host cell expresses at least three iRNA that target a single gene. In one embodiment, a host cell expresses at least four iRNA that target a single gene.

In one embodiment, a host cell expresses at least two iRNA targeting at least two different genes required for maturation from larva to adult of at least one insect, preferably a mosquito.

In another embodiment, a host cell expresses at least two iRNA targeting at least one gene required for adult insect survival, alternatively at least three iRNA targeting at least one gene required for adult insect survival, alternatively at least four iRNA targeting at least one gene required for adult insect survival, alternatively at least five iRNA targeting at least one gene required for adult insect survival, alternatively at least two iRNA targeting at least two different genes required for adult insect survival, alternatively at least three iRNA targeting at least two different genes required for adult insect survival, alternatively at least four iRNA targeting at least two different genes required for adult insect survival, etc. In a preferred embodiment, the insect is a mosquito.

In another embodiment, a host cell expresses at least three iRINA targeting at least two different genes, alternatively at least four iRNA targeting at least two different genes, alternatively at least five iRNA targeting at least two different genes, alternatively at least three iRNA targeting at least three different genes, alternatively at least four iRNA targeting at least three different genes, alternatively at least five iRNA targeting at least three different genes, alternatively at least six different iRNA targeting at least three different genes, etc. In some preferred embodiments, the host cell is a yeast cell or bacterial cell. In some embodiment, multiple iRNAs may target at least one, at least two, at least three, at least four, at least five different genes required for maturation or development from larva to adult of at least one insect and/or adult insect survival, wherein the insect is preferably a mosquito, alternatively at least two or more insects, preferably two or more mosquito species.

In one embodiment, a host cell, e.g. yeast cell is provided that expresses at least four iRNA, wherein the at least four iRNA target a single gene required for maturation from larva to adult of at least one insect, preferably a mosquito. In another embodiment, the host cell, e.g., a yeast cell, expresses at least four iRNA, wherein the at least four iRNA target at least two different genes required for maturation from larva to adult of at least one insect, preferably a mosquito. In some embodiments, the target gene may also be required for adult insect survival.

Suitably, more than one iRNA may either be expressed by a single DNA construct, or may be expressed by multiple DNA constructs that are introduced into the host cell. In some embodiments, the DNA construct comprises multiple expression sites, each site able to drive the expression of a different nucleotide sequence. By this method, multiple iRNAs can be expressed in a single cell, where the multiple iRNA can either targeting multiple sites on a single gene or target multiple genes within at least one insect, preferably at least one mosquito species.

In one suitable embodiment, a yeast cell expresses at least four iRNA by four different expression sites on a DNA construct or vector. In a preferred embodiment the four iRNA are expressed in the yeast *Saccharomyces cerevisiae.*

Suitable, the yeast may be heat inactivated before contacting the larva. In some embodiments, it is preferred that the yeast is heat inactivated to reduce or eliminate the ability of the yeast to grow once released into a treatment area.

In some embodiments, the yeast is being synthesized into a ready-to use dry formulation.

The present invention also provides a mosquito insecticide composition for preventing and/or controlling mosquito infestations. The compositions may comprise at least one interfering RNA of the present disclosure or at least one host cell expressing at least one interfering RNA of the present disclosure and at least one suitable carrier, excipient or diluents. In some embodiments, the at least one host cell is at least one yeast cell or at least one bacterial cell that expresses at least one iRNA. In some embodiments, the mosquito insecticide is a mosquito larvicide.

In a preferred embodiment, the composition comprises at least one yeast cell comprising at least one iRNA. In some embodiments, the yeast cell is inactivated or killed but maintains its larvicidal properties. In a suitable embodiment, the yeast cell is heat inactivated. In other embodiments, the yeast is inactive by methods known in the art, for example, by high pressure, plasma treatment at atmospheric pressure, sonication, low-amperage electric treatment, or dense phase carbon dioxide processing.

Some compositions may comprise one or more iRNA, for example, at least two iRNA, alternatively at least three iRNA, alternatively at least four iRNA, alternatively at least five iRNA, alternatively at least six iRNA, alternatively at least seven iRNA, alternatively at least eight iRNA, etc. In some embodiments, the compositions comprise from 1-10 different iRNAs. In a suitable embodiment, the composition comprises about 1-5 different iRNAs.

In some embodiments, the compositions comprise a host cell comprising, containing or expressing at least one iRNA described herein.

In some embodiments, the compositions comprise multiple iRNAs that target a single gene required for larval maturation or growth, and, in some embodiments, required for adult insect survival. In some embodiments, the compositions comprise multiple iRNAs that target multiple genes required for mosquito larval maturation or growth, for example, at least two genes, at least three genes, at least four genes, etc.

Methods of delivery iRNA of the present technology include, but are not limited to, e.g. larval soaking, nanoparticles (e.g. Chitosan nanoparticles), bacterial cells, yeast cells, algal cells, ovitraps, dried tablets, sugar feeding, and topical applications among others. Other suitable methods of delivery are known in the art. Thus, compositions may include the necessary components to deliver the iRNA to the larva. For example, compositions may comprise nanoparticles, bacterial cells, yeast cells, algal cells and the like that contain or express the iRNA.

In some instances, the insecticide composition is placed in water. In other instances, the insecticide composition is placed in ovitraps. These are water-filled traps that are treated with the larvicides. They are designed to attract *Aedes* mosquitoes to lay their eggs in larvicide-treated water.

The term “preventing” or “controlling” mosquito infestation comprises the reduction or inhibition of the maturation of mosquito larvae into adults and/or death or decreased survival of adult mosquitoes. Suitable, the reduction or inhibition is measured by a reduction in the number of adult mosquitoes within an area.

Suitable carriers, excipients and diluents are known in the art and include, but are not limited to, for example, water, saline, phosphate buffer saline, and the like. Suitably, the carrier is formulated to the composition depending on the delivery method, for example, spray, powder, pellet, etc.

Figure 7:
FIG. 7 is a picture showing a dried inactivated yeast tablet comprising yeast expressing the synthetic shRNA of the present invention. This tablet is a ready to use mosquito lure that can be placed in the field or water to treat a mosquito infestation.

The compositions may be formulated into suitable forms for treatment of a mosquito infested area. For example, the composition may be in the form of a spray, powder, pellet, gel, capsule, food product or the like. Suitable, the composition comprises inactive yeast cells expressing at least one iRNA. In one embodiment, the composition is a dried inactive yeast pellet, as shown in FIG. 7, containing the synthetic interfering RNA in a tablet. These tablets are ready-to-use lure.

The disclosure further provides methods for controlling, reducing or treating a mosquito infestation comprising exposing at least one mosquito larvae to the at least one interfering ribonucleic acid (iRNA) or a composition described herein in an effective amount to control, reduce or treat the mosquito infestation. The mosquito infestation may be controlled, reduced or treated by inhibiting the larvae from maturing into adult mosquitoes by inhibiting at least one gene require for larval maturation or by decreasing the survival of adult mosquitoes. Suitable, inhibition of maturation may include the reduction in the number of adult mosquitoes found within a given area.

The disclosure further provides methods for controlling, reducing or treating a mosquito infestation comprising exposing at least one mosquito larvae or adult to the at least one interfering ribonucleic acid (iRNA) or a composition described herein in an effective amount to control, reduce or treat the mosquito infestation. The mosquito infestation may be controlled, reduced or treated by inhibiting the larvae from maturing into adult mosquitoes or by killing or decreasing survival of an adult mosquito.

Mosquito infestations refers to a population of at least one species of mosquito within a given area, for example, a population of one or more of the following mosquito species described herein. In some embodiments, the population comprises at least two mosquito species, alternatively at least three mosquito species, alternatively at least four mosquito species and can range depending on location. In some embodiments, the population comprises from about 1-20 mosquito species, alternatively from 1-10.

The present disclosure provides suitable insecticides comprising at least one iRNA which specifically targets and suppresses expression of one target gene, e.g. a larva maturation gene or adult survival gene within an insect, preferably a mosquito.

The term insecticide is used to describe a composition or iRNA which is able to target and kill an insect at any stage of its life cycle. For example, the insecticide may target and kill the insect at the larval stage or as a mature adult insect. In some instances, the insecticide is a larvicide.

The term larvicide is used to describe a composition or iRNA which specifically down-regulates or suppresses a gene required for the maturation, development or survival of the larval stage of development. In other words, a larvicide kills larva or inhibits larva from maturing into the pupa and/or adult stage of development, resulting in a reduction in the number of larva that develop into adults. In some instances, the larvicide may additionally be able to inhibit or reduce survival of adult mosquitoes resulting in adult mosquito death.

The mechanisms by which to deliver the iRNA of the present invention allow for the simultaneous delivery of multiple insecticides. This reduces the likelihood of developing insecticide resistant strains arising from point mutations in any one target sequence and also facilitates the development of broader based insecticides targeting multiple arthropod pests.

It should be apparent to those skilled in the art that many additional modifications beside those already described are possible without departing from the inventive concepts. In interpreting this disclosure, all terms should be interpreted in the broadest possible manner consistent with the context. Variations of the term “comprising” should be interpreted as referring to elements, components, or steps in a non-exclusive manner, so the referenced elements, components, or steps may be combined with other elements, components, or steps that are not expressly referenced. Embodiments referenced as “comprising” certain elements are also contemplated as “consisting essentially of” and “consisting of” those elements. The term “consisting essentially of” and “consisting of” should be interpreted in line with the MPEP and relevant Federal Circuit's interpretation. The transitional phrase “consisting essentially of” limits the scope of a claim to the specified materials or steps “and those that do not materially affect the basic and novel characteristic(s)” of the claimed invention. “Consisting of” is a closed term that excludes any element, step or ingredient not specified in the claim. For example, with regard to sequences "consisting of" refers to the sequence listed in the SEQ ID NO. and does refer to larger sequences that may contain the SEQ ID as a portion thereof.

The invention will be more fully understood upon consideration of the following non-limiting examples.

Example 1: Screening for Larva-Lethal siRNA

This example demonstrates the development of a new class of insecticides for control of disease vector mosquitoes using short-length interfering RNA as mosquito specific larvicides.

RNA interference (RNAi) has been used for functional genetic studies in a wide variety of organisms, including insects (Yu et al., 2013; Zhang et al., 2013). The RNAi pathway is initiated by Dicer, which cleaves long double stranded RNA (dsRNA) into short 20-25 nucleotide-long small interfering RNAs (siRNAs) that function as sequence-specific interfering RNA. siRNAs silence genes that are complementary in sequence by promoting transcript turnover, cleavage, and disruption of translation (Zhang et al., 2013).

Numerous studies have demonstrated that target gene silencing through RNAi can promote insect death (reviewed by Li et al., 2012). For example, Baum et al. (2007) engineered transgenic corn plants expressing dsRNA targeting the western corn rootworm *Diabrotica virgifera virgifera* LeConte. dsRNA insecticidal corn targeting this species was recently registered by the U.S. Environmental Protection Agency (EPA, 2015b), which deemed that this intervention meets the regulatory standards described in the Federal Insecticide, Fungicide, and Rodenticide Act (FIRFA, 2015). Likewise, Whyard et al. (2009) showed that *Tribolium castaneum, Acyrthosiphon pisum*, and *Manduca sexta* were selectively killed when fed species specific dsRNA targeting vATPase. These and other studies suggest that RNAi can be exploited to control insect agricultural pests.

Our recent studies have demonstrated that synthetic siRNA, which can be designed to be species-specific, can selectively target *A. aegypti* larval genes (Mysore et al., 2013, 2014a,b, 2015). We performed a high throughput large-scale siRNA screen to identify genes required for mosquito survival. Genes required for larval survival were identified in *A. aegypti* and *Anopheles coluzzii*, both of which are straightforward to rear under laboratory conditions and appropriate selections for large-scale screening studies. For each larval lethal gene, we identified sequences that are conserved in multiple anopheline and aedine vector mosquito species. 2-3 interfering RNA target sequences corresponding to each larval lethal gene are identified. This will combat pesticide resistance arising from a point mutation in any one target sequence.

Larvicide Screen in *A. aegypti*

The Scheel laboratory at the Indiana University School of Medicine, South Bend, Ind., USA, in collaboration with the David W. Severson laboratory (University of Notre Dame, Notre Dame, Ind., USA) has screened hundreds of siRNAs for mosquito larval lethality. Custom siRNAs corresponding to putative larval lethal genes were purchased from Integrated DNA Technologies (IDT, Coralville, Iowa) and are being used in larvicide trials that are being conducted in the laboratory per the WHO (2005) guidelines. For the screen, siRNAs are delivered to mosquito larvae through microinjection (Clemons et al., 2010) and through larval soaking (Singh et al., 2013). Two or more biological replicate experiments with 20-30 age-synchronized larvae were performed, and larval lethality assessed at the end of the fourth instar. siRNAs that generate significant mortality as compared to treatment with control siRNA (which lacks significant sequence homology to *A. aegypti* and *A. gambiae* genes) are selected for further bioactivity characterization.

~5,000 *D. melanogaster* genes (*drosophila*) are larval lethals (St. Pierre et al., 2014), meaning that loss of function mutations in these genes result in larval death. *A. aegypti* orthologs for most of these genes have been identified (Kasprzyk et al., 2011; Megy et al., 2012), and ~2,500 are expressed in all four *A. aegypti* larval instars (Akbari et al., 2013). Sequences of these *A. aegypti* orthologs downloaded from Vectorbase (Megy et al., 2012) were imported into the Integrated DNA Technologies (IDT) siRNA design tool program, allowing for identification of siRNA duplexes corresponding to each putative *A. aegypti* larval lethal gene. Custom IDT screening dsRNA oligos were used to perform a larval lethal screen in *A. aegypti*. Neural genes, a focus of the Scheel laboratory, as well as *A. aegypti* orthologs of *Drosophila* larval lethal genes that were also identified as larval lethals in a recent *Tribolium castaneum* study (Schmitt-Engel et al., 2015) are among the genes prioritized in the *A. aegypti* screen to date. The screen was initially conducted using chitosan nanoparticles as described (Zhang et al., 2015). Although this procedure worked well (AAEL007292 and AAEL007548 in Table 1 were initially identified in this manner). Later screening used siRNAs through microinjection, which given the technical expertise of our staff who routinely inject developing mosquitoes, was still relatively high-throughput and required less siRNA per trial.

For these experiments, siRNAs were microinjected into each of 30 third instar larvae as described (Clemons et al., 2010; Blitzer et al., 2005); ~10 pmol siRNA were injected in a 30 nL volume per larva. Simultaneously, we also began screening the same siRNAs through delivery via the larval soaking method described by Whyard et al. (2009). For soaking experiments, 20 larvae were exposed to 20 ul of 0.5 ug/ul siRNA for four hours (rather than daily as indicated by Whyard et al., 2009) allowing for detection of siRNAs that were capable of killing mosquitoes following only a brief exposure period, which may better simulate the field. First instar larvae, which are technically difficult to microinject, were used in the soaking experiments. Third instar larvae, which due to their large size require a larger (and therefore more expensive) volume of siRNA treatment solution in soaking experiments, were used in the microinjection experiments. Following siRNA delivery via nanoparticles, soaking, or through microinjection, larvae were reared and lethality evaluated as discussed in the standardized WHO (2005) larvicide testing guidelines.

siRNAs corresponding to target sequences in >400 putative larval lethal genes have been tested to date. ~30% (~100) of these siRNAs resulted in significant larval death following microinjection or soaking experiments ($p<0.05$ in paired t-test). siRNAs targeting 10 of these genes induced an average mortality rate greater than or equal to 50% following microinjection (Table 1, two or more replicate experiments were performed). These same siRNAs also generated significant death ($p<0.05$) following brief four hour soaking of first instar larvae. These 10 genes, which were demonstrated to be larval lethals when targeted beginning in either the first (soaking) or third (microinjection) instar, and for which targeting resulted in death after a brief four hour exposure to siRNA, have been selected for further evaluation in our yeast interfering RNA project.

TABLE 1

Top hits identified in larval lethal screen in *A. aegypti*. Gene functions and the average percentage larval mortality (from two or more biological replicate experiments) observed following siRNA injection are indicated.

| Gene ID | Accession No. | SEQ ID NO: (nucleotide) | Function | Average Larval Mortality |
|---|---|---|---|---|
| AAEL007292 | XM_001652616 | 58 | Unc-76 kinesin binding | 50% |
| AAEL007548 | XM_001658387 | 59 | Leukocyte receptor cluster (lrc) member | 65% |
| AAEL007546 | XM_001658390 | 60 | Actin-related protein 2/3 complex subunit 1A | 65% |
| AAEL007563 | XM_001658402 | 61 | Dual oxidase | 55% |
| AAEL007876 | XM_001652912 | 62 | Tyrosine-protein kinase | 50% |
| AAEL009273 | XM_001653725 | 63 | Inosine-5'-monophosphate dehydrogenase | 60% |
| AAEL007718 | XM_001652797 | 64 | eIF3b | 50% |
| AAEL004756 | XM_001649686 | 65 | Vesicle docking protein | 80% |
| AAEL003517 | XM_001656855 | 66 | Ubiquitin carboxyl-terminal hydrolase | 60% |
| AAEL014566 | XM_001647781 | 67 | Wnt-5 signaling protein | 55% |
| AAEL007298 | XM_001652617<br>XM_001652618 | 68 | Unknown | >50% |
| AAEL007554 | XM_001658382 | 69 | Methylosome protein | >50% |
| AAEL000032 | XM_001647881<br>XM_001647880<br>XM_001647882 | 70 | 40S ribosomal protein S6 | >50% |
| AAEL004874 | XM_001649902 | 71 | LIM domain containing protein | >50% |

All genes can be found at ncbi.nlm.nih.gov/nuccore by searching the accession number or at vectorbase.org by searching their name or accession number.

TABLE 2

25 bp nucleotide sequences that can target and downregulate larval lethal genes for at least *A. aegypti*.

| 25 nucleotide target sequence | SEQ ID NO: | Gene Name Targeted |
|---|---|---|
| CTAGCATCATCTTCCGACCGAACCA | 1 | AAEL007292 |
| GCACAAGTGGCATTGATAATCCTAT | 2 | AAEL007298 |
| GTATCAGTCAGTATCAGAACCAGAA | 3 | AAEL007548 |
| CGCTGGTTCTGCTGAGAATCAACCG | 4 | AAEL007546 |
| GGGAGAACAGCGACAGCAAGGAGAA | 5 | AAEL007554 |
| GAACGACAATGCTGTATATTTGCGA | 6 | AAEL007563 |
| CCACAAGCTGCGTCACTTCTACGAC | 7 | AAEL000032 |
| CGAGGAGCTGAATGAGATTAAACCG | 8 | AAEL007876 |
| CGATGAGTCTGAAGAGATACGAATC | 9 | AAEL009273 |
| CCTCCAGGCTGGATCGTTTGAGTTT | 10 | AAEL007718 |
| CGATGATGTCGGATGGGATGTCCAG | 11 | AAEL004874 |
| GAAGAAGTACCGTGTGGAAGTGGGA | 12 | AAEL004756 |
| CACTGACAATGATCCGATAAAGACA | 13 | AAEL007292 |
| GTACCTAGTCGATGGTCAATCAGAG | 14 | AAEL007554 |

TABLE 2-continued 25 bp nucleotide sequences that can target and downregulate larval lethal genes for at least *A. aegypti*.

| 25 nucleotide target sequence | SEQ ID NO: | Gene Name Targeted |
|---|---|---|
| CATTGTTATTACTCACGATGTCAAG | 15 | AAEL007563 |
| GGAGAAGTGATGACCGTCATGAGAA | 16 | AAEL007563 |
| GGACGTCATTGAAACGGATTTGCTA | 17 | AAEL007563 |
| GGAACTGCTAACCGATCAAGAGAAC | 18 | AAEL004756 |
| CGTTATTACCATTACGGTAAATGGC | 19 | AAEL004756 |
| GGGAGGTGATAAGAAACGATGCTCT | 20 | AAEL004756 |
| GCAAGACAGATTTCGATAAAGATCA | 21 | AAEL007548 |

At this juncture, interfering RNAs corresponding to the genes AAEL007292, AAEL007548, and AAEL004756 are our most promising *A. aegypti* larvicides. The sequences initially targeted in these genes are:

(SEQ ID NO: 1)
AAEL007292: CTAGCATCATCTTCCGACCGAACCA (SEQ ID NO: 3)
AAEL007548: GTATCAGTCAGTATCAGAACCAGAA (SEQ ID NO: 12)
AAEL004756: GAAGAAGTACCGTGTGGAAGTGGGA

All of these target sequences are well conserved in *Aedes albopictus* (88-92% identity), which also vectors Zika and dengue viruses. Our initial computational evaluations of siRNA targeting these sequences suggest that they have little potential for targeting genes in humans.

Determining Potential of iRNA for Targeting Genes in Human

Multiple in silico methods to select only risk-reduced sequences for siRNA synthesis are used to minimize potential for targeting of human genes. Prior to synthesis, the initial set of designs generated with Integrated DNA Technologies (IDT) Custom DsiRNA Design Tool (IDT 2016) is first restricted to those with i-Scores greater than 60 (which correlates with a greater than 75% likelihood of effective functionality) (Ichihara et al. 2007). In mammalian cells, siRNAs can exert off-target effects through two distinct mechanisms (Doench et al. 2003); reducing the risk of off-targeting via both of these mechanisms inform both pre-synthesis design and an additional round of scrutiny after initial laboratory testing for effective inhibitory functionality. The seed-dependent off-targeting pathway requires matching of the six nucleotide siRNA seed region of nucleotides in position 2 to position 7 to the 3' untranslated region of the transcript. Risk-reduction is associated with a lower number of times a given six-nucleotide sequence is represented in the 3' UTR of the human transcriptome; the number of occurrences of a given hexamer is called the seed complement frequency (SCF) (Anderson et al. 2008). To achieve risk-reduced design with respect to the seed-dependent pathway, SCF in the mid-high and high ranges, as defined in Anderson et al. 2008, are disallowed, favoring designs with SCF in the low range. The range between the lowest and highest SCF designs may be 10-fold or greater, which can correspond to a greater than 3-fold difference in undesired off-target inhibitory action without significant difference in desired target inhibition. To address the overall complementarity-dependent off-targeting pathway, this limited subset is then further restricted to those with at least four mismatches over nineteen nucleotide sequences; this standard is more stringent than published threshold for target-specificity of two-mismatches (Naito et al. 2009).

The risk of off-target effects though the overall complementarity is extended to non-human species through Basic Local Alignment Search Tool (BLAST) searches, including broad general categories such as birds and plants, pollinating insects, and specific organisms present in the geographic region of intended use, with mosquito predators as a prioritized class. As an additional pre-synthesis safeguard, the IDT Custom DsiRNA Design Tool (IDT 2016) can, as of February 2016, be configured to report and specify cross-reacting transcripts; designs with no cross-reacting transcripts reported are selected for synthesis. A motif of UGUGU has been found to stimulate the innate immune responses in mammalian organisms and human cells (Judge et al. 2005); the presence of this immunostimulatory motif disqualifies a design from selection for synthesis. Additional in silico criteria can assist with candidate selection among synthesized designs which have demonstrated the highest efficacy as mosquito larvicides in laboratory testing. Among these considerations are thermodynamic stability of the extended seed region of nucleotides in positions 2-8, with a benchmark $T_m$ of 21.5° C. (Ui-Tei et al. 2008) and high average guanine or cytosine content in positions 8-15 (Kamola et al. 2015). Additional nucleotide-by-nucleotide analysis of pairwise BLAST alignments can be guided utilizing the results of finely detailed studies (Wee et al. 2012, Kamola et al. 2015). All of these elements, not found in combination in any single algorithm or tool, together dramatically reduce potential risk to off-target organisms, including and especially humans, before any exposures occur beyond the protections of the laboratory.

Larvicide Screen in Anopheline Mosquitoes

We applied the results of our *A. aegypti* screen to identify larval lethal genes in anopheline mosquitoes. As in *A. aegypti*, genes that were demonstrated to be larval lethals when targeted in either the first (soaking delivery) or third (microinjection delivery) instar, and for which targeting resulted in death after a brief four hour exposure to siRNA, have been selected for further evaluation. At this juncture, these genes have been identified from *Anopheles coluzzii*, and all of these target sites are preserved in the malaria vector *Anopheles gambiae*.

TABLE 3 provides a list of the larval lethal genes targeted in *Anopheles*. Top hits identified as larval lethal genes identified in *Anopheles*.

| Gene | Accession No. | SEQ ID NO: | Function |
|---|---|---|---|
| AGAP000891 | XM_316868 | 72 | Phosphatidylinositide phosphatase |
| AGAP008903 | XM_001689147 | 73 | Unknown |
| AGAP003014 | XM_311865 | 74 | fasciculation and elongation protein zeta 2 |
| AGAP011489 | XM_317813 | 75 | Protein tyrosine kinase |
| AGAP007987 | XM_317480 | 76 | bone morphogenetic protein |
| AGAP007596 | XM_308277 | 77 | Septin |
| AGAP007254 | XM_308548 | 78 | ribosome biogenesis protein UTP30 |
| AGAP009777 | XM_318870 | 79 | mothers against decapentaplegic homolog |
| AGAP011133 | XM_309514 | 80 | Inosine-5'-monophosphate dehydrogenase |
| AGAP010510 | XM_558416 | 81 | tubulin beta |
| AGAP004548 | XM_001237547 | 82 | LIM domain-containing protein |
| AGAP010265 | XM_319454 | 83 | Delta signaling protein |
| AGAP009978 | XM_319115 | 84 | dual oxidase: peroxidase and NADPH-oxidase domains |

All genes can be found at ncbi.nlm.nih.gov/nuccore by searching the accession number or at vectorbase.org by searching their name or accession number.

TABLE 4 siRNA targeted sequences corresponding to the larval lethal screen in anopheline mosquitoes that result in at least 50% lethality.

| 25 nucleotide sequence | SEQ ID NO: | Gene Name Targeted |
|---|---|---|
| CCAACTGCATCGACTGTCTGGACCG | 22 | AGAP000891 |
| ATTGGTTCATCGAGCGTGAACGCAA | 23 | AGAP008903 |
| CCAGCACCAGCCAACGAGGAACACT | 24 | AGAP008903 |
| AGCTGAACGACAACCTGCTGCTCGG | 25 | AGAP003014 |
| GCTCGGTACGGTACAGTTTCACTGC | 26 | AGAP011489 |
| GCTCCATTCGGATCAATCACACATC | 27 | AGAP007987 |
| GCAGAACGGACAAGAGACAGAAGAT | 28 | AGAP007596 |
| ATGAACAGTATTTCGCTGAAGGAGA | 29 | AGAP007596 |
| GCAAGAGAAAGGATCGAAATCGATG | 30 | AGAP007254 |
| GTGCTGGATAGAATTGCATTTAAAT | 31 | AGAP009777 |
| GTACCAATTGCATTCGATAGAAGCA | 32 | AGAP011133 |
| CGTTCAATTTCTTGTGGCAAATGTG | 33 | AGAP011133 |
| CGACGAGTTCGAACAGGAAGACTGC | 34 | AGAP010510 |
| CCTACAAATACCTATGGATAGGAAT | 35 | AGAP010510 |
| ACAGCAGCTACTTCGTCGAGTGGA | 36 | AGAP010510 |
| GGAATGACTAGAATGGGAATTACTG | 37 | AGAP004548 |
| GCAAGAGAAAGGATCGAAATCGATG | 38 | AGAP004548 |
| GCGAGACGATCAATTTGGTCACTAC | 39 | AGAP010265 |
| GTAGGATTATGAACTCGCAAGATCA | 40 | AGAP008903 |
| GAACGAGAATCGTTGCAAATAAATA | 41 | AGAP008903 |
| CCTCCATCTCGATGCTGTATCTGAA | 42 | AGAP007987 |
| GGTCGACTCTGTCAGTGTACCAAAG | 43 | AGAP007987 |
| CCACCACTGCCAACAACAACAACAA | 44 | AGAP003014 |
| GAACCAGAAGGATGACGACTTGAAC | 45 | AGAP003014 |
| GCAAGAGAAAGGATCGAAATCGATG | 46 | AGAP007254 |
| GCAAGAGAAAGGATCGAAATCGATG | 47 | AGAP007254 |
| CCAACTGCATCGACTGTCTGGACCG | 48 | AGAP000891 |
| ATAGTACCGTGGACAGCAAGGAGCG | 49 | AGAP000891 |
| CGGTACAGTTTCACTGCGTGGCGAC | 50 | AGAP011489 |
| GGTGGACTATTACGGGCAACTTTGG | 51 | AGAP003014 |
| GTGGTGGACTATTACGGGCAACTTT | 52 | AGAP003014 |
| CATCGAGCGTGAACGCAAACTTGCA | 53 | AGAP008903 |
| GAAGAAGGATGTTACGAATGTGCTA | 54 | AGAP009978 |

TABLE 4-continued siRNA targeted sequences corresponding to the larval lethal screen in anopheline mosquitoes that result in at least 50% lethality.

| 25 nucleotide sequence | SEQ ID NO: | Gene Name Targeted |
|---|---|---|
| GGAAGATGTTTAATATCGTCGACAA | 55 | AGAP009978 |
| GGGAGTGGTTGCATGCGAATCACAA | 56 | AGAP009978 |
| CGATGAGCAAGTAAACGAACTGATC | 57 | AGAP009978 |
| GCCTAATCAACCTGATCGACCACAA | 218 | AGAP000891 |
| GGATGCACGAATCTTCGATGATATG | 219 | AGAP000891 |
| GTAGGATTATGAACTCGCAAGATCA | 220 | AGAP008903 |
| CCAGCACCAGCCAACGAGGAACACT | 221 | AGAP008903 |
| CATCGAGCGTGAACGCAAACTTGCA | 222 | AGAP008903 |
| GGTGGACTATTACGGGCAACTTTGG | 223 | AGAP003014 |
| GTGGTGGACTATTACGGGCAACTTT | 224 | AGAP003014 |
| GCAGTGGTCAAATCGTTTTAATAGC | 225 | AGAP010265 |
| CGAATCTTGAAAACGATTACCGCTG | 226 | AGAP010265 |
| ATTACTCCATCAAGAGCGACATCTA | 227 | AGAP011489 |
| GGACAAAGATCTGCAGTATCTGCAT | 228 | AGAP011489 |
| CGGTACAGTTTCACTGCGTGGCGAC | 229 | AGAP011489 |
| CCTCCATCTCGATGCTGTATCTGAA | 230 | AGAP007987 |
| CAGGTGATGGTGTACGACATCGTGC | 231 | AGAP007987 |
| ATCCTAAAACGCTAGTCGAGATAGA | 232 | AGAP007987 |
| ATGAACAGTATTTCGCTGAAGGAGA | 233 | AGAP007596 |
| CAATAACAATCACAACGGTCTGAAC | 234 | AGAP007596 |
| GGTTGAATGTGCAGGCGATCAACCT | 235 | AGAP007254 |
| AGATTAAGGAATCGATTGAGCAGGC | 236 | AGAP007254 |
| GCAGGTAACGGACGAGGAAGATTCA | 237 | AGAP007254 |
| GAAGAAGGATGTTACGAATGTGCTA | 238 | AGAP009978 |
| GGAAGATGTTTAATATCGTCGACAA | 239 | AGAP009978 |
| GGGAGTGGTTGCATGCGAATCACAA | 240 | AGAP009978 |
| CGATGAGCAAGTAAACGAACTGATC | 241 | AGAP009978 |
| GCAGTGGTCAAATCGTTTTAATAGC | 242 | AGAP010265 |
| CGAATCTTGAAAACGATTACCGCTG | 243 | AGAP010265 |
| CATCGAGCGTGAACGCAAACTTGCA | 244 | AGAP008903 |
| CGCTGCAGGAAGCGAACAACATTAT | 245 | AGAP011133 |
| GCTCGATCAGCTATTACGAACTGAA | 246 | AGAP009777 |

siRNAs corresponding to the genes AGAP000891, AGAP008903, and AGAP011489, are promising anopheline larvicides. The sequences initially targeted in these genes are:

(SEQ ID NO: 48)
AGAP000891: CCAACTGCATCGACTGTCTGGACCG (SEQ ID NO: 23)
AGAP008903: ATTGGTTCATCGAGCGTGAACGCAA (SEQ ID NO: 26)
AGAP011489: GCTCGGTACGGTACAGTTTCACTGC

The target sequence in AGAP000891 is perfectly conserved in *A. gambiae, A. merus, A. arabiensis*, and *A. melas*. The AGAP008903 target sequence is found in *A. gambiae, A. funestes, A. sinensis, A. dirus, A. arabiensis, A. quadriannulatus, A. melas*, and *A. christyi*.

The target sequence noted for AGAP011489 is also conserved in *A. quadriannulatus*, and *A. merus*. Our computational evaluations of siRNAs targeting these sequences suggest that they have little potential for targeting genes in humans.

We have identified multiple siRNA target sites in each of our top aedine and anopheline genes. The use of multiple siRNA allows us to combat the potential for pesticide resistance emerging from a point mutation in any one target sequence. For anopheline mosquitoes, we select sequences that are conserved in multiple anopheline species, specifically those that vector malaria parasites in the Bill and Melinda Gates Foundation priority areas, which include sub-Saharan Africa, the Greater Mekong Subregion, and Hispaniola. In this manner, we identified larvicides that can kill multiple malaria vector species across the globe. Likewise, as we identify multiple target sites in each *A. aegypti* larval lethal gene, we can identify sequences conserved between *A. aegypti* and *A. albopictus*, which has a broader distribution within the United States.

Additional genes identified as larval lethal for *Aedes* genus, include the genes listed in Table 5. Suitable iRNA may target any gene listed in Table 5 or an ortholog thereof. All sequences for the genes can be found at vectorbase.org by searching the gene or accession number at ncbi.nlm.nih.gov/nuccore, and are incorporated by reference in their entireties. Orthologs of each gene can also be found at vectorbase.org, which are also incorporated by reference in their entireties.

TABLE 5

Additional larval lethal genes of the *Aedes* genus. All gene sequences can be found at www.vectorbase.org by searching gene name or accession number or http://www.ncbi.nlm.nih.gov/nuccore by searching the accession number.

| Gene | Accession No. | SEQ ID NO: |
|---|---|---|
| AAEL012496 | XM_001662571 | 85 |
| AAEL004491 | XM_001649215 | 86 |
| AAEL007302 | XM_001652587 | 87 |
| AAEL007526 | XM_001652764 | 88, |
| | XM_001652765 | |
| AAEL007547 | XM_001658369 | 89 |
| AAEL007538 | XM_001658370 | 90 |
| AAEL007544 | XM_001658380 | 91 |
| AAEL007566 | XM_001658399 | 92 |
| AAEL007579 | XM_001658408 | 93 |
| AAEL007581 | XM_001658416 | 94 |
| AAEL007586 | XM_001658433 | 95 |
| AAEL007584 | XM_001658424 | 96 |
| AAEL007589 | XM_001658431 | 97 |
| AAEL007602 | XM_001658442 | 98 |
| AAEL007637 | XM_001658476 | 99 |
| AAEL001244 | XM_001658486 | 100 |

TABLE 5-continued

Additional larval lethal genes of the *Aedes* genus. All gene sequences can be found at www.vectorbase.org by searching gene name or accession number or http://www.ncbi.nlm.nih.gov/nuccore by searching the accession number.

| Gene | Accession No. | SEQ ID NO: |
|---|---|---|
| AAEL007660 | XM_001658506 | 101 |
| AAEL005271 | XM_001650568 | 102 |
| AAEL005975 | XM_001664278 | 103 |
| | XM_001664277 | |
| AAEL013809 | XM_001663948 | 104 |
| AAEL003051 | XM_001663042 | 105 |
| AAEL005816 | XM_001651417 | 106 |
| AAEL002932 | XM_001656111 | 107 |
| AAEL007742 | XM_001658562 | 108 |
| AAEL002137 | XM_001654794 | 109 |
| | XM_001654795 | |
| | XM_001654796 | |
| AAEL011432 | XM_001661601 | 110 |
| AAEL005359 | XM_001650724 | 111 |
| AAEL001698 | XM_001659907 | 112 |
| AAEL004165 | XM_001648513 | 113 |
| AAEL000822 | XM_001651235 | 114 |
| AAEL013892 | XM_001664046 | 115 |
| AAEL008578 | XM_001653263.1 | 116 |
| AAEL002848 | XM_001655976 | 117 |
| AAEL005895 | XM_001651523 | 118 |
| AAEL003517 | XM_001656855.1 | 119 |
| AAEL004344 | XM_001648893 | 120 |
| AAEL012107 | XM_001655804 | 121 |
| AAEL000584 | XM_001648604 | 122 |
| AAEL001574 | XM_001653540 | 123 |
| AAEL004707 | XM_001619561 | 124 |
| AAEL002348 | XM_001661305 | 125 |
| AAEL005507 | XM_001650968 | 126 |
| AAEL008058 | XM_001658821 | 127 |
| | XM_001658820 | |
| | XM_001658822 | |
| AAEL011527 | XM_001661684 | 128 |
| AAEL008696 | XM_001659375 | 129 |
| AAEL010850 | XM_001661051 | 130 |
| | XM_001661052 | |
| | XM_001661053 | |
| | XM_001661054 | |
| | XM_001661055 | |
| | XM_001661056 | |
| | XM_001661057 | |
| | XM_001661058 | |
| | XM_001661059 | |
| AAEL004371 | XM_001648944 | 131 |
| AAEL000763 | XM_001650931 | 132 |
| AAEL001876 | XM_001654103 | 133 |
| AAEL011447 | XM_001661620 | 134 |
| AAEL007546 | XM_001658390 | 135 |
| AAEL010506 | XM_001660834 | 136 |
| | XM_001660835 | |
| AAEL009430 | XM_001659998 | 137 |
| AAEL002761 | XM_001655903 | 138 |
| | XM_001655904 | |
| | XM_001655905 | |
| | XM_001655906 | |
| | XM_901655907 | |
| | XM_001655908 | |
| | XM_001655909 | |
| AAEL005211 | XM_001650462.1 | 139 |
| AAEL013159 | XM_001663290 | 140 |
| AAEL007538 | XM_001658370 | 90 |
| AAEL007605 | XM_001658438 | 141 |
| AAEL004166 | XM_001648524 | 142 |
| AAEL000242 | XM_001660084 | 143 |
| AAEL004600 | XM_001649385 | 144 |
| AAEL010488 | XM_001654556 | 145 |
| AAEL011279 | XM_001661515 | 146 |
| AAEL014566 | XM_001647781 | 147 |
| AAEL004688 | XM_001649545 | 148 |
| AAEL004942 | XM_001650039 | 149 |
| | XM_001650040 | |

TABLE 5-continued

Additional larval lethal genes of the *Aedes* genus. All gene sequences can be found at www.vectorbase.org by searching gene name or accession number or http://www.ncbi.nlm.nih.gov/nuccore by searching the accession number.

| Gene | Accession No. | SEQ ID NO: |
|---|---|---|
| AAEL009600 | XM_001660229 | 150 |
| AAEL002684 | XM_001662076 | 151 |
| AAEL004859 | XM_001649836 | 152 |
| AAEL002534 | XM_001655416 | 153 |
| AAEL002047 | XM_001654537 | 154 |
| AAEL011776 | XM_001661853 | 155 |
| AAEL006062 | XM_001651739 | 156 |
| AAEL011656 | XM_001661777 | 157 |
| AAEL009496 | XM_001660119 | 158 |
| AAEL000185 | XM_001658891<br>XM_001658892 | 159 |
| AAEL007049 | XM_001652493 | 160 |
| AAEL010226 | XM_001660647<br>XM_001660648 | 161 |
| AAEL005356 | XM_001650727 | 162 |
| AAEL003193 | XM_001656464<br>XM_001656465 | 163 |
| AAEL005454 | XM_001650853 | 164 |
| AAEL010063 | XM_001660545 | 165 |
| AAEL009898 | XM_001654041 | 166 |
| AAEL004546 | XM_001649342 | 167 |
| AAEL013236 | XM_001663353 | 168 |
| AAEL008741 | XM_001653377 | 169 |
| AAEL012171 | XM_001655866 | 170 |
| AAEL003908 | XM_001647954 | 171 |
| AAEL010387 | XM_001654441 | 172 |
| AAEL013221 | XM_001656454 | 173 |
| AAEL001440 | XM_001659262.1 | 174 |
| AAEL010059 | XM_001660555 | 175 |
| AAEL001101 | XM_001652364<br>XM_001652365 | 176 |
| AAEL012944 | XM_001663079<br>XM_001663080 | 177 |
| AAEL007718 | XM_001652797 | 178 |
| AAEL013795 | XM_001663931 | 179 |
| AAEL017156 | XM_011495422 | 180 |
| AAEL004526 | XM_001649284 | 181 |
| AAEL017349 | XM_011495018 | 182 |
| AAEL010048 | XM_001654123 | 183 |
| AAEL009829 | XM_001660391 | 184 |
| AAEL011782 | XM_001661856 | 185 |
| AAEL013002 | XM_001663144 | 186 |
| AAEL001324 | XM_001653011 | 187 |
| AAEL002411 | XM_001655165<br>XM_001655166 | 188 |
| AAEL000050 | XM_001647845 | 189 |
| AAEL010821 | XM_001654966 | 190 |
| AAEL003287 | XM_001663494<br>XM_001663495 | 191 |
| AAEL008461 | XM_001659198 | 192 |
| AAEL008220 | XM_001658989 | 193 |
| AAEL008656 | XM_001659346 | 194 |
| AAEL011070 | XM_001655039 | 195 |
| AAEL002062 | XM_001654551<br>XM_011494771 | 196 |
| AAEL007874 | XM_001652913 | 197 |
| AAEL000693 | XM_001650205 | 198 |
| AAEL007730 | XM_001658558 | 199 |
| AAEL008863 | XM_001653431 | 200 |
| AAEL007884 | XM_001652923 | 201 |
| AAEL012420 | XM_001655986 | 202 |
| AAEL004756 | XM_001649686 | 203 |
| AAEL005175 | XM_001650448 | 204 |
| AAEL012585 | XM_001656090<br>XM_001656090<br>XM_001656091 | 205 |
| AAEL011701 | XM_001655595 | 206 |

Table 6 provides additional larval lethal genes listed for *Aedes* and *Anopheles* genus, and includes specific siRNA targeted sequences within these genes that is conserved between both the *Aedes* and the *Anopheles* species. In some instances, the sequence targeted is also conserved in *Culex* mosquitoes.

TABLE 6

Additional siRNA sequences and corresponding genes

| *Aedes aegypti* Gene ID | *Anopheles gambiae* Gene ID | siRNA targeted Sequences | SEQ ID NO: |
|---|---|---|---|
| AAEL000014 | AGAP003349 | TACTATCACCTTGGTTATTGT | 207 |
| AAEL000528 | AGAP011320 | CCGTAAGGCCAGCAGTGTAGT | 208 |
| AAEL000704 | AGAP007942 | TTGTATGCTGAACCTAATAAT | 209 |
| AAEL002653 | AGAP008656 | TCCGTCACCGCGACGATAATT | 210 |
| AAEL004269 | AGAP007247 | CACTGCGCCTGCGGATCACAT | 211 |
| AAEL004313 | AGAP008822 | GTCGTGCTCGGCGATCATGTT | 212 |
| AAEL005451 | AGAP010163 | CCGGGAGCAGCGGATCTTGAA | 213 |
| AAEL005733 | AGAP010147 | TGCTGAGCTGGCGCTGGATGT | 214 |
| AAEL006901/ AAEL006898 | AGAP010242 | GTGATATGGCGAATTATTAAT | 215 |
| AAEL014564/ AAEL015302 | AGAP010307 | GCGTTGGCCTCGCTGTTAACT | 216 |
| AAEL008696 | AGAP009777 | CACCGACGCGCAGGTTCAACT | 217 |
| AAEL007874 | AGAP012189 | CTCGATGGGGCCCCACGATTT | 247 |
| AAEL001875 | AGAP010138 | TGCTGCGGTCGCAGATTGATT | 248 |
| AAEL000421 | AGAP002731 | ATGGCACCAGGCGTGATAGTT | 249 |
| AAEL004266 | AGAP007242 | ATCCGGAGCCGGTTTTGTTTA | 250 |
| AAEL002287 | AGAP000591 | GCCGGAGCGCCTCGATGCAGT | 251 |
| AAEL007526 | | CGGCTTCGTCGGCGAAACGTT | 252 |
| AAEL003875 | AGAP004438 | TTGAACCGGTTGCATGAAATT | 253 |
| AAEL004344 | AGAP011655 | GGGCGAGCGGGGCGAATGCAT | 254 |
| AAEL005400 | AGAP003893 | TGCCTCGAGCGGTGTTGTACT | 255 |
| AAEL007146, AAEL007143 | AGAP008200, AGAP008201 | ATGTAGTCGATGATATTTACA | 256 |
| AAEL007505 | AGAP005010 | CAGTCGCTGCCCGTTTGGTTT | 257 |
| AAEL010467 | AGAP002374 | ACCGAACCCGCGGCTACGCTT | 258 |
| AAEL011197, AAEL004631, AAEL005961 | AGAP005095, AGAP011516 | ACGGGGCCAGGGCGGTGATTT | 259 |
| AAEL014176 | AGAP004311 | GTCGACCACGCTGGTAAAGGT | 260 |
| AAEL000242 | AGAP000254 | AAGGAATGATTGCGATTATAT | 261 |
| AAEL000242 | AGAP000254 | TTGCTTGTTCGCCTAATTCAT | 262 |
| AAEL014915 | AGAP001651 | TCCGTGCACCGGCGTCACATT | 263 |
| AAEL017168 | AGAP006089 | TCGCTCCGCATCGCTACTATT | 264 |
| AAEL004006 | AGAP002974 | TCCCAACGCAAGGTATGATTA | 265 |
| AAEL002653 | AGAP008656 | CCGTCACCGCGACGATAATTA | 266 |
| AAEL017168 | AGAP006089 | CGCTCCGCATCGCTACTATTA | 267 |

TABLE 6-continued

Additional siRNA sequences and corresponding genes

| *Aedes aegypti* Gene ID | *Anopheles gambiae* Gene ID | siRNA targeted Sequences | SEQ ID NO: |
|---|---|---|---|
| AAEL002902 | AGAP011985 | ATCGCTCGGCAGCGTTGGAAT | 268 |
| AAEL004006 | AGAP002974 | AACGGCAGGCACCTTCATAAT | 269 |
| AAEL002653 | AGAP008656 | ATCCGTCACCGCGACGATAAT | 270 |
| AAEL014915 | AGAP001650, AGAP001651 | CTGGGCCAGCGCCTTCATGAT | 271 |
| AAEL003920 | AGAP004613 | TGCAGAACGCGGCGATGATAT | 272 |
| AAEL000242 | AGAP000254 | TCGAATGCCTAGATAATTTAA | 273 |
| AAEL000402 | AGAP011038 | GGCTTTCCTGGGCGGAGATCT | 274 |
| AAEL012925 | AGAP004405 | TACGCTGCAGGCAGGATTTGT | 275 |

Laboratory Biological Activity Assays

Following the identification of larval lethal genes in *A. coluzzii* and *A. aegypti*, siRNAs targeting the orthologs of these genes (vectorbase.org) in additional anopheline and aedine vector mosquito species are determined, particularly anopheline species that are endemic to the Gates foundation priority geographies of sub-Saharan Africa, the Greater Mekong Sub-region, and Hispaniola, as well as *Aedes albopictus*, which is broadly distributed in the United States and a vector for several disease-causing viruses, including Zika. Wherein it is possible, siRNAs corresponding to target sequences conserved in multiple species are tested. A guiding principle of these assays is to focus on siRNAs that have little potential for targeting genes in other animal species, which is examined through BLAST searches in sequenced genomes. siRNAs with high levels of homology to sequences in the human genome are eliminated. An advantage of using siRNA larvicides is that when resistance builds due to mutations in the sequence targeted, additional siRNAs corresponding to separate sequences within the same target gene can be used. Our goal is to identify 2-3 siRNA target sequences that are conserved in anopheline or aedine mosquitoes that result in significant lethality when targeted. Genes that can be effectively targeted with the smallest amount of siRNA are selected so as to increase the effectiveness and reduce the costs of this intervention. Fine-scale laboratory bioactivity analyses are then conducted for the most lethal siRNAs. These assays are being performed as described in the WHO (2005) guidelines for larvicide testing. Lethal concentrations (LC) for 50% (LC50) and 90% (LC90) mortality and inhibition of adult emergence (IE50 and IE90) are determined. Data are analyzed through Probit analysis with the POLO-PC program.

siRNA Delivery Strategies

There are several methods of interfering RNA delivery. These techniques, are summarized below:

Larval Soaking:

RNA interference was induced in *A. aegypti* mosquito larvae by soaking larvae in a solution of dsRNA for several hours (Singh et al., 2013). We have had similar success with siRNA in *A. aegypti* and have found that the siRNA soaking strategy also works in anopheline mosquitoes (MDS, unpublished). These laboratory experiments have been conducted using the Singh et al. (2012) protocol in conjunction with gene-specific 28-mer siRNAs at a concentration of 0.5 micrograms/microliter. siRNAs that kill up to 85% of larvae following a single four hour soaking treatment have been identified. These findings suggest that siRNA larvicides could be added directly to larval breeding sites.

Chitosan/siRNA nanoparticles: We have successfully used non-toxic chitosan nanoparticles for interfering RNA delivery to mosquito larvae (Mysore et al., 2013, 2014a, 2015; Zhang et al., 2015, see also video protocol at: jQve.com/video/52523/chitosaninterfering-mananoparticle-mediated-genesilencing-disease). Chitosan/siRNA nanoparticles are formed by self-assembly of polycations with interfering RNA through the electrostatic forces between positive charges of the amino groups in chitosan and negative charges carried by the phosphate groups on the backbone of interfering RNA. Chitosan is believed to enhance the stability and/or cellular uptake of dsRNA (Zhang et al., 2010). Chitosan/siRNA nanoparticles are mixed with larval food and then fed to larvae. This technique is relatively inexpensive, requires little equipment and labor, and facilitates high throughput analyses. Our experiments have demonstrated that chitosan/siRNA targeting larval lethal genes results in up to 50% mosquito larval lethality. These nanoparticles along with other nanoparticles known in the art may be used to target the delivery of the siRNA of the present technology.

Bacterial Delivery Systems:

*Bacillus thuringiensis* bacteria have been successfully used for mosquito larval control, making interfering RNA delivery through genetically modified microbes another potential option. Such a microbial delivery mechanism is attractive since it would significantly reduce the cost of this intervention by eliminating the need to purchase siRNA or synthesize it in vitro. Whyard et al. (2015) fed mosquito larvae dsRNA-expressing non-pathogenic *E. coli* mixed with larval food as bait. They obtained significant levels of knockdown—even when using heat killed bacteria. For proof of concept experiments, we are using the Whyard et al. (2015) approach for delivery of our siRNA larvicides. This strategy involves the use of nonpathogenic *E. coli* strain HT115-DE3 (obtained from the *Caenorhabditis* Genetics Center, University of Minnesota, USA) which is transformed with the dsRNA transcription plasmid pL4440 (obtained from Addgene, Cambridge, Mass., USA) containing a fragment of the gene of interest or GFP (control). Expression plasmids and bacteria feeding lines are prepared as described (Silencing Genomes, 2006) and then fed to larvae as discussed by Whyard et al. (2015). Both live bacteria and heat-killed bacteria are being assessed in our laboratory experiments. Our preliminary data suggest that this microbial delivery system provides an effective means of delivering interfering RNA larvicides. We have observed up to 100% larval death/failure to pupariate—even when the bacteria are heat-killed prior to treatment of mosquitoes. The plasmid-based expression system described above is appropriate for simulated field, semi-field, and small-scale field studies.

For large-scale field studies, dsRNA expression cassettes would be integrated into the bacterial genome, which eliminates risks of horizontal gene transfer or introduction of any antibiotic resistance marker genes carried on plasmids.

Yeast Delivery System:

Van Ekert et al. (2014) silenced *A. aegypti* larval genes by feeding them nonpathogenic *Pichia pastoris* yeast expressing a long hairpin RNA (lhRNA) sequence corresponding to the gene to be silenced. In collaboration with Na Wei (University of Notre Dame), we are conducting laboratory experiments to explore the use of this delivery system. For proof of concept experiments, we are using the Van Ekert (2014) delivery protocol with the following modifications: i)

we are using *Saccharomyces cerevisiae*, non-pathogenic baker's yeast that is commonly used in baking and beverage production, ii) we are using short hairpin RNAs (shRNAs), a short artificial RNA molecule with a hairpin turn that can be used to silence gene expression through RNAi. The short sequence of these shRNAs, which correspond to the sequences of our siRNA larvicides, is preferable to lhRNAs, which have a higher risk of off-species targeting than shorter shRNA molecules. iii) As with the bacterial studies, both live and heat-killed yeast are assessed. *Saccharomyces cerevisiae* is an appealing delivery system, as mosquito larvae are highly attracted to yeast and will ingest it directly. Moreover, the yeast can be dried and packaged much in the same manner in which it is sold commercially, which would greatly facilitate the distribution of interfering RNA yeast larvicides. In one embodiment, the yeast is heat-killed and dried into a pellet formulation that is fed to larvae and has shown success in killing larvae.

Finally, as is the case for bacterial delivery systems, use of yeast is expected to significantly decrease the costs of siRNA production since shRNA expression is easily amplified through yeast cultivation. We have cloned inserts designed to produce shRNA corresponding to larval lethal genes into the pRS426 GPD bacteria/yeast shuttle vector (Mumberg et al., 1995). Yeast expressing these hairpins have been tested as described by Van Ekert et al. (2014) and according to the WHO (2005) protocol. Our preliminary data suggest that ingestion of yeast interfering RNA larvicides generates up to 100% larval death/failure to pupariate even when the yeast are heat-killed.

As with the bacterial studies, the yeast plasmid-based expression system described above is appropriate for simulated field, semi-field, and smallscale field studies. For large-scale field studies, advanced genome editing techniques such as CRISPR/Cas9 will facilitate stable and seamless genome integration of shRNA expression cassettes, which eliminates risks of horizontal gene transfer or introduction of any antibiotic resistance marker genes.

Stable Yeast Delivery System

The inventors have integrated the shRNA expression cassette into the *S. cerevisiae* genome to allow for stable expression of the siRNA in the years. Further, the expression of the shRNA was placed under the control of an inducible promoter. Generation of stable transformants was performed by DNA encoding shRNA corresponding to sequences #1 and #3 in Table 2 was ligated downstream of the Gal1 promoter (Bassel and Mritmer, 1971; Douglas and Condie, 1954, incorporated by reference in their entireties) and upstream of the cycl terminator. The resulting Gal1 promoter-shRNA-cycl terminator expression cassettes were cloned into the multiple cloning sites of pRS404 and pRS406 (Sikorski and Hieter, 1989, incorporated by reference in their entireties), yeast integrating plasmid shuttle vectors bearing TRP1 and URA3 markers, respectively. The resulting plasmids were used for genome integration of the shRNA expression cassettes at the trp1 and ura3 loci of the *S. cerevisiae* CEN.PK strain (genotype=MATa/α ura3-52/ura3-52 trp1-289/trp1-289 leu2-3_112/leu2-3_112 his3 Δ1/his3 Δ1 MAL2-8C/MAL2-8C SUC2/SUC2) (van Dijken et al., 2000, incorporated by reference in its entirety). Stable transformants were selected by growth on synthetic complete media lacking tryptophan or uracil. Integration events at both loci were confirmed via PCR and sequencing.

Generation of these stable transformants eliminates the use of plasmids with antibiotic resistance markers and the potential for horizontal transfer of shRNA expression cassettes.

Algal Delivery System:

Microorganisms, including microalgae, serve as a primary source of nutrition for mosquito larvae (Merritt et al., 1992). Kumar et al. (2013) described a microalgal-based system for delivery of interfering RNA to mosquito larvae. They silenced *Anopheles stephensi* larval genes by feeding them *Chlamydomonas reinhardtii* expressing a hairpin sequence corresponding to the gene to be silenced. We have separately confirmed that *A. aegypti* larvae will eat *Chlamydomonas* in a laboratory setting and believe that these microalgae can be used to deliver shRNA to *A. aegypti* larvae. For proof of concept experiments, using the GeneArt *Chlamydomonas* Engineering Kit (Invitrogen Life Technologies), we will clone inserts designed to produce shRNA corresponding to larval lethal genes into the pChlamy_3 shuttle vector. These constructs are used to transform algae. Algal interfering RNA larvicides are tested on mosquito larvae as described by Kumar et al. (2013). This system can be evaluated in simulated field, semifield, and in field experiments. As with the bacterial and yeast studies, the *Chlamydomonas* plasmid-based expression system described above is appropriate for simulated field, semi-field, and small-scale field studies. For large-scale field studies, hairpin expression constructs are integrated into the *Chlamydomonas reinhardtii* chloroplast genome as described by Economou et al. (2014). Use of algal species that are native to field sites in which the interfering RNA insecticides are used can also be used, preferably those that are normally ingested by mosquitoes. To this end, we are collecting larval specimens from the field to evaluate the algal species that they consume in the wild.

Field Studies

Simulated Field Studies:

Simulated field trials are conducted in the Scheel laboratory according to the WHO (2005) guidelines. In summary, each control/experimental condition is tested on 100 third instar larvae in 5 L tubs containing 2 L water, larval food, and covered with nylon mesh. Mortality is assessed at 2, 4, and 7 days. Four replicates are performed for control and experimental conditions, and data are analyzed through Analysis of Variance (ANOVA). The effects of bacteria, yeast, algae or chitosan delivering interfering RNA targeting high priority genes of interest are being assessed, as will the larval soaking delivery strategy. Experiments are performed at 26° C. (typical insectary temperature) and 32° C. (typical daytime temperature in tropical climates).

Semi-Field Studies

Rooftop semi-field experiments are conducted at the Galvin Life Science Center, University of Notre Dame, Ind. They have established a semi-field larvicide test site which can be used to evaluate our siRNA larvicides and delivery strategies. We have conducted semi-field studies in collaboration with David Chadee at his rooftop laboratory at the University of the West Indies, St. Augustine, Trinidad and Tobago. In all locations, these studies are conducted as described in the WHO (2005) larvicide testing guidelines, which follow the simulated field trial methodology discussed above (IV), except that the studies are conducted outdoors and on natural mosquito populations (for the Kenya and Trinidad and Tobago studies). The effects of bacteria, yeast, algae or chitosan delivering interfering RNA targeting high priority genes of interest are assessed, as will the larval soaking delivery strategy.

Figure 3:
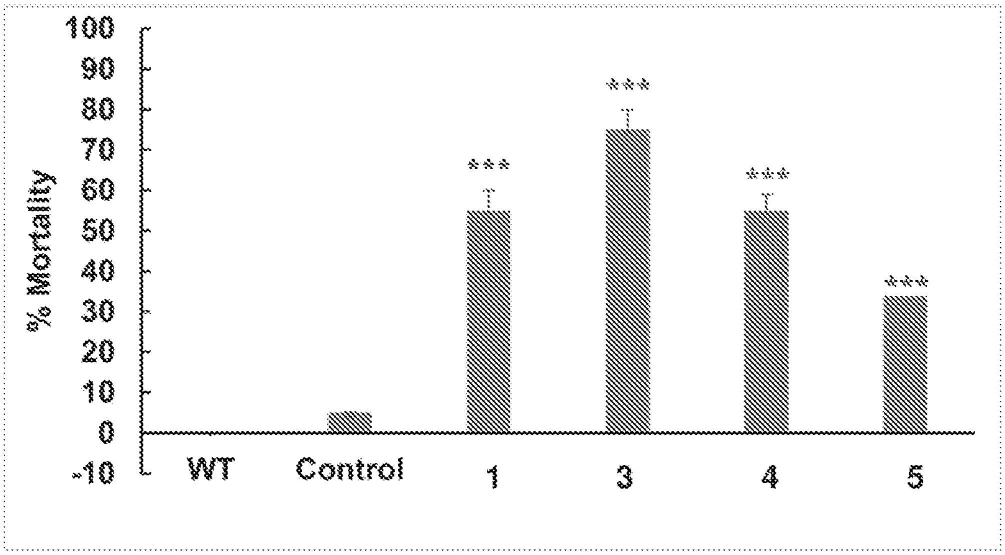
FIG. 3 is a bar graph representing larval mortality following brief exposure to siRNA of the present invention in semi-field trials.

A semi-field test was performed with *A. aegypti* eggs collected from oviposition cups in Trinidad. siRNA (#1 targeting AAEL007292 (SEQ ID NO:1), #3 targeting AAEL007298, #4 targeting AAEL007563, and #5 targeting AAEL004756 (SEQ ID NO: 12) were delivered through larval soaking for three hours as described above, after which time larvae were reared under semi-field conditions. This brief exposure to all of the siRNAs assayed induced significant $p<0.001$) larval mortality in comparison to control siRNA-treated or wild-type (WT) untreated animals. Results compiled from four replicate experiments is shown in FIG. 3, each with 20/larvae/condition are shown. Error bars represent standard errors of the mean.

Field Trials:

Larvicide field assays are conducted in Belize, Thailand, Kenya and Trinidad and Tobago. Guiyun Yan's laboratory has described several potential field sites in Kenya (Kweka et al., 2012). The proposed field site in Trinidad and Tobago is an area south of Sangre Grande toward the northeast corner of the island, in Guiaco Tamana District. The site is located on an isolated stretch along Los Armadillos Road. The area around the site is completely forested for several kilometers. The Severson and Chadee labs have performed larval sampling experiments at this site, where they have found an abundance of *A. aegypti* larvae. We are conducting field trials in several locations throughout Belize, including the Belize Vector and Ecology Center Field Station. Sites in Thailand, including the Kamphaeng Phet and Kanchanaburi field sites, are selected for testing of the siRNA and compositions of the present invention.

Small Scale Field Trials:

Small scale field trials are conducted on natural mosquitoes located in natural breeding sites. The objectives of these studies are to: i) determine the efficacy, including residual activity of interfering RNA larvicides in natural breeding sites, ii) identify the optimum field application dosage, iii) monitor abiotic parameters which may impact the efficacy of the larvicides, and to iv) record qualitative observations of non-target biota cohabitating with mosquito larvae (WHO, 2005). Specific interfering RNA larvicides and delivery strategies deemed to be suitable in our simulated field and semi-field experiments are assessed in the field. The habitats to be evaluated in these experiments include natural and man-made containers that are not used to store drinking water. As discussed in the WHO guidelines (2005), at least three replicates of each type of habitat are randomly selected for each dosage of the experimental or control larvicide formulation. Post-treatment immature (first and second instar, third and fourth instar, and pupal) abundance are monitored in samples taken just prior to treatment, on day 2, and then weekly until the density of fourth instar larvae in treated habitats is comparable to that of the control containers. Efficacy and residual activity are ascertained through measurement of the pre- and post-treatment abundance of each larval instar and pupae, accounting for the dynamics of change occurring in the treated and control containers. Adult emergence are monitored by sampling and counting pupal skins. Data are assessed as described in the WHO (2005) guidelines using ANOVA.

Large Scale Field Trials:

The efficacy of larvicides deemed acceptable in small field trials is verified in larger scale field trials conducted according to the WHO (2005) guidelines on natural mosquito populations located in natural breeding habitats. The objectives of these trials include: i) confirmation of the efficacy of the larvicide at the selected field application dosage when applied to large-scale plots in natural breeding habitats, ii) verification of larvicide residual activity and application intervals, iii) examination of the ease of larvicide application and dispersal, iv) assessment of community acceptance of this intervention, and v) detection of any unanticipated effects of the treatment on non-targeted organisms (WHO, 2005). Pretreatment densities of larvae and pupae are assessed in each larval habitat at least twice over the course of a week prior to treatments. The habitats to be evaluated include those assessed in the small scale field trials, but 25 replicates of each habitat are assessed for each control or experimental treatment. Samples are taken and assessed and data evaluated using the same general procedure described for the small scale trials. Nontarget organisms cohabitating with mosquito larvae are also be counted and examined to ascertain unanticipated impacts of the larvicide treatments. Furthermore, the ease of storage, handling, and application of the insecticide formulation are assessed. Observations on the acceptability of these larvicides to residents of the area will also be recorded.

Example 2: Bacteria Interfering RNA Larvicides

Figure 4:
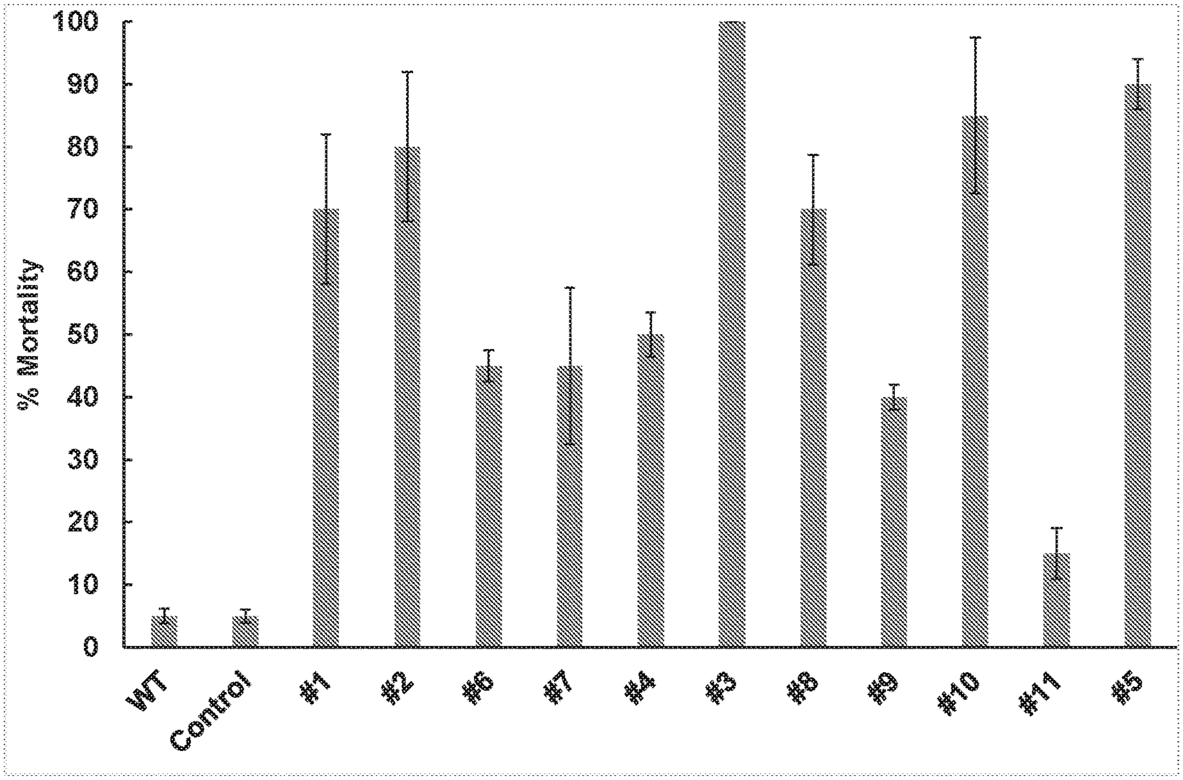
FIG. 4 is a bar graph depicting larval mortality induced by bacteria interfering RNA larvicides of the present invention.

*E. coli* expressing interfering RNA were prepared as described in Whyard et al (2015). Interfering RNA used were #1 targeting AAEL007292, #2 targeting AAEL007548, #3 targeting AAEL007298, #4 targeting AAEL007563, #5 targeting AAEL004756, #6 targeting AAEL007546, #7 targeting AAEL007554, #8 targeting AAEL007876, #9 targeting AAEL009273, #10 targeting AAEL007718, #11 targeting AAEL004874. Bacteria was heat inactivated and fed on larvae for three days post-hatching. Larvae fed with bacteria expressing dsRNA corresponding to GFP (control) survived (no significant differences were detected in comparison to wild-type (WT) larvae fed a normal laboratory diet. Larval mortality was significantly higher in bacteria #11 vs control-fed larvae ($p<0.01$). All other bacteria interfering RNA larvicides induce very highly significant ($p<0.001$) larval mortality levels. Results compiled from at least four replicate experiments is shown in FIG. 4, each with 20 larvae/condition. Error bars represent standard errors of the mean.

Example 3: Preparation of *S. cerevisiae* Expressing shRNA

Our laboratories and others have experimented with dsRNA delivery strategies that could potentially be implemented in the field. For example, we have successfully used non-toxic chitosan nanoparticles, natural carbon based materials that promote dsRNA stability and uptake, to deliver siRNA to *A. aegypti* larvae (Zhang et al., 2015). While this technique is effective, we have begun to explore microbial delivery systems for interfering RNA delivery. Such systems would be advantageous, as they would reduce costs associated with synthesis or purchase of interfering RNA. Whyard et al. (2015) used live or heat-killed orally delivered non-pathogenic *E. coli* expressing dsRNA to silence *A. aegypti* larval genes, and we have successfully employed their technique in *A. aegypti*, confirming that it is possible to use a microbial interfering RNA delivery system for larval lethal gene silencing in mosquitoes. While we have had success with this technique, it requires that the bacteria be mixed with yeast bait. Likewise, chitosan nanoparticles must also be mixed with yeast as bait. Thus, it would be advantageous to simply express the interfering RNA directly in yeast. Moreover, as discussed above, *S. cerevisiae* can be dried, packaged, and shipped, which would facilitate international shipment. These advantages indicate that yeast may be an ideal delivery system.

In bacteria, dsRNA was produced through cloning target sequences into dsRNA transcription plasmid pL4440 (Addgene), a plasmid with T7 promoters located on either side of a multiple cloning site. However, use of such vectors in the field may raise concerns regarding the potential for horizontal transfer of such plasmids, which also bear antibiotic resistance markers.

We therefore use yeast to express shRNA, an artificial RNA molecule with a hairpin turn that can be used to silence gene expression through RNAi. Whyard et al. (2015) showed that both live and heat-killed *E. coli* give comparable results, and we have confirmed this result. The release of heat-killed yeast may be deemed more environmentally-friendly, and therefore both live and heat-killed yeast are assessed.

Target site selection: Input sequences for shRNA design correspond to the siRNAs used to target the 10 genes noted in Table 1, as well as to the sequence of an siRNA control (Tomchaney et al., 2014; Mysore et al., 2015) that lacks significant sequence homology within the *A. aegypti* genome. BlastN searches will be used to confirm that all of these *A. aegypti* target sequences have minimal sequence homology to genes in humans or other non-targeted organisms, thereby reducing the potential for off-species targeting. Additionally, we will use Scott Emrich's algorithm, a derivative of the program used in Tomchaney et al. (2014), to identify additional target sequences within these ten genes that are conserved among disease vector mosquitoes, including the closely-related disease vector mosquito *A. albopictus*, but not other species, including humans. These additional siRNAs will be assessed through microinjection and soaking per the protocols described above. Target sequences that are poorly conserved outside of mosquitoes, but that result in high levels of mortality when targeted in *A. aegypti*, will be assessed in yeast. We will identify at least two such sequences for each gene. This will be useful if yeast interfering RNA larvicides were to one day be employed for vector control; if insecticide resistance were to develop due to a point mutation in one target sequence, then the second sequence can be targeted.

shRNA expression: For initial laboratory experiments, DNA cassettes corresponding to shRNA for each of the target sequences identified will be cloned into p426 GPD (ATCC® 87361™), a bacteria-yeast shuttle vector that allows for constitutive expression of inserts cloned downstream of a GPD promoter (Mumberg et al., 1995). shRNA DNA cloning cassettes will be designed using the Clonetech shRNA Sequence Designer Tool.

(Clonetech, 2015). Custom DNA oligos obtained from Invitrogen were annealed to generate shRNA DNA cloning cassettes that will be inserted into the multiple cloning site downstream of the GPD promoter. Appropriate restriction enzyme overhangs were added to the DNA cassettes to facilitate cloning. Following yeast transformation, shRNA expression will be confirmed through qRT-PCR, which will be performed as described (Hayes et al., 2011) using real-time quantification with the SYBR Green I PCR kit and a Step One Plus System (Applied Biosystems). Following sequencing to confirm the sequences of the inserts, the plasmids will be transformed into *S. cerevisiae* strain BY4742.

Preliminary data: We have successfully cloned silencing hairpins corresponding to AAEL007292 and AAEL007548 (Table 1), as well as a control hairpin in this manner. Our preliminary analysis of yeast transformed with these experimental constructs demonstrates that they are larvicidal as demonstrated in FIG. 2 and FIG. 5.

Generation of stable transformants: Following larvicide testing, DNA cassettes for expressing shRNAs with larvicidal activity are inserted into the yeast genome to generate stable transformants using the general methodology described by Wei et al. (2015). Advanced genome editing techniques such as CRISPR/Cas9 will facilitate stable and seamless genome integration of the DNA cassettes, which eliminates risks of horizontal gene transfer or introduction of any antibiotic resistance marker genes (DiCarlo et al., 2013; Hsu et al., 2014). shRNA expression will be verified as described above.

Figure 2:
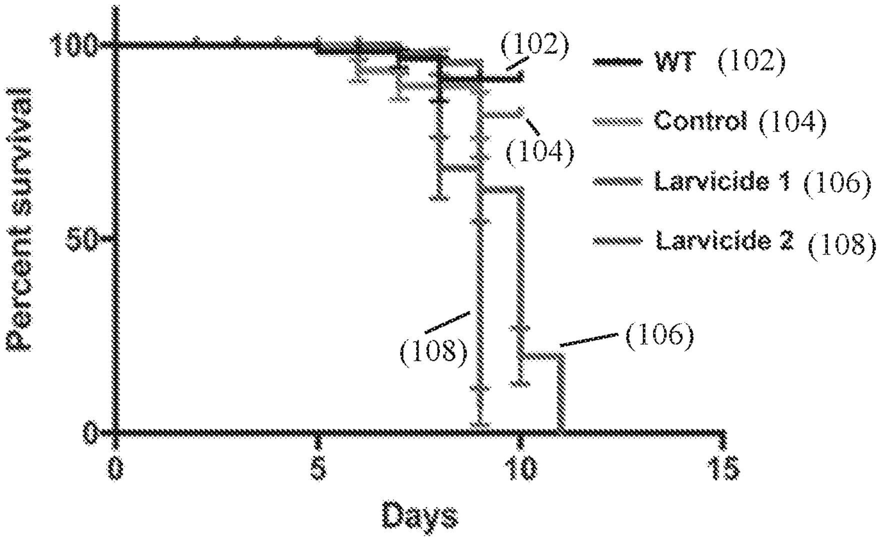
FIG. 2 depicts the results of yeast interfering RNA larvicide trial. Larvicide assays were conducted with yeast expressing shRNA corresponding to target sequences in AAEL007292, AAEL007548, or to a control sequence that lacked significant homology in the *A. aegypti* genome. A second control group was fed only wild type (WT) yeast. Assays were performed with 20 larvae. Yeast larvicides targeting AAEL007292 (Larvicide 1) and AAEL007548 (Larvicide 2) resulted in mortality within six days.
Figure 5:
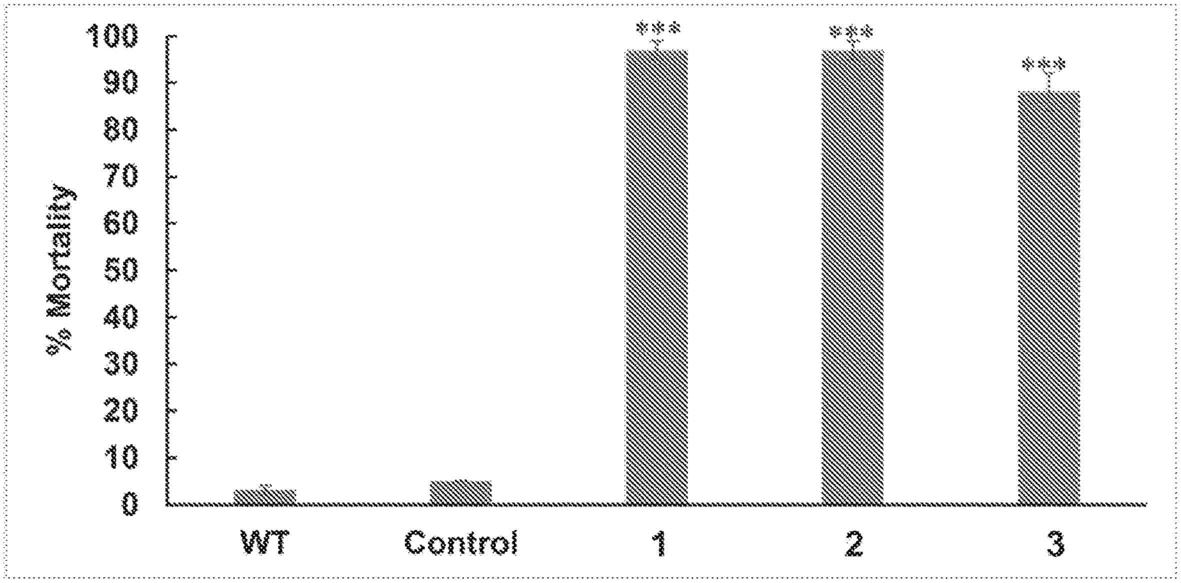
FIG. 5 is a bar graph depicting the larval mortality induced by heat-inactivated yeast containing the siRNA of the present invention.

Yeast Larvicide Studies:

i. Animal rearing: The *A. aegypti* Liverpool-IB12 (LVP-IB12) strain from which the current genome sequence (Nene et al., 2007) was generated was used and reared as described (Clemons et al., 2010b). We have also used *A. aegypti* eggs collected from oviposition traps in Trinidad and are using *A. aegypti* strains maintained at the Belize Vector and Ecology field station. A. *coluzzii* were obtained from Nora Besansky. *A. gambiae* were obtained from the MR4 Facility. For larvicide assays, larvae are reared in accordance with WHO guidelines for larvicide testing (WHO, 2005; see details below). Larvicides will also be tested on the *A. aegypti* Rockefeller strains.

ii. Small scale studies: 30 first instar larvae are transferred to 500 mL plastic cups with 100 mL water and reared at 26° C. Larvae are allowed to feed at will on yeast expressing control or experimental shRNA. In these and all of the experiments described below, both live and heat-killed yeast are assessed. Dead larvae that do not respond to probing will be removed daily. Mortality is assessed daily. Pupariation and adult emergence rates are also be assessed at week's end. Experiments are performed a minimum of three times, and ANOVA is used for data analysis. Trials conducted in this manner with yeast interfering RNA larvicides targeting AAEL007292 and AAEL007548 (see Table 1) shows that these larvicides are highly effective at inducing mortality in small scale laboratory studies. A representative trial is shown in FIG. 2. FIG. 5 also demonstrate the results, showing heat-inactivated yeast are able to kill *Aedes aegypti*. FIG. 5 demonstrates the results of laboratory larval feeding experiments with heat-inactivated yeast interfering RNA larvicides #1 (targeting AAEL007292), #2 (targeting AAEL007548), and #3 (targeting AAEL000032) are shown. Nearly all larvae fed with yeast larvicides #1 and #2 for the first three days post-hatching died as larvae, while larvae fed a normal laboratory diet (WT) or with yeast expressing shRNA with no known *Aedes* target (Control) survived. Yeast larvicide #3 also induced very significantly high levels of mortality. Results compiled from at least three replicate experiments, each with 20 larvae/condition, are shown. For larvicides #1 and #2, 100% of the larvae died in two of the three replicate experiments. Error bars represent standard errors of the mean. ***=$p<0.001$ in comparison to control-treated larvae. We have also found that three yeast interfering RNA larvicides targeting *Anopheles coluzzii* genes induced 100% larval mortality when animals were fed either live or heat-killed yeast (FIG. 6).

Microbial Interfering RNA Larvicides Targeting Anopheline Mosquitoes.

Figure 6:
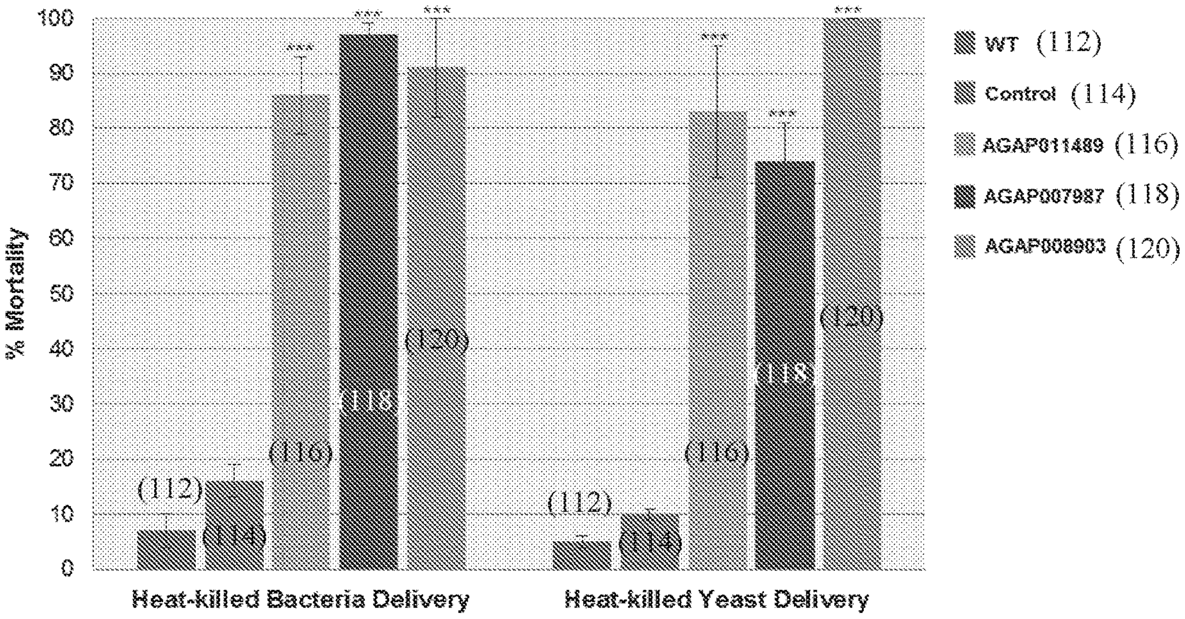
FIG. 6 is a graph showing the percent larval mortality induced by heat-inactivated bacteria or heat-inactivated yeast.

As shown in FIG. 6, *E. coli* producing dsRNA corresponding to target sequences in larval lethal genes identified in the Anopheline screen induced significant larval mortality (Left: AGAP011489, AGAP007987, or AGAP008903 dsRNA vs. control dsRNA, $p<0.001$). Also shown in FIG. 6, *S. cerevisiae* producing shRNA corresponding to the same target sequences also induced significant larval mortality (Right: AGAP011489, AGAP007987, or AGAP008903 dsRNA vs. control hairpin, $p<0.001$). Bacteria and yeast were heat-killed prior to larval feedings.

In addition to assessing mortality, silencing of the targeted genes is verified and quantified through qRTPCR. qRT-PCR is performed using real-time quantification with the SYBR Green I PCR kit and a Step One Plus System (Applied Biosystems) as described in Clemons et al. (2011). At least three biological replicates are conducted, and PCR reactions will be performed in triplicate. Quantification of results are made by standardizing reactions to levels of the housekeeping gene RPS17 (Morlais et al., 2003) and using the AACt method. Data will be evaluated with the Student's t-test.

Adult Mosquito Lethality Screen.

Target genes identified as larval lethal genes identified herein are further screened to identify target genes that are also adult lethal. Adult mosquitoes are starved for 12 hours and then fed ad libitum for 12 hours with 100 nM siRNA dissolved in 5% sucrose solution delivered to mosquitoes on cotton wicks. Food dye is added to the solution for confirmation of successful feeding. For the screen, two replicate experiments with 20 mosquitoes per treatment are assessed. Adult death is monitored for 1, 3, and 5 days following treatment, and data is analyzed with ANOVA.

siRNA SEQ ID Nos:1 and 3 were found to be adult lethal in addition to larvae lethal. 70% of animals fed ad libitum for 4 hrs with 100 nM siRNA #1 died, and 44% of animals fed with 100 nM siRNA #3 died.

The present invention is not intended to be limited to the foregoing examples, but encompasses all such modifications and variations as come within the scope of the appended claims.

All references cited are incorporated by reference in their entireties.

REFERENCES

1. Clemons, A., Haugen, M., Severson, D., and M. Duman-Scheel (2010). "Functional analysis of genes in *Aedes aegypti* embryos." Cold Spring Harb Protoc 2010(10): pdb prot5511.
2. Economou, C., Wannathong T., Szaub, J., and Purton, S. "A simple, low-cost method for chloroplast transformation of the green alga *Chlamydomonas reinhardtii*." Pal Maliga (ed.), Chloroplast Biotechnology: Methods and Protocols, Methods in Molecular Biology, 1132: 401-411.
3. Kumar, A., Wang, S., Ou, R., Samrakandi, M., Beerntsen, B. T., and Sayre, R. T. (2013). Development of an RNAi based microalgal larvicide to control mosquitoes. MW Journal. 4:6 (GCE Special Issue).
4. Kweka, E. J., Zhou, G., Munga, S., Lee, M. C., Atieli, H. E., Nyindo, M., Githeko, A. K., and Yan, G. (2012). Anopheline larval habitats seasonality and species distribution: a prerequisite for effective targeted larval habitats control programmes. PLoS One. 7(12):e52084.
5. Merritt, R. W. (1992). "Feeding behaviour, natural food, and nutritional relationships of larval mosquitoes." Ann. Rev. Entomol. 37: 349-376.
6. Mumberg, D., Muller, R., and Funk, M. (1995). "Yeast vectors for the controlled expression of heterologous proteins in different genetic backgrounds." Gene 156: 119-122.
7. Mysore, K., E. M. Flannery, M. Tomchaney, D. W. Severson and M. Duman-Scheel (2013). "Disruption of *Aedes aegypti* olfactory system development through chitosan/siRNA nanoparticle targeting of semaphorin-1a." PLoS Negl Trop Dis 7(5): e2215.
8. Mysore, K., E. Andrews, P. Li and M. Duman-Scheel (2014a). "Chitosan/siRNA nanoparticle targeting demonstrates a requirement for single-minded during larval and pupal olfactory system development of the vector mosquito *Aedes aegypti*." BMC Dev Biol 14: 9.
9. Mysore, K., E. Flannery, M. T. Leming, M. Tomchaney, L. Shi, L. Sun, J. E. O'Tousa, D. W. Severson and M. Duman-Scheel (2014b). "Role of semaphorin-la in the developing visual system of the disease vector mosquito *Aedes aegypti*." Dev Dyn 243(1 1): 1457-69. Silencing Genomes (2006). "Creating an RNAi feeding strain." silencinggenomes.org/downloads/pdfs/rnai_feeding_ strain.pdf, accessed 6/2015.
10. Singh, A. D., Wong, S., Ryan, C. P., and Whyard, S. Oral delivery of double-stranded RNA in larvae of the yellow fever mosquito, "*Aedes aegypti*: Implications for pest mosquito control." J Insect Sci 13: 69.
11. Van Ekert, E., C. A. Powell, R. G. Shatters Jr., and D. Borovsky. "Control of larval and egg development in *Aedes aegypti* with RNA interference against juvenile hormone acid methyl transferase." J Insect Physiol 70: 143-150. WHO (2005). "Guidelines for laboratory and field testing of mosquito larvicides." http://whglibdoc.who.int/hq/2005/who_cds whopes_gcdpp_2005.13.pdf, accessed September 2014.
12. Whyard, S., C. N. Erdelyan, A. L. Partridge, A. D. Singh, N. W. Beebe, and R. Capina (2015). "Silencing the buzz: a new approach to population suppression of mosquitoes by feeding larvae double-stranded RNAs." Parasit Vectors 8: 96.
13. Zhang, X., J. Zhang and K. Y. Zhu (2010). "Chitosan/double-stranded RNA nanoparticle mediated RNA interference to silence chitin synthase genes through larval feeding in the African malaria mosquito (*Anopheles gambiae*)." Insect Mol Biol 19(5): 683-693.
14. Zhang, X., K. Mysore, E. Flannery, K. Michel, D. W. Severson, K. Y. Zhu, and M. Duman-Scheel. "Chitosan/interfering RNA nanoparticle mediated gene silencing in disease vector mosquito larvae." J Vis Exp 97: doi: 10.3791/52523.
15. Anderson E A, Birmingham A, Baskerville S, Reynolds A, Maksimova E, Leake D, Federov Y, Karpilow J, Khovorova A. Experimental validation of the importance of seed complement frequency to siRNA specificity. RNA 14:853-861, 2008.
16. Altschul S F, Gish W, Miller W, Myers E W, Lipman D J. Basic local alignment search tool. J. Mol. Biol. 215: 403-410, 1990.
17. Custom DsiRNA Design Tool, IDT, Coralville, USA. Retrieved Jun. 23, 2016. idtdna.com/Scitools.
18. Doench J G, Petersen C P, Sharp P A. siRNAs can function as miRNAs. Genes & Development 17:438, 2003.
19. Ichihara M, Murakumo Y, Masuda A, Matsuura T, Asai N, Jijiwa M, Ishida M, Shinmi J, Yatsuya H, Qiao S, Takahashi M, Ohno K. Thermodynamic instability of siRNA duplex is a prerequisite for dependable prediction of siRNA activities. Nucleic Acids Res 35:e123, 2007.
20. Judge A D, Sood V, Shaw J R, Fang D, McClintock K, MacLachlan I. Sequence-dependent stimulation of the mammalian innate immune response by synthetic siRNA. Nature Biotechnology 23(4):457, 2005.
21. Kamola P J, Nakano Y, Takahashi T, Wilson P A, Ui-Tei, K. The siRNA non-seed region and its sequences are auxillary determinants of off-target effects. PLOS Computational Biology 11(12):e1004656, 2015.
22. Naito Y, Yoshimura J, Morishita S, Ui-Tei K. siDirect 2.0: updated software for designing functional siRNA with reduced seed-dependent off-target effect. BMC Bioinformatics 10:392, 2009.

23. Ui-Tei K, Naito Y, Nishi K, Juni A, and Saigo K. Thermodynamic stability and Watson-Crick base pairing in the seed duplex are major determinants of the efficiency of the siRNA based off-target effect. Nucleic Acids Research 36(22):7100, 2008.
24. Wee L M, Flores-Jasso F, Salomon W E, Zamore P D. Argonaute divides its RNA guide into domains with distinct functions and RNA-binding properties. Cell 151: 1055, 2012.
25. Bassel, J. and Mortimer, R. (1971). Genetic order of the galactose structural genes in *Saccharomyces cerevisiae*. J Bacteriol 108(1):179-83.
26. Douglas, H. C. and Condie, F. (1954). The genetic control of galactose utilization in *Saccharomyces*. J Bacteriol 68(6):662-70.
27. Sikorski, R. S., Hieter, P. (1989). A system of shuttle vectors and yeast host strains designed for efficient manipulation of DNA in *Saccharomyces cerevisiae*. Genetics 122: 19-27.
28. Van Dijken, J. P., Bauer, J., Brambilla, L., Duboc, P., Francois, J. M., Gancedo, C., Giuseppin, M. L. F., Heijnen, J. J., Hoare, M., Lange, H. C., Madden, E. A., Niederberger, P., Nielsen, J., Parrou, J. L., Petit, T., Porro, D., Reuss, M., van Riel, N., Rizzi, M., Steensma, H. Y., Verrips, C. T., Vindelov, J., and Pronk, J. T. (2000). An interlaboratory comparison of physiological and genetic properties of four *Saccharomyces cerevisiae* strains. Enzyme Microb. Technol. 26:706-714. DOI: 10.1016/S0141-0229(00)00162-9.

SEQUENCE LISTING (275 sequences)

SEQ ID NO: 1 - DNA, 25 bp, Aedes aegypti
ctagcatcatcttccgaccgaacca

SEQ ID NO: 2 - DNA, 25 bp, Aedes aegypti
gcacaagtggcattgataatcctat

SEQ ID NO: 3 - DNA, 25 bp, Aedes aegypti
gtatcagtcagtatcagaaccagaa

SEQ ID NO: 4 - DNA, 25 bp, Aedes aegypti
cgctggttctgctgagaatcaaccg

SEQ ID NO: 5 - DNA, 25 bp, Aedes aegypti
gggagaacagcgacagcaaggagaa

SEQ ID NO: 6 - DNA, 25 bp, Aedes aegypti
gaacgacaatgctgtatatttgcga

SEQ ID NO: 7 - DNA, 25 bp, Aedes aegypti
ccacaagctgcgtcacttctacgac

SEQ ID NO: 8 - DNA, 25 bp, Aedes aegypti
cgaggagctgaatgagattaaaccg

SEQ ID NO: 9 - DNA, 25 bp, Aedes aegypti
cgatgagtctgaagagatacgaatc

SEQ ID NO: 10 - DNA, 25 bp, Aedes aegypti
cctccaggctggatcgtttgagttt

SEQ ID NO: 11 - DNA, 25 bp, Aedes aegypti
cgatgatgtcggatgggatgtccag

SEQ ID NO: 12 - DNA, 25 bp, Aedes aegypti
gaagaagtaccgtgtggaagtggga

SEQ ID NO: 13 - DNA, 25 bp, Aedes aegypti
cactgacaatgatccgataaagaca

SEQ ID NO: 14 - DNA, 25 bp, Aedes aegypti
gtacctagtcgatggtcaatcagag

SEQ ID NO: 15 - DNA, 25 bp, Aedes aegypti
cattgttattactcacgatgtcaag

SEQ ID NO: 16 - DNA, 25 bp, Aedes aegypti
ggagaagtgatgaccgtcatgagaa

SEQ ID NO: 17 - DNA, 25 bp, Aedes aegypti
ggacgtcattgaaacggatttgcta

SEQ ID NO: 18 - DNA, 25 bp, Aedes aegypti
ggaactgctaaccgatcaagagaac

SEQ ID NO: 19 - DNA, 25 bp, Aedes aegypti
cgttattaccattacggtaaatggc

SEQ ID NO: 20 - DNA, 25 bp, Aedes aegypti
gggaggtgataagaaacgatgctct

SEQ ID NO: 21 - DNA, 25 bp, Aedes aegypti
gcaagacagatttcgataaagatca

SEQ ID NO: 22 - DNA, 25 bp, Anopheles gambiae
ccaactgcatcgactgtctggaccg

SEQ ID NO: 23 - DNA, 25 bp, Anopheles gambiae
attggttcatcgagcgtgaacgcaa

SEQ ID NO: 24 - DNA, 25 bp, Anopheles gambiae
ccagcaccagccaacgaggaacact

SEQ ID NO: 25 - DNA, 25 bp, Anopheles gambiae
agctgaacgacaacctgctgctcgg

SEQ ID NO: 26 - DNA, 25 bp, Anopheles gambiae
gctcggtacggtacagtttcactgc

SEQ ID NO: 27 - DNA, 25 bp, Anopheles gambiae
gctccattcggatcaatcacacatc

SEQ ID NO: 28 - DNA, 25 bp, Anopheles gambiae
gcagaacggacaagagacagaagat

SEQ ID NO: 29 - DNA, 25 bp, Anopheles gambiae
atgaacagtatttcgctgaaggaga

SEQ ID NO: 30 - DNA, 25 bp, Anopheles gambiae
gcaagagaaaggatcgaaatcgatg

SEQ ID NO: 31 - DNA, 25 bp, Anopheles gambiae
gtgctggatagaattgcatttaaat

SEQ ID NO: 32 - DNA, 25 bp, Anopheles gambiae
gtaccaattgcattcgatagaagca

SEQ ID NO: 33 - DNA, 25 bp, Anopheles gambiae
cgttcaatttcttgtggcaaatgtg

SEQ ID NO: 34 - DNA, 25 bp, Anopheles gambiae
cgacgagttcgaacaggaagactgc

SEQ ID NO: 35 - DNA, 25 bp, Anopheles gambiae
cctacaaatacctatggataggaat

SEQ ID NO: 36 - DNA, 24 bp, Anopheles gambiae
acagcagctacttcgtcgagtgga

SEQ ID NO: 37 - DNA, 25 bp, Anopheles gambiae
ggaatgactagaatgggaattactg

SEQ ID NO: 38 - DNA, 25 bp, Anopheles gambiae
gcaagagaaaggatcgaaatcgatg

SEQ ID NO: 39 - DNA, 25 bp, Anopheles gambiae
gcgagacgatcaatttggtcactac

SEQ ID NO: 40 - DNA, 25 bp, Anopheles gambiae
gtaggattatgaactcgcaagatca

SEQ ID NO: 41 - DNA, 25 bp, Anopheles gambiae
gaacgagaatcgttgcaaataaata

SEQ ID NO: 42 - DNA, 25 bp, Anopheles gambiae
cctccatctcgatgctgtatctgaa

SEQ ID NO: 43 - DNA, 25 bp, Anopheles gambiae
ggtcgactctgtcagtgtaccaaag

SEQ ID NO: 44 - DNA, 25 bp, Anopheles gambiae
ccaccactgccaacaacaacaacaa

SEQ ID NO: 45 - DNA, 25 bp, Anopheles gambiae
gaaccagaaggatgacgacttgaac

SEQ ID NO: 46 - DNA, 25 bp, Anopheles gambiae
gcaagagaaaggatcgaaatcgatg

SEQ ID NO: 47 - DNA, 25 bp, Anopheles gambiae
gcaagagaaaggatcgaaatcgatg

SEQ ID NO: 48 - DNA, 25 bp, Anopheles gambiae
ccaactgcatcgactgtctggaccg

SEQ ID NO: 49 - DNA, 25 bp, Anopheles gambiae
atagtaccgtggacagcaaggagcg

SEQ ID NO: 50 - DNA, 25 bp, Anopheles gambiae
cggtacagtttcactgcgtggcgac

SEQ ID NO: 51 - DNA, 25 bp, Anopheles gambiae
ggtggactattacgggcaactttgg

SEQ ID NO: 52 - DNA, 25 bp, Anopheles gambiae
gtggtggactattacgggcaacttt

SEQ ID NO: 53 - DNA, 25 bp, Anopheles gambiae
catcgagcgtgaacgcaaacttgca

SEQ ID NO: 54 - DNA, 25 bp, Anopheles gambiae
gaagaaggatgttacgaatgtgcta

SEQ ID NO: 55 - DNA, 25 bp, Anopheles gambiae
ggaagatgtttaatatcgtcgacaa

SEQ ID NO: 56 - DNA, 25 bp, Anopheles gambiae
gggagtggttgcatgcgaatcacaa

SEQ ID NO: 57 - DNA, 25 bp, Anopheles gambiae
cgatgagcaagtaaacgaactgatc

SEQ ID NO: 58 - DNA, 11766 bp, Aedes aegypti
accccaagagcttgcaagtcctcctcgagcatagtccacgtctcatgcccatagagcactaccggtcttatgaccgttggatgcggggatgaatctttcttgaccgcagttttttctggagcccatagtaggcacgacttccactgatgatgcgccttcgtatttcccgactaacattgttgtcagtcgtcaacaaggatccgaggtagacgaactcatccaccacccgtctatcgtaacactgcttcctaggcgggccctgtcgcgattagttccgccaaccagcatgtactttgttttcgacgcattcaccattagcccgatttttgttgcttcgcgttttaggcgggcgaacaaatctgccaccgtttcaaattttctccgaataatatccatgtcgtccgcaaagcaaacaaatcaaaagcttcatacactgcgcaaaatagtgaatattctaatcgaaaggtttccagcttgagttgtcgtcaatctatcaaaagtttattcatgattctaggctaactccacaattatgtgtctagtatgattccgcaatataatacattttctaaaattttgttgttctcattataattgtaggatgtggtggaccattacgggcaatttcggaaacattttaccaatcgattggtcaaaaacgtacgcgagacaaatgcatgtaccggcactgaaactagcatcatcttccgaccgaaccaactacaatgacattcaagatcttagctccgaagatgaggccgttgctaacgatttggatatgcacgcattgattctgggcggccttcacactgacaatgatccgataaagacagcggaagaggtcatcaaggaaattgacgatattatggacgaaagcgcctccgaagacggcattgttggtaacgaaatcatggaaaaagccaaagaagttcttggatctcccctctacgaagaaagtaagtacaccattgctggagcatcatacacattgataaattgtctgatctttccacagagttacgctctctaagtattactcaattgaacgaactctacatggagatggaagtattaatcagagaattctcggagactctcatatcggagttagcgctacgtgacgaactggaatacgaaaaagagctgaagaacacattcatttccttgttgttagcagtacaaaatcgtcgtcgtcagttccatgtcgaaaggaagaagggaaagtcgcaaaataagccagtggcggttacaagcagtgagtatcgagcatgtattaaaacgagtcgatctgggtattgttagactcgtttaagtaaccatgctgttcaagcccaatgtgaaaacgggcttcggcaaagttgtaactgatgaatgtatctgacagtatcagcatagttctaacagattgaatgaattgcttgttttatagtaatttctatgctaactttgaagggcttgtgcagtctcagttttcatgcaaatgggctcacattttgggaggacacctagaatttgatctagaatcaaatgagcggtgtggagcaaaaacgtttttttaaccaccctacactagccaaagacacggttatatggaaaattttgattttcgctccagtccactttttggattgaatttaggtcataacaactgtgcaaaatttcagctcgatcggggaaataatattttagagctagccgttcaaagtttactatgtgaaatctctgtaactcaggtaagtcagatgtaagaatattggggatgattcatatatcacgtaattgcatattgaaaatttagtgggctttgtggccgtgcggttagtgttaccaagcatttagccgcatcgagtcaaggagtgtgggttcgattcccactgcagttcggaaaacttttcgtcgggaacgtatctcgactatgtatttccggtggccattcctgggtaattttggtgggccagaagaaccaaagtggtcattcatctaaaattgaactagcagagtcacaggtacccaaaatcatgaagattgaggcgtcgcatgcctagtgttggtacaaaaactgaaatgtcccacaatacggccatctccggtggtcattcctgggttatttcggtgggccagaagaaccaaagtggtcgttcacctaaaattgaactagaagtgtcacaggtattcaaaatcatgaagattgagccgtcgcatgcctatttttggtacaaaaactgaaatgtcccacaatacgagtatttccggtggccattcctgggttatttcggtgggccagaagaaccaaagtggtcatttatcaataattgaacaaccaaagtcacaggtattcaaaaccataaagattgagccgtcgcatgcctagttttggtacaaaaactgaaatgtcccactatttgagtatctccggtggtcttcttcttcttctttctggcattacgtccccactgggatagagcctgcttctcagctaagtgttcttatgagcacttccacagttattaactgagagcttactgtgccaatgacctaacaatgagccagagtggtaattcatctaaaattgaactaaaagagtcacaggtatccagaatcatgaaaaatgagccgtcgcatgcctagttttggtacaaaaactgaaatgagttgtcgcttgcctaattttggtacaaaaactgaaatgtcccacaatacgggtatttccggtggccattcctgggttatttcggtgggccagaagaaccaaagtggtcatttataaataattgaactaccaaagtcacaggtattcaaaatcatgaagatggggccgtcgcatgcctagttttggtacaaaaactgaaatgtcccacaatacgggtatctccggtggttattcctgggttatttcgtggtaacaatgagccagagtggtcattcattaataattgtactagcagagtcacaggtattcaaaatcatgaagactgagccgtcgcatgcctagttttggtacaaaaactgaaatgttccacaatacgggtatctccggtggccattcctgggttatatcgtggtaacaatgagccagattggtcattcgtcactaattggactagaagaatcacaggtattcaaaatcatgaagaatgagccgtcgcatgcctaattttggtacaaaaactgaaatgtcttcacaatacgggtattttcggtggccattcctgggttatttcggtaggccaggagaaccaaaagagtcacaggtacccagaatcatgaagaatgagccgtcgcatgcctagttttggtacaaaaactgaaatgtcccacaatacggatatctccggtggtcactcctgggttatttcatggtaacaatgagccagagtggtcattcattaataattgtactagcagagtcacaggtattcaaaatcatgaagactgagccgtcgcatgcctagttttggtacaaaaactgaaatgtcccacaatacgggcatctccggtggccattcctgggttatttcggtgggacagaagaaccaaagtggtcattcatcaataattgaactagcaaagtcacaggtatttaaaatcatgaaaattgagccgtcgcatgtctaattttggcacaaaaactgaaatgtcccacaatacgggcatctccggtggccattcctgggttatttcggtgagacagaagaaccaacgtggtcattcatcaataattgaactagcaaagtcacaggtatttaaaatcatgaaaattgagccgtcgcatgtctagttttggcacaaaaacgggtatttccggtggccattcctgggttattttggtgggccagaagaaccaaagtggtcattcatcaataattgaactagcagagtcacagggaagcaaaatcatgaagattgaaccgtcgcatgcctacttttggtgctaaaattgtgtggtcccatattacgggtttcccggtggccattccggtgctccaaaaggaccagaataaccatccattcattattttggcaaaatacatccaaacataaaaaatcataaagaattggacacaattcatttggttttggggttcaaatctgagtaatttcatcgaattgtccagattgaccacctcccgggactccaggaaccagttccgcagggaccatactggatcgaatttttcagggaatgtgcgccggtaattggccccttattacagaaaaaaattatgccaaaatatccatcaaccgaatagtgccgatgtgaattacatatacagaactgcgatggaagcttacttttcggatgtgccgggtttctggaaccgggtatgaataactaagtgatttgagaatctctattcacagtccacgtgaatacctgttcaacaatatgaggacggttcagattacttgtttagttacgaaactacaggtcgtcaaagtaagggtctctaaagggacttttttcgtatgtagcaggttcccggtgaccacagtgaccaaatccagatctccgggagggtttctgaaactagacatgtgtgcctttcatttaagcccaacagaactaaattcggtcaacacactgatttttgcgagctgtttgaattttcgggtcgaaaacgaccctaagtcacaatttgtaacttttttttatggatgctcccctaggggtcattcaaaacgtttgtttccgcaggttatttcaatcaaaagttacattgatttgaattttgaaacgggtcgaaaaagacccaaggttaaatcgatggaaggggcgtagacatgaaagttaatgttactccatgttaatttacaccatgtgtcatagctaatgagctttaggcttaggtttaagcgccactccacgctttctgaaacgagaagataaatttccaaaaccccatgatgagcagagtccaaagaattagcaggaacaaacttaccaaatccgttcgcttgccttagcgtcgagtaaaaagtcattaccgtaaaacggggtaactttgatagtttttttcgaagaagacttcaatataactgcatgctgtttcaaagaattataaattatatttttaatacaagtactggcatcctacctatcgattgcagttgatagattgccaaaaaaaatattttgaattggtatataatttttcatataatcgaaagttggttttctgttttgggataactttgataatgaagtctgaatcgaacaaaatttaatgaattacgaacatttgtagggcattgcatacctctaggcgtttaacgttatatggaaatttctgactaagattacaaaaatggtcccagtttgtgaaaatgcttttcgctaagagatttgagaccgttttcaaaatctatgataactaggctatcaaagataagtgaccaactattcaaaactacatcaaatagtgatcgtagaacagattgtttgtaagcgtttcgaaaatgataaaattgtgtaaatttttgatattcgtataaaaagcctcaaatggtctcgattcaaatgaaaacagctcttacatgaagtgtcataataatattcttcggttttgcattcgttttgcttaaccgattagcagaaattatgatatttcgtttagtatgtggtaggttacgcactatcaaagttacccgcattatcaaagataccccgttttacggtagggtagatgcaccaatagtggaggtactaagcacgattgaacttcatataatcgccttaattcaagtagcgcacttaatgcacatgttaatgttgtaacgggaagtaacgaccattgacttaatgaaaaaaatgatttcatcgtagtaatccacggcatgtcagtgaaaaataatacctccactattggtacactgttcctttagttatttttaatttgtgttcctatagttgcggtatccgtggttttcttatgggatcctccactataggaacactttaccgcaactattggtgcaagcaagaaaagttttagcaattttagtgatatttcatcagttttaaagcaatttgaatgttctttttaagtattccgtgtatcaacaagccaatacgtcgattggcagtgtcggttctgtggctaatgtaataaaatcagtgaaaacgacattaccgcaactataggaacacccacaactaagggaacacttaccctaccacaaaaaaaaaaacattttgttgggaaatttattccacatcctttgaacacgacatgggtgcattttcgccatagacgctgcaattctagcataacaaagtcagatagggtggtgaacttgaatggatcataagcaatcaaaagaaggagactcgacggtcaaacaaaaatggtgcatctcagctgatcagtcgttcaccaccctaaaatgcatgaagttatgactttaatatcctgcaaataaagaataaaataatatgttaatcagtccacagtccgggaagcctcctcttctgcgcttacggcagccagtatttatagctcagaaatcacgtaggtacgatcaagtaaaaggtaccagagtcataaggagataggtagacatgacagtcctttcccctttagaatgccaccttcacggtataacaactcatacaacgaagaatcggaaatatacctaaaaaatttcacaattgtatgttcatagtacttatttcatgacaaacaaacattggattcatattgctcaacattacatatgacaacttcgtcaacactaaagaacaatttcgttcatctcgatataatatctcgcttcacaaaagaacaactatgttcacaatgtacgacaatttcgtcagctctaaaaaacaatttagttcaactcaaatttgcgatttcactatactcaaataaataaaattggcaaactcgccacctcaaagaaaaacgataatcgccaacacacgtttccatgatcctcgtcgccacttttatatcctgcaaataaagaataaaatagtatgttaatcagtccacagtccgggaagtctcctcttctgcgcttacgacagccagaatttatagctcagaaatcacataggtacgatttgtttgatcattgtccctttggaattgtaacgtgagaaatttgatgagtcttcaattcaatttttgatttattttgctatatttttattatagagacttttagctctgagctggttcgtctcttcttaatccaacttggtttcaagagaacattacatattaccgagttgcaaatttttgtgaagtaggtatttttaaactgaaacttattttattcctttcaattgtgaaaatactgagaaatactatcaatgtaatcctgtcaattaaggatagcaagtcagctatagttactcaacgcacatccatgcaaatcaggtgtgatcttgaatattaaaaactagcaactagggttgtcatgtgtattactgcttactgggagtcgtgggttcgaagcccaatcagaatatgtttgacgatttattagcggaattgggagtgtttccatgtaaagtattttattttgtttaagtgcttcttattgcagacaattcgaccgaaaaaaaattccccagtcaaagtggatcctggaagtgttaaagttctttactttaatgtgaaccgtacataaatgtggcttactgttgtgtttcagacaatttgtaggcgaaaacccccaagtggtttatcctacttttcgtgcatgaattgttgaattttgtcaagatcccttatggaagttccttgtcatattattggaaaagtactaggtagattcctgactcaattcatagtggactcctccaaaatattacagcaggatttttgcattgataatttctccattaagatttgcactgtactactgacattatatgtaggagcgcctacacagtacatcagctaacacttcaatagtcacattgtgttaattattcaacacagttcagaatacatcgcttttcgttcacagcaacttagtgcttctggcgatggtcaaccacgtggcgatcggaagggttaatcattggagagattcggtctttccataaacattgattttaagaacatccatctttaggggtccttgagacgtttgtaatgcttcaaagggggtcgcggctctgaaaaggttgagaaccactggtctagttatattacatcgagggtacattataacgagatttgactgaatatatatcttacttatcgctgtctgccaatttggaaaatattgatcataaactagtattaacgtatcgaagggttccggatgatttgcaatatgatcgcacttgaagaacatcaaaacatattaggtttttaaaccgtttggaagtaaattgattgggttgaaataattgaactcgaagaacatagtccctgtgccaaatattgatgttgtttttagctatcagtagtgtatctgtcagaaatcagaataagtatttatatgaacgggagaacgggtggttgcgcgacacccgatagccagaatctatctcttgctgaatttaactttttaaggactgtcgattttgtcctcttgtggtctattgtccttaaaaaaaataaaatatttatgaactgttgtcttttggtagacccccccccccctcctcctgccaaaatgtcatcacatgatttatggatggccccttatgcatcttccatattttgagaagtgtagttttgaaaaacacacctaggtcatcattgtttcttcttcttttgccagaacaaatcgtatttcctcatctcctacattgttagtaatacccttatgtttgcccttcctgtccacacaactggagaaattatgtggcctttcactttttccgtgataaaggtgggaatagcgtcaaatggtcggaaattgacaccaaaaatatgtagatttttataaatttgtactcacgagttttcaccctgattacgcctctggtataataaatatacatttttaatatagatacagggtccgttcgattttggcacggttcagttttggcacggttcggttttggcaacataccgttcgattttggcacggttcgattttggcaacataccgttcgattttggcaacaccgtttttttttctttcaaatcaaaagtatgtattattttgttttaaatgacttaggggctgtccgttaacaacgcagaccatttatttttggaaatctcaaacctcccccctagtacacttttgtccatacaaaaaaaaaacattgtatgggccgtagacatcggccaaccccctccccaaagtgtctacgtagtttatgaacagccccttatgttttagtatttaaagcgctgtctataaaccatgtggtctcattgttaaaaatctcaaccctctcccccttccttatggtcttctgcctgtaatgtagttttttttaatttgtatgaattattgtctttggtctgaacccagaacatccttccgcgccccctcaaaataaaccacgtggtttatgatgggttcaccattaacgtcgtagtcatattattttccatggatgcggaggaggagggggggtttgggtctttggtcgatgtcgacggtgcatacaaataaaaaaatgtattaaaaaatgttttgaaaacttctacccttcccctcccccctttttggtcaagttgtttatgggcatcccccaattggtcaaaaatttaatcgtttgcaacataggagtataaattaaaaaaaaaaatgtgaacaaaaaaaaccgttcgattttgacacggttcgattttggcaacacgaaattcacaagcttgttgccaaaatcgaacggaccctgtaattataaattctgtctttaactactattatcagcattaaaattgtagttttagttgaataagaaaattttacaattatattcgatatgcaaaaatttgcatctttaagagcccctcctggctacaccacaggcccgtcacccgaaaggttttggttttttccatattttgacatatagaatccaacaaaaatagtccggttgaaaaccccgggggcgtgatcgtgaccctcccttgtaaatatggccaaactacaattttggtctagcacctcctgtcccccagtttcggacagcttcatttgttacatgatatctttgtaatttttgcaccaatgtcttcaaatatatacattttttatggattttattgaacatggtatcaaagatacaataaaaataagaagattgaaaattcataacaacacgtaaaatgtgttatttttcatcatatatgaaagaggttttttaatgaaccacttgcacactaagtaaaactctaattactctcgtgaatgttgcaaactcattaaattacagaatcgatgcatttccaggtcgtgtccggtatttgttgccaccttttaacattgatcaatttggtactaaaatacatcatcaaaatgcaatgtcaaaattcatatttattttttcaaatttattttcgtgcgctacaaaaacgataatatttatcataaataggcattaataccgtataaaagaaatagattttgaattacgaattctgcggcttaggtgtccggtactggggatctcccactatgcacgagctaattttaggggtcttttgtagtagataacaataatgtttattgtcttatgatttatgtttttatactttcacttccagatggaacagaaccaaagtatcttaccacggttattccgtataacctggacactgcaccagacaaccaaactctacaaatactcataaaaagtaagtataagacaaataattttttgtccatccaagtttaatgcattctctattgtttcagttttgaaagccataaatgaagatagtccgaccgtcccgactcttcttaccgactatattttgaaggttttatgtcctacataagcaggaactattcctctagcttgaaaatactcttactcgcgcgtattaacattaagctgctatttagaacgcacgtttaaaaagcttcgttctcaatgtcatgtggactcattgaaatattacgacagaaatgtaataagaataatatgcacctaaaataattattttaaatttcgtaacggtggttcaaagcttagtggaaatgaataaaataaaaacattaaccttataagctaataaattggaatttcatatgaacggacgcgacactaagatcaatggtaaccaaattgaactaatgtgtgtggcatcggtttgtctgtgtataaattttactgaaaactggatgacattttcgttaaggtctatattttgatagtcaacatttccccactgagcgagtctgtgctagatcaaccatacgagtcatcatagcgatcccaagcgtcccatcataccgtaagtacttgagggggtgtaaattataagttgccttacttccttctgcaaggacattcttttattaaggttccacgaggcaaaataggttccagaggcatcgtgcaaaagtttgggttcacctgaacttacttaaagcacgaaaaatctgtgaaatctaaagcccattattatttgcgtttgaaaaagctatgaattattgaaatcggttgaaaaatggcagagatattgacaaaaatgatttgaatgacatgagccgcacatgtgaacccaaacttttgcacgatttgcatcatactgaggggtgaacccaaacttttgcacgatgacttgaatgactgtttcatcgattttgaatagtcttcagatttttccgcaa

SEQ ID NO: 59 - DNA, 10686 bp, Aedes aegypti
  misc_feature (7911)..(8091): n is a, c, g, or t
gaaaacaaatcaactgcgaaagagttccccgagcacgggatggcctatcaacagtacgcccagtattgtaacgcttactatcagcagttgcagttcaatcccaacggggggtcaatttcgacaaatgttccgccgccaccaatttccggtggaggaaatgctggaggatctggttctcccggaggtggtggagcccctcccggtttcaccaacgcttcgatgtcagccattggcaattccggagaaaatcagccagggggtggttccgatgtatcgtcctcgccttcgtcaggtagttttatgaacacgtcgtcattttttagccctcagcatcagcagcagcaacaacaacagcagcaggatggaaatatgcaaggattcaaacaagcgccaagccaatttggtcctattcgattcaatattaacaaacagccacagagggttagtcccttggtacagaacaatgccttgtcgaatggttctcctcaattgccacctccgcctcaacaacaacaacatcagcagcagcagcatcaacagcaattcaatcagaacaatcaaccgataggtaagaaaaagaagaagaagaataagaataacatgaacaacatggccaaccagcagcagaacaacaagcagatgttcaacaatgggggaattccgccattgatgccaccgggtcctccggcaggtgctaacttctcctcgccagtgcaagtgccagacttgagcaaacctccgccaccgttccccggccagtccggaattggaggaaccatcagcactactgtcccgccgccaccggtaccgaaaaaaccggatcccttcaacaatcctaccgacgcctggccggaaagcttgaacaactttgtcgcgcgctgttacgccaaatgcaagacagatttcgataaagatcagatcgatatttgccttaaggggcgcatcacagctgccgcgaacaaaggtgagctgtggaccaaggattgggacaacgaaccagtgccgagtgttcacagcgagcgtgccctgctaacgccaaacaacaagcccaaaccgccgggaattgtcggaagtatcagtcagtatcagaaccagaacctccgaagcagcagtcctcccaacggcttcggtcgaaacagtcaaaatttcactcgcaaaagcggtaattccgtggggactccgcattcgcttggatctcgcctaggcaataagtccggttcgaaaaagtctcgcacatctcgttcgcggtcccgatccccctccagtcgctacggcagcagtagaagccgccgcagtcactcttccagttcggattctcgttcccctcgtcggaagcgccgctcgtccgacagtagcgaggacagtcgcaactcgtccggaaagtccttcaagctcaaaagccaaaaagccaatcagaagaacaagtcccaccccaacgccaaaggtcagaaccagaaacggtccggattctactcggagcatggtcagatcggaggcgccgtagatggtgatcaggaagcgctgaagaaacgggccgcccggttcaacaactccaacgccaagaaggtctcgcctcccagcttcgcggtcaagaaacgcctacagatgccgacgccgtcccgcttgttcatcgatgatgccgccggagatgcggatggtggcctggatctgttcgatctgcacatcgtgggaacgtgtcgggatctggagaagagcttcctgcggctcacgaaagcccccgccccttcggaagtgcgaccggtcgaagttttacgctactcgttgcagaacgtcaagaataagtgggtcgagaagcaggattactactatgcgtgtgatcagctgaagtcgattcgacaggatttgacggtaagtccctactatttttctttgcaagcttacccatcgtgactagccccgtaccaacggaattggtaattgtaaaactaaatatgggaatttacgtattcttctgcagtctaagccgatgacgcgcttcttttgtaattttctcggacatcagcagacaaattgtttgtctgtttacatttatgcgctgctcaatcccctatcgattcataccggcagacctgttaaaatcttttggcaaacgtttttactacgcttcgaacatctcatgtctgtgtgacttttgtcgacagctttcctataagaactgcgggcaaatctctttcaattcagtcgcattttgaggcgaattcatttgaattgatcacatctgggaagctgacacaaaaaagaatcatctgaatgtttttattggggtgtttttttaaaaacaaaatactgtgtatttggctgttgaagtttgattgccgacaatagtcgaatggtgccgaaggtcgtaaattaccctatgacatgtaaaaagttgcttaagtctatttcgaattacacagcgtaacaaaaatgacatttttgcgtgtctcaaggatcaaattatgtgtctctagtagatttggggttgctgaatctggtgccattctcagaaatgttccagcacgtcacaatttttagctacaggtcgccaaagttgtatgaaacactggttttattcatgtttacatgaaatttcaagtacaatttatcaattttttttgtaatctaatccaccaaacatgcaaaatagaacttgaactttcatttcagacataatttcatgccaaacttttcaatccgacgtatctgcaaaaataaacaaatcgagatttgctttgcatgagcttgacaaacgcataatctacctattgtgtctataaaagtattcctacatccattttttgatttttagaaataaattaaaattatgccctatgtgcactttactcagtgtttttaatttggctacatacacccttcgtttgcaaagcgactcaactgtcaacatttttcatgctagcacatacaccgtacatatgctcatagtaaagcgacctatatgtagaatcaaaacataaaatttcgaacaccagatacgtcatactgcttccaaatcactaaacatgttggaaatcgagagaattggatttccacagttgagcgagctgacgggtcggcaaactgatgtggaacatcatcagtattcggtttaagacaatatttctcaccaaatttcgcacaagaactgttctcctcctgcttttgttatttacggctccgtccggtgctcctcttagtcgagttgaaaatggaaacattcggaaactaatattcgttgtcgttgaaagttgaaactgtcgaattgactaagtttaataagttttatgggaatttgcaaaccggtgtatgtgcaacttcaaaacaatactggtgtatatgacgtgacgtatgtgcaaaacgaactgtcaaaccgacgcatcaagcaaggtgtatgtatcaatcaaggtatggtatcgacgaatcatccatggtgtatgtgagcagcacaaagcaaagggtttattctctaattttacctgtttttcaattaaattcaaaacaaatcggatttgtttaatagtggttagaaacagtgttctttttttcaacttatagtagacatcgcaatagaaaaaatgcaaaacattttaaacaggatttaaaatgctttacaatattttgcatcgcatttttctcgaaaccatccgagtgttagatacgccgatttgaaaaatcatgcttgatttgattgaaattgcgcgatttaattttgattaaaccgattttttcaacatgcttgcagtccccatacaaaattcttcgtttcttctatatggcaaaatacaacaattctctaaaccattaaacaataacttttccgcatcgatagtattacaaactttgatgctaagtattgttgtatacataaagcttgagttctgtggcaaattaagccaatatattaccttacaagctggcaaacttgcatgcaagttggctgaaatagtatttttttgcattttcaacagtcaatatctcaaaaactagacgtgctatgatatttctgaaaacggcaatgaattcagcaacccttaattaagtgaatagcggtattttggagctggagacaaaagcgtgttccgcagtgttatcgataatggtctaggaactgttcaatccagtagttttctttacttcactttgcataaaatatcttactgaagctctttcattacacatttcaagcataattcttcattccgacgtatctgcaaaaatgaacaaatcgagatttgctttgcatgggcttgacgaacgcataatctacatattgagtccaaaaaagtaatcccaaaacatttttttttgattttttgaaataaatttcaattctgccctatgtgcactttactcagtgtttttaatttggctacatacaccctaccattgcaaagcgactcaactgtcaacatttttcatgctagcacatacatcgtacatatgctcatagcaaagcgacctatatgcagaatcaaaacataaaatattaatcagcagatacgtcatactgttttcaaattactaaacattttggaaatcgagagattaggattttcacagctgcagtaagctgacgggtcggcaaactgatgtggaacatcatcagtattcggttttagacaatatttctcaccaaatttctcacaagaactgttctccatttacttttgttactcacggctccgtccggtgctcctgttagacgagttaaaattggaaacattcaatattcgttgtagttgaacgtagaaactgacgaatagaacaaactttattatgttttatgggaatttgcaaaccggtgtatgtgcaacttcaaaacaataagccattttatgagacgtttcgaatcatatggtttccgtttgtttaccagctttgaaagtttctggcgggccgatttatttacgtttcttctagcgtgacatttggaaggagcatattcaataatggcgctggtggaaatgcaacacagtttttaatgttcacatgtaaaatttaaatcagtaggcagggaagatatttttcatctacgttacctgtaatacatgtaaaccgggcagaaacatgcgctgaaagagacggggaagtcatcggcaacaaaaatgtgaccagcgccattcagatatcatgctagttttttgaacaacaacaatgagcggcccgccagaaaacgtcattcgaacgtctcgtaaaatggcttatactggtgtatatgacgtgacgcatgtgataaatgaactcaagactaacaattgaaaaggcctcaagtccaaaatgtaaacaaatcggttttctgctgatttcactgtataaaagcctgttcttactaaaacatacaatagtcatttgaaaatatgcataaaagttgaaaaaataacatttttctaaaaggccccatctcattttccgctaaccaggatattcatcgaaaatgcggccttttctcaaaaaggcctcatttctatatctgacggaaaccgagttgaggcctgttaaacaaacatcaaaattgcaatgtagattgcgaaaaacgttccaaattcactaagtagatgcaggttttactacggagcgactgttccttgtattattttatacagtggttgtctaaacggcgaacattatcgggttcctgtaggtagactgatgtattttgtatcatactacctaataatacctgtgtcagcctgtctgtacttcacaaattatcaacaaaaacacgatttggttacaattgcatgaaaaataacattcaattgcattattatttcaattgaatcaatatttccatacattttctcgacgacaaactcgcgtagcacatacataatgttcatggatgacgaagggttcaatcaatcacatatttaatcgaccgcacgaatcttctcttgctgtagggatctccatgttctttactttaccacttaacactcttctacacttcaaatttattatttcatcatcaattttgaatgattttcaaaaggccacatcagaagatgatgaaagaacaagccacaaccagaaggcctcaacacattttagagtaaacaaaggcgtcaactcacaggcctcatcagcgtcggccggcgtctatgggcacaaatgaaaagggctgcacagcttttggtgaaataaaagcctcatttcctttgactcgtttttttagcaagattttttgctataatgatagtaatgaatattcatggctataaatcagtttatccatcgactttctggacgataaaataacatacaatgcttaaattcataatttaaatttgatttattgtttgacaaaacaagattgcatttttctcattgtttactttttggagatgaggccttttgaaatgttagtcttgaaccgtcaaaccgacgcatcaagcaaggtataatatcgacgaatcatcatggtgtatgtgagcagcacaaagcaaaagggtttattcgataatttcaccagcttttcaatctaattcaaaacaaatcggaattgtttaatagtggttagaaacggtgttctttttttcaacttatagcagacacagcaatagaaaaaatgcaaaacattttaaacaggatttaaaatgctttacaaaatattgcatcgcatttttctcgaatccttccaagtgttagatacgccgatttgaaaaattaggcttgatttatttactaacgacagcaaaaaagtatgcttcaactaaattagttttcaaaaacacaaatctggagaagccctgaccacgatcacagggtttgacggggccaaagtagaaggtgcaccataataatacccgtctgtgaaacatatcaccttcccaatactttggcacacctctaacggttcatgatttatcatgaaacggctgcattcaggcggaggatctgttaatatgtttcggcatattaccaggtcctcttcgaacggagggaccgccagggctcattagttacttataaaccagtgctggttgttgatggttcagttcgtttaccacgagctgtagcatcctttgtactaatcagtaatggttgttaagtttcgaagctaacgtgtgatcaatcgttttataatgcaacataagaatgggtgtttggtggaactgcgcgtaacacttgttgttattaaatatagtgattgtgttggtgctaatggtgtgtttataataaaatctatggtgatgaaaatttgaaaatgaaattggaagtgattctgatagttttgttagacatataataatgatgatgtataatgatgtgaactctactaatttaataaaggccataataccttttgcaatcatttctctgaatataaacattattgcctagttcttcaaacatgcatgataaaagtgttaataatgactgcgagtgcagaaaaacggatcgaagtgattttgttttactgtaactttgttgataatgctaaattgtagtttgaatagtaatgactctacagcaacataaataatgaaacatttaaattgaatatcttttaattacttagtaatgctaacagatggtaaatgctaataacaatgaatttatatgaaaatggtgtgatgtgaaaagtgatataatggaaagtatatctgatgtgtattacgaaagttgatgagtgataatcggtgaaatacgtgatagtgtcgaaaataaaagtgacgatagtgagtgatgaaatgaaatggggaatgaggaccttttaataaaactatttcgttcttcactttaaccactctagtagcatttcaggccttatcatagtttgatagtagtctaaagtactagactgcaaaactacggtaagggctgattgctgctagggtacacagtgcaccatttgagcaacattgcttaggaacgtctgtgtgatgaacgcaatagaggcttatagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggcggggtgacttgcacacattgtaatttaaaactaaatttcactataaaacacaattttcaatagaaaattcgttttaaatcggtgcttcaatacgtgcgactcacaattcaagtaggagccacgattaaaactgttattataaatatattcatacaataaacataattcttttaaatgtctagaaaactgatacttgatggaggttcgatatcgtgacctgaaaacatgagatagatttaatgtacaaaagtaatattttacatgttgtttctataactaaaaagtgataatatgacgaactttattgtacgaaattgtagcaacaactttttaataaaaataatttttatacacatgtacctatgcggggtgacttgcaacacttttttctaagcaatatagagttttataaaagttaaaaacttttgtgttaggtctactttataatcaaaagagtaataattcatcaatcaactacaaacactcgttaaaaatattgttcagttaagatattggaccttgatgatttaacgcctctttttcccatacaaaaatagctcaattattttcttacaaaaaagtattctaaatgtccttgtactagttcgaatgctttaaatacatgaataacaatagttaacaagtgggactaatgaaaaatatcaacattttgttggaaaaaactaaattagcagtgagtgttgcaagtcaccccgcacaaggacatttaaaaaatttcacctttttgatgacttttgatatgacaaaataattcgattcaattttctaccatctcattctgtaggcgagccggccattcaaagttctacaaggaatttagatttttagattacgtttagatcatggttttggttgattgaagttgaaaagtgttgcaagtcaccccgtttgacggaacttgttttggcatctcttctcactgctagccttgttcatgagttttcttgccttttacaggtccaaggcattcgggatgcgttcaccgtgcaggtctacgaaacacatgctcgcatcgcgatggaaaagggcgaccacgaagagttcaaccaatgccaaacgcagctcaaaatgctctattccgaggtgggaggcgagaacatattggagtttacggcgtaccgaattttgtactacattttcaccaaaaacacgctcggtaagtttggaaattgatacaaaagagaagaacagtcaggcttcttacacactatctattgctcttctaccaacagatctgaccaccatcatgaaagctctcactccgaccgaacgggaacaggacgtgatcattttcgcactaaagctgcgttcggcttgggccctcgggaactacagtcggttcttcaatctgtaccggacagccccgctgatggctggctatctgattgattggtttatcgagcgcgagcgcaagatcgccttgaagaacattattaaagcgtacgtattcgacctagctttgcggcccgattgagactgcgcccacaaagttaggtctcttctcccctcccatataggtttaggtacggttcggagttgcagaccggattaggatgtcgcttcccttgttggtttgacggggatatttttgggggcacatttccaaattgattttctttttacaggagcacatcccccggaccttgaggatcttgaatatgctttgagatgattgttctattctatttactcttcttaccgtatgtctctttcgaaaataacttatttgccatctattatcatttagttatcgtcccaattgcccggtggactatgtcagtcaagcgttggcctttgagagtgtggacaaatgtttcgactggttatcgacgttcgaattgacctttgttaccaagcaaggtggcgccgcgacagaggatggaggaagtgctgctgctgctgttccggcgaatggagtttcaagattcatcgactgcaagaccagcatgaatgtgttggcgaacttttaagctagtctcctcgtcgccgccattggggcaaagaattctctcaacatcaagtggtgacacctctttcgtgatccatagccgcaagtgtccccgtcgtccctgatctgaaccggtggctgtctactctctcgtcatcgactgattctcgtttaagttgctgagatcagttcgaatccgtttgccattttcgccaccggtgaatgttccgccaggtctaagaggaaagtttacgtgaggacaaagaggaatgcgttttagaattcctctctatgttcaggaggattagctgcgcccggatcgtcaaatcgaaggaggttgaggagacagcgcgacgggagaagaatggatgtatagtgatttctcatggaacgttgagaatgaagaattgtgttgtgtgattattatatgataatatgaacagtcggttgtcggcgaaatgaagtggacactgcttccaggggggcgacgaccaattttgtctctgtctgctaagccttgtggggatcgacagcggagaaaccggcggtacggatgttgcggaagaaggtgcggatcacaaactcgaggatttcgaatgaatcaagagtacccggagatcgt

SEQ ID NO: 60 - DNA, 6680 bp, Aedes aegypti
tagtgctagttactaatactaagtacaagagtaatatcattcttactatacataattacactacatttgtttttgagaacaatttttttattggtgatccactaccccaccatggtaaggaaagtggatcatttggagcaaattttcaagttcctcattctcaatacacaactgtaagaaaaatcaaattaaataacgatttaaagtatcttagcccctttttggttatccacagaaaaaagttttaattacattattccagagtttatatacacagagttgcgcgaagagacttctttgaatgcctcctcttcttcgtcttcgaaaacagcccctatctattttgctgggctgctcgataggtagacggtttgacagttcgataggtagatttggtttcactcttcgcgcaactcttcattcatagactctgcattattcaagttagctgtacaaaacaatgaagttgactcttgatttttctgtatccacttatactccacggtaccttagttatttttaaatgcccagtgagtttgcgcatgcacgaacacacacgaaccgaaatgtcaaatttcattcataaaaaatcactcattcattcgttggtggtaccgttgttcggtcgattgtttttccgatccgtgtttttgtaacaaattcaggtgaaaaattcgtgtagacggcccagagtccgcgaattttccaggattgcattttggaccaggtatttgtggtggagttcgttccaattgttagattattttcgaattctttccttttcggtagagattcgctcatcttacgaagactttgcgtggggtgtgtccatttgccatcgactcccatcaatcatcgattagtcaccgtcgccttttttggggggaatttcgtatttctgatagccgacaatgaccgagcgtcacacttttgggggtaatctaaacccaatcacctgccatgcctggaacaaggatcgcagccgtaagtatcgtaaattggttctataacattccccaggaaaccatctcattccgtcgaatgcaccattccccggaggactggtagcgagtcacttatttttggcagtaactctcacttgtttccaatcgtccggaacgatgttgctctccaagaatacattgaataagttcaacaagcgcctctttgcgacgtctggaaggttttccagcaagttgaacttaatttcatccatacctggggcagaattagctattacatgaaaagagagcaagtgagaattttaccatcgaaaaagttgagtccattgcattcgtttcgtctggataatcacgaacgaatagtcatttgaatttggactgaatccaggcaaccttttttttttttgcgaagtcgaatatccatttaggagagctttcgcgatcgtcatttaccgataccgaccgtccaaagagttcgcatcgacgtttcccgtgatagaccattcatcctccagtaatagcgtttcttcgctttcgcgagactcttgaacttgcgatccagagaactataccgctcgaagttatcccgtgttccacgtttccgatattcttaaacgcgttcgatctttcccgataaacaccggtacattcgtcatcccatcacggggtgggcggtcgtcgtcgtaccgaggatcccggaaccggtttacgctgagcttgaagagcactgttttttaatcaacgctgataagaattgatattcttccaacggaggaagtatatcgaccgattgctcacctacggagatcgcttcagcatattttccccagtcgatatgcttcgctacgtcgatctggtgtgttcgacacggattattgttaactgatattttgataggcaggtgatcaaggatggaaatctagtgatcatgataatatccacgatgcatcgcggttgttctttgtcgttgaagcatagcaacaatgatcaaccttttgtcgtcaagtcatcacaacaaactacgctctacgaataaataatggatcgcaaggcgtgtacgcttacgataaataattcgtcaatcaaagtaataatttttggacgatttttatcgttttttatctgtgatttgcctccttatagaccgtgttcgatgtggaagtaaatttgggatagtttgggcggaaaatattgctgtgaatgcgttccgattcacgttaatcgcaacatgttacattatccgacaaactgtttgtcccgcgacaaacagtacatcagatgctccatatgtcggtatcatgcgctcagaatgcggtgttggaatcatgctgtttcatgaacgacggcccttttagaccgtgtcgtttgtcgctagagtcgattttttccatccttgcaggtgatcactaccatggggatcctgaattactttccacatgcaagccaatgataataacatacttaggggatctgtaggttttattcgtgttgcttccccagtgttcaaaattgtcagattgaagtagtcgcaaagatcatacaccatcagtgcaccagtatccgctcatgcctctatttccgttcactagtgtaaaaattgatttttcgtgtcaaaactctacatttttcgcacggatatctaaaatattaaaaacattcaaatgaagttgtcttacataattttcatttgacaaaataattccttatattgaaaacacaagacctcgtgagcggttattggatcattaggtatttttgtgtgttctaataaccgctcatttattgaattagtagtcatggtttgatgcactgatggtattaagtttgcgcaatggtcgtccctcggttacccccagggtgtaccgtgagaattaaaatctcctaggatcaaccatggcgcaggcatattagcttcgcatattgctgctaggtctctgcgaggggtctaccccgtatggcataatggcatttggcataatgccgtttggcatacagtcgtttgacataaagccgtttggcatacagtcgtttgacataaagccgtttggcataatagtcgtttggcataacttgaaaaggaagattttgcaatggtatagtaataaccgcgaccataagatgcgtcatgaaacatcatgttccttcttttttcaaataacatgacatatctcaggcgttgcacacatttttgttaaaaaaaatgcgctacaatatctcaaacacaatggccccggctatcatgtacgatgcaattctgaaagagttttattaaatgttggttccctttaaaaatgaagatttgaagtatgttcttttaataactgacagcagaatgtgcgatcgcgagcagtttatcaaaacctcctttgcttaatggaacgaatttgattaaattcaatgctatttacaattatgcccaacggctattctgccaaatagcgattatgccaaacgaccgttatgccaaacagctattatgccaaacggcattatgccatatggaattatgccaaacggggtaaacccctctgcgagatgctctagcactcggtgatatgtatagagctgtgatataccactaccactactactgtggtacttcaatgcccgtcatctaggggaagtcgattctgtaaaaggagtggagcttgttaattcccaacagcacccctccgtatccatccccttggtccagacggataatattgaaatcgtgggaagagacgtttttatcagaagtgggccatgtttcgcagagtgcaaatatgtcacagcgagtgctgtgtactaaagacttggacgcctccatactttttaaaatacttctacttctcttcgatcatatcttcgacctcattggacatattagccatcgaaagatacgaacgagtcatgaatcggccaccttgaagctgtttgcttcagaaaatgtttcaccaaagagagtgccattttgattaggtttctcgtttcgggtgagatttgaaacactacgaaaatgaaatccactattccagaaatcgtcagtttcccggagcaacattttgctcctgctgacgagtttgttcagtttggggctttagatgttcccggaagtgacgtaaatactccaaatgaaaatttgaaacctgtaggtgacgccttgttggtgtgtctgccatttcttgaaattttcagaggtagttgaggagcttgttgctcaacaggaatgttcttagaaaccttctgctgcaggtgccgttttgtaacagcacgcttccttttcgttcctgtttcaattatagtatactcttctccaccctcagactcatagcattgatcattaaatatttttcttaaaaactctaactttgacatactatacaactataaaagatcttgccctaatattccagaaatatcttaatagaagtgtttactatggaatgatgtacaagaaaaacctctcagaacaagtcattttttcgattattggccacctgatcgcccatagtgcatctgtatcggtccatgatcggcggcaatgcttcgcaagttgtaacaagcttgataaataacagcagtgtgtacagtaactttctctattaaggcttaacaaaaaagttgatagttttatcggtataagaagtactattttttttctcaggataattttcatataagccttcaacgtctttgggccgcattcaccaaaatgactgttacatctcaaacatttttttaaatttgaaactctttacttctcatgtcggtacttgaaaaaaacttgaaagttgttttccaggaaatgatgcattttgggaaaagagattaatattagaaataatattctgggaaaaggtttttagtgaaatgttatagagtttgtgaattttctataagtttttttatagctttctaatcttttcaatctcgtgggctttcagaaattgccatctctccgaacaacaacgaggtccatatctacaagcgggaaggatccgagtggaagctgctggacgtgctgaatcagcatgatcttcgcgtcatgggaattgattgggcgccgaacacgaaccggattgtgacctgtgccgtcgataggaatgcctacgtttggacccaaggggacgatggcaagtggaagccaacgctggttctgctgagaatcaaccgggccgcgacttgcgttcgttggtcaccgctggagaacaagtttgctgtgggatccggtgctcgtttgatttccgtgtgctacttcgaatcggagaacgattggtgggtttcgaagcacatcaagaagccaattcgttcgaccgttacgtcgttggattggcatccgaacaatgtccttctggtggcgggttcgaccgattacaaggtgcgagtcttttccgcctacattaaggacatcgagcagcacccggaaacgacggcttggggtccgaagaaaccgttggggcaaatgctggccgagttcaagaattcgacaaccggcggtggttgggttcatagcgtgagcttctcagccgatggtaatcgtgtttgctgggttggccacgatagtgcgatcaacattgcggaggcaaacagtggaaacgtggcgattaagctaaagacggagtacttgccgttcctttgctgcgagtggatctcgccgcaatcgatcctggttaccggccatagttgcgttccactgatctacaccttcgatggaagtcgcatcgtgttggctgccaagttggatcagtcgacgaagaaggaacagagcgggatctcggctatgcggatcttccagtcgttggatcgcaactctcgtacggagaattccgacaccaatctggagtcgatccaccaaaatgcaatcacctgtgtttgcatctattcgggtgacaagggaagtgccggtcgcatcagcacttccggactcgacggacagttagtcatttgggacattaacacgctgacccgttcgatgcagggtctgcgcatttaagcgtgcaacatcagtattcaccggccaaacggaggtaagtatggaatgatgaccgatatattgtgtttgtagcatttaattcgcataaacagtgcactgctggccgataaagaatccattaataaattccaatctttacactcaagtctagttagtaatgaatttatatggaacgtaaaagaaatattcagatataaaagtacagggcaggtactgattaaaggtttgaaaataggaacttagaaaccacatgtccgaaagagagattgatcaggaaaggaaccataaaaagataaaggagaccaataaggaatcagggaatacgtgaagggtagttttataagaatgttatagagattgctcaggtaatccgagaaaatttgtcaaagatttctaaaaatctcttcgaatattcctccactacgcatagggtattacctttgatttgagcttgaaaaatagattcttgcccatgaaaaccaatttttactatggatccctagctcgatatcgagatacaatattttgtgaaagtataaattgaatgttgacacaagaaaatgtgatttttttgcaacttctaaaaccttattttggatattggaatattttggatgaaaaaataagctttgcataaagttttgactattgtatttaatttttttcacagcatcgatgagcatgttgtgcacggaattacagtcctctcccttactcgatatcgaagggaccatcgagttagg

SEQ ID NO: 61 - DNA, 194179 bp, Aedes aegypti
  misc_feature (85520)..(85619): n is a, c, g, or t
  misc_feature (107025)..(107714): n is a, c, g, or t
tcagacgccttgccaggctggacatatacaatataatttatgatcgcacgcaactgaacttggttacctttcagtggttgatttcatgagtgtcataagtgtattttatctacttgggaatataatgaaattcaaagtacataacactgtgaatccattcccgtttctattttacgcatatacatacaattcaatcagtctaaattagggcaattaaaattaacgaagccatctagggcacgttcgtggaaatgtgtgatgctttgaatgggaaattgtttgccatccatttaattgggggaaatttggcgctattgcttattgctgactcccaagggattcccatggcaaagcgacattacgccaagcgtgtggcgcttatcagcgatttctctctttgtgattcagcattttcttcatgtttctcgcttatcacgacttctatttatttgtagaattggaaaatgtccagacacatcttggggtttttaatatatagatttagaaaacggggacaccaacaactcaatatctactttttaagaagcgcatttgaaagattcacatgtttactctttgtgagaatagaacacagagataataaataatcatgttttttttctgatagcatattcttcttcttgctggtgatacgttccaactcggacaacctgcttctccgcttcgtgatctacgtttttcttaaaattttctgatatagtggctacattataagtgacttgaaatctgcttacctttaggggcacaaaagcacagaaacattttcacccgacatgacccagtgacccaccagaataactccggccacaggaacatttgcgagatcctttggccacttttagaatctagatatgtgtacaagtatactgacaaaaaataattgaaatccgttaggtattcactgagcagtgagggttttggttttttttttcactcgggcctatacgggttaatcgattcttttaattatttttcgacggactacaaattttgagaaatatagggtacgctgtgtgtaaattatttaatagttacaggaagattgaattttgacaagcaaaatgcaccaaggtaaaaatttaagtacataatatgaaaacaacacgtaaaatcatcttggtgtctacagctcagttgtccatcattactcgatgaataaatgcgttgaatacttaaatgctttaactcgttgtttttctgatacatcattttttgtattcatgcatttttattgtcaaagtttagcttacttaccaagtaaaaatggtgctaaagccaacactgaaaaagtagttttcttcatttaatcaaacaaatcggcacacagatttctttaatttttcgaatgaaacggctgtgtgtttttatttttgtttggtttataaggagaaatctactttttcagttttgacttttgcaccatttttaattgggccttaagtaaagttgataattttatatggaaaaactgctttggggaattttatatgtccgatactgtacaaggtctagcttatttatataatcaccgaattaacctcgttgctgttgtatgtatgtaggtatgtaggtagccaccatccttgcttgagtcttgctctgcttgcggttccactcaacagtaaggtcaaatttcattaccaacctgatttcaacatactgctgtatgaagggccaaaaggggggtggcggacccgtaagcagagacacttacgcgaaacccgcgggaagtagagaatctccttccaacagtgtgatccaacagattgagtattggaatttgcagtacttgtcgagctttccacgggatggtttgttaatagaagggcgcgtcaaatcgattacaactgttggagagaaaagtgttgatcgctagcgactaacattcttcctcctgactccgattggcactccacttcattgtccagttgcaacttcaatgatgccctgatgctccctcccttccccgtatattgtcaatgttatatagtataatattatatgatataaaaataatatgatatatgtaaaacataataaaatataatataataaagcataatataatataacgaaacattatgtaatataatatagtatttataatctgccaacccagtatcctgaaaatgattaatgctgtaagtatacgctggacagggcatatagtaattattccatataacaataccgtacaaccaaagttcacgtcacttcagtaactccatttcattgtcctgttgcaacttgaatgatgctttggtactctgtcccttctattatattgtcagtatattatatatgttatttagtaaatagtatttaaatatgaaataacttaatacaatataatgtaatatgatatataaaacatcatatattatagtaaaacaaaatataatattataaaatacaccaaccccagtatcctgtaaatgactagtggttgaagtgtacgctggacagggccaatggtaataattcaaaataacattcttctaaaaacaaaattcgcgtctcattcaggaactctcattcattgtaaagtcgcatcttcaatcttgccatgatgatccttcccttcccggtatattggtaatataatacatatgttatatagtatatattatattatgaaataatatagaacagtataaaataatataataaaatataatataacattttataaggttatacgccgaccatggtatacagacaattactaaagccatggaacgcagtggaataggaagattgacaaggcgcaactggttctgaagaatgtattatgtggccgaagataaaggatggctgccaagatccaagtaaattggcttaatattatgtggttttatatggataatgatgtagaactaaatgaataataattttttaaaattatattaactaataacataactacttttgaaaaaattaccaaatcaaccgaaaataaataatagtaaatattgatataatatggtctatcgcttccaacgtgtccatacaacacgtgagtttaaacagctatttaaattcaacattctgttttattaaagacatttatacaaactccttccaacgtggtgatcctatactatgaatgctgaaattgagaatacttgaaaatatcattgtaattcaaatggtataaatattattattttgtttatggtgtataaaagtgtaccttttcattagaaaaaaaagttcatatgatatctacgcataagcctgaaaatctttttctccatatgctcctgaaacagaagtgttgtgaaatctggatattttaaacaaacattatatgtaatatagatatgtggcatcgttccaaattacgaatcgctaacactgattgccccattcctcccctacgtcatatattttgttttgattgtagtgccaccgtaaattgtatacgatgcctatatgaactaatctacgatgacgtcacgctgcaacttccagcgggaagaaaacctttactgcgggccgtgtttacaaaaaatgaacgatccactcaatgttcatccggtgaacattccttcactggatgttggtccggatgtcattttatgttaacacggcccgcatttagagtggaaaagaaaaagaaaatcactaataatagaagaccgtggataagtccatatgtattctacgcctctccggccgacaagatacctaaacatacaaaaatgctgaaagaatgaaagcgatattagcttcccaccaccatcaaaccgacaaaacagagagcatcacattgcagcaactacctacatgtatcagctctgcaaaagaaaataggccaggggaagtggttcacctagagtgaatttctgtcaaagaaaaagtagattttgtatgagatttgacagaaaaatgaatgacaagatcatccacttctcctggcctatagagattcagacgagcaaactatcacgcacaccaattgatttctgtttatctacgttttagcgaaaaattaatgacgctgatgatgatgattatggtgatgtgcaggcgcaagcgttgcgggcgtttgtcgatatgatactagtcatttgtaattttgcgacacgctttggagatgtgcccgctaatacgtaaaaaaatatgaaaatatacttagcttcgggccttctatgaattgcctgccgtgccataagcactccaattcctcatctcctagacgccaggtactggtgtcgtaatcacgctgcattcatcgtgatttccacatactgatacttcacgcataggccaggggaagtggttcacctagagtgaatttctgtcaaagaaaaagtagattttgtatgagatttgacagaaaaatgaatgacaagttcatccacttctcctggcctataccccctaatcacttcttccgtcatctctcaacccaaacggcgcaatatctatggatgatgaagatgatgatgatctcgccactgcacacacactacaaccgtcacaacaagtagcttatatccgcggatgttttttttttttttcactctcactaacagcgctctgacgccttcaaccttcattttttctcaacttaatttatcacttttccacattttattcacgttcatccacacaatttctgttattttcaaaactttccatcttttctactgcaatccaactatgtaacactattcacaatcatacaattaaacttcatcgatgcgaaaaaaaaaagttgcagtgaggaacaacacgcacacacgacttgataggttgagagaacaaaccgaattttgattgcaaatacggaccaatttaaaactaatcagtttaaaaaaaattgatccaactctttgagaaatttattagtactccttataaaagtccaagattcgctttcgaaaattccttcagaaacttcttaacgaattttttcttgacttcatcagaaaaatcggtaaaatttaatcaaaatacttttcagtaaattcatcataagactctttaaaaaagtgattctgtaattctgttaaaatacttcgagctctttgacaactccttcagatgctcttggaactcctcaaaaatatcactaggcctctttttttgtctattcgaaccatctgaacagaatcttaataaagaggatctaaaagtagatcgagtattgtacctttcaattccgccctaatttaattatctttcgacagatcggaaataactttttcagtcgagtaggcgtttcacccctgaaccagtgggaactagccttccagttttgctaggttttttatgtttctgaacaaaaagaattccgatttgttgtagtatccggatgaaataaatgcagcttttgtcctatgattctaaaattattgaaaaaaacttggcgaaatcccttgaaatttaaaaaatcaaatgtcttaaaaatactcatgggaattcttagaggcgttcaaagtaatgttcgcatatgacatgacatgaacattgaacatagacatgaactaagaaatgggtgacggaacatttctgagtattgcattggattcagcaactccaaatttacttgaggtataatttgatctttggaacacgaacattctgttccgctatgttatagaggaggttgtatgacatttgccagaaaaccatttgccagaattaaccattccccggaaaataatattacttcattactaagctgtgcatgacaatactaaggcatgtaaaattcttcaaattattatgattttcagcatacgatgttaagtacagtgaaacctccatgagtcatttcatggttactatggtggtcccatcaaacagctatccatagcatttgagttccatgactcgctccttgagtcgatggtctcttcagatatcgacttttggatgtttgactgtaaacgaaaaatgatttcttcgtgagatttacatgataaaatggcttttgagtttttcatagtttcttaaaatttactatgttataacacccattagaggcaattctattgaagattttctcttctttgtgtattaagctgttctttagaactaatttttacagggatttatatgcttcataggagattcacccttctttatatcattggctgttcttcttaattgtattgaaaaattgttgaaagttattcaactcacttgcagtactagatctaactaactacatactaaccatctcattgagccaacgttggcttacactcaggcaaatggactatcgataaacataggaaccccttatgaaaattcgccacaaggaatcgggttgaaattcataaatttaccttatgaaatcgaaatttaaaaacaaaaatagttttcgcggcaacctggaatcgaaccaagaaccttgcgatcgataggctcggtcgtacatcccgcgcctatcgacgccttggtgttgagtgatgctaaaacgatacataaagcgttcgtattgcgataaccgttccatctttcataaggcaaaatgtatgaatttcaatagtccagttcgctgcgtgatatatgagtagtgtggtacaaacaaggcaacagtgcgacgctaaaaataaaatctctcactattgttcataggcacgcttaggagagtcgaattgggcatcttagagagccgaaggaggtgtagggttgtgaaggagaatatgggatcgtgacggagtttggtttcaggttggccgattgcactgcagaattcttacccgttctgtggcgtagttggttaacgcgcccagtctagtgtattgggagtcgtgggaccgaagcccaccagaacgattctattatttttcataattttacatctcaattcgtccaaaattcacttttgtgtctacgaccgccaagattgctatgtgttccaaggcaaatatgagacatatcatgtaaagaaatacctaagattttaaaaaaaaatgggctttttcgcaaaatgttgagctagctggaatacgaggggtccatcaatttgagaaaacctaaagaaccatcctttagttttagcatatactagtgaccagtgacataaaattagaattctaacgatgggtgccgatggcggcctggtttcagctcaactatcggatataataagcacatattttgacaactattgtctagtattcatcttgcttcatttttgtctagtttatcgagaaccagtggagctctgcagctacgttggaaaagagggttgaagtcttctactacagaagttgtgttaacaatacaacatgaagattgtttgcgacattcaacgccaagttccaatctgggagggagaaaccgatacgaaatttatgctcatcaaggtgagccgagattttgctgtgacgaactgtcattgtgagcccggatcttaaacaatggaccaacatgataaaagcacgtaattgatcaaaacacatctttgcatttcatcaaaggaaactaagatcgaatgagaatcagttcatgcatattcaaaagtaatgccacgagtgcagcttttattccgattgagtataaaatatttaaaattaaatgcatagaaaactgtgacccgttttccatccaaactagtggttttcatcaagtctgccttgcttgtcgttggcaaactgcagttatcttgcagttcagatattttttatcatatttcgtgtgtagaatctgtgcctccctcccaggttccaataatcgaagcatacagttgatgaaattgaacactcactgtagcaggttgcgtagccttcttattcacatgcatggaaagcagcgtaaagtgcggctcattttcctctctcacgaaccctgttcgaagctctcatctctccagagtctcacacgacgcccgattttcttccgctgctcgggcccgatagcaaccgcaccgttgttgtgcccctaaattagctcgttaggtttccgattccgaggcgtcggaatctctttgaaagcgaaactgtgtcacacttttattttcattcgcgtttcaccactgcacaattattgctgttccgaacggtgcgtctggcagccgaccatcgaaattcgctacgaccatgctggtttgtatggttgtgctggtgcgatgtgtggtgggttgtattgatgcgattttttcactgtaccaacctatcccacaatgcgccgtcgcattcgtcgtgatgatggggcggcaatggaagaaaatatgacaccgggtggtttagtggttttgagctttttcgtgacggtgtgtgagtgtatgggaagggtggcaatgtggttgacaaggtggccagatctaacgatttctaggtggttctaccgatttacaggcatgagtcaaaaatcttacgatattacattttctaccaaataatgttaattttttaactcttgtttattttaaaagtaaaacatatttctgaaacaattcttaatttttataatacaaaattttaaaatttttactattgtttcctggttttagacaaagaaagcttaatagacttcgcaaggaccggtagttaacggaggatccggaattgtaaccggaagatggacgtccagcgctcttgtgagagcatcgaactaagttgcgtcgttcggctaaccggggcccattctccaatattcattgacattaatttattatactttacacattacaataagattcaacatatttgtttactgaagtaaatatacttttgaaataatttaattatttatttcgtaccatattttttttatttttcaaagttattttaatttattacactaaatgtaataaattaagataactttgaaaaagaaagaaaaatgattcgaaaaaaatcattaaattatttcaaaagtatatttacttcagtaaacaaatatgttgaatctgatagtaatgttgaattcttgtttaagcaattttataagctaatgctaaaacatttcatcgtgttccactttgaaactaatatagatttctgttgggctttgaaaacaaatttgctatttcaaacttgtgttcaaacagatgagacttaaaaagtatgtccaacattttttattgagtttgatgagcctaccgataactatcgatttttgttcatgaaacctaccgatgaggcaaaaacaatctgaccaccctggtgcctgatccggagcttgatagtcgtgtgtaagccagcatcactcgctagtgctgcgtgaatgttgttttgaaagtgaattcgtacgcgaccacatgctgcattccattgcttctgggtgcctctgcggtagtctttgaggtagatcctacatacgggttaccagtttcggtgatggtcaggtcgtgtcgtgtggttgacggcatgatttatgcactgacggttcctggccaatgaagtggtggcaaattgagcaagctgtgctgttgaaattaaacatttactcttgaatgggattaatgtagctcattaacgatgctcgttgtttcaactgagctcagaaggcaaaagttcaaagcctattgttgcgaagagcgttgtgtgatgcttccaggaatctcgctctgctgtaacaaagaatattgagcacgcgtgagaatgaattttcatgagcttgtagatattccaggtttactaacgagactaagcaagctaatacggaaactcttcgctacgaattatatggggcgtaaggtcttctgtggaatagtgtggagtttacaagcaaatatgggaaaaagaacaacaagaagcgttgtacagattatcaatttgattgatatttttatgctgaaccactctctcaaaatccgtctagagttgtcaattgaattgaattgaaggattccttcatcactaaactttttaaaaaggtaattttgaacagaatgatggcccacataaataaaaattcaatgtttgtcaatgaacagttcggattccgatatggacattcgaccactcatcaacttttacgtgtaacaaatctgatccgttccaacaaatctgaaagctattctactggttttgctcttctaggtatagaaaaagcattcgacagtgtttggcatgaaggcttgattgtataattaaaaaactattccagcatacattgttaaaataatccaaagttatctgtcaaatcgtacacttcaggttaattatcacagcacccaagtctgaaagacttcctataaaaggcagcattttgggataattattgtacaatattttcacatttgacttacctgtgttggttgcaaataacacaggtctctccgccaaaaaacaaagcatgcgagtcatctgtaatagattacaaaacagattggatattattattattatctttattatcgagtctttcagccgttgactggttcgcatccgatcaaaagtttggatattttttcttaatacttgcaaaaacagaaggtttctcctaatgcttccaaaactcaactaataatattcccacataaaccaagagatctttatttgaacctttaagtagacatgttgtcatgatgagagggattccaataaattgctaagattaaattaagtatctagaactcatattaattttcaaaaatcacattgagggcattcaagccaaacgtaataaataagtaaaaagtctgaatccatttattgacaggtaatcaaaattgtgtgtcaagagcaagcttttgatcttcaaacacattttcaggccagccatgttatatgctgtacaaatttggactagctgttgtaataccaggaaaaaagcctctacagagcttcaaaattcaaacatcagtatattgaattgcaaattattccgaagagctcttgtcaaataaaatccttccgttggaattgctttggaaactgtgccacgaatggtgtttggcatcaaaatttcgaaggataaaaaaaagacttattttgagacaattttctcaagacagttcgaagcatttgaacttgccacccagtgctttgaaaaagcaaatgggcagttaaaaagttcgtttactaagcagtgtttcaacaaaaagacacaaattttcaaaattattatagcatatattttaaggtatttttatttttgttttgagcacccagtaaatcatggaatttgcgtgaggtatcagttccaaacttattcgaagaatttttcagagttgtttaaaggttctacgaattattcatcaaaagattccgctaatgatgcctttacgaattttcttagatattctttaaaaaagtcaaagaattgaatccagatttttttttcaggaattctgccatatttcaaacaattctcgatgatatgcatttgaggattccttaaaaaaatcatgaatggatcacatccaaaacttctgaaaccttcatgagaacttctgaagaaattactggggatatcttttgaaaagtgctaatccgtaagacattttcatagggccgagttggaacccttagaatgactctagaagacatttctgcaaactttaatgcagaaattttcgagtactttcttgaattcttgaataagctgttatggacgaaattctacagaagtctctggaggttttaatagaacacctacattaactaatgttgacatttctatttcttcttgtcactatatattcactagggcagcactaggccataatgttttctataagcactgttgacgccgtttttgtatggtcgagctctgggccgatggtgcaccagcaattcaggaattcagtgatatttaacaccacacattacgaaatactgtattcataggtcacagatgtatatttcttaacatagagggctatatacactaattacaattcttcaattgcaccatacccggtctgtgggcatcgaaggctcgagaatcgaacgcgcgcgggtacggcttgactgtgccgatgaaccgtagtattcggcggtcaactaataactcaactaatagtatgctcaagtactcttctgttggtgttgtagcttagatgtagagtatctcacagaaatgggataaggaggggtgggggtttgctagtgaaactgtattgctctacatcgtatactgctgtatacgtattgttagatgtgatcagtttccacatcatccttacagtacagatgaacaatcccgactgtgctggacggctaatcatttgtttagaaacaacgtggaaacgagccggattgtaaattgtcctactgtatttgctgtacgtttgacgcagtttcacacatcgttcacttcatctgtgtttagaagcctacgacgaggataaatcacagcaaggtttaattgaactacagtatggaactctatttgcactatgggtgcgtgcatagcatgttgatggccaaaatattgcaaataaagttcacgtttggcgtgaacaagcactttcacaattattaattgagagctcatctatttttctaaagttctaaaaacataaattcgtgttctcaattcgtaaaaatctcaaagcttgagccaagtatattaagatttttaatttttatttaaattaagcgacttcattcgaatttccaagttataaaatatgaccttccgtgaagtttccataaatttgtcattttatatctaattagatgcttttagcttattctctaatctcaaattaaatttatgaaaagtttgtagaacaccaattttgtctaaaatcaaaactaagtcttagtgaaaagtagtttcctccaaaattttcctctttttatcaagaacttcatctttgtttgaccatggcttcatgagtactcaaccgattttaaatcttattacaagcttttgaagatttagttgtttttgaactgtacactgtgatttaaataaaaaaaaaatgactcgtttatataacaaaaactacccaaaaccatacaattttaacgataaatactatatttttaaaatgtttgcctgttagacgttaatacttagattcaactggtttttctcttatggtgactccttaagtatgtcttaacaacatttgtgtaataaatttcaaacaacattatttttgtatttattaaaaaaatatatacactatttagcttgtacttgcaacaagatgctttataaatccagagtaattagattaatttttagtgaaaagccatgtttttgaatattttttgttgaacaactaagtccttttttaattaaatgtgttaagcacactgtttaaaacaatttgataagcttcaaaattatgcaaaataatttgaaatcggttgagtatttatgaagttatggtcgaacaaaatgatttttttagtaaaagagaaacacaattgaagaaatctacttttaaccgagactagttataatattatataaatttgaaaaaaaacagagttgtaaagactccattgaaggtaatgtattataacttgaaaattcaccatctagtcgcttgtgccttcttttctttttggcccaaacttcgagatttctctatttgtgtgaattgaattcgaaacagcacacgtaattttggttctgagaactttcgaaatataattcgcaccctaattcccagggcaggaattccattgcgaaaagatcctggaccagactggaatcacacccagacacattcagcaggacttcgctatcctctatgggcggtttccatacagattagcggccaaaactgttttttcatctcatgtcgtatttacgagttttgtgatacaaatttgatgttttatttcaaaaacaagttttcgggactaacttttgaatagggcctaagcgaaataataagttttgttactaatgatgcatataagccatttatgcgattaacgttgtgcaaaccattatacatattagaacttacatataaatgatgatatgaatcacttggcgatattcagttattctctagctgtttttaatagaaaatggttaaaaatataggaaaaattcaaaaagtcctaaattaaaaagtgcaaatatgtgcaactgaattcttctcgatcctgtagtttacatctcaagtacccttggaaatacattttagccttggacaaattgcctattaaataagctttcggacagtgtataaaggtctgtataaaatattacgattattcagtatattgtattcaatcagtaccttgtgttagcactgaattctttatttttcttaaaaactctaactttgacatactatatcaataaaaaaagtgaaaaatcttgccctgatattccaggaatatctcaataaaagtgtttacaatggaatgatgtacaagaaaaacctattaaaacaagtcattttttcgattattgaccacctgatcgcccatagtgttttccagccgcgggcgttattactggactaagaaagaaacattaaggtgaagatgtatcgaagccaaatcttaaattttcaagagcacgaatctagagaactaaacagccgttcaagctgaaaacttattcgattggtcaccaccagcgtgtgaccaatcgattaagttttcagctcaaaccgcagtctggttctctagatttgtgctcttgaaaatttgaggtctggcttcgatgcatcttcaccttaaggagatgttatagaacatatggtcaatagagtttcccatactcgcttacggatttttctaaatggaattcttgtttctcggttgagcagagtctgttgaaacagttggatatgtccttagagtaataactgtgtgaaataggaaaaaatccttggaaattcctgaaaaaatatccgtgaaaaaacttgcagaaatatgtggaatgcttgtggaatcccagacaaatttatggaacagtttcttcagaagtttctatacgagtttttgatagatgttttgagaaaatcttgaatatatttttgtagcaaatctcgaagtagaatgtctggactcattcttagaaatgtgctctaattaattgctagttaagctcttaaaaaatcatgaaaaaagtattagaacaaataacaggcacatttgtcgaaaatttctgcaagttactaaaaatcttgtactatcttttttgtgtaatttcagtaggtaaggaaaataagggcataatgaaaacattaagaaaatgctcattttaagatcattaaatggcaataattttcaaatacctttggctatttttcaagtttagtataagtacgacgtactgaattcaggaatgttgataaaaatcatcttcttcttcttggcattaacgtcctcactgggacagagcctgcttctcagcttagtgttcttatgagcacttcaacagttattaactgagagctgtctttaccaaatttgccattttcgcatttgtatatcgcgtgacaggtacgattatactctatgcccagggaaatcaaggaaatttccattacgaaaagatcctggaccgaccgggaattgaactcagacaccttcagcatggctttgctttgtaaccgggggactctaaccactcggctaaggaaggcacctctgtgataaaaagcatatcaaatataaaaaagggatagaaaattgggtcaacaccaaggctgcttaaaaaggagtcggggcaaaatatgcactttaatggaaatttgagaaaataatgttatgtattcatgagtttcaataggctacgtaaaagagctcctcctggatcacactagcaaagatatgtatctctaagttcttactctgcttaaaaatatgttcaatgtcttgcttatataaagggcgaactcaaaattattgcgacacattcaacaggacataacttttctaccattgggtaaacatcaaccaaattttgcacactttctcattgatgtgtattgttgctgtctaactcgaagtcgtgttttttttttcgattcaacgaaaatggaggtcaaccattgcgagtcgagagaactaattctttccaaacatctggaatttcctgacctgtcgcaccagctgttgggaaaaatgttgaacattcaccattcaaccgtctccagagtgttgaagcggttccaggagcggttgacgttggaccacggcaaaggaactggaagaaaaccgggaccggagaacaaaaagacggagggaaaggtgaagcggatgattgaagcgaattccaacgtctcaagccgtgattcggctaaaaagatcggcatgtcgcagagctacgtccagaatgcaaagaagagatctggactacatacatacaaggtacagaacttcccaaaccgcgatgagcggcaacaatcgacgacttaaactcgggcacggaagctctacgagaagatgctcacaaaatatggctgctgtgtgatggacgacgaaacgtatataaaagccgattttaagctaattctggggttggagtttttcaccggcaagagcaagttcgatgtggacgaaaaatttaagaagaagaaaatgtcgaacttatactgactgaacttatcttttatactgacaatcagctcatatacaatacagattatacaattttgatgatttttatgcatattctaagagaataagcaggtgtcaatttcctcctgtgctcattatgcttctaatcccactaatcaagattaaatgattgttggaatacgtgttgtaatttgatgaaaactcatggaggtttttttttaaataaaataaaaatgcttttggcgttcattttgaaacatttcttcaatcccagggcggtgtaatgcagttctaaaggttcaaaaactgtcttttttgacagggtgcagaagtaaaaatgatgataagcaatcaaaagaaaagaaatttggttaatcttgcctgaacacatcttgccacaaatactgatacggtgaaactcgaacgaatagttaataaaataaccaagggcaaatatcagatgattgatttgttcaattggcgaattatttttggcgaggctttatcaagataattgatgtaaagccaaataagtaagtaagtgattcgttcaccaccttgaaatgcaaaaagttatgacaataatgagagataaaaacttttcgtggaactgcgtgggcttttcggtgaaatgggatattcgaagatctggcgttctgggaaatgacattcggggaaaagtagctcaaccctttgacagaaattagtagattctcattatgacttttcagcaaattcatggtggattcccgacgaaacgtatccggagatctttgaccgaagccttttttttggtggacattagggattttcgaagaaaattttcattttatatgagaaatcttgctttttgctattttaattccaaatttcgctaaatttatgactctaataacgctcaatatgctgcggaaatttgaacttgtttcctacagagagctctttttagcacgtgttttaaaaccaatacgatcagcattcttttgattatatttatacatcagtgtttatgcttgatgataaatccttcttgctacgcaagtgaaaacggcttctcatcaagcagtttttgtacgcgagcctaaataaaaaaatcatttcggatcacgaagagtcttatctgagctgtggatctgcttgttattgcgcgtatataaataccaataaagttgattcggtactgtgattgtaccaaggtacctttcaaagactgctcttttcggacacttaaaattatggtccatatcttgacatgataattggtgatcatttgttaatgggtgttaccgacgggttattgacaccaaatgatacggttggcaagcgtttcgtgaaataagcttatttatttccgggtgtaaagttagggtggagattgagttatacagaccttgagagtttctttttcttttcctactttgtggtactacgtttctattgaaactatctcattacctcacatattctgatgagcaattacacagcgtgtacacattttccctgaaaatattttgaccactcaattagttgaactcgcatttttttaatgagtaatccaaaacctaactcaaaacttgtttgagcttcaaataaaattgaaatttttccgtggcgtacggtcctcttagacccgtactgatcatgttttacattggtgcttaccacttgaaccatcacagaaacataatttaacataatacaggaattgtttatgaaaaaattgcaaacagaagtccctatcaataattagcccccttaaaaatggcaaaaaaaggcttgaaaatgatagtccaacacgtaccttcgcttgtcaaatgaggatctatcttaaattataatatccttcagtttataaatggctttcaattagccttagattatggtgtaatttgtaccgagaagcaatactcgtgtgttagaatacccaatggctcgcttagaccataaattacctgcagatgccttgcattaaatgtgtgtggttatttgactgtgcctcctgctgtgtgatctcaccccttggacctcaaacaaaatatcggtttgcccccaaaaatagcaagctcaacagtggcagcctgaacccacattactattaactctagtatacctatagtttcaaaagcaagcgagttattcttcgcacttgggaactttgaaatgtcgaattggaggtcacggtcaagtcaccaccatcgtatcggactgtgaccactttgtacgatctcccactcactgattgcctaccattacgtcgtctatcgagctcaatcgtttgaacacaaagtcccacagctaattcatttgattagtcgatacacctttcagacattgggggcaactcgacaacggttaaccaaacggtgaaggcacggtgcgttcggtgagaggttaaaaattgtccaccgatcgctacattgtgttataatcgataaaaaaaaatatttggatcgtagaattcatacgaacggtgttgatttgcatagttttgctattgaaagtgcatcttgttaaaaaaaagtacagtattttcaattggctgacatagttttccaaaagcttcaccaaaggctcattttttttggttttgattagaatttgatgccaacccacataatttcgaacaaacgaaggcaagaatttcttttacgtaatgattcaattcacgtacccccgacccattgagtaaattgagattttagtgtagagcatcgaatgttttagttatttgttataatggacctatgcatgagttcactatttcacgttttagcggtgccgtattatttatgtcaccatggataccaatgaattcggcaccgctcaaacgtcaaatagtgaattcgtgtatcggtgcatagattgctgagccaaaagtcagattcagaagctttaaatgaattgcaaagtgtataatgtgattgcagacaactcagaagtgtcaaaaactttaaactcacaatttcctgaaagatcgaagcaattctcctttgtcgtcttcatttcatttcatctttcataaaaagcgcatataatcaaaaattaacaagtcactgaatctcttcacttgacaaaaagaccaatagcggcttaaacggagttatgaccttaaccattgtactgccattggatcaagatttatgtttcacctgagagaatgctcctgcctacctaggctcgtgaaaggtcccgtccaattaatatcgagtaaggccaataaattttactaaaaagaacagaatgaggtcacgcgaatgcacgcgaaaatgaggggaccagaatcgatcaactttgcccggcctaggctaccgtagtcaggggtgtcagtctagtaggccgtctgactgcctttaccgtcgcgcaggtcaacgagttgctaggtgatacgtcaagtgcttggccaactcggtcttcacgtaacagcatacctgcctgcatgccagccatttcaaaaggcacgacgtaaaatccgtttccagggtgactaataacaataaaatgtatcgctatattgattcaagcgtttgatatgcttctcaccttgatggttatgattaatcgaaaaatttacacgcatcgtgcctgcaacgcactacaaacttagcgacattgttagagaagtggctttgtgccagatcagacctctaagtggagtgagccacagaaccatgggcgtacctagatgggtggcatgggggaatgttctgagtctggtacaaaaaataagatgggattttaagactcctagcaaatatctcatcagctttttttctaggaacctaatcttgctcatgtagctctctgatggacttctcaaaaatcaatcaactcatttcgcgtggtaatgatatacaaattatgattgaaattatgaaaaaataatccacgtgttcaagtgggattcaaacccacggctcctgtttgttagacgagcgctttacccactaagctaccgagccacttgaaggttacactcaaatctcaaagccctcccgcgagagcaaagtcattagagatcatagattgcttacctagtttttgtagcagctcttattcagttttttctcagctttctgattgtgacctcagaattcaaaccaagcagagctcttcggagaaaaaaaagttttcttacgaaattctaaaggcaccaattttttttcagccgatggcggtttggtttcaacgagaactacccattggcaaaatgatcgtgaaattcgtgtatgaattttgaggtcgatcgacaccccctcaatgaaaatccttgctacgcccatgcacaaaacagcgcaaaaaaaaaaaaaacaaagcaaagcacttgtcatggagtgctacgatcgtgggggttggtgtcagatctcgtcactgtctgtcatgcgtcgattactcagttttccaccatcgcaaatcgcgaccggtaacgattgtagattttgagctactgatttcttctagcgcacttccgtctcggacgttgtgtctttggtggcccacaacgatgacggagcaaatttgcatgtagacttgaaggcggagtgatagaagcctagaattagccaaccccttttcggaacgagatctaatttaatggtagccaatcgaagcattcgtatgttattatcgttactgatttcgaacctttccttcgaagtccgtctactcaaaatggatggcaaatttctcgatggctacttcgactagctcttttatggatgggattcaatggtgatcggatttgtagaatggctattccggtccaaatgaagagacggtcaggcggcaaaaggtggccttgatttggcactttcgagcatacattgggtttgttattgcaagaacaatataaacatggtaatggaaaaatcttatttgtttctagcttttgtgttgaaatgaaaatacttttaagccgttaggttcactcaaaccctttcattctaaaacaatgtaacacatagcctaatatcaatacatcatgcctgtattttttgtccataactctttgataacattctgattgaatctctttatctatggttcattcgaaacaaagttaattttacttcttaggtattttaactatacagtttttgaatgttgtttactagatttttatttgaagtagtggcatttttagcggaacttcaatgtaaaatcatgtattttttttgtaggattagattcgattaaatcttaaccataatcttatattctttaaagagcgcttgcaaaatttggatgaaaaatgtttccaaaattaataaaatatgactatatcaagtcatcgcgctaaagtttggggttaccgtaatttctagtgactccaaaagtttgcacgatgacttgaatgacaaatagttttagatagttctcaagatgttttgcaagtgttcttcgaaaaatatatgattaaggttctaatgtcgtgttgatttaaaattttggtcaaaccaatgctaaaaaaacagtattataaaaaattggtcaagatacctactgattacctctactaattgccctcctagaaagtttaaataaggcataaaagaaataaggctcaagaaaactttattcaaccatcagcaataatcaaaaataaaaacaactattttttttgttaaaattcaaagatagcctcataagaatctatcactgcattacacatagcaagtgcaaggcaatgatagatttttataggtagaaattgcttctattttgaaaaaaatggttttggaaattaaaacgatgatggttattttcctctaaaacactttggaatgttatctgagagtgatcacaaaattttgcacgggagtttgtatcctgaaaaaaaaaactccagagttcaatttttcaaaaaaaaaaatcctgttacaaagatactatatattgtgaaacatctctatgttgttgaatgtctcacgagatgtattccagaatgtttgattgtggctcttcgctgctgctgaaaaattaaatcgttccaatttcagcccataaaatccgttcttcacggcaatttttttttattaaggagacaaaaatgagatttttgagataagctaaatcaaagtaaagcaattactctactacacattttatcgctagggataccacagatccaagaaatttgaagttttcaaacagaacttgattgaatcataaatacaatgctcatacataatcaagaatacattgatcgcataaaagaaaatatcgaattttgtaagctctcgcattagacgctgtcacacactttaggctcaaagcaatttttcagctgtcgcagcttaaccacaaacaagaaatcgatttcaataaatattggcgtaaagggggtgattgtaccaaaaagtttgggacactgatgtaagcggtggaatgacataaacgtgcttttaaagatgtattgaataaaattttacatgttaaaggacacaaaaatgatagtattgttatcgaaattacccgtatcagacactaacgtaattgaaatttgacgcaaatttagatcattcgacttgctaatttcatgtgcatccaaaagacgtaacatcacagcccgattactttagtgcaactcaactgcattttactttagttttactcaactgcagtcagtgaactgaatttcctctcaaacaaaatgcccatgtttggagctttgtatctgagcttctggttggccgaatcagatgaaatttaattgaacctgagtttatgtgaattcattacgttcatttatttttcaaaaagcttcagaaaattgttcaaagactaaagcaagcaaccgagatttttgtttgttttaagtcaataacagtgagttgagctggtgtgttttgaaaatttccgtaacttctgaaagtgaatagctttgccgaacaaaccaatcgcctagtgttcaccgtttttaatcaaattgaagaattttttttttacttacttcttcctatcttactatctcttactatctcttaaagacactctgaaaaactttgaaaaatgactgtaatgacgaatcacacatgttcccaataatgagaaattcatctcaataattcaatttattgaaaagaggttttcggactttggtcgcgaaattttgatttctggcccatagtgggctggttggtttttatcgccagcagtactgacgaaggcatttcctccgttgtcccgtctttcattgtctgtgctctcagcgccattcaggtgtttgtcgaagtgctgctgccaactctcgatcacctctcgttcgtccgtcaacattaaatttctcctgtgcaaagtatcacgcatgtactttaacttccaaggctatattagtagaatgttgaaagtcttttcaatacacttcacacgtgttttccttttccacacacgtattttgatttttccacaaacatttcattttttttttttttcggtacggtgtctaagacattgaaaatgggggtgagattgggtcaaggaagaacgacagtgaatgaaatcacaagtcaactcttttggtgtttttacggtgcaatgtgtactattccctcattaagatgtgtttattccttctatatacagcatcgctgaaacatcaaacaagtctagttgaggattccgtgcattgaataacagtgtaacgcattttgacaacttctcaaaccagcaactgtttttcgtgcccaacaacatcgtaaaattttaacaaatggatttttttaaattcaattatatgttagtatttcatattatagaatcatctaacggaagtacaaatgagttggatgtctgaaattccgggactatgacgtcaacatctgcctgaaatgtattgatcgtggaatgtcgcatcgaaatttaacgatttgcgaaggtttagaataatcactgttgcagtaatcctttttgaggaaactgaataggctttatggcaatggagatgagactttgaagacaatttgagggaaaaataaaaaatgtaaacttgacgatagatgctgggtttaaatatttttgctcataacttttacttttttgctataattgttcttttaagtgggtatagcatacttgcatcgtatttcatcgatattttcagctttgaatggttttgcaatcatattctcgataacaagttatttcaattacagtgacccaatgtcaaccctcctatggggtgagattgggtcatttctcatgcacttgtagtgccgcagtgaataaatatttttcttttttttttttggacagttgttaatctaccatcaaaaaatatacaaacaccaaatttaaagtttattggagttaaattgcgatagttattcaataaataaatagtacatatccccaacgacggtataataaaaaaaataaaagcaccaaataagctcaaatcgttttaatagttttgggaggcgactttgtgcacttattaattttacaaaaaatatttgatgatgtcctagctgtggtaatactcgttaacgcttgagaactcacagaattttagagaaagtgagatataaactggacgtattttatgtcgaagcttttattgctgaaatcctattttatcctctataccaaaatctagagtagaagagctaataacaatgctcataaatactatattcagatagcttaaaagcactcatcttagttcgtgaaccatatgacaattgtcgatttacagtaatttgcaatgccgataagttatgcaacactttcttaatgtcatttgccccataagggcacacgccgtatcactgatcggtcatcgcaatcttcggtcgatgatggacctcgtaacctcgtattgggtcgttcgaagcctccaggccgagcacaaagctcttttcgccatatcaactttggcagccatggataatatgcaataagttatgcggcttgctggattaccgatccgatgcacaatgcgattgattggcccctcgatgcaggtgaggaaggttgagtgcggacgaaggcagctattcaaatcgcacgggcacacgcccgatccttcacgagcaccacgattccctgtcgcaaattcgccgagctggccgagtaatacacgtatcaattcaattgatagagagacccctttcggcgacagggatgacgcgatgaaaaatttattgtaattattcaattgacatgtaaatcgtgtgagtaggtaaacaactttatacataaatggctgttgaatgaatggaggtggagatgaagaatcgataacttggaggaacttgaaaaaacacagaactcacagccaggagctgaagccggatttagaaaataattaaaaataatataacaaactgcaacgtgacgacaccgacgaacaattcactaagatggcactgagcttggagatctctaattgcttcataattgcgctgcgattgagggtttgaatgagggtcaagcaatgctcaattcttttttttcccgctggatggattaagtccaatcaattagtaaacattgaatgctaccataacagaatcacttcacacttcatagattgatggaaaggcaatctagtggttgttgaacaaccatagcgcaaaagtcactcactcacttcaattgcccgaataaaaacacttgaacttcatcaacggccttggatggcactggcaaagaaatgctagttcatgagatgaaaatatatgagacaaagatgtttttgcttaaaatagtgctttgttggatcctaaacgaagcttagtatttgaattatttataaccgagttggtcctatttgcatcgttcaggcaaagtgatgtagcgaggcgttggaaatgaccaaatcaaaaggccatagcattgaagttaatcatagagcaggttcctaactacacagctgagctgattctcatcgctcattgcggttacggtaacctgctcgtttgcggatttgactcataaaattttcaacaatccctcgcctgtacgtacgtattaagcatattgctaccaattggcggtcgaaatagttccaagccgccgaaaacgactttcgctccaaaaaacgttttcaagtggtgcaccgaaccgacgaccgacgaccagctatgaatgccgacgtgcttcaatgttgccgcggcctgtgaactgtaaaaaaaggtgcggaggctcaacaccatcagtgaaaaatagaagccaaaaaaaagttgccaacaagcacctagatgttcaattaatttcaatgctgcgtgggcctttaacaccatcgtcattgcactacatctttgtacggaccgtcgtcagcaggtttgtacacttgatgatggaagaggtcactaactgagaagagaagaatgtcggaatcgacttgaacgctttggatgcttttcatttgaatgggcaaagacaatcgaaaaaaataaaacagttcaatgtcaaaataatgaccaaggagctttaaatgaaatttgttacatattttttggcagtaccccatagtttcgaatcgatcacaaactaaaaaactattaccactgttacatttcggtgcaacctcaacatgttccttaagtttgctatgtatttttctaataggctgaacactcgatgactcattgactcaaaaggctacaggttccgacttcaaaatctcaacagcccacacatgaataacccagtagtttaactggcatagtacgcgttttgcatacaagaatcgtggatttgcatcccacctgagcacgtggattttttccgtaattttacttataatacagcggaacaaaaataaatattttcgcttctctctaagatcaaattatgtctccagaatattttgatttgacgaattcgttgccgttctcagaaatattgcagtaggtatgggatggtacacaaattatgtcacgctaaatttcaaatttttcgaccccctcccccccctttgtcacggtttttgtataagccctccgaaaattttatagcaatttttcgagaaaaccactcatatcttatcaggatgaacaatcattctatgattcatgtcttttatatttaaaagttgtgaaaatatcgccacccttcgaaatatgagacatgtttggaatttgaatcgaaacggtataaaattacggttttattgatgttcaaatgaagtctgaactatgatttattaaactttttggtaattctatccactgagcatgcaacataggacttaaacttttatgagatataggagaagtggtggaaaaatcatcacgcatagacgatttagagcataaagtagagtattcgggttgatacggaggtcaattgaattaaaaatatcaacaaaaactaagattttagaaatccaggttttaaaaatacaactgatataattttaggccttgaggttttcccagtggcgtaggtagagttttggaggctgggtgcggaggtagatttgggggtcccccaaatagaggtttgccaaatatgtcttttattaccgaactcacacgaaacttcaacattttttcgaaaacgtttaacatttggaagaaaattttgtgatttaagggttaaaaaaaattactgataaaaatccacccaaacgagggcgtagccagaacttccgtcagaaaatagttattgatgcgacgtttaatgcaatcgaaaaatataaataaagcaattgcttcagaagttcctatatgtttctgtttaatggatcttcttggagctgcatattcttgaataactttcggtattgtaagaggcgaaacagttgcgaaagctgaaaacctatataaaataaaaacacaagaaagcttcttgtatgttgtaggttgtttagtagtttacttacgattattcctagttaaactgtttgaaaacctgtgaaagatatcgtggaacgattcaccagatattttcgtaaaatcgcaggacatattcttaaaattcatgtattgcgcaaatccctgaaattttgttgttatggttttcgatgcagatcaagaagacaatcaagataaaatgtttgtttttattataaatattgtttgataaggaagtcccaatgaatctcgtagaagtatttcagaatataccttaattaaaaaatatcaagaacaaaaaaaatgtttttgaaactccgtaaaaatccttaaatttttagatttttttaaatacttcttataaatgaagtcttagaagaattcttgataaaaactggtagaactgctaaggagtttctgtgggaattgctgcttttattacccgaagaacttttttgtaataatgaacgaacccaagaagggctccctggatgaaaaatggaagacgaatccttgaaaaaatccaggtagaatttttcggaatccatgtagcaaaatatttaacaagcccttatctgtttttaattatgaatcgtggtttacggccaaccagccgagtggaagtttaacaactaccgaaaagctaaacattacatataatttgcaattggattagatggacaaattgatgtgaagatttgcgaaaaagttacacgtcttctcagtgagaatcgaactcacgactccccgatctctagttggggcgcgttaaccactacgccatgagaggactcatgaacgcagaagttaacctgaattcgatttcagctcaataatcacgtggtcctctttcgcaaagtgcacctctttcggaagaattagatgcccatccaaacacaacgctttctatatatatccaatgcctagcccgagagcgcattgttttttagatataggaatagcacactacactagccagcaactgcgctggctgaggtttctattgtgtgggcttccaatgggtcgcgacgttctcaaacgaccggttacggaacatgagtccgttgctcgataaatacttgtttttaattatgaatcgtggtttacggccaaccagccgagtggaagtttaacaactaccgaaaagctaaacattacatataatttgcaattggattagatggacaaattgatgtgaagatttgcgaaaaagctatacgggttctcagtgagaatcgaactcacgactccccgatctctagttggggcgcgttaaccactacgccatgagaggactcatgaacgcagaagttaacctgaattcgatttcagctcaataatcacgtggtcctctttcgcaaagtgcacctctttcggaagaattagatgcccatccaaacacaacgctttctatatatatccaatgcctagcccgagagcgcattgttttttagatataggaatagcacactacactagccagcaactgcgctggctgaggtttctattgtgtgggcttccaatgggtcgcgacgttctcaaacgaccggttacggaacatgagtccgttgctcgataaatacttgtttttaattatgaatcgtggtttacggccaaccagccgagtggaagtttaacaactaccgaaaagctaaacattacatataatttgcaattggattagatggacaaattgatgtgaagatttgcgaaaaagttacacgtcttctcagtgagaatcgaactcacgactccccgatctctagttggggcgcgttaaccactacgccatgagaggactcatgaacgcagaagttaacctgaattcgatttcagctcaataatcacgtggtcctctttcgcaaagtgcacctctttcggaagaattagatgcccatccaaacacaacgctttctatatatatccaatgcctagcccgagagcgcattgttttttagatataggaatagcacactacactagcccttatctatataagaacgccacgtagattttaactgtccatattatagtgattataagcctgaggcatttttttaaattacttaaaaagtcctggtgtcattgctctggatatactgtactgttcctacatgaaactgctgaaaaaagttccctggatttgttgctaatattaattctaaaaaaaatcatctagatgtggttattctgcgcgacgtgtgaggtgagacgagtcgatttaggtgacagttgtcgtctcgctctcatatgattagtcgtctcacgacactcgaggtgagagcgactcctctggactcacccgtcgcgcagaataagctcaaaaatatctgcaaaaaaaaaaaaaaaccgaaagaaatctaaaacgaattcttgcaaatatagcctcgttttttcaacgaaatcttagatgaatctctggatactttaaataaaaaaaatgttggcaaaatccacggaatagtttcatataagttatcaggagaattttttaaaagaaatatcctcatgaattattttaagtcagtcgagaaataatttggatgtttttttagtaggttttattgggtgatttaaagaacaacacctgcaggaaattcattttaaataaaaacataaaattaaaattcgtaaaaattactattttgtttattatttgtttgcaccctaaatatttttcctcgccttgagcctcccaagtggtcccggaaacaaaaaaaaaaaaatatttgcatcagtctgaatagtaaataaaaatcaaaatctttagcttgctcattctaccaaattcatgattatgaatatatctcaaactttttattcttaaaaaaaattacacctttggtctttaactcacgtatgtacctttggtttctgcatcatgtcttatgacaatgagaacggttgagatagtaaaaaattgtgtacaagtaaaaaacccaccaatgcttcagatttttgaagtgctgcaaacttggattgatttgaatacatgaagtattatataaatgaattcaacataaattctcaatcatcaacatcttcaaaataggtatcggagcctacttaagtttccacatcagggccgcgtttatctattagaaggctcagtactttcatgcgcgcaatcggttgaacaacaaaaaggaaaataacttacaaaccaaatatttgtgaaggcccctgaaatgccacggttcactcgaggctctcggctcactctaaacctagggctaaaatataaaaaaatagggataatcaagaggcccctgtacatcacttctccaagtctcctccaaaacatatccttgccatactcattttctttttggtatcttacaaattgtcagtttcctctagctatgtcgatctttttatgctatgagaaatatccgcactgcgattttgaggcccctaggagatcggggcccgatgcggaccgcacccaatgcacccccccgccctagctacgctactgggtttttcagtcagctgaatatcgttataaaatgaggtaaaattttatacctttatatatttttatgaatgggttacctacaattatgtatatattgtcggaaaggcaattgacattttcaaaaataattgttttgctcatatattttgtaggatgttcggtttaccaccaactgctgttcatttaattcacatagggcaggatatattaacatttggatcattttttgctatcgataaaaatatgtaaaataaatacttacactgaattcgtgttgctgcttaagataaaatctttattattgaagttgtgcgatagaactaccacatattcatcgtttttctgttagaaagaagatgatattcttaaggtgttcattttaccaccccttcccctactgttttgtctcaaattccgaccatgactcatattccgaaaacttgctctattatagcgttttttccaagaaaaccattatgatatctttaaaggatgatcatttattctatgattcaactcctctacattcaaaacttcatataacaaacatctgaaattgtcagtcatgtgcagcattggagacaaaacgctagttgtattgaaatcatccgattaacttttgcgttactgacctatttttacattttttctctaattttcataataattttgcactaaaaactacagtgtttttaacaaaatcatgaattaaatatagtatacaaaatatatgatgcatagcggttattttttatcatgcatatcaataacgataaaccattaatcgtcaagtcctaacaacaaactccgctccacgaaaaatgaatcgctcggcatgtgtgctaacgatcaattgttcgcaaaccaaactatattataggatttttaagcatttattccgcgatctgccttctggtttgccatttttgattcgaaagtcaataaggcatggtttgaggggacccgggttctggttcatgttaattgcaacatgttacaatatctgacaaacgatttttcccgcaacaagcagtgcatctgatgctccataaatccttactatgcgcgcgtaatgagttgttcaaatcatgtttctgcaagagcaacggccctcttggaccattcgaatactgtattgttagtcgctagaggtatgattttttccatccttgctcgtgagcaatcgaacaaggtgtgattttttatagtttttcaattgtatatccatcaaatcaacagtaaaatccttaaaatccagaaatttcttcctataagcgcaatcaactctgaacagctctgaacacgttcaagaatcacttaagcatcgtttactcgcaatcattactctgatggtcgcaagcattttgttttgttttaaaattacgtcaatccgatgataataaaccctatcatgcgacacatcaatcttcaacgctgagagtatagaacgatgtatctatctatctatctatctatctatctatctatctatctatctatctatctatctatctagctatctatctatctatctatctatcttctatctatataaataaaaatggaatggtgtttgtatgtcacgaaatggccttgagaacgggtcaaccgatatacacaattctttcacttctgccttctgtaagggttacgacctgttcgtattaaggaaaatattttttggaatatttggtagagcggggaaaaattaatataccattttgtatggttttttgttttttattaaacttttcaacagcctacttgatggcaagacgctgggaccacttacttgatacttgatgggttacaatccgctacgttgaatctacgccgaatggataattcttctccactgggctcggtcctgagccaatcgcttccagtcgccctgaacgttaaggctaagtagcccgtcattcattttggcaacaatgatgacttttcagcttgcatttcaaattgataaaactcagtgttaatagtttatattgacttaaaaaagtatcactttacgcgcttacacgcataaagtatgctgatactttttcagccgtgtcagtgaaaaaccaactgattttctttgattcgaaatcgtgagatgaattagcaatttcaatgacggcctacttcgccttaagtgaccttaagtcctcttcaactgcaaaaagccaacgtgtgtaaggcctaccacgaagccgacggcctcgcccgggttctgtactgaatattatttttgcttgtcgtttttctggcatttgtaccacgtgaccagcccaacgcagcctgccgtgttttatgagcttgataatattcacttctttatagacttcattcattcatgcgacgccgccagatgccattttcttgtttaccgccgagtattgttcgcagcactttacactcaaaaactccaaacgctttccggtcgacctcttttaacgtccaggattcatggccgtataaagcagtgaaggataagtgtcctatatagcgcgaattttgttttcgtctgcaggctacgggacttaagctggttacggagcccgtaaaaagccctattcgcagctgcaaaacgccttttcaccttgcgggtaacatcattatcgcacgtcactaaagtaccaagatacacaaattcttcaactacttcaaatttttcaccatccagcaccacttcactaccaacgtcacgattggaaccacgctgtttaccagcgatcatgtacttagttttgctggtgttgacggtaagtcctcgctgtctccctttgaaaaggcacaaatgcctcttctacggctcgacgatcaattccgattatatcgatatcgtccgcaaaacctaggagcatatgcgaccgggtgacgatggtaccgcttctttgcacgcccgctctccttatagctccttcgagagcaatgttgaacaaaaggttcgaaagcgcatctccttgcttcaatccatctaaggttacgaaggaggttgaagtctaatccgcaacccgcacacttgatttcgatccatccaacgttgcacggatcagtctaatcagtttcgccggaaaaccgtgttctaccattatctgccataactcatttctctttactgaattgtacgccgccttgaaatcaatgaacagatggtgagtctgcaagttgtattcacggaacttatcaaggatttgtctcaaggtaaacatttgatccgtcgttgatcggccctcacgaaaaccagcttggtattcgccgacgaaggactctcaatctgttgaacagaacacacgacattattttgtacgccgaattgaggagcgttattcctctgtaattggcgcactccaatctgtggcccttctcatagagagggtagatgaggccctccagccagctgcttactatcgtgcttgaaaagttcggccgggagctcgtcttttccagcagccttacagttcttcaactccttaatcgctcttctaacctcatctagcgtcgggggctccacagcttgtccatcgttgctgatgattaaggtgaaacagtttggaatcaacttctaagattgtactaaaacttcaaaggcacaaatctcgcgaagaaagcatcccacaacagtgcacttttattattttggctttgagcactagcagaaagcttaaaatatcaggaacgtttgccaactatttcgccagtgttgtgcctttgaaaacgtgagtaggagtagaagtcagccattgcgccggccatctttagattccgagatgtttcaccttaatctgttctcagacgcgctcgagttctctccattcaacaattgctcgaagtgttctttccactgggaccactagtaatcaataaatcattgcaacatagggtcaattaccagtacttccggaaaattgcatatatgaaaaatattcgagatataattatacagatgaaaccttaaagactgaaggcattcgctcgttttttgttataaaagagagggtgttgatttatccatttgagtttaaaacttattttcttaaccttttaatttatatatttttatacatcaacttcaacatctaaagacgaagctctctcattttgggaaatatgaatcttgagaaccacaacggatttaaatccccttcttaggagtacggatttcgattccacacggtacttattgatctctttctaatccattttataaccagtgccttcgattttacgttggactctttggagaaaactataacgggcaatccttcttggacaccgtattgtcaatcatacctagttgctatcacgaaaagcgaaagggtgaatcgatgattctttctaaatagtgagttttcaaactatcaaaaatcgtgtctctggaatggtcgcttttttcaactctgaaatggataatgatatttgcattaaaatggtcaatcagttcgacgcctaagacaattttccaagcagcaaatcaaagtagcatctagcgcaggctgttcgattcaaatgaggaaacaaagggttagtatttctgaatttggtgggtttagataggaaatcttgaactcccttagagaatcaagggttctttccaaagaaagatgattgctgtgttttggtggaaccagatttcgtgacaaaaatatattatgagttcattgcaaaaccttcgaaaaagcacatgtgtgattttaaaaagatgatcgtctattaagggaacatccaataatgaataggagaaaaaagtgtagttcgaacaaacttctaaactgatatgagcgagaacacaacaaatcaactaactgggcgtgaagcttctcagaaaattcttccaaccatgactaatggttagcaagtctgtcttaatcattccttagccaaacctttgcggaagtgtttacaaaatcaagaaagaatcctagtcaagtcaattcaggaaaaaaaaactttgagtccctttgactaagctcctaacatctaaggtcaaaacaacatagccaagtccatggccgaattagctgacttaaaatgaagaacaagttcaaattggcctaatacttacccacactatcaattccataccgagcgtcagtcatccgaaaacaccatttgaatataattgttccgctcatgaagggattaattttagccatcagccgatgtatcgcaacgcctggacggccttgttaccaattcgaaatcattaattcaattaagacgaacgaacgaaccgcagagcggatggatcaagtagggcgagtaggagctgcagatccagatagttccaagcagtgagcttcactatgggtagttgaatctggccaaaaatattttgaaaccttatgtcattttaacaaattttatgatacatattagatgctttgttttcaaaaatcaagcttttgaataaggcctattatagtccatattgcatatttgttagtagatgaaaccccgaatttagtactataccatttaattccactgtatcttttggcagatacgcgtttttagacctcaactgtaaggccgtattcagtgtcgtgtactagactcgagtttttcatctacttaataggtattccactaaacagctcgaagatttatgatatgcatatttgtcacattaatcatttttatcaatttcgagttaataccatggaaagtttctttcaatcaacttactgaaatctgtgagattgttctgttttgtcacatcggtaattgtaatcgcattatagtcacattgagatcacacaggggcctcgtcatatagtagcaacaattttttaataaaaatattttctgattattcaccgaatatgcgatacgagctgtacaatattttcattctcaaataagcacttctttcttggtgatttctagaaattttggtttcttcccatactgccataaaatgcacactgtgtatcccatttactcaatacatacttttgtcaaatgttacaagtaagctatgggcagatcagcaaaactacaaaagatcttttgttcattttacaggaatatcttgctagaagtatttaatgtgcaatgataaacaagaaaaacctatcaaaacaagttatttttttcggattttttgctggactatcgcctatagtgagcttcagtcaattagagaggaaggcaatatcggacgattgaagggagaaaaatgcgaacttcatgaatcgtgagccatggtatgcaaatcaatcattattcatcgccaaattagcgtcagacaggcttctttcggttggaggaagaacaccctcaccacgaggaatgttcctaatcaatttataactttgttggagcctgagtggagctgccagggtcaaggaaaagaggattggaggcggacattgaaataaattagggaaaactcaacggtcatctgggtacggctgccttttgttttgctcataaggggccaaaagcatgagtttcatttaaacgtgccgctgttagctgagatcactttcaacagatttcagcacctcaagggtcacgacgcgaatttttcaatttggcgtgattgatacccacacttgaggaggatctgataattgaatacttaagtggtgatttgaaaagtcatggtgcttaaatggatgtacttattagtgaatatgattctattgggaactgtttccgcaaggtttgagtttggtaacagtgaatcagaggtagatatagttattagggtgattcaaaaatcgtttctagtccacaccgctcatttgatgctagatcacaaatatttcgttcaatcggtcctagtgtttaaccatgtgttcttgaggatactgtttgatacattagtcagctagagcttctccgaagaccgttttcagacgcctcagtaattagttattgacagaataagccattgtaatttgtaatctttttttttattcaaccaaaaaatataggagaaaattgtagaagtttgaacttaaaaattgtatacaggtaatttcgttctttcagttacagtcaccccacgcagttgaatcacccacaatcagagccgtagcgtggcctcatggcgcccttggcgaaccgcgatttgagcgccctttgttcaaagttctttatttttcgcagctttacgtaaacttccagttgattttggaggattttttttactctagggagtttcctgaaattttgttcattaaaattctcaaaaagtaacatgataaagttccagtaatacttacatttgattactttggtaaggcttgtgcaagaagtcatacaacaatttttaaatctcctgtaaaggagaattgtttaaataaccagaggttcttgaagatttttgaagaattgtaaataaaattgatgtttatatgaccagagacgaaagaaacttatggattcattgcacagaacttggcgtcacgtcttttatgtgcctctattaaagtttcaatgaaatgtatacccctgaaaagattattgtagatattgctgatttatttatttctccataaatttttaatgcatttgtccaatatttcaaagaaaatgtccaataaatttcgttgttgtaatttttgatcatattttgctgtctttaaaaggagagttagttggagaatatattcaaaaaagtgcttctttaaagttcaagaatttgtcgaatttgcattgaatcattcaagaatagtttctaagcattcacgtcaaagaaacgtaatgaatttgtatgtagaagttttaaatttacgcaatgattttaagtaaaaagtttgacatttttttctcaggaataactcaaagagaccaaaagaagatcttctatagaagtttgattaaaaatagtataagaaaattaaatgccaaacgttgtaaatcaatgaaattgatattgagcaattctcgctgaaaccaggccgccatcggcacccatcgttagaattccaattttatgtctctgatcgctagctttcgataaaacttaagggtggtcctttttgttttctcaaattggtggacccctcgtacgccagctagctaaacagtttgcaaaaaagcccattttttgataaatcttgggtatttcttcacgtgatatgtctcatatttcccttggaacacataccaaacttaatggcatcgtatagagaaaggatatagctttcatttgaagttaaaaaaaatccggcggccattttgaatttggccgccatcttgaattttgttagaaaaatcgttttttcaccattagcgcaccgctcgttttgaattctgagatcaccatcagaaagctgaggaaaaattgcgtaagataggctacagaaactaggtgtgcaatggtatttaccctatgaaatgaacgattttctaaaacatgttccacgattttgacgtatatggcgagtgcaatcaatgcaaacatcatttttggtacaacaaagatacaagttttcaatagttggtgtatttttcgagtcagatgaagaataggagtattattttgagtgaaaaaatctggcggccatcttggattttgacgccatcttggttttaagtagtagaatgagttttcatcttgataacactcaacatgttgaattttaatgccaccgttacctttactattcttcttgttcttctttttcctgacgttacgtccctactggaatagagccagcccctaagcttcaaaaataaattaacaagtagaattttttaacgcttatttgccacctgaatgattgttgaaaaatagcattaattctttcatttatttggtctaaaaccattgatagaaatgaacaatctgttgaacagctaaaataagataagaaataaagaatctgtttgttttttaacggagatctttaattaattaaacatgaagagcgatgagatggtaaaaaatcattctactgctaaaaactaagatggcgtcgaaatccaagatggccaccagattatccaaactcaaaatgattcacctgagtttcggcattacgtccacattagaacaaagcctgcttctcacctttcaatttcgctatttttcacatgcatgttgggtgttagtaaaaacaatactttatgattcagaaaatcaaggatttttttttgcttaaaaatttaagatttccattctaaattaatgcacttttggaaatgttttacgttaaaactacagatattaccacaaaacttactaatgtcccaacgcacaatttataaacttcattcgatgacaaaaaaagcatatggtaaaaaaaaaatttgtttatttcaatccatgtttttggacggtttttattcattaaatttatttattcataataaccgaattcaaagatatgtcgaagaaatattctgttattaaaaatcgtattataaaagcaaattcctatttaataacctgtatttataactgtaaaggtaagtatcaggctcggttccactagggacgtaacgtcaggaaaatgaagaataataagaagaagagtatacgtaaccttgtttttattggtaacctctaaattcgacatgctgagtgctatcaaggtgaaaaattcattctactagtcaaaatcaagatggcgtcaaaatccaagatggccgccagattttatcactctaaataatactcctattcttcatctgactcgaaaaatacaccaactattgaaaacttgtatctttgttgtacaaaaaatgatgtttgcattgattgcactcgccatatacgtcaaaatcgtggaacatgttttagaaaatcgttcatttcatagggtaaataccattgcacacctagtttctgtagcctatcttacgcaatttttcctcagctttctgatggtgatctcagaattcaaaacgagcggtgcgctaatggtgaaaaaacgatttttctaacaaaattcaagatggcggccaaattcaaaatggccgccggattttttttaacttcaaatgaaagctatatcctttctctatacgatgccattaagtttggtatgtgttccaagggaaatatgagacatatcacgtgaagaaatacccaagatttatcaaaaaatgggcttttttgctaactgtttagctagctggcgtacgaggggtctaccaatttgagaaaacaaaaaggaccacccttaagttttatcgaaagctagcgatcagtgacataaaattggaattctaacgatgggtgccgatggcggcctggtttcagcgagaattgctcattacgaaaaattctgtacgaattcaaacatttatcagtcagttcgaagcagtgtttgggggaaacgaaaaaaaaaactggttttatacaaatatcatattccattgatttcaagggtctgagtcatttggcataaagccatttagcagaaggtcattcggcataacgccatttggcacgaaggacatttggcataaaggtcatttgaaataatagtcatttggtttttaaagttgaaagtcataaagtttttcatgccaaatggcccgctcttgtttttttcacttatattcacttatatcaaagttctataattatctgataatccttttcgggattctataataattttgctcaggattgattcaaatttttctctaaaattctatgcaaatctggattgaggttttgtggaaacattattaatcctgctctaaattctgtgtgggagccgcctagtattttataatattggttatgagttatttataattaattatttgtgaacattatatgccgagttgttaagaattatgcagatattctgtgaaatttttacttccagttggttgaattgtcatattcgtgttgtgatacctaatagctatttttaaagtaggcaccgtgcataagctgatttatcattgtggagaaatattttcaaaaatattgaatgtatttttattaacaaggccgcatctcaggaattttctattgacgaaacattcaacatcttctgagatgcttccaaaatattttgttaaaatcgttattgaaaaagttttaatctaccatgtttatgaatagagctaatattttttataagataaatgatgaaactttgtctgtgacgcaacatgattgtttttctagatattgtgactctagaaacgcgcttactaaatatgtatctctattagagattctctaaggtgcgtcaggcattttggcgccccctgaatcctggcgcccttggcgggtgccaacctggccaaccgcacgctacggcactgcccacaatttatgaatcagctgacttcaaaagacaaaattattattaaatttgtcacaaaacatcacagaattgtttttactgataagaaactatgtgtaaacataattctgtgatgttttgtgacaagtttgataatcattttgtcttttgaaatcagctgattcataaattgtgggtgattcaactgcgtggggtcactgtattttgccaaaaaatcatcgttaatttcttcagttgttctcaccgaaaaaacgtatgactttatcgcaaatttaacttcaatttgttcacttaatttaattacaaagtatagtagtagtgctccgcgaagccttggtaggctttccgcgataaatttgaaaatttgtaccaatgcttgaaaatatctcaactttttgcttgaaaatatgcttttaataatattaaaccaagccatacatagaatttagattgaacttttgtaattgagaggttaatagtattctgtcggcgtatatttgatcaaattttgtatggtatggtatggtatgatattttttcacgaaagaataatttgaaattttcagggtgttcaagttttgttgggatacttatacccgtaaaaatactgagctgaattaactccgatttgtgttgatatttgaaacagtttagaatatctcactcaatatttcctttagtgttgaacttagacttgaaaaaaaaaatgcatttggttacttacttttgtcattgaccgtaaatttcacttcatggtttttgtaggaattactgggtcggtttaagcgtatacaaaatcggatttgaaacggagatgaaaaacaggagcgcaacaattgaatttcaaaatgttctccgcaagcccaaatggatgataacccctgaagtagataaaaggacgtttaaattaaattacagttgactgccatttcctggtaatttgatgacatattttagccaaaaattccagccaaatcgccaaccaaaaaaacgagtgttcgaaatatgagtctgtttagaatttgagacaaaacgatatattgtggcaattgaagattgcatcgatttttgtcttaaattactaattattctattcgatatttggtccagtaatcaacattggatattctatacaactcagggagctacaggatcattttcaaaattttgatttgaattctctgcagagctttcttcctagtattacaacggataatccatattggtacagcatacaacatggctggcttcaaaatttgtttgaaaatcaaaagcttgtttttaagacaatgttttgattttctctcatccctctcatcgtgacaacatgtctaataaagagctttaggtttatgtgggaatattattggttgagctttggaagtatgaagtgcaagtatgaagaaaagtattactgacacaccagtgaagcgtaaagtacatttttaatattactgtcacatcgctgttacattcaaatgcaggaggtttcaaaacattcatttgtgacattcggattgctactgatacatgcttattgcagccataaatgtatcaccagacatggataagagtagcgtgccattcttttcagcataccatgaacgttatgctgtcgtgcatgatgggagtgcaaaatgaatgtaaaaaacaatcacaaagcagctttaattgtagcaagcactcttttcgcgtttgtttctgatccaagttgccacttgatcacagcttgatcgccgcctttagagatcgctcatatattacgtgacgcatcaggggaagatgggagtattccgtcgtgttccgacagttacagtaattcaatacaaccatgatacatttacagctgagcaaaaaagtcacagtcacgcgtgacttttattttcagtatcgcatgaatgtttttgttgcatgaaagtagggtaggtgtaccaattatggatgcaatatgtcaacagtagtgataaaaatcaagttgtaaccgcgtttctaaaacgcaagcatgacttgttggtgtcaattactagtttaaagccttgcgaatctgttgatttaaacagttttagtactaaattgactttaagcttctaaaaatggattttaaaaagcgttgtctttgtaccaattatggcaatagcgttcctagcattcgacataaaagtgtaccaattatggactatcgaatatttgcacgaaatgaactcaaacgccatgaagagcgaatgataatgcaacgctaatatgtaataaagatatcgctcataaaattttcctaaaattttgggttaaatagatgttaaataatttttttgcaatgggttcatgggagaaaattaattttcgaaaaaaaaagtcaaaatgtagtgtaaatgcaaattatgatacaaaacagcattaatgatctcacattacctttccagtgccaatttttatcgaaaaaagagggaaaattcaaaaatcgagtgtcgctgaaaacccctctctgccatgaaattagcatcttccgctagcgaacgttttcgaacgtgtgattgaaaaattttagtaattgagtacaaaacatgaagataatgccttaccgaaccgtcccgtcgtggaagtcacccgtaaaatagctttacttcttttatttcattgatcaaaaaatgtaaacaaaccgccaccagagtattgccataattgggctctcatacactctttgtaccagttatcgacatagatgaaataacacgatttccaactttaaacagtagaattgattgcattccagctaaattgattcatttgttctcactaggcaacatacattcatcggttgaaacagtttatcaggatgaaaacatacatttcgtaacggaggtcccttagccaactgctaagaaggtgacatatatgtgaggcaaaattttcaaatgttcatttttcgaagtttattgcacgaatgttcttttcaaggtttagttaccatcaaaaacaaatagtttaatcattcctgtgaatataagccattatagtctagtgaaacaataagaaaaatctctttttgttcccactattgccataattggtactatagccataattggtacttctaccctagtaatagtcaatgcgtgaatgtcacactcactatagtttttgacggtacattttcgttcactggcagggatgggaaatgtaccttagcaaacatttaccacctcgacattcacatttttcaatacgaccatcaaaatccgaagcaaatcatgtccgttcaaaacaaaaaaaaatgtcacggttcttaaaaactgtaatcttcttcttcccaacttttgttcaaacccgaatgcgaaattactcgagcacagtggtaacacgatttttccggttttcggggtttttacttttgctcggtgaaggcggcataaaattgaacttgtttgtatgtatcgcaacagaatgattgtgctcttgctgttagtagtaatagatttcaattaattgaaaacacaagttagatattagagattgaattatttaacatttttttcgatcattcacctcgggatggctgcctggaaacgatcatagtggagagacaaaaacattcaagtagtgtgtgaaccgtcggcagcgcaacgcctgatggtattgatgctgctgctgctttgtgttttggttgactggcagaatcaatgaactgtggtaaattgtggtcacagttcccaagcctgttcactggtcagtatatagaacacaagggaattcaacttgtaaatgcaggatgaagttgtgaattccgcacatcgtgtcaagactcgtaactgaagtctggtgcgtttttaggttaccaacgagatgtgttttttgttcaaaaactccttagaaaagctatttgtcaaagtcaaacattatttttcgcataacaaaaatacccatttttatgagcaaactgtttatgttggtatcctttactattctgccataggtagaactctaaaaaatcaataatattccaccattctctctctggcattaggttactttagtgatttatccatttatggccaaatttaatgatacaccatcctttcactcccagcaaaaatgaaaagtaaaaagagtattcaaactagtttagattactaaacaaacatgaaccagagttaaatcgtgaatttggaccgcagtcttaagtgtaaattttactctttatagtcgttttactaaaaagtctgatacttttcaaatcatgtacacatatttttcgatccacagcatattgtaaacatttttttccaaatgtttcaattggtaatctcagaataacatattataaaaataatatgtggaaaataaaatcgattttatatacagaagcgttgccagttttgagtatcgtcattgtgctttgagaggtcttccaaaaataaatcgtttgattttctattgtgctttaaatgtgacgtagagactaaataaggaactctatgaaggcgttagtttttcatattacagtgggattccgtttttggcaacaaagtcgaaattttcagttgccaaaaacggaaccgtgccaaaattggaacccttattttaaattttatttttcaactactggttttgaaaacatgattagaatgttattacatcatccttatagaaccatatggcataaagacttctgaacggttcacttcgaagcagttttccgtaatattgtactatgctatggatctatagcgccgaaatgttaattgtggcaaacgttctacatccatgctttttacacctaaacgtctttaatgatttttagaagctttatgtacactatttgtatgagtgggccatgtaaaattaataatcgcaaaagtggcttttatacaagaactgaacattttcctaaaactatgtaagaatacgaaaaaaattaaatgtgttactgtattcatacaaagacgtttttaagtacaaatcaaatgtcctgggtatatatttcgccagaaacactcaaaataccaccacaaattcacattttcccgctaggaattaccaggatgccctagaaatcttaagagtttattaggaatcaccaaatttcgaacttaatccccaataaccaactatacattctcaggatcccacaaaaaaccccaagtatccgctaggaatctgcagacattctcaagaatccgttaaaacttttgataagtcccttaaggactaagaatctcctaaggattctccaggcttcagttaggaaactcatagttccagctcgcaaggaacattttgtttatgttgagacccgtatccttgattataaatcttgtaccgaacccgtctcttaaaaatctaacgtcttaaagaatttccaacaaagagggaacgtagttctaattagttggcgcagaaatattaatatacacactaataccacaaacaaaaagttaaaatactcttaatagtttttatcgcacgcttcaattattgagaataagttgtagtttggactgtgttcgcatttgtgccggtattgaatggaacattgcaattcttaaaaaataatatgcaataaagtaaaatcttcacttttttatggattatatgctgccacttctgcaattcactaaaattaagcaatttattctatgaaattccttaaaagttatgatgcacgacaaattgttgtattttcatttattactgcattgtgtttttcatgcgcaatgtatgtaactccataataataacagtgagctaaaaaggtgacttttagttgtctaatgtgcttgtgctctgttcaaacaagctcttccaaaacaggagagaagtgatttttagtgtaccacctactggtagacccaagtgggctggacacttaataggaatgcctatgagattgatctctagttgagattgtggtggagatgaatggccttatgaaacgttgcgaatgcatgacaaatgaccatcctgaagtaaataagcgcgtacgggaggccttagtagttaatgagatttgtaggaatatcaacgaaaatgaagatctggaatgtaatcggtgtatagttgacctgccattcagataaataaagcgatagacacgataatatttacaaaaagattacaaattttaatgatattcaaaaatgttgccaaaaacggatccattttgttgccaaaatcggggggtgccaaaaatggagcatgccaaaaacggagcatgccaaaaacggaatcccactgtaatactatattagcacttccgtcaaaacgtactttaaaccaaaaaaaaaaaataactgcaaatatcagttccctttatatttaaaatatttttcaccaaagaaaaaggtgaaaaatgattttatgatatctgttaaattgctcctccaaaataacttgatatttttcagcagggttctgattgatgatgctttcaaataacaagccattttgaaaatatacaatatagattgtcgaattatccagcaaatttccaactatcattgaatttgataacctcctaaaattgacctttctaaactttgttccttattcgtgtgaaattcaattatgttggaagattttttattatcacaacattgtgctatatgagtcgaacaatgtacagaaaaccgattgcaatttcattgataaattaaaaagatacagcataaggactgtttattttataaagtggacactttgttcatgctatatttttttagttattgataaaatcgtatttggttttctgtagttaaattattctacaatgatatgaaattataggatcttagaaaatgcttttggttgaagagctaaaaagtttttccatatttcatcctcattttatgttcaaattgtatgttggtattcttaacttttcaactaaatgtagctttaaaacaatgaattatattccacctgacgaattccatccagaataagtcgaaaaaaaaaaaataaaaatcgtgctcgatagtcttcgatttgaattaaattttgcacatgtttttggtatcgtaaaacacgtttccatagaaaaactcatcattttggctcaagtataacttttgaaaatggcctataaatttttgcatgcaacttatttgaaaaattataactacgaaactgttgatttttgagaaaaacgttctatgaagaagttgtagtgaaccgtttggactattagaaaaaaaatatacactgaaataatattttatttattttcataaagaaataaaacttaaattttaaattacacaaaaaccctatacttaatagttttttttaattatcaccagagaatcttgatagttagcagatgtaatggacaatgtttcatgatggagaaatttttaataaatttttttttcttagaataacttttggccgattttaaaaattttgatagttagtcaaaataaatacgttctgatgatacaataacaatcttgaaataattctgaactataatgattatatggataatgtctctagaagtagtcattttcgaattatatcgagtttaattaaaaaatattatttaaattttaaaatgggccgttttcgttagttattcgcgtttctccatcaaggaaaataagttagtgtaaagaaatatggtcttcactctcgaaaacgtattattattgatggcttctgcatgcgggaattatgttcaaaatcaaacaatacttaaaagaaacttcgtcagtgtgtgtgtcttataattagaacatacaataaaagcgccggctgcgtctgaatgcaggtcaatttggggatgagaaggaaatattggtgtgttatttgctttcctgaagccgttgagtcttctacacttccataagaaaacacttggaatttgtaaatgggaaggtgttgtttcaaggaattcgtataggtaaacgaatatcatttgaaatgaacatagatgaccgatactcttttcgtaaccgcagtactggacacgatcggtcttggttatcgtcgtttcgttaactatgcggtcaagggaatcactaccaacagttttgattagttcagtttataaaattagcagactaattataacttacaatgaatgagcaattaatcgcaacatctaacatttcaaatcttcaaacctaaaaaatgcggtatatcttcgttttgcagctccccgttaatggcagaaaaagaaaacgaccttgaatggaacgcagccggtcgacgtctcgtcttgcggttttttttcgtgggtcttgtcttattattgtcagacgtaccaccccctgtttgctgcaacgagtttgagcagagatgatgactattcaagtcaatgctaacggtgaatcaattacgactcttgtgcgtttttttttttttgacatggttaatctccggcatgaaacagcggtttcgcatagaaagcctttgggcgatttgcgataaaatttagtatgctttggatctaccagcgaacgatggagcacttcctggtactaagtggtccaaagctggccctaagtcgaaacaatgaagatcttcctttccatagtattgaatatcaacttccaaaagttttaaatccattggtatatatttcgatttttatattatgttaattgtagaggcgtcaagtgaaattaacacttgcaatttcgtagatcttgttccatcaaaaccattatatctattctcaatcttaacataatctggatgaacagaacttatttaaaaaaatagtcctttctatttctttataagtataatttcgaacataatagtcatttcttttatctaggtgttctgtgtcaggcagaactatcatcctaattagttaaaactacattaagctgttatcaatattttatttacaactttacttcacttgccgtagcataacataatttttacaggtgagttgatttcacctgtttataagagtagaaaaatcgctgttaattatcttaacctgaaattgtaaggcattgatcgtggcaatagtagattgaaacgatttttgtttaaaattattgatgatttgattcgatatttgttccaatgtttcaatattggatacatattcaatgttactcatcagtactatactaggaagggaactttaaaatcattctcaaaattttatcttgaattctctgcagagctttgttcctgatattataacaactagtccatattggtactcaatttaaatttcgaaagttaatttttcatctaactagagatactagtttcttaacttaatctgatcaatttattggaaactctctcatcgtgacaacatatcaacttgaaataaagagctattggcttatgtgggaatactataagttgagttttggaagcattaggagaaaattccatacaaagaatgaaaatttgttgaaaattttaaaagttgatctttttaaaactagttatctgtcacttacacccctttgctagtatccctctcatatattgcaaaattcaaacacaagatttgtttgtccatcgacgattgtatgaactgcagccactgtgtgtcggcggcggccggcgggtgacctgccgaagacgatcgtgaattgtttttttttgtcgattgcagattggcttgcgatgaacgaacgcgcgtacaaatcggatatcagacagtacacaagttgcgaaacagcggcgttgatactcaaaagaaaataaatgcatctggcaaatcgatgcgattacacgatttaagaaaaagataaaagtgaaatccaaacaacttatggaaccgatgagtgggtgaaaattgcctttagagttcgactaatgtgctacatttgtttatccaatgttttcaaaattgattcgaaatgatcacattcataactatctcttttcatttgtggaaacataatagtgagaacctgtttatattaatgatattttattaaacatcgtttaacttatttctttcttttcctcttcatttcagattggtttccataattgacctttgaggcccggcacgcactgataacgaattatttttgaaccggttcgattgcttggagcgcacgcttacataatttagcgaaacagccgatggaaacgtatctccattattgcagtttatctgcttaattctggtggttcaagctggaggaaatacgaaagtatagaaaaataatcggctatcttatccttcatatcactattcatttcgaggatagtataattcaatttttattcgaccttgcaagataataatagcctgtattattcatttagccatgagagtcatggatgtagctagaaaaaggtaaaagggtattaccactctccctatctctgaccgacgaagcaactgatttcgattgattttttcaaaagtttttcttcagtatctatacatagacaaatttaaccttttgaaattttttaaaatctaactataaatcaggcttctgccaaagattctataagaagttattcaaagattttttcaaagtctgcaacgcatcttgcaagaaaactttcaataataactatcatgaaattctccagcatcatctagagagtcatctgaaaataaatatattctggaagaatggtcgaaatatgtgacgagcaatctctctagaaataaactacttcaaatatttttcttgaagtttttccagggattcctccaatgtttactttagcaactttatttagttttccttcagaatcctaagcacaaattactttgtcaggaactcttctgagcatctcacatggatattgcgagaatctttaagattttgcagatttcttcgaaacattaagatttttcaaactgtcacttcaatactccaattaagataccaatttatggctcctcaagacaattctttacatatacatcaagaattttctttagtggggtggggtgtctcaaaatttcacttttcactaacttaaaataatagctaagtttgttacgaaaaaaactttagtatggagagaactgtgagaaataatgttcagatgttgcaccattgtaaaaaaatcagtcactttatattttttcaaataaattatacataccgattttttcaatttttgaaaaactttttcagtacattttcattgtaatgaattgttttccagatcttttccttcacatcatattcgattgaatatgctatgaaaaacgttggaaacatattcaattaattgtttccttaaaattatctcccttcgaacctgctttatctgagaaaagttcaaaacggggctgctaaacagaaaagtcatcgttaaggctcgttaagaattttatgcaaacttcagaaaataataaagacattttgggagtacagatccggagtatgtttcttgtttttcggtttgaatatataaaattgaaataattttgtattacgatgtacaatacgtttttgggatttattgacgttatgaatactacagtgaaacctccatgagtcgatatttaagggaccatcgactcatggaaacatcgagtcatggaacagcaatcctttggaaaactgtttgaagggaccatcatagtaaccatgaaattttgtttccagtatggttcaatgagtcgatatcgatcactgtaaaatcagtctacacgatcgatattccatcaaatataaaatatgattgatttagcagtttggctgtggtggggggtcttgaaaaataaattattttttatatagaaactcaaatatttacaatcaatataaaatttatgaattaaaatgaaaatattatgattatttcaataatcattgactaagctaggaaatgctgaccataagtaggaacatttccatatatttaactttgatcatcatttagtatttaaaattaaacaaaaatctagcgaaggagcatacaaagtgccccgaaagattcaccgaaaaaattctctggattaattacgtccaacacgaaaagctttcgtttaagggaaagcttataaattacgttacgtaaaatttgcccattcccacactctcctctctatgttaaatttttttgtatgaatatttcgatatattttttatggatcatcaccaccgttatgaagatattatttatgtacgacctctacagctagcatagccgatcaagtgaaagattagttagaactgtacttgaaatgattatttttcaagcgtgctaacatttttttttcttttttaaggtccctaatgttcctaggaaaataatacggtcttctatcgcaggtttcaatttttttttcagtggtttgattatccgatgtgaaaaaaaatcgatagtctggataagcgagaccgacctgtgttcctgaaaaacaccacgtgtaattcttggcgcaattctttgaaatgttttgcaaaaaaaaatgtttaataaaccttgaaggactgaaattttttgatgttttttcttaactaatgaattatttctagcgaaaaatctttgcgtcatggtttatgattttttacaatccttggatgagtctttgcaggaattttaatgtttgatgatcctcctggtggccacagaggatcagaataaacaatcattcatccttctgacaaaagacatccaaacataaaaagtcatagggatttagaagtcattcatttgttgttaagtaggtaattaaaaaaaaacaatttgtctagactgatcacttttagagacccctggaatcggtttcgcattgactatgcttgacaaaaatttgcaaggaatggcctccggtaagatttacgtttgcaaaaatatctaccaaccgtacagaaaactgcaacaaaaacatttttcagatgagatgttccgagattccggatccgggtacgactgtggacggatgttttattagggaatgtccattaaccctaaaagcccgacacgaaccttgatttttcaaataaccacaattcagagacttgtggatcaattaatttggaacaaattttgaagtaaatgcggttagttggtcttaaaatacttgggtgagacatcgcccctgacccctcccccttctctttgtaacggaaaaagcgtagacaggaggggtgcaaaattggtttcaaacggatatctcaacatccaaatgggccagaaggttggtgtcttcggcaaagcagttcagcagttcaagggctatctggcagtgaagagtctgattagaaattcatccgcttggtggtgctagtaaaaataaaccttcaatcttctctacctcaatagcttgatgagctagaaggttggtgtcttcggcaaattattcatcagattgaaggctttctggcggtagaggtagaataagaatttatccacttggtggcgttagtaacaaattttcttcaattgttttgatcttaacatgcttatcagctagtccttgtcttcagcaaggttgttcggcatataaagggctatttggcggtgattcgaaattcttgagatacaggcaattgaataatatgcgttactagcttagaatagaaggttgaagtatattgcttgcttgctgaaattttttgcgagattttgctgaattcagcgaaaaaaagggtttgtggaggtgaaaaatcaaagtaagaatttatttgctagctgatcatgatgatgatgataatggtcccaccaaaggtttgaacaagacgatatatcttaagtataattcattgtaatcattttaaccagatttgcaagcaataaacgatttgattatttttacagacataaatagcttcatacgtttccatagtacaggtcggactcgattatccttctcaatatctctccctatgtcgatgatttcttcagtcccttcattcggcatacaatctccttctccatatctcgatgtgattttcattcccgattttttctccatgtgtcgatatgcccattatgatgcagtggggtagtcagtaattatttttaggataattaggggtcttgagaagaaaaaaatgttttgattagcatacacaaaaatcccctttttcaaccccccttctcttacccaagttcaatacagcaaaaccattcatattgtatactgcccataactgcatatttgtcacattcgacatttttaacaatttcgagttaataccggggagagccatcaaatgaaaaatactttcgatcaacttactaaaatccgtgagattgttctagaaaattcgaaaaaaaaataccaagttgtcttgtcccattggcaattgtaaccgcataacagtcacattgagattataaatgaacctcgtaatgcagtggcaacgaaatttctatcagaattattttctgactattcacccaatatacgatataaattgtacaaaatttcagcctcaaataagcacttttgaattcttagtgattttttgaaattttagttccctcctattatgcaatgaaatgcaaacttggtatcccatttactcaatgcctacttttgtcgaatgttacaaatatgcagttatgggcagtataatgcaaaactaaattatctcaaatttatgcataaaaacaggtaaaccaaaaaaagaaatagaaaaacatataccggataatcgagtaaaaaatttcgaataatcgagtccgacctgtataaagcaaaaattaaaatggcaaaatattgcaggtctcaacaataaattttaccagttgaacaaaatcgaatactttgccagaattgataaccccgaagctggtttcaaaactatctgtgacattcgcattttcaagaaattactgacattcgaccagaaaacttactactgatgcataaaatcctccaacaacctaaatacagtactgacccgattctgtcagcctattttaaatttgccaaaaaattgttatcgtcatgttttaccccgtttacattaaaattgatgatgatgtttgatgtcatgcacgcatgggcgtagccagagggggcaatggcaatgctttttatgaagtgttaaaaatcgatattaccaatataagggaggggggagcccctgataaaaaaaaaaatctggctacgcccatgtccatcgccctcttaaatgtccatgtaaccatgtaacacgtcaaaatttgaaaaacgggaacaaaataaaatgacccgattttgtcaggttccccattttgtcagccttaaattcattgaggggctgacaaaatcaggtccttactgtactgaattcaaattataaataatcaaatagtcgttcatatttgtatatcgcgcgctggactcaaagctttgtagactacacacaaaaaggaataacttataactacgtcttcagtgtcatgtacttgtcgagtctagcacacgagactgaagacggccttacagttgaggttgaaataccctatctgtcaaaggatacaatctctaatggaataaaatgatattgtactaaatctggttttcatttatttaaagacatttcaatcagctctaagattcattatcatgccaagatatttaatttcatgctcgtgatcaattgtatcctcattaatttgtattgaaacgtctacaatgattcgattccacgaaatcaacataaatttagttttatttatattcaatttgaactctttatactttaaccaattactcgtaattaagctagtaacaaattttcttcaattgactgtatctcaagaatttcgaatcaccgccagataacccttcatatgaacagctttgccgaagacaccaacctttcagctgataagaatgttaagcgcaacctagcggataaactgtcattcagaattttcacctacttgatatctttgccttgcagttgaagtagagaagattatacatttatttttactagcatcacctagcggatgtattttcaatcaggctcttctcagccagatagtcctacatatgctgaacatctcttccgaagaccaaccttctggctttcaaggttctcaagatacaaacatttaaagaaaatttgctactaacgccacctagtggataaacactcattcaggccctctaccaccagatagccaatctggtgaataactttgccgaagaccccaaccttctagctgataaggtttttgaggtagaaaagattgaacatttgttttactagcgtcatcaagcggatgaatttccaatcagactcttcacttccagatagcccttgaactgctgaatagctttgccgaagacattaatcttctagctgctaaggatcttgagatacagacaattgaagaaaatttgtcattagcgccacctagcgggaaaatcctcaatcaaactcttcaccgccagatagcccttgaactactgaatatctttgccgaagacaccaaccttttagctcatttggatgttgagatatccatttgaaaccaattttgcaaccctcctgtccacgcttttttccgttaccaagagaagggggaggggtcaggggagatgtctcacccaaggattgtaagaccaactaatcgcatttacttcgaattttatttcaaattaattgatctacaagtgtctgaattgtggtcatttataaattcaaggtctcaggctttttaaatttttatgatttttgcatattttcatacaaaaaaatcctaccatgaggggaaggtcatggtaagattcttgtatgaaaatttaaaatattttttatggctcgcaataaatttgaaaccccttcctcccataacttttaaagtaattaattgacatccccttagtatctgttcaacctatgctcctacaattcgaaagatatcttagcatcctctccatgaatttgaaaatatagtgatttgaaggtttagggccattttcaagggatgcattgtttaaaaaaattcccctatgctgcataatttatcattcaaaaaccaatagaataaccatcaggttcatatccaacttttgaaagatattatatctaagcatgaaccccgataatttgaagacatttcattgacggaaacacaagtaacaattaaagtttattttagagtacatttatacgcatacgtcgcatcaaagaattctgtcatcaaaaatatatatttataatattttcacttgacctttgaaaaattaaatatttgggcacgttctctgaaaattttaaaatattttatgagaaggaagcaaattaatcgtgatttgaagattttgacctatcgtcaaaaatatttgaaccatgattttggatcgttgcttaaagatgcaggactaaaagtcaaaacagatgttcgtcaatcgtttacctaaagcatcatccatttattacgtaacgccaaaaattgaatttttttgactacttccctccccctttcgtgaagttttttgtatgaaaattttcaaaatgttgtgcgattcgtaacgctagactgttttcaacgatagctcttgtatcaactgtatacttcacttgagcatatgtagatttttctctattcattgacgattcgagggctgaaacttaggccaataataaataaattcagagcgtttttatggctggaagtacaaataggagtcaacagatgaatataaatatttcaatcttaacttaaattgcattcttttcaagcatcgtctccatgatgttgagaacatctactagagacgaagggaaataaaaactgtggttagcagctgtagactttttaacattttattacgcatttatgacaactcatctttgatcggttttggttattgaatataagaattatattccgaatgacgcagatgaagtatacctactattaaacatgttatttgtggatataggagcatttttgatcatgacccatcctgctgctcgtatttagcttggaaaaaaaaagttcaaccaatgcattcacttaactttttactttttcactcaaaactttctacgtttaacacgaagaaactcgtattagaacaataaaagattaagcaatatattgaactgaaatcgttaaaacgtcatataacgagagttaattattccaaaaaaattgactggcagattgttcacaaaagttaatcattcgtttttataagctgccttaccgactagtttttaagtatgattgttgagaatttgttttgtttttaatagttatacaaaataaatgagagcatgatgattaatccaaagaatgtaatattaagtaataattttgtgtaaatataattttcttccatatggttttccacatgcattgtgaaaatgtccaacaattagttttgccagatctggacatcaaacattgaatattaactatggacataattgataatcacaccacattgggctagcattatgtaaagcaagtatcccccccccccacgataaaacgtcgtttcattttgtgtttcatattaaaaaacatttttgaattatatgttttatgtgtgaaacattgatctaataaatattttgttttcagaaaatgggataacctctgatgagtgtgctactttgaactaaaaatctttaaaatttatccatatttaatgtttccggaataaggtttatctccatttgaaaaaaaaaaacaggttcacagcgcatataaaatatttcaatataggaaaaaagctctaaagccgtctaaaagaaaaagagccgcagaaaacttttgtcaacaaaattgcctagcattcaatggtctacaacattgctgaagcatgtatctataattcctacatataaaaaagttgactttttcatttctatgaaaatggtagtccacatctaatcgcaacgtaacccctacacccctggcttcaccattgataagaatagccgatcaaatttggatatttttttccgtccatgcacgtcaaaattttcacgatctattatatcagaaatgacaagctcactcttgacagctttagtttaaaatacctacgaacgtttagagttatttcaaatgttgaacaagtgatcttcaagatcaagtaggaggcccttcttttgccgtttagcagctaaaaaacgatcagttctgtgtcgcagtgtgtgtggctcgattgtccatgaatacctcaaattagtacaatctgacccgttcgaattgcccacatatacaccctgccggtctttgttgttggctcgttgcggaaagatcataaacaatccgatggttgatcccggtagtttggggactgctttcaagtgcgcgattacgtttgctatccagtggagcattccgaggtaatggcttgctgctaaagttgtaaaaaaagaaaaaagcatttgccaaagccataaagccattccggttcgctgatattgaacgttgaactacaactagtggcccgtatttctttattttggtgcacaacgtggcgtaggaaagtgaaaggaatgtgatccggggaaacgcaacgagcacaaagtgatgaaaataaagaagccaaaagtgttgaaatcgataaaaataaatataaatgctattacgtttgcttgatatttttttggatgggtttattgctttaggttgctgtttgtagtgctagtggtgttcattaacataatcggttcaatattgcagctaaatgagaactacatgaaaatcaagtgagaaattaattgtagtgaggcgaaaatatgagcgtcctccggaggccctttgtggctgtgctggtgctgtgtctcgtgacgtccctactgctggcccagagcaacgatggcggaggaggtaagtcaagtaacctttagtatagataaaagagtgtatgatgatgttttccgaagtttttttttcgatcacaacataaattttattttaatgaaacttgttctcgcagtgatccgatgtgtaaaacttttaaataatgtttcaacttcaaaatcatcaaaattttcatgaaaaataatataaacatttgctgattttgatgattttttcagtataaaatgaaaattacctcaaaaagataaaacacaataattgatttttgaggcgtcagattaaaaaaaaaactattcgatagtgttgcagctgatacatttgttcaatagtatcagattaaaactaatccttaagggcccatggacaaaaattatcaatgattgaatgaactgtttcgtttttccatacaagttgcagattacattttcaaccaattgcgcaagacactcagaagcaaatgagtgttgtggagcaagaacggttcttcgaaccatcctaataaggagcaaaaatgtgtaatttcgctaccattaataaaatatcagagtctcttcatacgctattcatcaaatagtttaatccttctctagattcatcaatgattttacttgtttcaaatttcacatccattctttttatatttagcattacgttacgtcctcattctgcaagagccttcttctctggttagtgtattgagtgcactttccaatgatcttattttagaatattctttgccaaagttgccctttttgcattcgtacctcgtgtgacatcttgctgcaaaaataatgatattttatacccttgggttccttgaaaatttctattaccaaaagatcatggactgaccaagaatcgaactcagccgcagactaatgaaaccacaatgctaatgaaacgcaaaagctaacataatttccatgactctaaagatttcgcatttttttttttgcacaatacaaacacgacccaacacctacaaatcgaacccggccaccatcgtttgagaatgccgtaatgaatcgactagtttggcgtcatcgcttgagaagcatgagtcaattaaatcttacaaagaagggaacaccagtgtcgtccatcctcgggtacgaccataaatctacacacctctaagatcgcttcacacgtcacaacctcgcgccaagcgcctaaccgatatacgtgttgaacgtgatgctgtacgttcgcgcctcatccgatgcggtagatatgctgtttccttctttagaatctaattctgcgagccgcgcccccgtcaatctacctgcttgttgagtcggcaaatttgatgagttcttattcccaatttgcgcaaagtggaaaacgctcacaaaacaaatccggcgtcatctaaacaccacttaggaattattctaggtatatgacttatgggaaaacggcgatgatgataacagagaatcagcactcactctcaattgaatggcatgcatgatttcgaacatgatgaagcactcacgttcagcactaatgatcttggggtgaggcattcatgtccggaccgtgcgtgatgacggcaggggcgtgtataattttgacgcctcgtggagaaatatttacacttcagatgaatgcggtcccaaaaaggaattgcggattctttctacttgggggctcattcaaattggttacggagtttaaatcaacttagacagtgagctgttcggggttgttgaattcggaaacatgtggcttttggtgatggattgtagtgacgtacactgccgtcaagcacacaaaacatacgataaattttcatcttttggctattcaactgtttcttcaagctcgtccaacgtcataggtggctatgatgcgcttagtggctaccacccagctatgttgcagaaatactaagcagaattgcaaatctacttcagatggctaaaacaccaactttctcaatgtaaatcatcatacaaccttctacaatattgttcactatggtatcaagtagtgtttttgacattctgagttcaattgaacgcgatcaacaattttcctgacccgaacaggagatgatgttctatttcccatatgtttgagctgaaattcccatattaacttcaattcaattgcgccagctcatggaacgaccatatgagctgaaattttcaggaagtcttcctcgaagcctaaggaataatcctggggggtgccccgtggaattatacaactttatttttctcccatactgagctgggccagtctagtatacatagtataattcgtagaaaatgggcttatcgttttggctcccaaacaattcttattaagtacataattgctgaaaatcttttaaaccgtttttcttaatagaagtttttttgtcacttacacccctttgcttctaacccatgtggtgtcgtcattgctctatgggcaagggacgcaatctggcgggacaaaattaataacttggtaacgaagcgtttccggtattttgagttttcggcaaagttttttataacaatgaggaccatcttctgacataaacggatagttcgtgaatcatccgcataggttggcgccacaatttaactttttactgtgacgttctagagacttggcatgttcggccacgttgttcattttgatgatataaacagctctttcgagaacgttaaaatttcacagcctactgttttctagttattggcaaagtaagaccaaattagtaaaaaaaaaacgttatttttcatctattttcacatttttcttaagaatcaagcaatgttattgctgatgaaaatataacaaacacaaactctggtggaaaaataataataatacgacccataacaattgagaaataattgaaaaaaaaaaaaaatgaaaaatagagcaatttttgaaccttaaagtgcaaaacatcacaagctcaaattttcaggcaacatagaacaatactagatgaaacggatgtcaaaatttcagagaggtatattttggtgttttcgagatttttttcatttcttacggttttttttttttcattacgcgataaatattttcgtgtcaaatatttaagtgtaatttaaaattagcggaaaaaatatacgttattatttcatgaaattattatatctgcccacaggacaaagccagcttggatttcatctggaattcgtctgttacagtttttgaaagctttccttttaaacgaatcaccggaatttaaacacatgtataagcttaaacagcctaaccgttctcaaagtcaaatcgatacatttcgatctgaatcctcagtttcaaaacatccaaggatcaacgttcttcccaattaaaatcaaacctacaaagtcatgacaagagatcgtgcgctctgaaatttttgtatttagagatatcgacaggaatatgttttaaaatttgattttccgtattaaaagtaacacattctcaaactaaattactcagcttaggccatgatgactacaattaactgacacatgatcacatttttcatggcatactatatcatttgaatcaatgaagaaaaacatacaggtacccagttttaatctacactttcatccacattattcgatatcaactcaaagagctgctctaaaactgaattttatagctaacatgatggcttattcaaacagttttctaaaagtttttgttccgtgacttgttatttataaaagtcgatcgacctttcagatcgactcatggaaacttaactgtatttgagtaatataatcatagtagaaaacatggatatatctcaaaaacaccaatatatacctctctgaaattttgacatacgttttatctagtattgttctatgttgcctgaaaatttgattttttgcgcttttggagattttaaggttaaaaaattactctatttttcaaggtttttcgttatttcttaatttaatacgtcgtattattaaaaattttcaaccagtgtttgtgattgtaatattttcaccaaaaaaaaagaacaacatagttcttaagaaaaatattaaattcggtgaaaaaaatcgttcatttttaactaaagttttcctaataactagacaacagtaggctgtggaattttgatgtctccaagggagttgtttattttatggaaatgaacaactttgccgaacataccaagtctctagaacgtcacagtaaaaatttagattgtggcgtcacctatacggacgatttacgaactatccatttatgtcagtagatggttctctttgttactaaaaactttttcgaatacaccaaatagcctaaacgcttcgttatcgagttattaatttcgttccgccagattgcgtccctggcccatagtgtattgttgaaaaaaatacattataaattaaccgaaaaatgtcatcacagagcgatctagtcgttgttaaaataatcgttataactattttcgactttatacaatagtcctgaaaatttgaattttgcatcaccatgccaatattatgggttggactttgattttgttagtttggagtaatagtgcttagtacgatttacatgaaaacggattttatatgttgtaaaccttgtcatcccctttctttccttttgagtcctctatttattgtaaaccccttttattccttattcagcgtgaaatgaataacaagtgcgatgaagtcatcagttgcattcaacgtgattcgtagtttcattcacgattcggtactaataggggttcagatagcgattgtctattttaactcgaatatttttagaacatcgtttccccgaacgccagttccccgaatgtcagtttgccgaaaagtattttacacttataattgttataaggtaccctggggcgagtgggacctaaaataacgatagtataaacctgagaggtgcggtctctaacattttggccattcaatttgaactcaaatttttctaccagtgctaaccgttgtttgtttgcttttctcgcacacttataatacttcacacatagcttctgcagtttgatgcaggcaataagttaaataaattaactgaatcagatagtatgttagttaaaaatgtatttcacaaaagttctgataaacttacgcatcaataagagcaagtaaacgtttttttttcaacagttgatatttttgtgtctcataaaatgtaaagcagattttgacgtgacgaagtaataaccgcgcacactcctaggcatactcggatcatttgaagaaaattttagcttgacatgagcctggctgcttgttgaaatccagttcgcaccccccaggtttaaacaaattgtcaatataattttcaaaagtcaatattttacaaatccaacattttggcaatatatttgctggtgtgtgcatgaatttgaatgaaaaatttcgaaattgtcaaatgcttagaagaaagttttaaaatgagccattagacgccgttacctcgctaaacgtgacaagtggcacgcatacaatttcatgtgtcaatccacagcagtaagtgaaccattgtaataataggattgaaaaatcatagatttttaattttgatttaatttgatgtacataaggcatgtgcatgataaaaccctcttaacaagctccaaacctgggggacacttttgctatcgaatgctcgggggttgtatatcaagccagtaaaacaaaacacctaccgtaatccggggtaacattgatcagcggggtaacactgatttatcgatggaatgttttcaatgcatgaatgatgattctcttcctactattcataagctaatagtcattaaggtttttgcgaaaattaaattatgttcatgtgtaaatttttcaacttttgacagtgaaaaataaattttataattaagaatgatacgatcaaataatcttgtctcgcatgagttctgagaacaaaatgagcaagataaatgcggttgacactagaaatgatatcgccaaaaacgataccgttgtcaaaaatctaatgaatatgttcagttatgcttcattcacaaatgactataaagaatgataagttttccaacatattgcctacctttaggcgtattccacaattcaaggtgttttagtgttggaataactcaaaaagtacatgacttgtaagagtttggtcttcgtattcggcttcagggaccatgattttagtaggtaatgatattttcaatattaccgaacgtagtgcccatgggtggtcaatgttagcccatatcagctaaataaaaaaatcacttaaaacattttttaaaagatgctgcatacttttaggaaacaaagtacagtatatatacacaagcaatgggtgtcagtacttttgattggttgtcttgaaattttcaagaaatacataaaaatgatcaatgttaccccggattacggtagctcccattggtaaacaagcgggaaaaatggatttgattatcggtctctctttggggctcttgtttgctgcttcttcttctttctggcgttacgtcccaactggaacaaagcctgcttctcagattagttttcttatgagcacttccatagttattaactgagagcttactatgccaatgaccatttttgcatgcgtatatcgtgtggcaggtacgaagatactctatgccctgggaattgagaaaatttccagaccgaaaagatcctcgaccagtgggatttgaacccacaaccctcagcatggtcatgctgaatagctgcgcgtttaccgctacggctatctgggccccttgctgcttctattcatcaaacttgttacaacttgcaatacattgtccatcatggaccgccacagatgggatgtttgtctttgctttaattctgcaatgccttgtcacaattcataatgcaagttgaaaatagcgttgaattgactgttacagtcaccccacagttatggatcagctaagggtcattttcctaaacaaaataagattaaaaaacattctgacgctgtacaaaacaaaattacatacttagcactgcaaaatatatttgtttttgagaatacacctcaaaatacccgattatttaagaaaaagtgtcgatttcgatagaaaatccaaacgatgtttaccccacagatgtggatcagtggatgaggaggatccttattatggatcaaatcgactcatattatggatcagaacactataacagcaatttatctgcgtggcaaacgaatggtgtgctagtgaaagcatacgttttggcgtttgtttcggaatcatcttatcattgattcattactgtggtatggttttcattaccccacagttgtgaatcaacacttccgggaatacggttgacattttatttcctacgcacggcaaaactatgcataagcacattataattgattgcgatgctgtaccgattcatggttcacatatagaaaatgttttctacgtaattacaaatccatttgatgatgatattcccgttttaattcaactctgatccatatctgtgtgctatccataactgtggggtgactgtacaaatagaaatataagtagtagaacgctagtggcgctgttatcacaaaataaaattttattattgttacttacttttgaagtttttgattgattgtttatccagacaaccagaatgcacgtataatgaaatcatcttttgcgttatgcgatgcttatatgtgcaatgtttcacgtataagatgtcgtgaaaaggccttatacgtataaaagtggaggcgatatacgtgcatattttatatgatgaaacatagcattcaatgcgagtgtgtagattttattgcaaactaatctatactcttatgcgacttaatttatgataacaaaatttatttgacagctgctacggattgatccgaattactttgtacgagtatacggaacgaaacaaaatgtacatatgaactcgtaaaatagcgttttatgcgaggaaactcatcgatgaaacgatttcaaccaccatttagtgcggatgtgatgcaatttgtatgagtaaacgactttgttcgtaaactgttatgcgacttctggttgtctgggtagtgccatgttgtatagaatgttttattttggtcgataaaattgatttgacacttatagacccggtactcaaccagtcagagcttggtaaactagatgttcaatggagcacatggtaataaaaataacattatttttgtactcaatgcattccgtaccattgtatcttcgactttctagaaggataccccctcggaaaactagtcccaaatgagctttgatggaaggtcccactttccccggggtaccttaacttcataaattttaaggtgataaacaaacttgtcatctgttatgcacccttatttattatatttatttaacttcctcttcagtattcagtattttattggtggttcttttgagtttatgtcataaaaatcatgatatcagtagttttgcgcttggaaacagccattgaattcaacgttgtatgttttgatttgaaataagaaataatgcaatataatcgtatacgcctgactcataaacttgaaccttcaatcttcggggtggaagtcttgtatattacttcgacaccaacttgaaccgtaaaaaagacataatgttcaaactcaacgacttttcacttcagagtctagagctagagacagtagagccaatccacgacgaaatatatcctccttccgaatgataatctttttttctgattcacaatcctgccattgaaaactattataacacctttttgaactgcataactttccggggaaacgggtcattcggggatatatgtagcattcgtggaaaagggtcattcggggaactgctgctcgggaagacgatattctgggaaaaatagtactaccgcagcttgcaatgcaatttataatatttaacttaaatccataaacgtcctgcacataacatatgcggaactaagaagtgaaagcgagtttcaaacttgtaccaacttccagcagtcggcaagtggtatgtccagtatgtataaaagacatcgaactgtcattgccaatggtaaacaaaaaacatatgattcaagcagtagaccagttggtgcaaaaattgctggtattaagatcgagggacttcgacaacattgggaatcaatgtttgaaaacaaaacttttttattttattcataatatgtaaatattgtcgctcgtcctttccaatactcatgttcaaggatggaaaaaattgcatctagcgactaacagcatagtattagaataatctaagagggccggcgctcttgcagaagcatgagctgatcagcttactacgcgcgcatagtaaggatagggagtcgatgccggttatggaccctttgcgtattatggaccccctacagaaaaacataaaattaacactcaaagcaactttattcctatgaaaatccaccgggggaacttcgactacattgttagtcagcagtttcaggcaaaatatttgatttgagacgcataaatacagatatctgaacagttttgtaaatgaaaccacacaagagggtccagaatacgcattcccaggtgggtccataataggctcgtcggcagcgagccggattacattggaatcaaatggagggtccataatatgcaacgtcaaatttgtaaacaatcctattatggaccccgggagggtccataataggcattcggacaacagtttttcaaatgcatatttcgctggaaaaatcgaatgattttgtatgtttcatagacgtactatgaagtaaagacattgaatttgttgttagactccacaaaacgtatatgcgtctgacatatcattgcggaaaagcgtcttgaatgaattccagctactaaggggtccattactagcattgaaaccctatatggagcatccgatgcactgcttgtcgcgggacaaaccgtttgtcggatgttgaaacaagttgcgattaacatgaatcaaaacgcgttcatggcataatttggcccgattgatctgaaatggcatactagaaggcagatcgcggaattaaagttaaaaaatccgccaaaagttatgactttggtttgcggacaattgatcgttagcacacatgccaagcgattcatttttcgcggagtgaagttttatgttaggacttgacgaccaatgcactatggtccaggaatcagttttacgcggaaagatgcattttgagctttagaatgaaacattagacaaaaacggccttctacaaagttgtttgtattagttaagccctttgtttggttttattgaaaattagggtggaccacatttttataaaaattgtgtaactaactttcttatttgtagaaattatattatacatgcttcagcaaagttgtagaccattcaatttcaagcaactttgccaaaaaaagtttttttgtatctcttaaattgaccgatttagagctttttttctacggtgacatagggtggtccgaacaaaactggttttctggctctagagttttcaattcaaatttctcatcaaagtagtctatgaaacacttttagagctttgaataatgcgtaatttggtgagtgaagaaactcgctatctccttccgtttaggagttattgttgtttatctctcaaaaacatgcctactttgattgtgaatatctctgattggggcaaacataaaaaatatcttttgacggcgttcaaaagacaaaattaaattgtatattatatcaaaaaattacagatgtgttatttttgtaactctaataaaacgtcttgaaagtcaaatattttttatcacaaaaactttaataacttttgaactaaaatcatcatcctcgcgaacttgcaaatcatttgtgctttgtacattgcttcgatcctgcagaagcgaaatgatgccatcgtgaaacagttacgattatataattactgcacgtttatattgcaacatcataagcttcgatcacgctcggattaccgctggggatcaagtttgtcctctcttccaaaccctgctatgctggcgtgattccgcagctgagttttgcactccagcagtagtgtaggcagagcgacctgttcagtgattgctaattgcttcagagcgtacgaattcaacacgtgcttcgggccggctaattacaatctaaaccggattcgattcagagcgacactacttcagacctatggacctgcattattgtccgtactttcaattcgaggcaaatggatttgtttggaaaatttaatgagatactttattgaagtctcctccaaatctactcagcgcaagctccttgacacctaacagacagtaatttaaaatatctcacatttataaactcccagttcgttgagagctctcaaaagaccttgaaggtcgtcgacgctaaaaataaacagaaccatccacttggaaacctcctaatcttccgtcgatgaacaccctcgaagcaccagcactttattaatttatacgaatgattttattaaaccttcgtgcgaacaaaacacatttgttggattgtctttcgagacatctgccgttccgttggaggaggggaaacgctaccgactttggtgctgaaatttgtagcactaatataagggtaatttgactcttaaaagacgtgttaagagttctagctcacaaaaaagattgatgatttgtggtcaagttcgaatacaattcttaattcgactctatattactctgttgttgatatttattttcaggtggaccattatcgtagtgtttgatggaaacgatttcagctcgtagaacgatagagtaatatgaatcacagtcaaaaaagtagattaggaaattccactatgatgagcatgacgacgtttattgcaagcatcacattgcccttgagcgattaatgattcgttcgcaaccttcgatatgagtataggtacatttggaagcattcaaacaaaaataaccatatactagaatttcgttggaatgagacagaaaaaaaatgttttttaactcgatgaaattaaaccgatagcctgatttaattcacccttatcagaaattacaaaattttaatagttagggtaaatgttccaatagtggaggtactaagcacggttcaaccttatttaacccctcaaaatttaagtagcgcaataaatgtatattttatttttgtaatgggaagtaatgaccatttacttgatgagaaaactgatttcatcgcagtaaccatcggcatgtcagtgaaaaataatacctctattattgatacactgttcctttaattgaggtatatttttaatctgtgctcctatgacatattttcttatgacatcctccactaaaggtacactttaccgcaactattggtagaagtgagaaaagtttaagtagttttggtggtattttatcaattttgaagcaatttgaacgatgttttcggttatttcgtgtatcaataagccaatacgtcgattggaggtgtcggatctgcagctaattcaataaaatcagtgtaaatggcactaccgcaactataggaataattaatggatcaattatcatagctaaattattacaagataattctagagcaaactatgtaataaatcataaccaattaggtgttgaattttctacaaaggatagctttatactggtgaattgtctttagcaatatccaaaagcaacatttgatattatttagtttgttttttttttgtttgccttcctgatcaggtatgctttctgaaataaattagtaggttgatggaaacatattaatcactacttcacatcatgcttctaacaaacatgactatgagttctgatcaatggatggttccttgccgtattcgatgaacttaatgacgtcaatacctgaattacgctgcgcatgaataaatagttttgattactactcggtacttgaccactcctttcgcattcttgcaacattccttattataattctttatttgtatcattccaaaacttacatttctttcttacaactacactcccatgcaaaagtttgggtttgttttgtccataactatgtgattacacgtccgattgtaactctttatggcgcattggaaggacaatgagttaatcttacttcgtaggtattttgacatgaacattttttgtaacatgttcactaaaatacttcaagttgtgacacttttcaaaaaaaaaaaaacacgcctaaaaacatggtttttttgcagtattggatcgaccaaaattttaaatcaaataatgaaaaaataatgacgatagcgttatttttcgattttatacgaatttttgttcatagatatgcggctattggtacatcgaccctattagaatcgtaatcttatattttttttcagagcacttgctaaattttggcgaaaataaaactgtaatagtagtttacggaacaagttgcagaatggtgatttttacagcacgagtcgtaaatttatcctacgaggcttgccgagtaggataattacgacaagtgctgtaaaaatcgagttctgcaacgagttacgcacaacattttttgcaatttcgtagaagaccacacgatggtatcataaattatataggaatgcatacactaacatattacattttctgaaaaattgttgtgtaatgattcattacgcaactcaaaacagttgggtaatgagaaagcgttgcgtaatgaatcattacagcactggtttcagttaggtaataactattcccgcactgcatacttcagtgcaggaaagtaggccgttttatgacagattgacgtgatgaaaaacagcctattacgatgagaaattgcaaaaactatttaaaatcaatgaaacagtcattcaagtcaccgtacaaaatttggggttcaccctttaaacctgcccaacctttttgaaccgcgggccaaaacatgtccaacatttttgttaaatgaatgagcaaagtaatttttttttaaatttcagtaagaatccctcttagtattttatgatgattttgcgttttgttaaaaatgtttcttggatacacccaaaaatatttggaaaccatgcacggatttttgtgaaaatttgcttttgacgattctgaggaatcctgctaaaggttctgtgagaattttgccaaagtttcccttaaaactaatatgaaaaattttgtaagagtagagcctagtagctttttgcatgaatatactgtgaattttgtatgagctgtaacatttcgaggacatccacccagcgctatgaaatttgtttacaatgccgtaccaccttttagcatcatatttatttaagcttgattgattgatttaagcttattccggttttgcttaacaaataataaagaaaggcatgtacgattgatgttgtgttttcaatgaaattatgcttactatttaaaatatatggtttcttattatgattctcgatgtgtagcataatttgaacgcaactagggttttatttatttatttatttatttatttattcactggttcaactgacttctatggtcttactgaacaataaaaatcaatcttaatattatatacttcagaacacaataagtttaacagtaaaagaaaaagcattctaaaatcatcacatcgttatgaagaacacatctatatcgcttctaattgaaacgcttcctttttaccaatggactgagcgttatattgccaagtccccgaaaatgcgaacaaaatgtttcttcattacctgcaaacgacttacgcgccactccttactggaggtcgttggcggagattctttcagggatgcccggcctgaaactccaaatctgtgggcgagtctatcgaaactatttcatatcaatcaaggactaactacttcaaaccaaatcaaaatcactcaaaatcacttgctaaaaacattaattaccgttaatttatacgaaaactactttagtgggagcgccacgtccactaatcaattcaaaaacctatttattcgatcgcgcatggtctatttacagaatacaatttatttatgactcattctaattaaatacccggggttttgaaagtataaaatttacctaattaaaattgagctcaattttttaacctacagtaatcactggcctgttttagacccttttcgtttgttcggctgcatagctctgcgacgaccagacggggtgacgaattcgacacctgctgtggggtgttcgcgtcccaagtaacaatattagttttacgaattatttccagggtgctataaataaacgccgataaaaccacggtcaaagtacttctaccttcatcgcatccctcaaaacctcttgtagattagaacgtgactagttggcccactctgaaagaggctatgaagtgcatatttatgttacacaaataaagcaaaatagcatttatggtagctatgttgatgccacctgtactagatgaatgtagcttcatcttgaaaatgattttatcgtaacgtcgatgttgacggatttattccaaaataaataaaacaaaataagattgaaaacacgtctgtgataattaatttcgtagtgccagttaaataattgaagttatttattttgatatagtgatcaaatcattagtgccgagtgagatttacagtgaaatgtgatgaaaaagaagtaaaattgcgagtgccccctctgaaagcggtatatttctagttatttagcatttgctaaaataaaccgtcagtgaagaataaaacatattcagcattttgtggtttgattgggcagtaattgtgcgctaaattatatttagacagtttaataatcctaccatagcatcttatgagcgaattcatggagataatgtgatttgaaaaaagtgaaattgtggcagccggaaagaaattaatatggcgggaccataattgattgattcatcgacaaatgctgttttgtcatcataaaaacacaaataagggcacactgttatgatccggcatttgtggatgtaaaattgccttgataaatgctgatcgaagatgattcagcttttttcgcattttatggtaactaagcagcattcaacaaactttgacagtttgagggtgctgttttgaagaatctatgcaaaaacaatgaaaacagacattagttttgcatttttccatccggaataagtgtttctgagtaataacgcaatgtttatgatgttatgttagtgtggtgagtgatgaacttgcaatgctaatggtgttatcgcatcttacgagcccaaataatgatttgggaggcataaataaggtaagttatcaagattcaagtgaaagttaatcagtttaaaagcagcttttatgacaacaagctgtattatatgagtcttttatcatagccgtcacaagtaaggatcgtttagccacggcaagcagtttaaataaggtattttatgctgcaataaagctggttttgtagccacaatattttgactttatattttgtctctaaaaggttttgaaaacaactaagagctgacttacaaaaaaacatcttttagcaacgttaaatgtcgcctctagctattacagcattcacataactgtcataaaacattaataaatccacacgaatgccaaattgctgtggaattgttacttggggtctcactacgcgaaagatctccgcgcagtatacgctaaacttcctccgctcaaaaatgagtgccgagcgcacaaaatcagcctctcttcatgtagcacagattctgtgcaaagggggctgtacacagttttgtgcaaacggtggtaaaagaaacagaatgagtgaaatgcgcacagaggaggaacgcttggaatgcgaaatttgctcccatttttgttttgcttctgaaaacatttaaaaaacattctaattttgaagtttttcagagattttttcattcgaacagccgaagcggaagcaagtagggaaaaaactttcgcatttacaaccatcttccggcttttcgctagaaaaaatcccagaaaacattccatcggcctgtttgctgccgcgcggaagatgattgacagttccgtttccatcgatccccgcacagccgaaggccaacacgtcggctactcacagaatgagtgcgacctacacagaattttcactcagtcagccagttcggcattggttgcctcattctgtgtagtttaaacacatgcgctgcgtggagcaggcttagcgtgtgtacgcataagcgattcgctcactctctcggcttgacgaagagaggttagaaaccttcggcgcctaatcggaattcggacagaccaatttcccgacgggtggttggacaaatccaacggattggaagcgtctccgagtccttggagtgcgtttgtaatgcggtttgcatatatgtccgtggatctaccgttcactacgattaagctgctagaatcgtcgctcctatctcaattcggaagaatttccgctccgaaactagctcccacgtaaatgggatatctattaacgtgataatcatactatttcgtggagggtcttacctgggtcttcttcactatatttcacacaattggtacctaattaaagccttctcaaataatagtcagataatcatcctacagagaagttttataatttgtcattcaataaggctattaacttttctgtttattggcacttacaatttcttctcttgttccgaattcaccaaattgaactgaaaacgtgttttccacaattgacttgcacataaacgatccgaacaaatcaagcactccaacaaaagtgatttgattttaatatggctattcttatgtagcctcaagaccttagagtaagcattcaaatatatttccgccgtaaaattaacgatctatcgttatctgcagtgtccttgagcggaacaattgcaacaaggaggagttcagaccgacgattagaaaattcagcgcccactggctgacgaacgagaacggcctacgactgagagattttgtcgcctccaaaaatatgggccattcgtagcagctatgttcaacacagcctcccgtatcgttacacctagagatcacctcagaagacaaaatcgcaaatcgaccacgtgatggtgatggtgaaaatgcgccgacggccgccctggtatgaccttgagcggctaaagcaaccggatgtcgcaactgcgtacgcgcagcacctcgaggctgcactactggaagagggtgagctggatgaagcccctcttgaggaccgtttttttatagaattttagcaattctagcaaagctagaaacattcacctaacccggctatctggggagcacatggggtttaggctctgtggttctcacttaacggtctattacggtctactgcggatgcacgtctcgggtgcggtaacagagaaaaaaaaggggaaaacaactctgtaccacgtcacttttctttggcttgggctacaagtccgatgtccccctggaactacctcatgatgttacttcaggaggcagagggcttgttgatgcctctacgcctttgcgccacctcttgctctattcgatccggctgcaatttgtctcttcaacgtcactcacattttggggccgaccacacgcctgggccatgtgagaatttttcgatggatgctgctgtgttttcttgatgcgcttgacttcatttttctgctcgctatgctctacgggcggatcggttggatgtcgaggtcggttttgcgattccggttgaggggtaactttcgattcgcaagcgccccgacgactcaagccggtgatacgcttgcactactcagaatagcccacaacgttggatctttcctactctttccccggcggcggaagatcttccgaaccgatgctatccgggcagatgccgaggtcaatcctgcgattcaggtggaaggaaacatccggttcacaggtgccccgacgatcatttgtcggtgctgttccgcgatctactcagctagtccccgacggtggacttagcctactccgaagataaccgggcagatgccgaggtcggtcctgctattccggtggagggaaacttccggttcacaggcgccccgacgaccatttgctggtgctgtttcgcgatctactcagctagtccccggcggaggatgtagcctactccgactcgatggtggtcgaccaagcgttagggtcggttctgcaattccggttggagagagacttccggttcacaggcgcctcgacgacttattaccgatactacgttacgctcgttctacttggtcaagtccccgacggaagatcgcgcccgattgtctcctctcatcaacaggctgacttatcaagtgccgaggtgggagcttggcttccggttcatcagcgccccgacgtctcgacgtcaagcgttgctctctgcgtctcgtttcgctgctcttctcgccagttgcgctgtaagccagacattatttgcaccaccatgttggtcatcatattccaaagatcgggatctcttatcattccatggaccacaccttctacacggataaaaatctgatccccacaccatgatttacaaatcatgaaattcataaattggttaggtcataatatcaggatcacaaatcatggttcctggagtcataatcatgattcctcataaacgtaacatccagtgtgaaaacactaagcggcgcactttgcttcatctcatttgtatcgatcactcccaaatcaagatgacgaagcggttaagtggtagagtacgtggttcacaatcggaaggttcttggctcgaatctcatgtatgctatttttaacttttttttttattttgtcgataaacggatgcgagactcagcatttttggcatttgaatcatgattccgagcaatcagctacaaaaacctaacgcgtgtgttgcgttacggcaatctgactcatgatataatgagtccaaatcatggtgtattttcataagacgaaaacacgctggaatcattatatcatgagccataatcttgtttttggattctgatttctacccgtgtacactgaagtactcaccaacagcagtcgccaccgtgtttcgttctatgttgaacctcgggcagtcgaagacaacatgttctggcgtttcttcaatctccatacactcaggacagaatggtgaagacgcatggccgaatcgatgcagatactgcttgaagcagccgtgacctgacaagaactgtgtcaggtggaagttcacttctccgagctccctgttcacccaggccgatagattcgagatgagcctgtgggtcaacctgcctttctcggaggcatcccattgttgctgccacttagccagcgaacgaattcttgccaacttccttgcctgcctagtttctctttgctgatagcagtcgatgtcttgtggactgctgaaaaacagtgaaagcatgcatcaccgatacagctgagagcaacgtcgggtacgtgagccggagttgacggaacgcttggttcgacgagaaatgcaggcaggttcttctccttcttggccttacgtcctcactgggacaaagcctgcttctcagcttagtattcttatgagcacttccacagttattaactgagagctttctttgccaaagttgccatttttgaattcgtatatcgtgtggcaggtacaatgataccctacgcccagggaagtcgaggagatttccattgcgaaaagatcctggaccgatcggtagttgaacccagacaccttcagcatggttttgctttgtaggcaggttctggaggtgaattggcaatttgaatgcatcggttgataggcacaatctgggaaacagaacagctaccggaggactggaaggaaggggtaatatgccccatcttcaagaaaggcgacaaatcagattgtgagaactttcgagcggtcaccattctaaatgcggcctacaaagcattatcccagaccatcttccatcgtccatcacctatagcaaacgagttcgtgggaagttatcaagccgacttcgttaaattgtgagaacattcgagcgattaccattctaaacgcgacctacaaagtattatccgagatcatcttccgtcgtttgtcacctgttgtaaacgagttcgtgggaagttaacaagccggtttcgttgacggccgatcgaccacggaccagatcttaactgtatggcaaatcctccaaaactgtcgtgaataccagatcccaacgcatcaccttttcatcgatttcaaaacggcatacgatagtatcgaccgcgtagagctatggaaaatcatagacgagaacagctttcccgggaagctcacgagactgataggagcgacgatggaaggtgtgcaaaattgtgtgaaggtttcaggtgaacattccacttcgtttggatcccgccggggactacgacaagatgatggactttcgtgcctattgttcaatattgcactagaaggtgttatgcggagagccgggcttaacagccagggtacgatgttcacgagatccagtcaatttgtttgcttcgcggatgatatggacattgtcgaccgaccatttggaaatgtggcccctgccacctggcacctgtacacctgcctgaaacgcaaggcagcaaaagttggactggtggtgaatgcggccaagacatagtacatgctagctggtggggccgagcgcgacagtgcttgcctagatagcagtgttacgaaaaactgggatacgttcgaggtagtcgtcgagttcgtctaccttggatccttgctgacggctgacaataacgttagccgtgaaatacggaggcgcatcatcattggaagtcgggcttattatggcctccacaagaagatgtgatcaaaatagattcacacttgcaccaaatgtaccatgtacaaaacgctcataaggccggtagttctctacgggcatggacgatgctcgaggaggacttgcaagcacttgaagtctttgaacgttgggtgagtaggacaatctttggcggtgtgcagggaaaacggtgagtggcggcgaaggatgaaccacgagctcgcccaaatctacggtgaacccagtatccagatggtttccaaatctggaaggatacgatgggcagggcatgttgcaagaatgccggacagcaactttgcaaagattgtgttcgcttcggatccggttggtacaagaaagcttgacgcgcagcaagctaggtggacagatcaagtgtgtatcgatttggcgagcgttgcaacgcgttgggtagaaccgaggatggagagatgcggcacgaaacaagtattgtggcgtgaaattgttgattgagtgttatctgttcagatgttaactaaataaataataatttgatgccgcaacataaataatttaaaataaatagaaatgtgtggagttcttatgactcttattccggacgctttcttatttttgccgcatatgccagacactctggttcttatgtcggacagctcctgaagatcatgtatagaaaaatcaaatcatcaaatgaaatcgtcaaaccactacagggacgtctatggcagttggacgttataaatatgcttaggtatctatctttgaatttgtctcccggtatatcggtctatttcgctcgaagtaagagggagcatggagaagatagcaatgaatactagatggataggtaccgtaagggaaaggcgagagaaattggattagatgttgaagagggcataccatttgaaacagtattaaacagccacaggctgtcctgctattgtcattcaaacgctcccgtattttgttcccttaggggacatatctacaggaaagtatgttgctcagaaaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntactgtttcatatggtataccctcttcaacatctaatctaatttctctcgccgttcccttacggtacctatccatctagtaaccattgctttcttctccatgctccctcttacttcgagcaaaatagaccgatatgccggtcaacaaaattcaaaagtgtagtttattgtattcatcttagaccacgaacctagtgtgatggtaagaacacatggactctataacgccgtagacctgaagacccatcctatcctcgaattatcatttttaatttaagattattgtgacgttttcttctggaagagaacaaaagtctccggtcttgagataagctagcgtaggatcctcctgaaaagattcgatgttatatcaaaactgtacagtgggattccgtttttggcatgctccgtttttggcatgatccatttttggcaccccccgattttggcaacaaaatggatccgtttttggcaacatttttgaaaaccattaaaatatgtacatttttgtaaatatttttgtgtgtgttgctggagtcatttgaattacatgtcaaccccacaccgataacattccagagctcaactttcatcgatattcccccaaatctcaccaactactaagggctcccgtacgcgcgtattatctacgggatggtcattggtcatgcattcgcaagatttcatgaggccaataatctccactagtatctcaactaaaaaccaatttcttttattaggcattcatactgagtgaccagctcacttgagtctgccagtaggtgatacactaaaaaatacttttcttcatatttggcacatgttgtttgagcacaagcacagcacaagagtaacacaaattttatgactcacacagagttctaaattctgtctcaacttttttattattatgaacttacatacattgcgtgtgtaaaaaacacaaacacacagatatgaatacagaaaaatgtcgtttataataacttttaaggaatttcattaaatatattgcgctattctagagatttgcagaagtgtcaacatataatccatgaaaagagtggatatttcattacattctaaatattttttaaggtggaatcaccggcactatgacaaatgcgaacacagttcaaactacactttattctcaaaaatatcattgaagcgtgtgataaaaccgattgacagtgttcttactttatttctgtggtattggtatgtatattgatcattctgcgtcaactatttcgagcaacattccctctttgttagagattctgtaagatgtttgatttgtaaagagacgatccagaattctatataagatttttaatcaaggatacgggtctgaacataataaaaatgttcctcacgagctgggtctatgagaatcctttggggattcaggggattttggggattcctggaggaattctcagaaatgttaacggattcttgatgatatctgcagattactagcggatgctgtgggtttctggtgggatcctgagaatatttatttggttattagggattaggtccaaaatctggttattcctaataaactcataagattgcttacacgctcaaaaaagagttctggaaaacgtgaactgtcaaaaatacaccatggactaccaccaaaggtcacataaacatgatctagttcacggtgtatttttgcttgttgacgagctcatgtctgctgttcacggatacgatttttctgtgtaggcgtcctattattttttttgcgggataatgtagatttctagtgatattttgagaatttctggtaaaatcttggtgatttagaaaaggtttccagaggaatttgaggagtgctagtggtagcctaagaataataaacttttgaaaattttcaccggagacttgagaattttcagcaatatctcagcggaatccaaagatgctatttcctagcaaaatcctgagaattttaggtgaaatcctacgttttcctagcaatatacttcagagtcctagcgatgtcctgtagatcctttacgagcacctgaggattcctatcaggctcttgaggtttcatagcgctatcatgtaaatttctgttgatttcataaggtaaatgtaaaacatatatgaagctcaattataactcatttcaagtaaaaatcatattctacataattacaaaccgcatttatggatcacctcaagtttatgcttatttttgtttgctcttttgactgcagtcaatcattcataatgcaatgctttactttatgagcaacatagattaaagggcaattcttaacttactgaattttgtaaaattttccgctaaagtctaaaagttaaactgatttttaatgttcatcaaccacagcgcttttgttttgtaaatacgtctttgtaagaacacagtaatacattcatttttttcatattcttacacagttttaagaaaatgtcgaattcttgaataaaggtcacttatgcgattattgattgtacgaggcccactcatacaaataggttccaaaacattattgaaaatttttaggcgtaaaaagtatgtacaacgtttgcaccaatatacattacggggctataaattcagagcatattacaaccctacgaaaaactgcttcgaagtgaactgttccgaagtctagatgccaaatgattccataaggatcatataataacattctaatgatgttttcaaaaccaatagttgaaaaataaaatttaaaatatgggtaccgattttggcacggttccgtttttggcaactgaaaatttcgactttgttgccaaaacggaatcccactgtatagaaggaggaatcacaagacctgccctggcaatgactctcaatcgcaacacttagcatcccttcatcagttatttatggtcaaataacaagtttcgctaagttattgctattttcctctgctcctgctggagtgccgcagacagaacgtagtagcatatctgttgaggaacttggaaaacactcagtccaaaccaaatcaaatttcggcatattcatcgcgtcacatcacgacaatatttgactattccacaatagctcattggtcattgatcctttctaccaaatagttcgaaccactgcagaccggtttgccaccgttttgcttcacgacgctaattgctctatggtttgcagagattgttgtcgtcgcatgaaaaatcgagtctaactttgtgaccacaatcaagttttgtttgattaatctgcatttggtttagttcgtttgctaacatgaatcagctttggacacttgttttcggaggaatgatcaaataacgttccacgaatcgtaatcgatcaaccttgacgaagcatggctgaattcgttgcaactgatcgagtgcaaaacgaaacttaactccgatagctccgtttttgttttatataaaaagctttttctaaacagcatgtctcattccattctgcaccccctcttgattagagtgaatggaagacaaattgagtctctaatcgaattcactcagattgcaacacattagtgacttgaaggaagtccgtgttcctgccgattgtgctgggtcatcaatttacaaaaaaaaaaaactcgaagcaacgtcgaattctctgagacaaataaaccgacaatatttatagcggaaaaacgctggataaaacagaaattttgaggtttgcttgcgggtcacaatcaggaagaacgttaatgctcattgatgaaacgataaattgcaatggaatcgtttttgatatgatctatgcacgccgcagtgaatggctataaaattgacgataaacaacgagatttatcaccatgataagactaaatgctctacttggtgggttttggtttctcttctcgtatggtggctctaatttgatttggttgagtttttgtagcagactgcataaattgagatcaagattgttaacgtatatgtcttatcgcatttaattatctttgaagctacgtttggtgtgaaagttggaatgaacttaattcatgttcaaccaaagtgttttatctacgtgccaacaagattcaacttgctacgttccattcatgataggatgctaatgatttatgattaacctactttaggcactagaacaacgacttataatgttagcgtggtgatgttccttcgatgagtagtgccacacaaactgcttttatcaacgacaatcctcaccatctcagttctcgtcgtgagtagtaaacctatactcaaagaggaactgaatgatttatttcactgtggtgtgtatcccattgatggtatgctacaagttactgccggttgattgccaattgactgccgcctgtcgtgccaccgttgcacaaatatttgatgtatgacgcatttaactgcggtaagatgctttacggaattcaaacatagttgatgaggaattgcggtttcccagtgcatctagtgagtgacacacaaaatgtgattaaatgtgtgcaagacacgtctgagcagcgttgagttccggaaagtgatcggtatcgcacgaaccagtagagagcacgatagtttgacccaaattgttaggacgtcttagccctcagtgaaccggatgtgattgataaacgtcggttaagtagtgatggaccccatttttgtcacttctattgattgaatctgtaaagtacattgtcgatagcattgtgtaagttacgtgtatcacggagggtgggtgtagggctgtcaaccacgaacaaagctcgcctaactatcatctctaatgcgtgcacaggtcgaaaacgcgggccaagccagccagcaaaaactgatgcttttcaactctcaaccaacgggatgtctagcagtgttgtgagccacaccagtggcgcgggaagtgggtaggacaggtaggacatgtactacgcacaaaaacacctgggtaggacacttaaaggattgtcctacctacgatccaacaaaaacaaaaacaagatcaacggaaagcttgaaaaacaaactaaattatttatcatctgttcaatatacacgtaaactcgatcaatgtcgtacttattcttatggaggatggaagatacgataaggtttttcattgtattctcatcgataatgacattgttgaatctatagtgaaaatcatggaaatcaaactgtaataattgctacaagaaacttatttaaccgttagaaaaacaaatgcatcactatggcatttcttaattaattaataggtaaattcttaaaaatatatatgatcaaccctgtatttgttctagaacaaattgccgtgagcattcctggaagtaattcttaagaagtttctggagcatccatagagaatcatcagaagattattgaagaatctttggatgaagtaatgaattaatttaataccagttgcatcgtgttatacacagcacgagtgtgatggtgctagcgattcctgaactcttataataatctatcaaagctttgctgaaccttttaacgattttctgagcaatggtttctatttaaatgcaagtctctaatatctcttttttaatagaaggtctttaaggtctttaaaaaaatggtctcctaagtctttttttttgcttactctgcttgcattgaattctgatgaaaaaatgtacagaatccatagaaaccttttgagactataacgggttcaacaggctcttcaagaatttcgtctcagattccctgaggaaatgcttcaggaaacatcatagtgcttttatttagaatacttcgagagtatcctaaagcgatctcttcaagaaatcttctagagctttctctaccaattcttccagcaattttccaaaggattctttgaagaattttctccaaaattttctcttgtaaatccttgagaagtcaaaagctactacctccagtaatttcccaatgtattaccggcattactttgattttttccccaaattatcctagaatttcctccaaatattttttcactaatctttcaaccgagttctccagttgtttttttttctatctttattaactggattttcaggcctcggctacttcatctagggaccaacggttttacttcaccttccgaaggacgtcgccaatataatctttttacgtcataagtgactatcttggggatgggactcgatcccagatcctcggcgttagaggcgtatgttctaaccactacacttggcccgtcccctctccagttgttatttcaggagatctttcaaagatttttatcgaatttttttcgaggaaatcctcaaatgtttattccagagtgttatttttttttttcaagaaaccctgccagaattcgtccgcttgatcgtgtggattgcttcaagaattcatctatgttttattccagaaatcaaaaattccttgaacgaatcctatttttttctggaatttttccgacatttcatcctaggtttattccaacagttttactaaacatttcttaaaaggttccaaaaactctaaatcccatgcaatcttcaaaagtttatttattatttacgtaagttttatcagaggttattctaggactttctttagaatactccaaggatttttttttcagaaaattttccttgatattccccctggaaaaaaacctgaaaaacaaactttcaagacatacttgagaaaaattcacagaattactggagaattgctgattgtattattagagaagtccctagttgaaatcttaattaaatcctgaatgaaaatttcaaaggaaatccctagaaactttttgagaaattattggttgaattttagacgatatttagaaaggaaaattttggaggatctcccagagaaatagaaggatgaaattttggaaaagttcgaactttcttcaaaaatctataaaagaatttttggaggaattcagatgataactcagaagatgaacggtaggcgcacctcgttgcgtataaccacccacaccccccaccccccaccctggtttcgccacattgtgagttatctgaatccatcaaattttagttgtatttgaaacattgtaacgctcagttttcattggaagtttgttcaaacccttttatatattcttaatgccaaaatgccttatagtcagaaaaccgctattgtcgataatatctgccaattatgaggtcattaatattcaataattgctactgactgttgaaaaagggtttgctttcagcaagttgcactggcttcaacataaaaacaaaataagtgcgtattggtaaacacctgggagggaggcaccgatactacacacgaagtatagaacaacgtttgtttgaactgcaagataactccagcttgccaacaacaatcaaggcaggcttggggaaaaccgctagttttcttctgttgtgtactttcgatctttcctgaaaaacatggaaaaagggccacagttttctatgcaccaaatattaattttcattggaaatagtaaaacgatacatttttcaatgcttcatattcaatcagttgaaaggtgctcacgtgacattacttgcattatgtgcatgaattgattttcattcaatttttgtcactttttatgaaaggcgaaaatatgttttaatcagttacgtgctttttccatgttagtccaatgtttgagatctgggctcacagtgacagttcgtgacagcggaatcccggctcactatgacgtacagaaattttgtattggtttctccctcccaggtaaacacctcatcgatgaaaaacaagtaccactattgatcctttaataacctgttgaatgacatcgtgacaatggaaaacgaacagcctgttattttgaacgttcaggggcatgtctaggtatttctctcatccatttatctcgtcctaccttagttgaactgaaaaaatgtaatttcactctaaaacaagttttcaacagaatgcttcaccttgttatcgaccatttgtcgtgtatgatgttaaggtgaaagaaagattttcatccctagttaaatcgccgcttaaagaaagtcacgacatattcatcacataatagtcgaatgcgcatcttaatcactgacggatactgctttaaaaaagatttcaaaatgaagccaaattaatttgatatataacatagattttatgcagattcatccaaaaggttgaacaattcttcataaaattatgtatcatttcaaaatacagtaacagtatgctaaagcaatgaagcatattttcaaaattatgctacagatcagcagctgaatgcaggagaaaaataacgaagatgaatctcattggctcatttatcaaaattttctatcgaatgtcattttaatgctaaaattatctttttgcaatttctcatcgtaataggctgtttttcatcacgccaatctgtcatgaaacggcctactttcctgcactgaagtatgcagtgcgggaatagtcattacctaactgaaaccagtgctgtaatgattcattacgcaacgctttctcgttacgcaactgttttgagttacgtaatgaatcattacacaacaatttttcagaaattgtgaaatgatggtgaatgcattccgatataatttctgataccctcaagtggtcttctacgaaattgcaaaaaatgttgtacgtaactcgttgcagaactcgatttttacagcactcgtcgtaattatcctacttggcaagcctcgtaggataaatttacgactcgtgctgtacaaatcattattcggcaacttgttccgtaaactactattaatataccctattacggggtaaaaaaatcatgtgctgatacttttatcgtatgtttcaaaaataacacgattcactaaattggtccctgcaggaatttcttagcattattttaccaaaattactctttatgtcggctttctcgcccgcatagtgaagtttaaatatgtcgcggatcgttagtgttcgatcttttgttcgcgtcgcttactcttgtgggagtgggcgacaaacatttgttcgttgtacagtgcgacaattgaattatatcgcgaattcggttagtcgtgaaaatatcatggatcgcattaccaactataggcgactaccagattcttaccttatcccactaatacaataccctttccatggtgtccggccatttggccgaatgccgtttgaccgaatgccatttggccgaatgccatttgtccaaacgggtcatttggccgcatgccgtttggccgaattacgaagaagtgtagcattcataagtgtggcaaaataactgatcaactaaataatttgttgatctttacgatgaggcgggcgggatgtcatgtttgttgatatattagtgctccaagagcataattaatacgatccgtttattcacgacgaagttgtgaactcgcgtcaagattctaagctctggatcaccaacggctagggtttagagtgttttttgataatttcatcagaaatgttaccttctttcaaacataggcttttctttcgatttttactggtttcattattattggcaataatttagctaatacattcaaagagaattttaccttctttaaatcatcggcagttctttgtagttatacttgctaaatattaataaatttactaagtacgatcatgattgaagcaaaccgatactacagaaggacgaaaaagtcgtaaaccgtttaagtaactatcaaaagctgactacaaatgcaatgcgaaaccctatgctgccagctatttccgctagcaaagaagtgaataattgcttacatttaggatgctcttctaaactgttctttgaaattaattaaaaaattcatgctaattgtagttcactattgtgttaaaattcggccaaacggcattcggccaaatggcgttcggccaaacggcattccgccaaatggcattcggccaaatgacccggaacccctttccatgataactatagagatgcagaagtatattcggtatctagtaagaatggttgtttaactaacatttcttcccttccacgacggccgtaaggacacgtccttacaccatggtcggcatcgttattgacttttaaaatttgagatctcgatttgtgcccattgagaagactaagctaatcccaagcctcaatcaaaaattgctctggtcaatcacggagtagtcactacaaattttacggttatctttgctcatgcttcgaagttgaatactttctcctaaaacttaagataactgactaccaatattcgtaaatagaagagatagaatatattaaattgtgatcttcttttatcttttaaggtatgtatcgattaacttttggagaatatgaaaaaaggtgcaatcaggtaaagcgatcattttttgtgaacaaaaaatatgtaagttttaagttgaattagtgattttaggatcctgcagcaaagcatagaaagctgacagtacacactcaatctgttcggtaaaaataactgggttttggaactaccgaaagagtcagtaaactaaaataaaatgtcagaaatcgaaaaacagagatttttcactgaaattttgcagagagctttctttttatatcatatatcgataaaaaaaatataacatgctgaaatttgcttttcaattacgcgcggcgacagttttcattttactgactttttctgtagttccaaaacccagtaaaattttagcgacctcagtaatttaatctaagtgtgtataaccaccagttacaaacctataaatcataagctattttttcaacgaccaaatatttggaaatccaacacctgataactatatggttatctagaacgaatctcagtaccgtaatccgggttaacattgatcagggtttttgatatttcttaactaagtgaaaattgcaagctttatattattcaaaacagtaatggcatccacagctcatgattggatatcgtattttggtggcacaatttttttagcgtgttttaataaatgttgaagttgatttttctatttggctgatatagggtaatgttgatcgcccatataaacaaatttgatacgattttgaattaccattaaccacatacatggcctctgaagccgaatatgtaggccaaatacttacaaatcctgaattatttgagttttgtattgcaatgtataatcagcgaaaaacgccttcaagttgttagaatcgtaaggtaaatctgtattttaaccgtttcaaattcatttattttgctgaattgaaattatttataaatatattttataaaaccatcttcagtgatttgagtagttaaataaaatttcacctctatatcattgacggaatcaatagaagacatttcacagatagaattttttggattatgaaaatgtagaccaaatactgatctctagtgtgaaaaaatccgaaacatagcatgttttgccgaaagttagttcaccgtaaccgagatcttggtaagagaattgatttcagtaaataattaaaatgatatcaattgttgaattgtcgggtaccttccctagccgattgtgctattttccccgaatgtcgttttcccaaatgtcacttttcgccgacaagtgatgcaggtaaaaaatgtaccagattagtatttagttatagagtggtaaactagaaagcttagcttagcttagactgactacacgttcgaaaccatgggtaggacaaacataggcaaatattttgtgcacagtgaagttaagaaaaaaaaaaaacaatggacaaaaaattgaaagttcctatatttaaggggctcaaacgtaagggagttgattgagcaagcggtaaactcgtgcatgggtccataattgaaaaacactgctgagttcacgaaaacaaactaggagtgtagattcattcatgaattcctccaagaattcctcttaacccgtataggcctgagtgaaagcaaaaatgctaaaaccttcaccgctcagcgaattcttacgaagcatatggtccttagcactcgaagttcgaaaacctcaagagcttgtaagtcttcctcgagcattgtccaagtttcatgtccgctttcatgagcattttatacatcgttcatttggcggggggttgtaattttgttgaccgcagtttcttctggagcccatagtaggcatgacttccacagatgatgcgaccctttttgtaaatagggcgtacaacactttgccttcacttcgccggtagttctatctatagattgattctgactatcagcctatgcttacaagcggttatggggaccaaatagccgcagccattcagcaagaccaagctgagggttgtgggttagaatcccaaggatctattcgggttaaatattttatcgactacccagggaaaagagattgttcgtacctgcgacatgatatacacatgctaaaatggtcaatcggcagagtaaactctcagttaataactgtggaagtgctcataagaacactaagctgagaagcaggctctgtcaaaaagggacgtaatgccaccaacatgcgggcccatattgatggctccgaaaccatccttgccaacggcaacggtttccactgtccgctgtgctgacatagacatcatcttcgttgtcttgaccccctgtgcctgtgttctctacgccattcaggtattcatcgtagtgctgcttccacctttcgatcacatcgtatccgtgcgtcaagatgctcccatccttatccctgcacatttcagcttgcagcatgaagccttcgctgatgcgtcgagcttctgatagaactgccgcgttactggagaacggtacagcaactccatctcttgacattccacctattccacgcggcgctttgtgtcctagaataggagcgtttgctttagtctgtaccgttccacgttttgtgccatgaactagaatactaacatcaaaatagctttttggaagcttacatagctgcaccggaggcggtaaaatacttagcctatcatcctgcagattgcgctggtgaatgcattcttcacattcaaagtgactaccacgcagtaacttccagtccaattttgtatgtaacagctttactcagagcgtataataacatgagagtcaataggagtaaactttcaaataacccaaaattttaattgaaagccaaatggcttctgtcgtttaacgttatgaaacgttcctcccttcaaggagattgattctaaaataataggggtggcaaccgaaaccatctaatcaatcgaacacagacctagcccccctctagcacaataaagctgtctgcagcataggtccctctatgatcgcacggttcgaccacgcggtagatggctgattttggagccgttaggcataaaaagcgcgtccgatggggatttgatcgatataagcaaaaagataatgaatttttcattcatcttgacacatcagatgattgtttttttttcgggcatggcttggggaagactgacatggtaacgcaaaaaaaaaaaacattaattcaagttgattcttctcttttgttagtatcatactcgattgtttcatgtgatccgatggcggtgagatataaaggggtattgacagtgctttggcgaattccatcaaatagctcagttgtcaattttgataagtttgtagtatgtttcacttggatcgtacttaacattggttggacatgctgtcaaacaagtgttgctacattttaatggggcactgtaacaaattttggatgatcattcaacaataatatgagtatttttttttattagtttccttttaaaattccttattcaaataatcaccataaccgaattacgtttacactgtaaaacggtttgcaaatttttactgtttactgtgactaagtaccaaatgcagctatcattagaagcaaatgtccagcacaggacaggtgagccgttcaatcattctcatccagtgcacttcagaccagtcgatcaagcacatagaacgaacaaatcgcagaagtattccattctcaatatttgcgcgtaagactggttcaacgaattgaacattgaatttctggatttgagaaagggagtcttctcaataagattaacatttcattagaataaagcggggcaaaagatcgagtgaaacaaaagtttcaagatatctagctcaattcaaaaaaatattataaatgtcatggtgattcgaatgctgttcaagtaagagactttctcaccaaatattataaaaatgagatttggaataattttgactatttgttggttctcgatgtgaaaatcatacttttcggccgaactttccttgcatggaacgaaaaatgtaaatttattttttatgtgagcgcgctggaaggcctatcaaaagggggtttaagtttattagtatttgtataaatgcttggataccatttttgaccaacagtagggtaaaatatcgatccatatactatctcggagcttaatgttcggtatttgtgaattatcaatccaaatcctacttacgtttagtggtttttacttaaacgggctctgaaccagtctgctttgcacggatgaattatggaattaaaaatgcagcgcgccctctccaacctttcaagcgcaaccactgcacgccatatctgtggcgatgaccagaggctaccaccatcaagctttgccagagccgacaatcgaagcttttatgtttcaattaattagcgaatcaaaatgtgcgaccgtcacatcacacactttttttttcttgttcgttctgctacgacttaactcagaacatgttcgacttgggcttcgggtacctatgatttgccgtttcgatcggacagagaacgtttgcccgtagaaagggagagctgggccgaagcaaagcttgagttatagtcagttgcgttcgttaaaatagtttggatctgaatatttgtcatatttttgcgcacggtccggattgaggttaagcaatacttgcagttaattaaatgtgggttttgttgcttgattcagtcgttgtctggtaatgcgtttaattgtttaatcttaatgacttgggctgcatacaacaggttttatttaagaaatccataacaattcaacaaccattgagaaggccgtgggttcaaatctcactgacgtaggatctttccgagtcggagattttctggcatgttaaatgagaataaatgacactgaaaaaacttgcaagtggtagtccaaatacgcgtatctgtcaaatgattagtaattagtgcggaattgaaaggttgggcacctaaaaggaaaggaaggaaaggagttgggttctaaatgttaactacaaatagcagttaagccgatttcatactctgtttttttttgttcctattagtttccgatgtgttgcaaataacgttgtgttcatttgggcgacaccttatgtccttacctccagatctgcacatacgataattatcaataatcaataatttttaagaagcaatatgaatttgcaaatcaattcacatgaattcggctccgttatgcctcacggcgcttgagcctaccaaataaatgttctagtaaaaaaatggtaatatcaataactaaaaaacaatgttgaacacctacagtacgtaggtattgtaatattgtctaactgaaatccaaacattaaactacatacaataaaatgacccctgctagtcaaatttgcacttctaagaactggttccacagaaaagaacgattccttatcaacagtctcctcttacactcctcggatcctacgggctaatcaaatcaaataaaatgctgaacataagcatcattagctcgaataatatttattcaattaataatcacaaatcgtacggttccccggtggcaaagattactttcaaatttcaaatatacgatcacaaaatccttggacatttcatgcgctcgagacagaattagacagtcccattctattgatacacctcaatggacgtttgcgcctaatagactcacatcgacacagtgtccaatttgcggtatgtcatgcgtgattgctttttattttttctccatccacttcgatctttatggtgtgccaatgttcatgagctctccacggcacatgtgaccgaaaatcaagttcgacggcaccgcacagtggttccgcttgtgctatgaagtggtcataaattgtatgatgcaatatctgatgataaatttcatcagaagttgccaagtcaaatgtgctgtgaatatctgtgcgcatcgtaccctcgttctgtgcgtacatacattctttctgctctcggaagtttttaaagctgtcgaaaactataaaacagtacttttcagtgctaaggaaacagtacttttcagtactattttttgtactattgatccgctttcgattattgtatggacccgtgccttcgatttttcgattttcgattgcttttgcttttcgattttcgattgcttttgcatttgcttctgcaaaccttgagcgtctgtactccatgttaggagcggctcacaacagcgtctgttccccatgtcaggggcggctgatcatcgtccaagtgccagagaaggactctaagctaaactgcgcactatggtcctccgaacatttagggggaatggtcctccggaaatctagggggttggtgtcaggccctgcaagccagccgtaaaaaaatcaagcaacgaataatcaacgagagaatacgaaccgggacaatcggcgaagaccacagcgacgtaaagggactagcgattggaagctcggtacgtggaactgtaaatctctcaacttcatcgggagcacacgcatactcgccgacgcgcagcatcgtagcgttgcaggaagtgtgttggaagggatcaatggtgcgaacgtttagaggtaaccataccatctaccagagctgcggcaatacaaataagctgggaacagctttcatagtgatgggtgatatgcagaggtgcgtgatcgggtggtggccgatcaatgagagaatgtgcaagttgaggatcaaagggcggttcttcaacttcagcataataaacgtgcacagccctcactccggaagcactgatgatgataaagacgctttttacgcgcagcttgaacgcgaatacgacagttgcccaagccacgacgtcaaaatcatcataggagatctaaacgctcaggttggccaggaggaggaattcagaccgacgattggaaagttcagcgcccaccggctgacgaacgaaaacggcctacgactaattgattttgcctccaagaatatggccattcgtagcacctacttccagcacagccttccgtaccgatacacctggagatcaccacagcagacaaaatcgcaaatcgaccacgttctgattgatggtcggcacttctccgacattatcgacgtcaggacctatcgtggcgctaacatcgactctgaccactatctggtgatggtcaaactgcgcccaaaactctccgtcgttaacaacgtacggtaccgacggccgccccggtatgacctagagcggctcaagcaaccggatgtcgcaggactgctggagaacagtaaaagcagtcatcaacgattcagctgagagcaacgtcgggtacgtgggacggagtcgacggaacgattggttcgacgaggagtgccaggaggttttgaaggagaagaatgcagcagcaagggacccggcagaacgtggaacgctataaacggaaacggcagcagcagacccgcctctttcgggagaaaaaacgccgcctggaggagacggagtgcgaggagatggaacagcagtgccggtctcaggaaacgcgtaggttctatcagaagctcagcgcatcccgcaacggcttcgtgccgcgagccgagatgtgcagggataaggatgggagcattctgacggacgagcgtgaggtgatcgaaaggtggaagcagcacttcgacgagcacctgaatgatgctgagagcacaggcaatgaaagacgggacaacggaggaaatgccttcgtcagtactgcggaagatggaaaccaaccagcccccactttgagggaggttaaggatgccattcaccagctcaagaacaataaagctgctggtaaggatggtatcggagctgaactcataaagatgggtccggaaaggctgtctgtttgtctgcaccggctgataggcacaatctgggaaacagaacagctaccggaggagtggaaggaaggggtaatctgccgcatctacaagaaaggcgacaagttagattgtgagaactttcgagcgatcaccattctaaatgcggcctacaaagtattatcccagatcatcttccgtcgtctgtcacccatagtaaacgagttcgtgggaagttatcaagccggcttcgttaacggccgatcgacaacggaccagatctttactgtacggcaaatcctccaaaaatgtcgtgaataccaggtcccagcgcatcaccttttcatcgatttcaaggcggcatacgacagtatcgaccgcgtatagctatggaaaatcatggacgagaacagctttcccgggaagctcacgagactgataagagcgacgattgaaggtgtgcaaaattatgtgaaggtttcaggcgaacactccagttcgtttgaatcccaccggggactacgactaggtgatggactctcgtgcctgttgttcaatattgcgctagaaggtgttatgcggagagccgggcttaacagccggggtacgatttttacgagatccggacaattcgtttgcttcgcggatgatatggacatcgtcggccgaacatttgaaaaagtggcagacctgtacacccgcctgaaacgcaaggcagcaaaagttggactggtggtgaatgaggccaagacaaagtacatgctagctggtggggccgagcgcgacagggctcgcctaggtagcagtgttacgatagacggggatacgttcgaggtggtcgacgagttcgtctaccttggatccttgctgacggctgacaataacgttagccgtgaaatacggaggcgcatcatcagtgaaagttgggcctactatggcctccagaagaagctgcggtcaaaaaagattcacgcccgcaccaaatgtaccatgtacaaaacgctcataaggccggtagtcctctacgggcatgaaacgtggacgatgttcgaggaggacctgcaagcacttggagtcttcgaacgtcgggtgcttaggacgatcttcggcggtgtgcaggagaacggtggccaaagctgtaaggatacgatgggcagggcatgttgcaagaatgccggacagcaaccctgcaaatatggtattcgcttcggatccggttggtacaagaaggcgtggagcgcagcgagctaggtaggcggatcaagtgcgtatcgatttggcgagcgtggggcagaaccgaggatggagagatgcggccacgaaccgagtattgtggcgtgaaattgttgattcagtgttatctgtgtagatgttaactaaataaatgaaatgaatgaagcaccatatttttacttatgacaacaaatctgaacgtttgttcaaagtcgtcttgaaaggtctctcaagtgactataagtcacctgaagagatcaaaaatggaataaatgatttacttggattatccccagtctaagaaatcattatgaaaaaaaaaacaatctggcattcttcggaaagggctttctcaagaatattatttagttacctttaataaaaaaagatctaaataatcttaaagctttagaaaaagcaagacttatgttcgatgtccgtgtgacatgggaacatttccagaaacctagaggaaatttccagaaccccacttagtgccgtcggtgccaaaagtgggatcatggaacaaaacattgccacatggatgctaaatgcatgatttgcggaggttctactcacgctaaggaagtctgtcctgtgaaggatgataccactaagtttgaatgcgggggcaaccataagtctaacttttgagatttcccttcccacaaacaagtggttgagcctggattccccaggcaaaatcttcaattattctcgtttttcagtttacgattgctttcttaataatcattcttaataggtaaatcataatcatgctcatttacaagctaattttcttctgtcgggtaaccgttcgaatcttttaatttcgaatggatgtgcccaagggaaaacctctgccaatactgtcgcaggtagtttcagttcctcatcccctttatattgcctttctacgagtaaccgttctaattgttccaattcgaatagaaatacctctgccaccgcaggtaatttctgttccacctcttcatcaacggaatagcccaacaaaaaattatcagaaaattcacctacttcttgtaaaatgtctccctctgattttgatttttgaactgaacaattgaatccggggcccagatagccgtagcggtaaacgcgcagctattcagcatgaccatgctgagggtcatgggttcgaatcccgctggtcgaggaacttttcgtaaaggaaattttctcgattcccagggcatagagtatcttcgtacctgccacacgatatacacatgcaaaaatggtcaatcggcaaagaaagctctcagttaataactgtggaagtgctcataagaacactaatctgagaagcaggctttgtcccagttgagacgtaatgccagaaagaagaagaattgaatcaaatgtttgatgcaatgttcaaaacctgagagagactcgcgaagaggaaaaatatcaacgtcatatgcagcccagattcccctctcacgaaacgtcaaatgcagccaaccgtttttatggctgaaaaagtgaaaagtattgtgttcaaagtaaactgttattaaaaacctcagtcggcggagcagttttttccaaagttgctgataaatctaagcagaagactaattatttcaaatgtctgctacgtttgctggcatgaaatttcactcaaatggctatttatgattcgatgtgatgcaaacttaatcattttttgctgagaggttcatgtgaggatttgaacagcatgcgcataattggtatgcgcatgcgcataattggtatgcgcatgcgcataattggtatgcacaaagtggaataagaaaaaaactcagcaatcacagaaaaagaagaccgtcttcgcgagtctcgtctcagttcaaaaccacctaaaactgagcagtaggccattcataatttttgaaatttctaaaagttaaaaattcgttattctaaagtgctcgttttggtgaaaaaaaacgtgtaaaattatgaagtccgtattttaacgttaagtggtcctccaacggcccaaaggtatcaggtatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagtggacccttgtatggccttatggtgggaatgcatgtgaaaccatctgatcgccaagtggtgattcaattcgatgaaggtgcaagacacaaaactgggagcagccaattttccactcaatttgcatggattttgttagcatctaaaacagaagccccgacaacgacgacgacgacggcttgtttggagtgatccagtgtatgtctggttgaaaatgacattgagttctaatcgtttgcatctctagcggggtctcgatggctgttgacatttattcatgtacattctccctgtgaattcattattcgtcatcgtggttccagatttttttgaaagttggcaagcttttacatcttaaacagtttatttctgtttttcacaagtttttttttatgatattagaaattatgtttgcatcaatttttagaggcttaatttcaaatcagtgtacatagttatttttttcctttacatgatacttgatgggccacaatccgttacgttgattctatgccgaagggataatttttctccactgagcttgtgcttaaaatttttgctaaaatcttcttcgctctttgtaaaaaaacatgattcgcaacacttcacgagagtatgtttatcaattaatactacagctctgattaaatccggggggggggtgtatttgataacagtgcaacataaaacccatctaaacaagcaataaacctgaaagcactattgatatatacagttaaaaataatgaagattacacgtcatgtaaacttcatttatgcaatgtaaacatgacgtcatgtaaatttaagtcggaaatcatgtaaaaatgtgttatatgtcatgtaaccactcataattctgctgcattacatgacatataatcgaagtttacatgacatatcatgtaaatatccatgatactccacgctccaattatgtgcattatatgtctcagaaatttacacgtttcgtttgaactgtgtagccagtaaagtaaaacacctttccccaatggtaagtaagcgagaatcatgggtttcaacatcactctctctttggagctctccatccacatcgagctcttgagagcgagctctgaaatgcctggcaatattaaaactgatattcaaaaatgcattgaatgctttgattatgttcgacgttcattattcgacaaaaacgccataggagttttactttttaacattggggttgttcctgcctgacatttcgaaagatacacggaaaacaaaatctcaaaaaccgggaaaatgttttttgaccaaaacaaacgaaaaaaaaaattagtgaacattgggacagggatggacctggtgtagtggttagaactcacgccgagtgagtgacgacttccttcggaagggaagtaaagccgttggtcccgagataaactagcctagggataaaaatttcgtaaataaagatagaaaaaaatggggcagggatttagaaccctattgattagagttttcgggtttggagtaacttttataatggatatgtcaacacatgaaaatacacaaccaaaccactgtgtgacatcaaatcaaatcaaacaaggcgaaaaaacattgtaagtctatgcttatttatataaaataatgttaatgaacattatcgattcatttatatgttttgttttttttttcacatagaatcaattggctttggaatagaaataaatatatatcaaacaaaattgaatgaattaggttaaataaataagcgtctaacgttttatgaaatcataagcctttgattacaaaaatggcatcaatttgtgaataaaaaaatcgctgagatatcaaagatcacattcaagttctacactgaaaatgttgttttctacaaaaaaaaactgattcatagcatgtatgtaacctgcttggtaacaatgtacgaaagatacgattttctgggttaaaatacagtattttttaggaaatgtgtgtaggaaactatttcgttgtgaaaaacaacaaacaattttgatacagtgcgagtagtgttagtgaacgacaaacgcataacattttgtagtttctcctaccttcacatgacgttttcttgacaaacctcgtacaacaatctcttcacactacaaaaaacaactttttgaataagaaaataggtaaattctgagagtttgtaaaaataattgcagaattttcataccggtgttcctgatttctgaaagtccatcaggaattccattcaacaaattttctaagtaatgcaaaaactgctccaagatttaaattcagtgaacatctacattacgaattttagcataagacatgtttgaaaatattcttaaaatatgccctcaatatttccacgttaaacttcttcagttctacaaccatagtttaaaataatccctccaaaaagtttgtttggaataaatggttttacatcaatctgttcgccatactttcatgaagctttggagttcatgcaaaatattttcacagatattatagcttcagtaataattccatcgggtttaatgccaatcatagtgaaaagtcccaatgaacactacacttaagctttttgtacggtatattgtcagaaattcgaaaaaacactggaaacatcgaactggacttacagttgaggtcgaaatatgcgtatctgtcaaaggatacaaactatagtggaattaagaggtatagtactaaatttattttttaggaattaagtatttttactaattcaatttaagctgaaataattcacaaaaattcttcagaagtattccttaaactttgttcgtatgtgttaatctagaaatctgatataaattaaatatggatagggagtaatttgtagagtaatttgaacaaaaacccctgaaaaaattgttgaggaaccgtaatccgggggcaaatttatcactattttacaactttttgttgcgttatacttcgaaattcaaatattgtcaaattaatttcgacaaaatcagtactccattgatctttatcagttgatgtagtcgacttttcattaaacaatgtttaacatgtcataaaaatagtttaaatatcaaaaaattaaaatgacacactgaggcgaaattgatcatcatataacaaagcaggtttaaggctaagtagcccgtcatttgttttggcagcaatgatgacttttcagcttgcttttcaaagtgataaaactcagtcttgatagtttatatggacttgaaaaagtaccactgtacgagctaacatgcataaagtatgctgatacttttttagctgtgtcagtgcaaaagcaactgattttttttattcaaaatcgtgagatgaattagcaacaatcatcaacgacgcatacaaatttcaatgacagcctacttcgccttaagaatcaaaaatttcccaatctcctgaatttgggtctcctgaatctgaaaatgatgttgaaattcttacaactcgagtatttgatcattttattgcaaaattaaactttgtagatctgcctaatacgcctaaatgtaggcaatttctcttgaaataagcatattatctatataaataaaaattgaatggtgtttgtatgtcacgaaatggcttacgaacgggtcaacggatttagctgattctttctcaattttgttcatcaagggttccgacgtgtttgtgtgtataaacatcccaggatattcaccgagaaagttgcaaaaacgagagggaacggagctaccattttatatgggacgatccatagcgttgagcaacagcctacttgatggcaagacgaagtttgccgggatcactagttttagaataaaacagtttaatgagcaaaaaacaatacttggtatgctgtttgatatcaaaaataagttcagcagttaatacttaagcttacactagattttaaacactcaaagttaacatgtaggatagaatcagtggattctttagcatcgacatatccaactgtattgcttacacctttaaaaagtgtgaatatttctatgcaaaaatgacctcaataaaaatgaaatagttcaaaaccatcattgtctaatcttcttcttcttattcttctttctggcattacgtcccaactgggacaaaggctgcttctcagcttagtgttcttatgagcacttccacagttattaactgaaagctttctatgccaactgaccatttttgcatgtgtatatcgtgtggcaggtacgaagatactctatgcactgggatgtcgagaaaatttacaacccgaaaaaatcctcgaccggtgggatttgaacccacgaccctcagcttggtcttgctgaatagctgcgcgtttaccgttacggctatctgggccccattagatcattagatatatataaactaaaaaacatggaatgtctgtggtgccaacgaaactttcagcatccttgggagaaaatgtattttggaacccacctgatcaaattcgccccagtgattacggtaatcacaaaatatttcttgaacctaaaatgaagagtggatacattttcatcgtagaataccggaatccgaaaaaaaaacatgtggtgcaattgctcgaacctaaaaaaaacttgatggaatttccggagattttttttttaagttcaataatgaattgcaaaatccttcagtgaaaaaaaaaaaaatgctataaaatccttattagaatcgtgatattcaaaaagtcttcggtgaattgtttgaaaacatcctacgacgttatcccaggggaaacaatgatataaatctttaacaaacaaatcaggataaatttcttgggaaattttagagtactttcacgacagagtttatgaaagaacagtttgatgtattctgttaggaacttcattggaatgtttgaaattattaaaagttttcttaagtagatatttttgaagaaattttcaaatactgtttttgagagaattttgaagaaatgtatgtagcaatatcaaattgatttgtggataaatctaagataaaaacacttaaagattttttttgtgagaaaaaatgcagatagttctgcggagaattcctctggacattcactcagaacgttttccaaattgaatcctttttaatttctcatggaaacctaattattagaagaatcagttaacttttttttagcaagaagtattattattttttctgcgaatttttcaaccaatccttgatgaattttcgaaagattttctggaaaatttgttgaaggaatctgacgagaaattcacggaagaacctcggagtcaaagttggaaagactgtttgtgaactcactaaacaatttttgtaaagaatccttgcttggtgatcttgaaaacggttttggtgaagctcctaaaatttatttttctctttcttggagaaattctcagtaatttccgaaaattctacgcaaactatcaatgaacagctggatgagatttaaactaaaaattggaatgtatacgtatagcacgtagaggatcttcctggaggaatgttcaaaaatattctaaagcattcccaggagaatttcatcaagagaatttttcagcaatttgatagcaattcttcgagaaatttgctggtaaaatcagaaattctgaaaaggcttcaggaaaagtctgttgcataatcccgggaaataatttccacactgaaaaaatatttacataattcttgaagacatttccgtggaattctcttagtaagctcttagaaacacatggtattatacctaggaattttgaggaagaatcacaaataatttctttggaagaattattgaaggatttttttactggattattgctgaaggatttttttactgaattattttttcattgcaatttgggaaaatcgtgtctgtcgcaatatgacattacttctgaaaaaaaaaaaaaataatttgctaggccatctccaggaaaatatctttacaacattaattaactcattacgcgtggtaaagatggacaaattatgggtgacattatgaaaaaatccacgtgctcggctgggatttgaacccagcactcttgtatgctagacgagcgctttaccaataagctaccgagccacttggtgatcaaataactgagttggttacaagtttagaattcaaatccccacagaccacgcagacccctttcatagcccatatccatccatctcattttaccacacgcgggctgagcgagtgcgatctgtttagtgttgaaactgtttgcctatcatacctacatcgcttccacaacaactgtattgtggaagtgtaaatatgtgggaaggccatcaacgtgtcgttctcactcaagtgacgacacgactactacagagaggtagtaacactctaatataaattgacacttatattgagctgttcggtaatccaatccgcatggttattgaattaatgaactcattacgcgtggtaaagatggataaattatgggtgaaattataaaaaaatccacgtgctcagctgggatttgaacccaggactcttgtatgctggacgtgcgctttactacgccaatgtcctctaccaaactggttttcacaaattcaaaggtatttaatatttttattggagttcttgcgttttaatcatctgacgatttcaacagaaagttcctattccaaataatggagcgtagtagaactaggaaatgcaacctgcttaaaaaagagtttatctttattagtgagaatagaatggtgttggtatgtcacgaaatggcttgagaacgcttcgacaaattcgcctgcactcatgaaactaatgaaaattacggtagacgtgattctctggcacatgatgttaataatataacgatacaaaaatgtgttcttgaagatgtattgaacgaaaattgtaattttacatgtagaagaatgcgaaaacgaagtataattgtcagatcccgaattagacgctatgctatttaagatgtgacaaaaatttacatcattcgactcgcttctctcatatgcatcccgtaaaattacatgatttttttagtttgtaattcttttgttgcttgattcaacaggggatgcgacgtgttgatttattatatcataaaagcttccgaaaaatggagaaagcgggaaacaccactgaaatgttaaaatgatttttacacggtctactttacaccctgcttggcaatacaatagggtatccatcctattatggaggacttaagcacggtgttgaaattaaaatcgtattgcagtgtccaaaatctaattattatagtattttgcaatgttaagtggtaaaactatcctttatctggagtatagtgaaataaaaaagtattttttggaatcatacatacattttttgacataaatctgaagctcttcctctgtcctattattgcggtattttgtcctattattgcggtagtgccgtcctattattgcggtataccaaaaatcattgattttattacattcaagatacattcaatatcaaccaatgttcgagcattgaaattatgctccctccatgttaatgacactgcacggtactgtcagtttgtgtgactttggacatatctatgaggaaaactatttcattactttatgtcacgattcgaaaacaaatcaacagaaccgaatgattttctgccggtttcgtctcctctttcgtcgtaggtggacaatgttaaagtgaattcttccatctgagaccactagtcgctataggcaaatataatgcgccaccgtcatagagatcgctggaatagagatagaaaactatagaggacgaatgtcgctgctgttccctttgttctcgctcagtagggttaccatatttgatctcatcggaaagagtacatttttttttcaaaattgtaaaagagtactaaagaatacacctagcctggaaaattaaaaaggtgctttttactaatgcgattggtttaattttcatgtcatgactagttttgttttttccttattcttaaggtgaatccagcttgcaccgaaatttcaaaggcacttatctcactcttttatttgggctttgtgcactagcataaagcttaagataaggtcagaaacgttggtctactatttcttcagattggtacctttgaaaacgtgattagaaaaacgagtcggccatccataaattctgagatatttcacctgaagtcgtttgtcgcattaaccttattggcgactaaaagttagattttggaaaaaaataataacatttttactaattacgtctttttctcgcctaaataatgcaaacaatcctcacgtttagtagggcgtaactgcagtgattgttttctcttcatcgattttttatttgactagttacttggcctggggacagttttcaaccactatttcttattcagttcatagaactcattgtccgtaatcaagctgtatcgttaaatgttgagaaaactgatcgaatttcgtgtaccgactctaagagaaaatcgacgaagaaaaatcgatcaatgcagatacgcctgtaagggcaaaaaatcacagccacttttcctacagttttatcacagttctttttagcgagacactaatttcaacttttcattacaaatttcttgaaatttaaccttagttttatactccaaatttatactatgcttattactaaactggacattactatgggcaaaaagaattacttattctatattttgtatattacaatattataacaaaaagccgttcgacttcttgttataatattgtctttaaaatagtctgctaataaaatctttttttcagaatttggtaaaaatgttcttaaacacaatagttgtttgtaaaggaaaccatacgacagagattggagaagagtgaattttgaaattaatgtcttcaatttcagttttactaaggacttgctaacattataatagatgaaagctctatagatttaacaattattctgttcgcgatgctatatatttttaccttgcgttcacacatctttttttaataattggatcgacaaagcgacgtttctagaaaaagtacttgagcaaaagtttttgcggaattattcaaaattacttacaatttttaactgaaaatcaattgttgtaccatcatgtcattcatgtcaatgatgaatcagcataaaaatgtattcttataatttttaaactaatagcaccaattcgactcatctagtacttgtccaaaatcagtgaaagaaagcaatcatatgaatctggtttattgaacaaattattttattagtaaggcttctcggtagtatctgaaaaagagtacccatgagccaggttagcaaaaaagaatagtacacaaattttcaagccaaaaaagagtacatgtactctaaaaagagtacgtctggtaaccctatcgctcagaaacatgtcgggtacatacactgaggcacaaaaacttaataatttcttaaggaataattatgatttggcgccacaacgattattattgaaaattttaagtatttacttatgattttggtgaagaatttcagtaataaatttcataagtctatcaatgaaattcgaagataaacgcaatgataataacttaattcgaattatcaatcgacaatatcaatcgccttttatttcaggcgcgctcaaaaattgacatgttttgataacatgtgaactgttttcgactaacttgtagccaacatcgaaagcggagtagttcttctagcgattgctatgataattgtttcaactaattcttgttaaagaattcaaagttctcacttatgaatcttatgatcccattttcgaaatgtttaagcgtgcaatgaaaccataatttggctggttcataagtcttgatttatggaaaacctaagtatttttgtctcagtgtaagtgtcaaactgcatactttttcgcgttgacatttatagccccgcctatctccgccagcaaaagatgttcctgcagcgacgtcagcgacattcttcctctatagtttattacctctattgtcgctggagaaaaacgagtgaaatgtcactgaaaatgtttgtttacgtccaaaattcaattcttcaacccaaaaattaattcataatcaatcgattattgaactattttccattggcatactcattttgtaccattattcttgccatacgtgtgatttcacaacaaatttaaccactaacaaagaatccggaagtttataacctatgttgccaaacaccaattttccaattttatcccactaatcgtacatgagcactgaccggatctgtacattttcaaagcaaaaaaagtttattatgtttctcaatgatctctgatcgtctacaaaacaactattccgagaaaaagtgtaaattgtgtgttccttcctacgctgcacacggtaagttctcaacccaacctcttttttgccggttctcctactagccaccagatgtcggagtgatcgtttagctttgaaaatgtttgcctatataagaaatgaatttgttgacctttttttggtataacctacaattttgatgcttttaaaaatattttccactagcaacacaattttaaagaattgcttccttgcgatcatcttatatcttagttttttaacatatttttggcatttgttccgattttcagtcagtttacgtgattttttggtaaaacatcctattaatatcctattaatataattaatgtttgcagcaattacatttaaaatgactatagaaatatcgaatttttgaatgagatttacagataccgcaataataggcaaaaagctattttcattgtcctattattgcggtatatggtttttctcaaaaatatagaacttttattcaaaattcaatatctatcatgtaactacatctatactgaactgatacacccgatacatataattgttttggttctaaacttaaaaatttaagcttatgaaaacaggcccgtagatagagagactggttaaaaatataggctttgcttgatgcatcatctataactgttcttccaacgatcaaaatcgtttaatttttaaagcattcatctggtacagcttgggaatactataagctttcatcatcatcaataatatccatagaaaatagagttttcgattaataatgagggtttaattcttataccgcaataatagggaataccgcaataatgggcaaattaccctatatgctgggacaactaattataaatttaaactacatacgtttattgagctctctcagtcttggagagatatcaaaacggatgctcttagaacactaagctgaaaaacatgctatgttccaatgggaggtagcgccatgaagtagaagaagactcgcataaagcaggtgatccgtttttcaaggaacacgccgtgagccaaactgtgcagacaattgaagcatcttggcggattaacgtgtggtgatcgaaaggtgatagcgatgcttcgatgaatacgtgaatagcactgaaagcgcgggcaataaggattattgaaacagagcaaatgtatatgtccatttattggacaaaagagcaacccaggcagtacattgaaagactcattaataaggacccggagaaacttgcaatttgtttacacatgccaatgatgacgccgaaatgaacgtttctactgggacagagcctgtttctcagcttaatgcattccaacaattattaactaacagctttctttgtgaaagtaactatctctgcattggttcatagtataacaggatcggttataccttttactccaaaaagtaaagaaaccaacacaggtaccttaagctacgtaagttggccccaaagctacaggctttacaacacggccagggggttgtaggacaaaaggtcgaaagacagtaggtcgaatgacaaaaggtcgaaggacaaaaggtcgaatggacaaaaggtcgaatggacaaaaggtcgaatggacaaaaggtcgaatggaaaaaagtacgaatggacaaaaggtcgaatggacaaaaggtcgaatggacaaaaggtcgaatggacaaaaggtcgaatggacaaaaggtcgaatggacaaaaggtcgaatggacaaaaggtcgaatggacgaaaggtccaaatggtaccgttgaaaggattatcgtacacacagttgctaacattttaatcacaggttcctcccttcccatctgaagtttttccttcttttaaatgatagctgttcttcagaactatcgtttgaagcaataatttgtattaatgctattgttttccaaacaaaagattcattttctgaatgtcggttgttattattttgatactccaaagcataaagtaatttttattagctttttatttgatacattttcaatagagatttgtccttcttaaaacattggctgttcttttggagttatacattatagtgattttatgctgttgtagacacttgtatcgacgattattccttcttttatacattgactgttctttatagatttcacttttatatcttgcctgtatttttgttttaattgatatgttgccttcttataaatatcggctgttcttcatgctttacagtgtttatgagcatttcaatttaatttcttacaaaggattttccctcttctgaagttttgctgttttagggctgtgcattagagttttatctgactgttgttcatgactgatttaaattagcagcagggaaaaacaatcatcctttttggaattatgtctcaactagggtagagtttgcttctcaactacactagcatttactgagagcttttctgataatttgatcatttttgcatttgtgcatcatgctttttattagaagatgatctgcaacccgaaccgttagaagaaaatttcagtatgatctgaatgacagctgcagttactgcattccagcacttggcatcccaacacatagcacatggagtggcatgcacctcgatgcacttagagttacataattaccaggaaaacataaatgaactaacgagtctccaaccaaaccacctttcaacgcatcagaatcgtagtgtgctgcgctaggttcacaaatattctgaaagcgcacgctaggggagattcaacacatgcgttgaaaaaacaactgctcagtaccgaagagtctctacagctatttttaccttattatgtaggtgtctagatggtctacatgatacggtcgaagacgcgcgatccggaagcttcaatttcgattctcgttttaaaattttgtcttcacatctattattgtgctagcacgtgctgtttttgaacaacgcatgtgacgaagcggagacgcattgagaaattatcctaaaaaaagtgaggacaccaacataggtctcaaaatgtacagtgcacgggtgagcatgaaaggaatgtggctcttgcacatatgcacataaggctacagcacgtacacagtaactctggatccactacgatctgaaaagtctaacaaaatttcaccccgaaaagatcgttgaccagctgaaattgaacctcccttagaatggtcctgctgaaaatatgcgcgttttcttcgcgtctatttaagctgtagtgcttgtgataacttgcttttttatctaaagattatagccctttgttcttccttaattgttgtccattcgaccttttttgtcattcgaccttttgtccattcgaccttttgtccattcgaccttttgtccattcgaccttttttgtcattcgaccttttgtccattcgaccttttgtcccttcgaccttttgtccattcgaccttctgtcattcgaccttttgtcattcgaccttttgtccttcgaccatttgtcatagattccggccagggaaggccatttctagtaatgtctctgggatagatagattctttctgtttttacagggctaattctagtagtccttaacaatgactagtttttttagttggagataatgattgtcctaaaatgtttgtataaaaggtccattggtcattcatagaatgaaatagatgcaaagagaactgggagtctcaatttccgctctatgcatagttggcacatgtagataaatttcagtcaatatgctgcttttaagcgaatagcacccgttcacgcattaatcgtacggacatttgtttcgcctcgtcatcaaccagatctgatacattaattgtgtgtagtcacgagtgagaaattgcctaaataagacgctcgaaaaaacggctcgtcatgtttctgtcaggatgtatacaaagcctcaccgaccacgattacagccggatgtggttcgaaaaggtccgaataaaattaaataaaaacatacttttgttgtgtcgggtaacctccatattccatcgtgcgtggtaatctggttcggtctggattagctgtggtgcccaactgagctgaaaacactccattacttgacagagccaatcatgtcctttgcagtgggctactggaggagcaagttgattttaatggaaaagtaggtactctgaccctttaagctgtcggtttttttgctttcttatggtttacaagtgtgacccacaatgacacagtaaatcgcacccagacgaaaacggagtaatgctcgaaaacacggaatcataatcttgtttatcactgtcaaaatctgttcaagagcaatcacagaggacccacaacgacagagctggtagcgattcagtgtcctaagaagggaactttagaaacctctaaaaagagaccaatcaggaacatagaaaataaaaataaaccaatcacctctatggatatcttcaggaattaaacaaatgttagcagcattggaagtactatagaagtaatcaaggaagagttcttaatacatgttccggactggaatgattcctggataaaccgcggatggatggataacaaaactgttgaaagaataaccagagaaatcagcttaggaattgctggaggtagggtgtcccggaaaaaaaacctcaaagcgaatacagccaaaactcagaaataaacctcctccagaaatcctgtacgaagctttgcatggtttattagtgtaacaactttcaatatcaacgaaagaataaatgactatttctgtggaggatggattaggatagtctatatgaatttttagagtaatctaggtggaaattacttgatgtaatagcattgaagtgctcaaaagttttcttgaccaaaccctgtataaatttctgttagcatctactgaaaatgcatggaggagtttttgtgttttatgagaaatttgtggaatactctcgcaagaacttttgaaatttggaccaggatgtactgtaaataggatatggaaaaaggttacttttaaggatttattcttcttgacagtacgtcctcactgggacagagactgcatctcagttcagtatttgtcatcgaaacccctcggtgtcgatagcacctcatcaacagctaccttgcggaagactgtcgcggtgacagcggttgacagatcgaaccgatacaatgaactgtcaggttaatgacaaggcaaaattacaatatagcgtgtgcaccagtaacatataatactcagattaattgtcttgaaattcttataaattatattactatgaatttatctctcaagtgaattaaggtagtatacttgtgtgaactagaactatacttgtgtgaacttataactaaacatttatttaacttagaactacataacgtaaaatagcctaatagtacggagaggacagtcgatcataagtacgtttgattgatagcaggtgagaaattgatattctatttgaagttataatttctcatattcaccaaccgtaattacataggtctcttgataaaaccttaatcagcaggctaggtccgacgaagccgaggaaaaaaaaagactaaatgcactaaacgtaagaagttaaacaccttaaaacttaacctaaaacatgccctaaaatctaatttacatgtaaacaggaatttaaaacggccctgaacttcggacgaataaaggtcgttaaggatttggaacgcatccatcgtctttttattgttacagcggcacgcaagtaacaaattttaaattcgtttaccgaggaacgatgtcggaaccggctggagcggtaggcattactgccaatcaaggtaagagctctgcttttcaatcaaatgacgcgcatgaagacccccctctgaacccaacggagaaatcaaataaaaaccctcttctcaaacctcaccaaaaagtaccctctgtcaaaagcaaatcgtcaaaaaatcgggataaatcatcggcggtcggtcatagttgtgaaacgtgtaggtcagcggacaacagccgtatggtgcagtgcgatgattgtgacggttggcatcattacatctgcgtgggtgtcgatgatcgaatagtgaagaaaccttggcggtgcgtgatgtgtgaggaggtttggacgaaacggaagaatatcaagcatacgaaagtggaagagggaaagaagaaaccgaaagccactggaaaaaccaaccaggaaggtggaccgaaggatgttggcaaagccaagcaaaaaggacgagtggagcagcgggaacaactgaaggaaccgtttgaccaggcggcgaaaagcctcaaagcgtcatcagttaagtcggcaacttcgcgtaaatcttcaagagtccaactcgaactgcagctgcgcaaactcgatgctgaacggaccttgctggaagataaacgcaaattgatcgagcaacagtacagtgtcctgcaagagcttgcagaacttgaagatcgcgttgaggatgtggaagatggtgaccaagtagacggggattccaaagtagagggttggctgcgcgacggactcaactcggactacgaggctgagagtactgactcaagcgaagagtacccaggtactgaagattcggatgacgaagacgtcggtaattcatcagaggatgacattcaagaagatccacgtagcaacgcatcgcacttcaacccgaaaggacgctccacgccaaggattgaccaaacgaaatcgcagaggagaaatgttacgcacagcaaccagttagcctgtagcctgactcgtaaccaactagcagctcgtcaagtcgtggcgaaagatctgcccacattcaccggcaatgcggaagagtggccgattttcttttccacctttgaaagcacgacacgaatgtgtggatacactaatgatgaaaatatgattcgattgaggaattgcttgcgtggagaagcgtacgccgcggtgaagagctttctgcttcacccgtcaacggtagacagagcaataggtgctctcaagctgagattcggtcaaccacggtttgtcattcattcgcttaaggaaaagatactcgccatgccaccgctaagacccgattcaatcaacaaaatgatcgactttgcgctggcagtacagaatcttgaagctacaattgatgcgtgtggacaaaaggagcttatgcgagatgcgtcgttgctaggcgacttggttggaaagcttccggcctcggcgaagttggaatgggcaagacatacccgatgcttgcgaaaggtcaacctgtcggccttcagcaagtggatttacgatatggcagaagatgcttgtttggttgctgaaccacgcaaaaatcaagaatcaccccagagtcatgagccacgtaaaaagtccaaggcgtttctgaacacccacaccgatcagccgaactacaggaaagaggaacggcacgcagctggtagcaacagtgcttctaaaccgacgggtgcatataagaaaacacaatctcggccatgtattgtctgcaaaggaggttgcgcttctcttgcaaagtgcggaaggtttttggatctctcttatgacggaaggtgggcaacgattcgcgaagcaagagtctgtcggaagtgtctgacgcaacacaaaggaggatgcgaatcaaagcagtgtggtgtgaacggatgtggctataaacatcatcccttgctgcacaaggagttgaatgtagaatcatcagcgattgagaggccacagcatgaagagcagtcgtgtaacactcatcagtctggctcaagttcgatccttttccgttatattccagtcgtggtgtacggatgcggaattgtagttcactgctacgcctttctagatgacggatcgtcgaaaacgcttatggacgaagagcttgcaaaagaattgaacctatctggagaacgtcatccactgtgcctcaaatggactggcggcttgcatcgaacggaagacggttcgcgtagcgtacaaatagaaatctccggtataaagggaaagcggtaccatttcgaggatatccgaactgtttcagaacttcagttgccgtgccaaacgctcgacgtgcaacaactacaatctgaatacccctacctaagaggagttcctgtacaatcgtatcgagaggtacggccgcgacttctcatcggaatccagcacgctgttgctacgctggtgaggaagagtcgtgaaggaaaaccgggtcaaccgatcgccattaaaaccaaccttggatggacaatctacggcggggcacctgctaatcaatctatgaacatggtgcactatacgaaccacgtttccttctgcgaccatgagattgaaaacacgaatgcgaacatggatcgagcaatgaaggagtatttctccctcgaaagtcttggcatcatgtcaccggctaaacatgtacgttcccaagaagatgaacgcgctatgagtctgttacataagctcacccatttcaacggagaaagatatgaaaccggtttgctatggagaaaagacaacgagcaattaccaaacaacaaagctatggcgttgaaacgtttcaatcatcttgaacgccgcatggaaaaggatcccgagctagcgcgagtagtgaaagagaagctggcagattacgtttcaaagaactacgtccgtaagctaaccagcgaagagcttgcagagatccacgaacgcgcttggtatttgcccacttttccggttatcaatccaaataaaccgggaaagataagaattgtctgggatgccgcagctacaacgaatggagtatcattaaactctgcgcttctagccgggccagatctattggagccgctgatacacgttctctacagatttcgacaataccgtttcgcgatatgtggtgatatatgcgaaatgtttcaccaggtcgtaatacgcaacgaagatcaacatagtcaacgatttttcctgagagacgacgaaggacaaaaggagcccagcacttacgtaatgcaggtgatgacgtttggtgcgtcctgctccccggcaactgctcagttcgtaaagaacatgaacgcagatcgtttcagcaacacccatccatctgcagcaagggcaatcgtgcggtgtacatacgtcgatgacatgctgagcagcgccgaaacagagcaggaagcgatagagcttgcaaaatctgtatggtttattcacaatgaaggtggcttcgaaatccgtaattggatgtccaactcgtcgacagttctcgcagccattcgcggaaactcaaatgttgaaaaaagcctcgacttaacgtctacccttgctaccgaaaaggtcctcggtatgtggtggtgcacgaaggctgactgcttcacctacaagatcaattgggacagacttggcgaagacctgttggcaggcaagcgctgccccacaaagcgagaaattttgcgtaccatgatgaccatatacgatccgttaggtttgatatctcactatctgatgtacctgaaggtactactacaggaaatttggcgaacaggtgtaggctgggacgaaaaggtgactcaggaaagttatgacaaatggcagacatggctgaagcttcttccggaaatcgagcttttgcaaattccacgttgctatcggctgcagacatcaactgatgagtatacggagattcaactgcataccttcgttgacgccagtgaaaatggtatggcagctgtagtgtacctccgatttgcggaagcaggaaccgttgaatgctcgttggttacagcgaaaacacgagtagctccgctcaaataccttaccatcccgagactggagcttcaagcagcgctcatcggcgctaggctggcgcactccgtcatccaggcactagacattacagtcgcccgatgcgtcttctggtctgactctagaaacgccctgtcgtggatacgcgcagatcaccgtagatacagtcaatttgttgccgctagggtcagtgaaatcttggatctgacaaatgctgctgactggaaatgggttccaacgaaatggaatgtggctgatgaaggcaccaaatggcagcgacgcccctcatttacaagtgagagctgttggtataaaggccctgaattcctgttacatccagaaaatgagtggccggctacacctgtaaaattcgaggaatcctgtgaagagttacgagccaacatccatgtgcactacgaagcaacgaagctagagtttccagtagacaaattcagtgaatggaaaagattgcttcatacaaccgcctacatgttgcgattcaccagaaacgctcggccgaaaaagttttcccgaattggcggctgcatcacaagcgaagaaattcgcgacgctgaagtcttccatttccgtaccgcacaagccaataaattctcagaagagctgtcaatcatgcgccgggaagagagcaaagcagtaatcccaaaacgaagtccgctgttcaaactaagccctttcattgatgaacagggcgtgctgcgtatgagaggccgaaccgcagcttgcccataccttttaccagacgccattaatcccataattcttcctcgtgagcatccggtaacgcatctcattgttcgaagctatcatgtcaagtttcatcaccagaaccatgaagcggtcataaacgaggttcggcagaaattctgcatcagtcggctacgtcgggtgtacgctaaagtcagactcgactgtcaacgttgtaagctgagagatactcgaccccgccctccggcaatggcagatctaccaccttgcagcttaccgcgtttatccgcccgttcactcacactggggtggactattttggcccgatggaagtatgcatagggagaagggtcgagaagaggtggggggttcttctaacatgtctttcaatacgcgctgtccatattgaattagctagctcattaaccactaactcgtgcataatggcgttacgaaactttatcgctcggcgaggaactccagctgtattctacagcgacaggggtacaaattttattggctctgaacgtgagttgaagcagacgttgaagactgtagaccaaaacagaatggcacaggagttcgtaagctccaatacatcatggagtttcaatccgccagctgctccccatatggggggaagttgggaacgactggtgcagtccgttaagcggactttgtcggagctcaaaccatgtccgcggccaaacgacgaggaattaaggaacgctttgattgaggtcgaaggtattttgaacgcacggccactcacacacgtgcctatcgaagatgaagcagccccggcgctcactccgaatcactggctattgggaagctccgatgggttgaaaccgtggtctctactggacaatgactcgattgcgttaagacgaggctggcatcaatctcaagtactcgcaaaccactctggaaagatgctcgagagtatctaccggagatactagacgcagtaaatgtatcagaaggtcccaccgatacaggaggtgaaatgtgctgatcgcagatccgatctcccaaggaatgctggccaaagggtcgtgtcataggtacggtcaaccgggacggacaggtacgtaaggtgacgatccagactatgagaggaatttacgagaggccagctgtgaacgttgcggtacttgacgtcaagggcccagaagagttggcaaactcagaggcggagtctgcaaactgggggggagtgtcatcgaaacccctcggtgtcgatagcacctcatcaacagctaccttgcggaagactgtcgcggtgacagcggttgacagatcgaaccgatacaatgaactgtcaggttaatgacaaggcaaaattacaatatagcgtgtgcaccagtaacatataatactcagattaattgtcttgaaattcttataaattatattactatgaatttatctctcaagtgaattaaggtagtatacttgtgtgaactagaactatacttgtgtgaacttataactaaacatttatttaacttagaactacataacgtaaaatagcctaatagtacggagaggacagtcgatcataagtacgtttgattgatagcaggtgagaaattgatattctatttgaagttataatttctcatattcaccaaccgtaattacataggtctcttgataaaaccttaatcagcaggctaggtccgacgaagccgaggaaaaaaaaagactaaatgcactaaacgtaagaagttatacaccttaaaacttaacctaaaacatgccctaaaatctaatttacatgtaaacaggaatttaaaacggccctgaacttcggacgaataaaggtcgttaaggatttggaacgcatccatcgtcttttttcttgttacagcggcacgcaagtaacagtattcttatgagcacttccacagttattaactgaaagctttcaaagttgccattttcgcatccgtatatcgtgtgacaggtacgatgatactctatgcccagagaagtcaaagaaatttccgtaacgaaaagatcctggaccgacggaaaatcgaacccagacaccttcaacatggctttactttgtagtctctaccaacccggctaaggaaggcccgttttaaggccatttagagtaaaaaagagattttagaggtttacattaaaattagagatttacatcaaaatagagaccaaaaagacttaagtcttcaaacagagatttgctactagccctgcaactacggatggtgggcctcagttcgctacgtaatcagcgttgattgctcttttgtgtagaggaaatgatcgttcaacgagatgaggacaaaaaaatccatcccacgacccacccggacgccaacgggttaatggatagatgtgatatttattccaagcaccgtgtactacagatcattatcgattttttgtaacattcttgaacccaaattgtattctcgggttagaacaatgaatcatttttttttttgggtgaagtgctttcgagtgtcgatcgccgagtaccccgagcaacaggtgcttgaggcacgaaatcgctattaacactgtggtacttaataaataatatagtcaccggcgtataaggaaatgaattcttgtatatcatcttgctacaaaaaatactctgcgtatcatcaaactagattgacagcctcagaagcgttgagcgttatttttgttttaaatgtttcttcttcgtgttacggatcaaaatcgcatgcgtagcaaggggataagaagaagaagaagaataataccgaaaacattttaagtacaattggttatatatagaaatagtgacacaatttcaagttaattctgaaaataatattgactttcaaccctaaaacatacaaaaatgaaaaaaaaacaaactataaaaaataaaattacagtagtacaccattgaactccaaatagaatttgtatcatttgactgatacacgtttttcgacctcagttggaagactgtcttcagtttcgtgttataaactcgaagaacagcaaacttggaaattcaagaaattaaataaatagaactagaatgcagtgaagacttgccagaaaagacaccaacagcagctctaccttcaacagggggccataagaattacaccaatcatcgccagtaggattcatgaacgaatatttgaagaagtaatgagtttctgaagtttctagattttcttaaattatgcttaaaataatttcaagaagaccttctgaagaaatttatgtagcaaatttgggagatttcaacagaaatcacgagggaaatttcaatactgtttcaaaaaggcatttaaaaaagtcagaatgtattctcggttttgggttgaaatgttgacgtctttctgggaaaaatttttgaatgcatttcataaataatctccagaaaaaaatatacagatacatgataaatggaggaatctttattggatgctatggaacgtttacctccccttggaaaatacatagcagatcaagcaaacacctcccccctccctatttttttttattattttcctcagcgatagggctagaaaaaaatattaaaatccagaaatccaaaccaaagtctgatattatctaatattaattactgactgaaatgtcagaatgatctaacgaatgatcctttgatataccgtggcgctcaatttggaaaacagtttaaacaaaattatatcctgtttcagttatatgattttgaggtgcagattacacaggttaaatttaatctgcagtacttttgctgttgttaaaacctgaaccaagtttacagcagaaatttacaaaaagaaaaaatcttactcggaataataaagctatcagcaatgagtaggggaactgcgggtaatatgcccattagtgtgggacaaaatttagattctcgttccagtccactttttggattgcatttaggtcccataataactgtgcaaaatttcagctcgatcgatgaaactatattttagcgccagccgttcaaagtttgtatgggatttactatgggaaaacttacttttgcaaagaaaaatcgccagaggtcgccccttgtcctctataaaaattctgaacacagatctcgataggtatttttacgacgaagaatattgccgaggatcgcgaaacaatttgacacttgtgaaaaaagttattcattgaaaacctattcgcaaggcgacgttgattaacacctaaaggaataacaataataacaaaactgagcaaaatttctgaaaagtctatgcttaataacttttctcgaaagcatcggattgcttttcggtctttgacaatgttgttcatcgtaaaaatatctatcgagatcatacaaaatggataaaaatgcttcttttaatatattttatgtgttttcctcaagaacagtggtcctcagcctaactgcttgtacgggccacttcaatggtttcaaaacatgacacgggccgcaagttatgtgaggatcagggtagacaatcttcgccgtcaaatggaaaaagtcagcaacgaaaccgttgtataactatttgctgtagtgatccgtcacataggctttgcgtcatgacgaacaaataagcttctttcgcaatggtagaatcttcgttcgggatctctgagctgaccaaaatatcaatcgtgtcggccacagattacgggcttaaaaaaattaaaaaaaaaccaaacaaagagagaaatgaggcgagaacaatgaggaaagcgggttcaatagccaatacaaacaattctgtgatagtattcgtcgtttgatgcttaagcgaagtatgcacttcaacagacctatctcgatgcgtgggaaatttcttgcaagaaatgctcaagaaaagcatttttctttgatcgcagtacgcagaaatgtcaattcaaatggagctcactgtacgaaatttcttgaccatttcttgggcagaaatttttacttttcttaagcggaacagcatacttagctttaacaagcaaatatacaacagacacccccttttttaagaaataatattaaaagcaacaaacttcgttaactattttggatcgaagttagttatggaatctttcgtcgatgacgaaacacagagtcggtgtccccgacctgcccgagttgaacacacttattcttgtttacggtggattcaactttcggttgaatcctattcgttagaatccatggtccactttattttgctggcgtaaacgtaaatgctaaacggttttcgatcgaagagaatccgaacgtaaacaaaaataggagtaggggtatgtatggacacccggggcagaatggagaccccctgtatctttgcataagcgagtacttttacactttcaatgcaaacaatatttttgttgcctgtgggaagaataaattatccactaaaatttcagaaaaaatgttcaaaacattgattttaaatcgaaaaattgagcatgattttatttggttcgaaaattataacattcacacctcaccaaataaggtttcacaggcaaatgactgcaagttgaccgaaaatgtagctctcgattgaatcttcaattatttatgctatattcaaaaataaagtagatttttttctggtactttgagacattgaaaaatttatatgaaaatttattatactgttggggcaatatggacaccggtgacaaagtagagctgacacatcaaagagaaagatatataacttcaaacacaaaattatccaaaaatctttagcatttaatgcaatgattacgaaccggaccaacatatcggttgaaaatcgtcaattcttgattaaaactaacctgaaggcaatattgaaagcatctctacgaaaaatgtcgtaaattggttctactcatgttttcagtggcacagtgacctgtcactatggtttactgaatatgtacttaatttttcgaggtttttagaacgatcgcgggacagttttcctataaacattaaggtatccatactgccccatgggggtgtccactttgccccgctagcttgagggcgactaccaaatataagctttttttaaacctttttttgaaaacaaaatatttttttcctaattatgcaaccatttttaacaaatgcttaagagctctaaaaagcatactgcacataaaaaacagtataataatcatgtctttacagtcaaaataggcaaactccttagggtgtccatactgccccgtgtccccctaactattctggctgacgattttttttatttcgtcacgattgttgactacaaagatctctttttgaagatgagatttatggaatttaaggaagcgttgatgacatgaaatatctagatttacatttaaatttgtaaatcattgaaatattttcaaccaagtaaaaattcaaaatacatttatgaaaaaattctgaggtttccggtctttctttgaagacttgaacacattctatggccatgaacgctgaacgttactggggagtgaagacatttttgaaagcatggggaaattttgaagccactagtctgccgatacatttttttttaaccaaatttctgaaactatcgccgagagccaacttgtgcactgtcatagtttgttttacaagcaaattggggtgggtaatggagtagtgtgtggtctttcgattccatggcatgctcttgcagggcgagcgacggaatcaagaccaattgttttcggtccgcgtggcgcgagtgcgaaaaaagattcgcatttctcagttagtatgtatgcttcaaataaagctgaaaattgtggctgctcaatcaaggatgaaggatcaattgatgagctcgtttcatttttttttaaatctataaaatatgtatgaccgcacatttaatcgttacaacggtggaacataaatatgattattcaacaaactatgaatggttcgtcactgtaagtgtcggcatgaactctaattcatttttttatatatagaatctcttgccatttacctttatttttataaaaaaagctttgaatggttcggtctgtttgtctgtgctagaagtatagacttgcaaaacgttcattttattcaaaacactttgaatggttcgccaatgtaagtgtcggcataagaatattatgtgatggtccagccaatcgatttatttttttaatttgagtaaaatattaataaaatattaataaaatattgcgaaggtatcagtaaaacatgtttgagatattttttgaggtattttacctcttatgcagggctcattcatacctcattcaggttgttagtattgaaaattatctggtatggaatacctcagtttggtattcagtagcacttttcttctgctcgggttggaatactgcattgacaatgccaagtgtaatatgtaaaagatgcggaggacaaatgttcaaaatctggtcagtgtaatttcggggtatcaatggcacatgaatgcagctggctcgtccattccgtttctttgaacgctcaccttctaaactgtttttcttgatgttgccaattgttcttgctgctccgcactgcaacgctaggtccttgatcattgcttcacagtacgaacaaggatgtgacgatgaatgcgcaattatacccacgacaatgttaataattttcagatctccagcggcaataaattttaatctatttaacattaaaggccggtttgctactgacaagaaaaggaatcgcctatctcgatgcgtggaaaatttctcccaagaaatggtcaagaaaatcacttttttctaatcgcagtacgcagttgagaagaaatcccgagcaaagtcgaataacaaccgcataacatagtgttaacaagatgttcagcatgatttcattttgttattttttgttatatcagtcttcattcttgttatcaacgaattttgagctgtcagatcgaggatgccaccgacgggtgcatgacgtcaaatgtttgttatcataattcgatctttataactaattgataacataatgagttatcaatgaaggaaatgggctggataacaaaacttgttatcaatgtgtttcaaatgataacacaatgagatatttatatgatatctttagtataaacttttgttatcatgtttgttatgttgcctgcttattcaaccaaaatgatagcaaactatgttatcaaatccttgttatcggataacacaacttgttaacattttgttacccaactttactcgggatgtcacttcaaagggggctctctgtaggaaatttcttgaccctttcagtctaggaatttctttacttttcttgagcgaaacagcatacttagcttaatagcttgttccacattaacgaaatatattcatatctctccggaagattgggagccaatcaaggggtggatcacttctgatgcattcgttatttccaaatgcatttaaatgtacattttctgaatatttgcaaatcatggcttgctccaacgtttagctgttgttgttgtcgaattgtcaaactcgtcttttcacaaactcgaggagagtcgcaagttgcgtctcgcaaccttacccaaaaactgtgaaaccagatcctgcagagaaatgtaggatatttatattgctttggacatatttgaatatcggataccaacgacagagtgttgaactaggaaacgaaactctcctggattgtaagcccggttagaaatgaaaaaaacacattttggatatgacaaaaatctcgtcagtggtaatccataacctttatgcaaacttccacattcagctgctccacttcgtttgctgtatccttccgtgactatgctcatgtcttaaatcctgacaagaagaattcctaccacgggggatgcgtgaaataggtcaggtgttgtatgtttattggtgtgtggaaacaaagctattcaaattagaggaaattagttactcaaatgttggaaaactagaagcacaaattttaagtgtccatattccaaacccaaaccaaaccaatattgacgctaataaaacgaattttagatattgttcggagttttttcttgttctttctcatattttaaaatacttcaatttcaagcaaatccactcaaccacgtaaggatgttttcagctcagtggggctaatgtattttttaggaaatcctaaaggctgtgggtttccggcaagagtttcggtcttcatgcttttgactagttccgttcctattgggaagcaagctcagtattcctcaacagtcaacacaatgtttttttcctagtctaaaaaatagctgtatctagacctgttcttaacctgaaaaaaaaaaacaattagtaatggattataaaagaaacaatcttaattaaaaactacgatattggaaagagtgcgacaattccgaattttcacaacaaacaattacgcgttgctatagattgatatgttggcaaacgccatggttaagttgatgtgaatgtcgaaaaatgcatttaatgcaaacgaatgcacatttgatgtgcattgaagaagtgttccaccccttggagccaatgcaataatgtgtgaacgcttgactccactatccttgaacgaacttgaaggttgaggtgttggatttcgagagataatggagatggtaatcatgaagaatccgcctccaccgtcaataccaagtttaatgtattgatcatcttggtcttggcggattcccatgatctgctcaatgagactgggcacactgttacaatagataattggaacattggcataattttccaatctcatgttttcagctgtaaacgatatgatatttggtcaaccagtattttttacaaaatggtatgccattatttacctccatccacttttccaagttctgtgacactgaaaagaccgctcagttgtggatttaatatcgaaagcttttctttcgttccagattcaatcttcataccagatcgtttcagacccttcatgacgcctgtgaaaagttgtgctataaaacaagaagtatcaattagctgatatgaacataacccagcgttttgcgcaagcttaaggaattgtcgatttttatcttgaacaaatcttcgggtccatttttttctgactgtttgacgatgatgctgttgatgttttttcgtagagcgacggctttccgcgacgattggacagacgaatctaattgccatctaaaaaaaataatgtattaccataaagaggacaaatacgctaaaatttagcagaggaagttgctttctcagctagaaattccgaaacagcatcttctgcggcttttggagtagaattttcagagttcagcagtttggacaaattttccgttcgcacagaagggcggcaagcatgcttcttgcccctcctgatttctgtaaggcaaatgttacacatgcgcaacatttaagccttttcagaaaactgtgtttttggactcacgttttacttacggcttacgttgaacttatactcgtataagtttaattttttgaaggttgttccgctgtacactttacccggcatgatgtacatatggacgaaggatagtaacaccctttactgtctaagtcatttcaaagcgatcatgaaccactttcttcactgcttctgacattggccttacatttttattattacagaaacacagaatacacactttgcttcggttattctcatgattatccatgattattcactgcactgcacaattttcgtagaggaacttcaaaaggcctcaaatgtggaactgacaactatgattttttttaatctatggctactagatctgttcttctgcctcctttgttcatctggtaataaacaagggctggtacaaaaaatacagtgcatatacatgattttttttttattctgcccatatataaacaaaatatattaataacgtttttacattcgagggtacgaaggtacgctgctaccatctgggaaaagtttgctcgatgcgtgaagcgtcgaaaatttcacccggtaaggtaaaggaagcgaaatttcaaatttaatttgcttaattaaatttcagtaagtatttgctggatattcagtaaactgatagtttactgatacaatcagcaagacatctgtcaaaaagatagcttgttttcttctcactgaatagattatcgatcctccatccacaacggacgttcgtgagtatgaaaaatataacgaaataaagataaatattacaatcaaagacattcgtttcttttttcaggaattgttttatacataaagagtcttccggcacaccgaaggacaaatcgtattcattttcaactgctgggtgttgcgctaaattttcactcctcgttgtccggcattccacaaaatatattgagatggacgattcaatgcagtcaaaacaataatattggtatattagggaaaactttccgttttacggttcaatgaaaatctactgcagctgtcacatcactgatttgcactggtaaatcatcagtaggcttcaatgataccttggataccgtcttgatgattgttgtttgttgctatttttcatagcgtttcctctttcaagcatactatgattgaattgtttgcttcaatgatgaaatgattctgaagcttgctgtaaaactttgacagctgccgtagaactctgcggctaccgcaaactggaaagttttcttaacaaccgtaatacgcatgattataacgggataatttatgttggagttgtagaaaagcgtgttccacaataaattaccaattgaaagtgaaaactagtatttggaaacttgcaatcagaagacacagtgtgtttgtttgacaaattgagaaatgaatttgcgaaaaaatacgcaaaaaaaagccgcatacctataagccgaatgcggctgtagagcgtaagaactcagtatccataaacaattcgctctcacttgcgatcgggagatacaaacgtgagcttgttgggggtttggcatctaagtccgaaagagacatggatttgcgaaaagagatgtgtttatagttagtactcggattcagtttggctttctattccgcagaatcataaggtgttctgtagcttagttggttaaagcgccggtctagcgtacacggagtcgtgagttcgagtctcactagaacgcgtattttttcgcaaattcatgtctcaatttgccaaacaaacacactgtgtcttctgattgcaagtttccaaatactatgtttcagacataccagcaaatctggtttatgccagtaaagggcaaacattcattaatgtgaaagtgaaaacatggaaaaatttattaaccaaaccgaatttactgattactggtagtccagcaaacatagtttcaaattactgattaaccagcaaacgggctgagccgtcgggcttgtgtgttgctgaatattcagcaaacgagctgtcatttctctgatcatccaggttgctgaacgatcagcaaattttattttgctggatggattgctggaattacagcacaaaaaaatctgcaaaattttgctggtagccagcaataaaaaaatggtgtgtatagtttacgattattgaacaattatatcgtaattttcacgaatgattagactttcatgacgaaattaagaagctgccaataatatactgatggtacattttcaaacactatttacctttcatccttgatttcagtcactaccagctggttttgacacgataacaagaccagctggagcttgagaacaatgacgatgactgtaaacatcggaagaccagctggttttgttgtgtaaaccagaccagctggtgagtcgagaacaaagagaaaatggtaaacactgagccggccggagtaaattgtcatgaacatcaggataattgcatgggcggttgtgatcgaaaaggggcagcgaaatcgaaggcgaaatctgagaaagacgaaattcacccagacaaccaaaatgtacgtataacgaaaacacctggaggctttatatgtgcaaaatttcacttataagatgtcgcgaaaaggccttctgcgtacaaaagtggaggcgatatgcgtgcatatattatgtgatgaataataacatacaatgcgagtgtataaatattctaccgaaccaacctgtgatcttatgcgacttaacttatgataacaaatgttgatttgacagctgctacggattgatgcgacttactttgtacgagtgtacgagacgaaacaaaatgtataaatgaactcagaaaagaagtgttttatgcgaggaaactcatcaaactgacgagtttatccacagtgttttgtgggtttgatgtaattagtatgaataaacgagttgtaacgtgaacttccatgcgatttctggttgtctgggcagatcctcaaagtctaagtggtaaaaaaatttgcagtatcatctaatcatattatatcattatatcatcatgattgtatgcgaacgtctacagtatggctaccgaacatagcataaattattcccaaagttccaaatgtttccttttttacactttcttgagaaattatcctcaaatcctggtaaaattcaattcagatagaattcaagcggggcattttacccagcaaaacaatacatatgcagttaagcaagcatttgttttaattgatttataaaccacagaaatgctaaaatggatcttcacgctattttgcacatcgtctatcgttgctcttattagtcttgtgagcttcccgcaaacttatttgcttgatattgtgctttgctttgataaatggattattgggaaagttgtgtatcgcacttcgaaggtcaccaagcagtggttccaaatatgtttccaagcaaatggatccatacccaaagttcttcaaatgtacatttacgcgacaaattacactggttttttttatccaaatgcagatttgcacttgactgcatcattgccacaattaattataatcgaaaaagcctatttcaaatggctgccatacttttacaaatgttttacaagcaagttttcgtgaaacaaaaaaaaaaaacaaacaaactagcaaccctgctgagagcacatgcttttgataaaacgtaaacaagtttcattggtgcgaaaccgattcactgccttttcttgcccgccaacggcaaaaacaaagggtttgacgtttccgcacttatgaacccgcccgcacttctgaagtgcggggtccaattaggtgggaaatgcgcaataacttcccacaaactcatttgctattggagatagacgacggaagataatctgtaatagcactttgtaggcggcattcaggatagtgatcgcacgatagttttcacattccagtttgtttgatggggcatatcaccccttgcttccactcctccagtagctgttccgtttcccagattctgacaatcagcaggtgcagacaggcgcccaaccactccgggcccattttgatgagtttagctccaataccatcattaccagttgtattgttgattttgagctgttgatggcatccttaccttccctcaaagtgggaacaggttggtttccttcatccaccgtgctgaagtagtcacttcctccgctgtcgtggccctctgcgcctgtgttttccgtgccattcaggtgttcattgcagtgctgcttccacctctcaatcaactcacgtcagtccgtcaagatgattccatccttatccctacacatttcggctcgcagcacgaagccttttcgagatgcgttaaatttctcgtagaactatcgcgtttcttgtgaacgatgcagctgctccattttttctcattccgcttcttcttggcggcgctttttatcccggaataggcggggttgctgctatcatttccttttataacgctccacgttttgtcgcgttccttgttgctgcatagcaacccgcgcattcttcgtcgaaccaatcgttacatgtcctcctttccacgctgcttatatggtgctccagcagtcctcaacaggggcttcgtcatgctcgccctcttccggcaacgctacctcgagatgctgcgcaaacccctccttccctgtcagcatacgatcaaagctcccaccggggttgattacccgatcttccctaaggtgaccccgaccagtaccacgaggaggtagggataggagttgctgggcaagaggctaaggaccacacaaaggaatctattttattcctgcagttacgcgaggtaccaattgtacgccatacccagccatttagcgtgcttttcattcaaattgttattttgttcaaaacatttttattcactagttttacacaatattcagcctgcaaatatcgcatacgttctgtcgaagtagaccgtttttctttttcaaatactttgagaactgcgtttatatatagatttctaccgtctttgaagaacaagtagaatttattgtaaaagccctctacggcgtttatggaacgagacaaattatctaacgggccggatagaggtctagccgaagaccactatccatacaaattttataatgtttgtatggtcaagacaccacgagtggggaaacgtgggcggttttgaaaatcattaaaaaaatatcccatggattgtccctaatgtactttgaggcactgaccaaagtctaagacggaaaacgctgtttaaaaactgttcatagttaatcaacagttcaacatgagccattcttagagttatatgtacaatgttttattatcaaccttggtccaagctgatgaaaaaaatagatatattgttgttttcataggctattctgccttcttttaaaaattagggtgatttgttctagtgttatatgctctatattcccaaaacctgggagggaggcaccgatactacacacgaaatatgacacatttgtttttcaaactgcaagaaaactccagcttgccaacgacaatcaaggcagacttgatgaaaatcgctagttttcttttgttgtgtaccttcgaacttttcggacaaacatgaaaaaagggccaaagttttctatgcattttattttcgtttttattagaaaaagtaaaattatgtgtatttgaatactttatattcaatcagaataaaagatgctatcatggcattacttttgaacaggcatgaatagcttatcaatcgattttttgtcacatttgatgaaatgcaaaaatatgttttgatcaattacgcgctttttccatgtttatccgttgtttaagatccgggctcacagggggacggacctggtgtagtggttagaacactcgcctctcacgccgaggacctgggatcgaatcccatccccgacatagtcacttatgacgtaaaaagttatagtgacgacttccttcggaagggaagtaaggccgttggtcccgagattaactagcccagggctaaaaatctcgttgataaagtcaaatcaatcaatcaatccgggctcacagtgacagttcgtgacagcagaatctcggctcactatgacgtaccgtaatccgggggcaaattgatcactagggtgaatttgatcaggtcggtaccaaattgcatttcctttcaaggatgcttaatattccgttgccatcacagacattccatgttttctagtttatagatgtcttatgatggttttaaactatttcatttttatttaggtcagttttgcatagaaatattcacagtttttgaaggtgttagcaatactgttggaaatatcggcactaaacaatccgctggtgctaagcctgcatgtaaactttgagtgttcaaaatgttgtgttagcttcagtgtgaactgctgaactcatttttgaaatcgatcagcataaaaagaatatttttttgctcgtaaaaccgttttttgttgaataaagtgcttatttcaaaggtaattgcgtacatttaggcgtattatgccgatttacaaagtttaattttgcaataaaatgatgatatacacaagttgtaagaattttaacatcattttcagattcaggagacccaaatttagtatatagggaaattttactttctaaaatatgctttattatatagtgatcaatttcgccccaatgtgttattttcaattttttgatttaaaattaattttatgaaatgttaaattttatttcatgaaaaatcgattacataaactgatagagatcaatgaagttctgattttaccgaaataaatttgacaattttttaattccaaaggaaatcatgacgaaaagttgtgaaatagtgatcaatttgcccccggattacggtacagaagtttcgtatcggtttccccaaagccccccccccaagcccaaaacaaattgatattgttctccctaggtttattgtcttcatcctctgaagaatattgtaacacaattacacaaaagaagtctgcttctcttttatgattttcttagaagatttccaacaaaacgtaacagctacaaaatatcaaagcctgtgtgcactagggtggcccatattaatcagactataaaattaaatgtttcatcttcaaattttgtttagcttctaaaggtaccagtagttgaattttttttgtgtggattccatcaactctgaagaagagctgaatgattttctaatttttttaacgaatatgtgtagaaacagctaagaagatcatattttattcgttcgtataaaataaaatgttatcagtattcatagaatcgttgattcgcaccggggggggcatgaaacccgtaccgtaatttcgggtgaaattgatcatttttcactgttttcttggtgtgctttctaaaatgttatcaatatcatacaactaaatgcaagaaaacaagtacgacggtgaacctcattggctcatgcaccgaaattgtttaacaaatgtgatgttagtgtcaaaaatctggtctaaaattaaaaatcggggaatcccattttggggtgaaattgatcacttatcattgttattattgttagtatcgaaatctactttacatacttaatttgggcctcctgaatccaaatatgcttgccaaattcttaacgagacaatatttatggaaataatgaataattaaatttcaagaatgccgcgaaaaacgcctaaatgtaggcaatttccaaaggatttccctactttgttgcagaaaattgaatttttcaacaaaacgaacaaattggtaagagtttcgatagtaaaatctgttttggagatatattgttagcatcctcacaaactttcaggtttacaccatgtccaaatccttgtttagaactagatgtttatagatgatgatcaattccacactaaacttgattctacaattttacattaatttcatagaaataaacattctgtggcacaaaaaacttcacaatacacaattagacattatttaagacaaacaacgttcatttactataggttgcaatgagcttggtgcattattagtaagaaataaaatcgcgtgacacggtgatcaatttcaccctactgatcaattacacccgaatttacggtaccgtaatccggggtaacattgatcagcggggtaaaattgatcgcaattaccctcttcgtaaaaagctcgaatcaacatttgttgatgaaatatttccaatgcatgaatggcgattctctttcttctaatcatgaactaataaacaatacggttttggcgaaaataaagttgtgttcatgcgtaaatttttcaacttttgtaaacaatgattttcattattatggatgacaccataaaagaatcatgtctcacatgagttctgtaaacgatatgagcaagagaaatgcggttgttactgaaaatgacatcgctgaaaacggctccgttgtcaaaattttcataaatatgttcaataaaacataattcacaaattattttaaagcgtgaagaatttccttaggaaattgcatacatttaggcgtattccacaattcaaggtgtttttaattttaaaataactcaaaaagtaaatgacttataagagtttgaccttcatattcggcttcagggaccatgattttagtaagtaatgatattttcaatattaccgaacgatgttttcatggtgtgatcaatgttaccccatatcagctaaatcaaaaactcacttaaaacatttttttgaacatgctttaaactttcagaaaacaaaatacagtacataaacacgaacaatgggtggcagtacttgttttaaaaatataaaatttgcaacacatgcattctcaaatcaaatgtttaagaaatattcaaaaaaatgatcaatgttaccccggattacggtaccacagttataaatcaacgataagacgattccgaaagaaacgccgtaacgtatattttcactaacgcaccattcgtttacttcacagataaattgcttttatagtgttgtgatccatattatgaatcgatttgatgcataataaggacgctcctgtttcactgatccacatctgtgggatgaccaacgtttgaaatttctatcgaaattgacaatttttcgtaaaaaaacgcggttttttatgtgtattcttgaaaacagcatactatactcggcattgccatgcgagtagttttgttttgtacaaggtcagcatgacttgtaatcatattttattttaataaatgacccttagctgatccataactgtggggtgactgtacgttcaatgttgcatttcatgcaaactttgacaaaaggttggaagttggaagaaacaacgtcgaaatacaaaatgtcgaaaaggatagaaaaaggtacaaaaggtcaaaaatctttttcaaataaggaaatttcgacccatgaaaaaattcaaccatgaagatcaaatttgtctttagatcttctctctacgttttggcttttgacctttcgtctcttaaccataatgcatctcaaatgtctagaaatactccgtttattttatgaaacgataaacaaaccaataaaagtcgaaacaaaaatcaccctgatatgcaaattgcctctttataatcgtttacaagataaatttttaatacccggcagttcccttattacatttaatatttatgacaccataaacgatgatagatcataaactgaatgcgttttccttattgttttccattgcacacctggcagtttttttaggggtttcatttttttacctcactgttgttcccaaacacgttcaccaaaatcgacaggcctctctttcacagaatcatattcctgtcgttactcgcgcatgattaatgactgcgaaatttgtttaacgccaacagccttgctattcagttatcgcccgatctgcacttcttgaactcacggcgcgtcgggtcagataagtcctaccgtttttggagtgaccgtttcttgtgcgcaatcctttcagtcgttttgaattatttattttcggtcgatccagagcaaggactgtaaatgggtttgagcatttttcgacaccttaattattttttcagcagtcatgcctaagattcatctaatctcactaacgatcatcatgtctggtcttttcattcgcagaacggctaatgagtcatgtggagaagcagcggtacgatggatggtacaacaatttggcccacccggactggggagctgttggtaagttgaagtttttttttatgttaaaggtgggataagtcccgcctgttgagtaagtgttgtggtaatgttcgatcattaaccatatctgcgatcatgtagggacctgagttggtcagctatttttcattcaatgataagtaatgtcttgatatgtttataccctacagtaggatttcgaaggtccaaactaagaaatgtcataccaacggattgctgaacaattgcatcacccgtttgggcggtgcgtaaaaatcccctagggtgcttctgctaaagaaatctgtcacattttattaccattgtgactttcggtatgcggttactgtggttaatgatcatgctgtctccatgggtctccttgcgtcacatttcgctatgggctgtattttcacaatagtaatatgatatattaaactgtctaccacgaacatcatcttgtctcgacagttaaatgatgtctcgtagtttacatggatgaagtagtatttatcttttgtttttacttcatagtccggagtctaccttgaatattatagtataccctcagtatactctaattagtatactctgagtataccctcaatgattataaggcttacaaattgaacacacgatttaatgctctctcttaacagctttgcaagtgtttcccttttattcctgtaaaacttttattagtgacatcttttccaaaacaagatgaaggtgattatagaacgaagccacacctccaattttagagagcacaagacttgagaaccaaacagcgctttgcgttgaaaatctatcccccaccagcaagcaagcaatgtgattggttttcaacgcgaactgttggcagattctgtagtcttgtgcacatgaaaattcaaagcttggcttcgttttataatcaccttatgataagaattttaagataaaatatgctttgcatatggttggcgttaagtcagagtgatccaagtacaacatttggcacagttgaattattctgttattagatgcaaaattactaatctccgttttactttcagcaatgaatgttagatgcaaatcgataaaaatatgcagtcagagtgaaccatgtgctttttaccattacaacgaaaatgaccagcgcgctgaggaatttgacaaaatataagtgatttgtcagattttttggcatataatgattattcttttttccatcaataaaaaggtagtgcttcgtgaggcccaagcaggacagttcggttttggtcgtccgatatattttgctcacgatttcgcgcgttttcgtcgccggagaattttttttccctgttttggagcgtcttgctgggtagtgattcgtgaggcccaagcagaacagttcggttttgcgtcgtccgttagattttgctcacgatttcgcgcgttttcgtcgccggagattttttttcccttgttttggagcgtcttgctgggtagtgcttcgtgaggcccaagcaggacagttcggttttgcgtcgtccgttagatgttgcttacgatttcgcgcgttttcgtcgccggagaattttttttttcctgttttggagcgtcttgctgggtaggtatttgggaaggcccaagcaagacggtttgttttcggaacgctgacagtgtcagttttgtgttcagtcgagaatggattaccaactggtgagttcgtttcatgcttaaaataacacattttttcttgaaagcgtaacttttatgtaatattaaaacaaactttgtatggttcgtcactacaagtgtcggcattattcctgtttcatataatttaaaatatatacatgtaattttcagttttggtcattaataaaaacctcttttgaattgttcgacagtatagatgttgacgtattttttaaagtttccaaaaagcaaaaacttctcgagacaaaaatacaaaactagctttaaatataagtcgtatatttcccccttgtccatggatcgcatcaccgaccagaggtgactcccagatctcttcctccctcactaataaatacccttcccgtggtgattgtggagatgcagaggtattctcggtctctagaagcaacaatcattacaccctaacattccttccccatcccaactgactgtaaggacttggccggcgccgttattgacaataatattagatctgctaaaattgcacttcgcgagtaagcggaaactcccatcccttattcatttggatcgtagtgcaattattaccagttctgatcaatcacggagtagcaaccattgacatgtacagtcagtctatgctatgctatgctatataatgattattcttttttccatcaataaaaacttataaatattacataattcgatgcatctgatttggatatctggccatttacgtcatttggatatgtggtgagaagttacaacaatatctgtgcggacagagtggagcaacgtcaaaacgcagtactgattgattattgcattttattagtcaattccagagtcagagttttcggatgttacatggtgtctgtatggaatatcctagatcccgcctgtattattatttatttatttattgataaaacctcaccaacaatatttcgccaattcactcggttcatggccgcttctctccatcctcgactgcgacccacgctctccaggtcctggtgcacctggtcaatccacctagctccctgcgccccacgtcttcttgatgcaaccggattcgtagcgaacaccatctttacagggttgttgtccggcaattttgcaacatgccctgcccagcatatgcttccagctttagctaccttcacgatactgggttcgccatagagttgagcgagctcgtggttcattcttcgccgccacacgccgttctcctgcacgccgccggggatgaatctttcttgaccgcagtttcttctggagcccatagtaggcacgaattgttgatgcgccttcgtatttcccgacttacattgctgtcagccgtcaacaatatccgagatagacgaactcgtccaccacctcgaaggtatctccgtctatcgcaacactgcttcctaggcgggccctgtcgctctcagttctgccaaccagtatgtactttgttttcgacgcattcatcattgattcttgttgctttgtgtttaaggcgggtgaacaaatctgccaccgtttcaaattttctcccaataatatatatgtcgtccgcgaaacaaacaaattgtccgaatcacgtgaaaatcgtgcctcgactgttaagtccggctctccgcatgacaacttcaagcgcaatattgaacaacaggcacgaaagtccgtcgctctgtcgtagtccccgctgagactgaaacgcactggagtgttcgcccgagatcttcacgcagttttacaaaccgttcatcgttgctctaatcaatcttgtgagcttcccgggaaagctgttctcgtccatgatcttccatagttctacacggccgatactgtcgtatgccgccttgacattgatgaacaaatggtgcgtagggacctggtactcacggcatttctggaggatttgccacgtggaaaagatatggtccgttgtcgagcggtcgtcgatgaaacctgcttgataacttcccacgaactcgttcgctataggtgatagacgacggaagagaatctgggatagcactttgtaggcggcgtttaggatagtgattgcacgatagttttcacactccagtttgtcgccctttttgtagatagggcgtataacgccttgcttccactcctctggtagctgttccgtttcccagattctgactatcagccgatgcagacaagcgaccaacctgtccgggtccatcttgatgagttcggctccaataccatccttgccagcggctttgttgttcttgagctgttgaatggcatccttaacttccaccatcgtgggagcaggttggtttccactgtccgctgtgctgacgtagccatcgccttcgctggcctgaccttctgtgcctgtgttctctgcgccattcaggtgttcatcgtagtgctgcttccatctttcgatcacctcgcgtccgtccatctaaatgctcccatccttatcccggcaatttcagctcgcggcacgaagcctttgcgggatgtgttgagcttctgatagaacttccgcgtttcttgagaacggtacagcaactccatcccttggcattccacctcttccaggcggcgctttttgtcccggaataggcgggtttgctgtttccgcttcagtctgtatcgttccacgttttgtcgcatactatgctacagcattgcatttttttcctctaaaacctcctggcactcttcgtcgaactaatcgtttcttgagctccattccacatatccgacaatgctttcggcagcgacgttaatggctgctttgactgtcctccagcagtcctcaagaggggccctatcgagcttatccggcaacgctggctcaagatgctgcgcgtaggcatttgcgacatccgattgtttcagtcgcgctagattgtatcgaggcgggtgtcggtaccgtacatcgttgatgacggatagttttgggcgcagtttcaccacaccaaatagtggttggagtcaatgttagcgccacgttatgacgtcggttatgtcggagaagtgccgtccatcgatcaaaacgtggtcgatttgcgattctgtctgctgatgtgatctccaggtgtacccatacgggtggctgtgctgaaaataggtgttgcgaatggccatattcctggaggcggcaaaatctatcagtcgtaggccgttctcgttctttcctcgaactttccaatcgtcgttctcaactcctcctcctggccaacctgagcgttcaaatctcctatgttgatcttgacgtcgtggcttgggcagcggtcgtactcgcattcgagctgcgagtaaaatgcgtccttgtcatcatcagtgcttgcggagtgtgggctatgcacgttgattatgttgaacattcttgcacattcgttcattgatcggccaccacccgatcacgtgcctttgcatatcacccatttctatgaaagctgttcccagctcgcgtgtgttgccgcagctccggtagatggtatgattaccgtaagccggggtaacattgatcagtttttaggatatttctaaaatatttaattcaaaaatgcgaatgttctgagttttatacttttaaaacaagtactgccacccatagctcgtgactacatactgtattttattttttgaaagattttagcatgtttataaaaatgttttaggtgatttttcctgatatggggtaacattgatcatccatgtaaacaacgttcggttatattgaaaatggcccctgaagttattttaaaattaaaaacacctcgaacagcggaaaacgcctaaaggtaggcacttccctaaggaaattttacattcttaacagtaattcgttaatgttgccttattgaacaaacttataaaaattttgacagcggaatcgattttggcgatgccatttatggtgagaaccgtgctgttagtgagaaaacttgctcatatcgcttgcagaacctatgtgagacatgaatcttcggtagtgtcatccttaaccattaaaatcattgtttcgcaaacttggcaaatttacgcataaataggagaaggtatcgaccgtgattgttttattttattttgttttacggctatagcggtcatgcgactcaaagctaaagggagtctatagaagcaaatgatggaaacgaataggtgcataggcgtcgcaagggagcgacaagattgaaaatttttaattaggtagtgaaaattgagcaagccattttaaagtcagtaagcatcgaagcgtcctgtattttgcctagcttctctactggaaaagggttggctcaaagctttgagctttgctaccaacacaggcaaaatacaggaggcttcaatgtgctcttatactgacggcaatcaaccgaacggttctatcgatcgatgactgatattgggaattaacacgcagtcaaagatggtttgtctttatcatgtgtgctcttcccgccagtcaccacatgatcctattagaactgcatttcttattagccaaatttttcatacataggagaaggtatcgaccgtgattgttttattttattttgttttacggctatagcggtcatgcgactcaaagctaaagggagtctatagaagcaaatgatggaaacgaataggtgcataggcgtcgcaagggagcgacaagattgaaaatttttaattaggtagtgaaaattgagcaagccattttaaagtcagtaagcatcgaagcgtcctgtattttgcctagcttctctactggaaaagggttggctcaaagctttgagctttgctaccaacacaggcaaaatacaggaggcttcaatgtgctcttatactgacggcaatcaaccgaacggttctatcgatcgatgactgatattgggaattaacacgcagtcaaagatggtttgtctttatcatgtgtgctcttcccgccagtcaccacatgatcctattagaactgcatttcttattagccaaatttttcatacataggagaaggtatcgaccgtgattgttttattttattttgttttacggctatagcggtcatacgtttacgcataaagttaacgcaatttttgcaaaaatcttaaaatagctcatagatataagaaagagaagcaacattcatgttttggcaatgtttcatcaataaattatgataccaatttattacgagatgagtcattccgatcaatgttaccccgctgatcaatgataccccggattacggtacctctaaacgttcgcaccattgatccctgccctggcttcgtagccgtgcggttagtgtcaccgaggcatttagccgcatcgtgctaaggagtgtgggttcgattcccgcctcaggccgaaaaacttttcgagaggaatgttttccgactgtgccactgggcgttgcatgctagtccgttgtctagtgtggtgcttccttcaaagggcaactagcccactggaagcattaaaaaaaaaaaaaaaaaaaaaaaaaaaaaaaaaaaaaaaaaaaaaaaaaaaaaaaacacctcttcctgcaacgctacaatgccgaatccgcggtccttcagcacgtcggcgagtatgcgagtgcttccgatgaagttgagagatttgcagttccacgtaccgagtttccaatcgcttccgtcgctgtggtctttgtcgattgttccggtccgtattctctcgttgacgttcctgtgctgatgtgtttttacggttggcttgcagggcctgacaccaatcccctagatttccggaggcccattccccctaaaagttcggaggactatagtgcgcagtttagcttagagtccttctctggcactcggatgatgatctgccgcccctgacatggggaacagacgctgttgtaagccgctcctaacatggagtacagacgctccaggtttgcagaagcaaaagctaaagcaaacccccccttccctgtcagcatacgaccaaagttcccaccggggttgattacccgatcttccctaaggttactcgtaccccggccagtaccacgaggaggtagggataggagttgctgggcaagatcccgcctataggaccagtcaattttggtcggtaatcatggtttttacttggtccactctgattgaatgcaactttgaataattttggtcttcaatgctctgacccaacaaaactttaattatcaagctatcgtattgtaactgatttcgtaattaaagatatggattcttgaaaagttttcgaaactaatatcaaaggacgttggtaatttgtttatcttgaagatatgaacctactttgtccgtgcagacattcaatgattgttttccaagaaattgttcagtcaaccagtttgagcatgttttaatagttatttatgcaacaagttggaaaatcatgattttttcagcacgaatcgttcatttatccgacgaggcttgaacatgtcgtgggtcaaagagtatatcggatgttgttacaagtagcgatcaactccaatcatggtgccttcgcgctatgatttttttcgttcttctatgcccaaatgatttaagaatcattaacagtatatccgaagatcttggtgatttatcttcggatatactgtttatgattctaaaatcatttgggcatagaagaacgaaaaaaaccatcaaaataataaaactttgactcgcgaacaattaatcgctagagcacatgcagaacgatgcatttcttttatttctagtatttttattgcatatatatctcaaattgagcagttgaagatatattgattgatttactttgaaaatctagcgaaaattgttgccccaaagctgaggatgcaacaaaattgacttctacttgttttttttttcattcaatcaaaggcatcccaaaatcaatcgtaatatagcactcaaaaaactccttagatttttttcataacatttccttagattttttcaagtttttacccttcttcttcttcatcttcatctttttggcgtaacgtccctactgagtcagagcctgcttctcagcttcgtgttctgttgagcacactttctttgccaattgaccattttggcatgtgtatatcgtgtggcaagtacgaagatactatatgctctgagaagttgagaaaatttcctttacgaaaagatccttaaccggcgggactcgaacccacgacccttcctgaatagctgttcgtttaccgctacggctatcgagtacttatcaggtatcagaaggccgaccatgtgccgtcatatttgatcctatttcatcatctacccgttggaaaaggaaagatatgggaaagccgggagggaaaatcgcaaaagcgaaatgagaggatgtagctccataccacaatgggttcaaacagcgccctaaaaatggcactgcaactcatgagcgtaaagagagcctatagatcattaccacagcgggttaagaataacagaatatcctgaagattcaggcttctgaattcagtttcatttaataagtgtttaccaagtaattgtaatcgcatttgcgcaaaaactggacagttacttatcaggtgatacgaagttccataatcggagtcacaactatcacacacaaatgagctagcacgctgaatagttgtcatgtgatagttgagtcggcagcggcctgtcaacgcgtcggtcgccctagtgtactgagtacacgcactttgcgaaaagtcgaaaaacgcgttgaaaatcccttcaaattgatccgggtgttggtcctattccaagatctactcttcttcttgcttgtagttacttgcaactttgcttcttgctatgtagttacttgcaactttacaagatatgcacacttaaatttgatgtgaaaaaatcagaaaatcgttcgtaaatcttcaaaatgaagagctagcgcttcagtgtctttggcaaaaatgtgtattttcacagcaccttaaacattgtagaacattgtaaaaatgcaaaaattcaaatttagaagttatggagaaaatatgagttttaagggggtacccatcatttttaccccctaacttcgtcagtgtaggagatagaacttatccgtcttcgacaaacttccatgaaatgatgtcgcctacaatacttccttagacagttttcaattttgataataattaaaaagttaattttttttctcagtgtatatcactttaagtgaaatttttttcagtgtctaaattaagtaccgtaaaacggggtatcattgataatgcgggtaactttgatagtgtgtaacccaccacatactaaacgaaataccataatttctgttaatcagttgggcataacgaatataaaattaaagaatattagtatgacacttcatgtaagagcggttttcacttgaatcaagaacatttgaggctttttaaacgagaatcaaaaattgacacaattttagcattttcgaaacgcttacaaataatctgttctacgatcactatttgatgtagttttggatagttggccacttatctttgacagcctagttatcatagaacatgaatacggtatcgaatctcttagcgaaaagcattttcacaaactgtgaccatttttgtaatctaagtcagaaattttcatataacgttaaacgcctagaggtatgcaataccctacaaatgttcgttattcattcaattttgttcgattcatactccattatcaaagttaccccaaaacagaaaaccaactttcgattatatgaagaattatatatccattcaaaataaatctgttggcaatttatcgactgcaatcgatagctaggatgccagtacttgttttaaaaatataaattataattctttgaaacagcatgcataaatattcaaattttcttcgaaaaaactatcaaagttaccccgttttacggtactcaacaaacgaagaaactttgtagaacatgtcgaaacgctaaacccaatagtttcagcgcaaacacacatgtcccactttttttgatttcgtcccactgtggagcggtcgcatcgtgtactgagtacacgcggagcatttagattatacatgtagatgtaaatctaaaataggaaagatagaattttgatgtcttcggcacatttcttcagttcagcgataccaatcggacagtgaacaaatgaaactttgaaaacatcctcacccttcattggccatcggaatgtgtcccggggaaccggggaagtggacatttcgcaatgcaacatctcgaacacaaatatctcaggatctagattttttagcaagatggtgtcttcggcaaagttgttcagtagatcaaggactaacatgtgataggctgcttgtttcgaaattctggcaccagttggcgctagtgagcatgtaatttttcaaacacggatatctcaggatcctgattacctagaaagatgcggtcttcgacaaagttgtttagtaggtcaaggactatcatattataggccatctaacttgaaattctgccatcagatggcgctagtgagcatgcaatatttcaatcacgaatatctcagtaacccgattttttagaaatatggtgttttcggcaaagttgttcgatagttcaaggactaatatgagatgatctatttaattcggaattctttcaccagatggcgctagtgagtatgacattttttgaacacagatatctcaggatcccgattacctagaaagttgacgtcttcaacaaaagtgttaagtaggtgatatgccatgtgataggccacccaacttgaaattctactaccagatggcgctagtgagcatgctgtattttgatcggggcaagctgtaaagtataagaaggtctaaacatgtgatgggccgtttgattcgcaattcttccactacacggtgttagtgattattagagcaaatcataatttgaaaaagtttgaaaatccaatctcgcatatgttcgttactataattaccttaaaaataatgttctgtgaaattcacagttttctaggtggttattaaaaggtggcccaaagacgatgtaggcttatatgcaaattactatagagaaattaaaaaaatgttccaaactcgttagtactagattgtaagtacaaacttatcatcacatagtaaaaactaattcttcaaactataatgaagtaatttgctgaagagataaattcattccaacggataggagaagagatattcatgagtttgtttgcttttatttagcttcatgaggggttatagccctgcaaacataaaaaagaaaatcccacacaatttagttcataagggatttgtttcttcagcaattcattagggtttgaagaatgagtttttagtatggaatgataaatttgtacttacattacagtactaatgtgtctggaacatttcttaaaaaatttccatagtaatttccatataaacctacattgtctttgggccaccttgaaattaccaccaaaaaagctaaaaatttcacagaacattagattagaaaaatggcgtctttgatcaagtttttctgtatatcacgggccaacgtgtaaggggtaaaatatactcaaaattcttccgcattcaattttacaatggagagggatgctacatgttcttccatcaggctacgttagaggtcctaattattttttttctaatgcagaatctcgagttcctgattattcttcaaagttattcagtaagcaaagtgctgacatgctatgggcaatcatatttggaattatgtaacacagcaaaagtgagtattttattttctgaatatcttatgattctgatcatttgggctatcagtgcacgttttgtcaaatgttaaaatatttcgccaccagtgaaaaacgcaagcataaaataaaacgagagttataaggttcattatcgttcaaactctagattcaaattgatcaatcttatttttatatttagcctattaatcggacttctgatgaatacattgattatgttgcgtgaaaagacttcgtacttaaaacgcaaagcagttctcctcacataagacgcactatatctacgcgatatacaggtgaatgaatatccatacgaaacatttcgccaagaatccaagagctgagaattcggtaattttaaatatcgaatctcggaacataatctaccgagatgtcggctaaccgaatttttcacaacataattactcttcgattttggtaagattaattttcgacatcatgccaaagtgtttcatatatttgttatgatatagcatcaattatgaacaaagtatatagaaaatcaatgttgaaggatgatttcctgttttattgtttagatagtttgagcgttgactataatgataaacccagagaatatgattatactagagaagcgctgagagcattttgaatgtatttataatcaacacaggcaataactgtagatcgttgcacgcctgacttaacctcaaaactctatataaaacatatgtcagcaattccagcagtgaacgccaaatccatataaaataatcgaattaattccagcaataaatttcaaagagcaggacagttcattgagcgtgatgagagagggacagggaaggggaattattcgtgacgtcaccatgcactcttctatcacattctaggtgattcgagcaatgttgtagtgcgcgtgtcatcctgtgagttgccataacagaccgagctaaccggtgacgacactttcaagtcgcttttcactaactcacacccaattgttattgtgtaacagctttctgccgcaaataagacaggccttttaatgaaacaggtccgtgtttccattcgtttcaatcggtggaggactggtgcatacacgggatcgtcatttccatacaagactgtcaaaaaccttccgaatcaatttatttgaaacatctcgtgaaaacgcctactgctcgattggaaccgcgtttgacaattcttcgatttcagtattcgcgcttctctatataaacaaattctgtacataaaccctactttcttgataatcttgaatttcaagtagtgtagtaaaatactttgaagtgaatgaaagccgaatttagtactgtatcatttaattcctctagagtgtgtatcctttgacagatacgcgtatttcgatctccattgtaagctcgtctgtatcgtgtactagactcgacgaagactcaactcggaaagtgattctataaaaaaaaactatgttaaaagtgaataggaggacgaattttataaaaaattgtttatactggtgcagctgataaagaaaggaaaataaatataattcctaaatgtgtttcctaacctgtttatccaagatttcttatagtgtttgtattgctgtgtgcgtttgaaatgcaaatatcaaatgcgggaacaacaaacgcggtaagatgtttaaaagggaaggcgaagtcaaaattagtttttctttgctgcgttagcggtgatatggatcatgattgctaagtatcctttgtatactttgtgttcgcgcatttgaagctcacaaagactggatatgcacgtcaaatgcaaacagcaataatagaagcctggaagcagttgaataatatttgtttcaagaaaaatccaacacagtttgtaaagagaacagaaaacgccatatttctaaatactggaagcagttgaataatatttgtttcaagaaaaatccaacacagtttgtaaagagaacagaaaacgccatatttctaaatactgtcaaacctccatgaatcgatgttccatagctcgatatcgactcatgaaacaatacttgaaacaaaaacaaaaatcatgatgcacccttcaataagctttccaaagaatgatcccttaaatatcgactggaaatttgactgtagttaagattttgaagtatttacttatggaattttcatgctgaatagcgccgtttggtagcatagttttgaatcaaatggattataacatgttaaacatactttagccttggacagaataaacaactttgttgaagacatcattttcatgactatgcaatcacgatcctagatatttgggttggaaatacagcatactcagtataaccatctagcggaagaattccaaaccaagtgaggcccatcacaagttatacttgatttactgaaccatttagccgaaaacttcatcttgtgatgtaatcgggatccttagatattagtaataataaatatacatgctcactagcgccacctgttggatgatttttaaaacttaaagacctttgcatttaagcttctgtctaatgaacaactttgccgaatatgtaatatttcttagtaatgagaatatatcaggatcatgtttttaggcatcaggatccaatgatatctgtgtccttgatctactaacagctttgctgaagacaccatcttgctataatatcgctatcctgagatgttttttacaatagggaaatctgcaaacttacgcctgagaaagtaactcaggcagtatggggttgccgcaccaacgacaacccactaaaaccagcaaatgcactgtacttgagcaaatcttgttgaattgctcaagtggtgtcgacattacccttggcctcagacccttatctccctaaacccaccttacagtatttcggtatggtattgctatcctgagatagccgcgattaatatacagcatgctcactagcgccatctggtggtagcatttctagttgggtggtctatcacatgctagaacttgacgtactcaatacttttgctgaagacgtcaactttctaggtaatcgggatcctgagatatatgtgttcaaaaaatgtcatactcactagcgccatctggtgaaagaattccgaattaaatagatcatctcatattagtccttgaactatcgaacaactttgccgaaaacaccatatttctaagaaatcgggatcctgagatattcgtgattgaaatattgcatgctcgctagcgccatctgatggcagaatttcaagttagatggcctataatatgatagtccttgacctactaaacaactttgtcgaagaccgcatctttctaggtaatcaggatcctgagatatccgtgtttgaaaaattacatgctcactagcgccaactggtgccataattctgaaacaagcagcctatcacatgttagtcctactgaacaactttgccgaagacaccatcttgctaaaaaatctagatcctgagatatttgtgttcgagatgttgcattgcgaaatgtccacttcatcggttcccccggggaacaatccgatggccactggaaggataggatgttttcaaagtttcatttgtccactgactaattggtaccgttgagctgaagatatttgccgaagacatcaatactctatctttcatagctttagattgacaatcaaaattgctccgcgtgtactcagtacacgatgcgacctggggacggtcacttatgacgtaaaaagttatagtgacgacttccttcggaagggaagtaaagccgttggtcccgagatgaactagcccagggctaaaaatctcgttaataaagtcaaaccaaccaaccaacgatgcgaccgctggtgtaactttttttgagcgactgacggaaggttaagatgtatgtgtagtggcgcaacgtcgaaaagggcctcgagcgctgctgtgggagttgtagagtacgcaccaaacatcgccatcaagcacatcctttcgagatggtccaattttgattggattgttctcacttcgccctttttccaccacacaagacatccatatgccaacattggtcgaacaactgttgtgtaaatccattcgatatgcttaagtttgaggccccaggtttaaccaaaggtttgccggcattgaccgaaggccttgcaagcttttttgactctgaaatcaatgttaggtgtccaagaaagtttggaatctagaacgactccgacatactttacctgattattcacatcaatctcagtgccaaaaagacgtaaaggttgaattccatcgcggtttcgtctttccgtgaaaagaacaatagatgttttattcgggttaactgaaaggccatattaatgacaccaactctcgactacttgaagagcactttgcatcaggtcgaatagggtgcttatgcacataccaactatcaaagctagatagtcgtcggcaaattcataagtaagaaaaccgcaattattgagttgcctcaatagcgtatctgctactagattccacaaaagtggtgacaaggctcccccttgggggcatccgcaaacactcaatttccgaatcgctgcttgacgcaatgtcgagaagagatgtcggtttcgtgcagcttccaatatggcatcgaaagacacgttatcaaaggcaccctcaatatctaagataacaccctagcaggattgcttctgagcgaatgctttctcgatatcatatgcaactttgtgtaaaagagtcacagtggactttacatattggtaagcatgttgattcacatgaagaggcatggttgccaaataaacaccacggatgtgatgatcgataatgcgttccagacatttcagaagaaaaggggtcagactgattgatcttcgcttcttcaaacgacgcatgttctcctttcgggataaactttacagtaatgtcacgccaggatctgggaatatacccggtagcaaaactgcttacaagtagctttttgaaaacatgtttgataaactcaaatccctgctggagcagaacaggataaatcccatccgctcctggagatttgcaaggagcaaaactgttttatgccgattgaatcgattcagtaattacgatactgcgagccgaagccagagactcatgactacacgaaaagacatttggtttatccgtagatgctatgtcacaaccggggaagtgtgtattgaataaacattctaacacttcttcattagaagaagtaaagtcaccattaggtaagcgaatttcgttcacttggaattccttagatttctttagattcaatctattttgaaacttctgaatttaagccaatgcttacttcaatgcaagaaaatgcacagtggcaagagaaacgaaaaatgtcgaccttcacttgtttatccagcatcctattatatatcaccttgtgtctttaactatttttcaattgcacattccagaactcgagcaaagagcatatttctttcgcaggttcctatctcttgctgttaacgtagtaaacggcaaaaaaggaaaaataataataatagcagtctactaaagaggaaaagtccattcagtagtgaaaaaaatacacacacagtaagagattaatagacaatgagctgcattcacgcagaagcccccggcgatactttttgatgaaggccaaacccaataggctatcaattagcggctttgagtagcttagtgtagaagtgcagtgatttgtcagatcaagtctctaataaatataatccaagcactaatgttagccccctgtttgacaaaccatgtgataaatggatgaatttggtttggttattgaaacctagatttgagtggaagcaatttagatccaaattgtgcacagaagcagtcattgaccggaaattgcacacttagatctctatacagtcaaacctccatgagtcgatatctgaagagaccatcgactcatggaaatatcgagtaatggaacagaaattacttggaaagctgattgaggggaccatcattgtaaccattaaattttgattttagtatggttctatgagtcgatatcgagtcatggaatatccactcatggaggtttcactgtatttagatagagcatcaagtgttgtaaactccaagaccttgagtaaaattgacaaaaagtaataatttagagcttcagttgttttcaaccgatatattttctccttgagcagagtaatgccaatgatctattttagttgaaatccacaatgcaatacattaagtaggtactgcaaaaaaacctaatcgtctgtgtccacaaattgtccaaactgacaaatctgtgtaaatcttcactacattaaaatgccagcttcaaatccgactaatggaaatattttggacatcccaggcagaaaaacgttagcttgttaactaagcaaatggaaaagaaagcagttaatagcttataagttttggttgaatgctgaacttagaatatagttatgtctcagttgggatataattccacgaagaagaaggaatttgatgatattatctgcattgcgtgatttcagttagcacaatcgattatcaaattcgctttaacacgacaaaatacatgacgagtgcttatgatcaacgctgaaactaaatggctaaggattacgatctcagattggttcctttaccgcttgttgaggcttcatgccttatgagtttggatgcatgaagagagccccgcttgagcatccgatcgtcatcgtttctgttgcaattcagtcgcacttaaatttgccgtaaaattgtttaattggatataagcggctctcggagcttatttggttggtttcacgccgagagagcggtcattggcacaagaattttaaagattgatcatgatgataattttgatcaaggaagccgaaaatgtttggaggcgtgtctgcgtttgaaaggctgtctgattaatgtcccgaatataacgaaccgtgaagtaacgctttgctaattattcatatattttatttgtatatgctgtccttgattgcatggtcgacgcatatcactattattacgaggaaagctttttcttgcgatttttgacccaataaatgtatgtatctgttgactatatctcttccgtaccatcaaacggcgcacaatggttcagatttccaaaaagctggaaaaacccaatttcaaaactaagtttttagttgaaaaacaaactcaaacattcatcttctatatccgattgttaaagattcttcatgcctaagtttgcccaaacgatagtttttttaagttgagagccatgcatgaaaaacagcattcttgttggaattgctctatgagaaccaaaacattgtgactatgctcagaatagagtcttcaaccctagatcgtgttaccaaacaatattgaacgctaaaaagagtaaaatgcgtaatttatgccatgatttcttaaatctggacaactgtgcggtgtgacttgcaacaattttcaacattaatcaaccaaaaccatgatctaaatgattcctactaatataacgacctttttgaatttttaatggccagtccgcttactgaatggaccaaagattgaatcgaattgttttataatataaaggatcataaaaaggtgacgttttttaaagtcccaagtattatttttaatgtattcaaagcattagaaccagtacaagagtattttgtttactaatttttttgaacaaactgattgacatatttttatatgggaatcatcaagctcctttcttatctgaataaaatttttatcgggtgtttgtagttaattgatgcgttgttactcgtttaataataaaatagacctacaacagaagtgtttcaatttaatagatttcttaattgcttagaaattgaatgtagcaagtcaccgcgcataggagcatttttataaaaaatatttatacaaaaaagttgctgttacagttttgtaaaacaaaatgtggagcattattacctattagttgcgtaaacaccatgtagagtacaacttttgtcaattcactctggtccaatagccggaccgaaacgtcggcgatgataagtaattaatcaacgcaattttgaaagactgcaagccgaaactcccaaaataagcattctgccttatgttttctggtctcgatttttaacctctatgaggtaccgttttgtctcaaattccgaacagactcatattccgaaccctcggtttttgtatagcgacttggttgaaatgtgtcactgaaatgtgtcatcaaataatcggaaaatggcagtcaattgaaattcaaatttaacatattccaatctattttgcacctcaggagttttgatgattctctagtgcggggttagtaaaactagctgagatatatttattttatttgcgaaattaaacgtttgaatacgatttatacgcagttttgtctatttttgtcaaaaaggatgtaactattaaggatattcatttttttaaatatgaatgataacaatagttgatccaatgaatgatctttgcattgaatcctaatgcaaattgtacaggctccaaagaaaccttctgagactgtaacgggtataacagactcttcaagattttcatcttagattcaacgaggaaaagcttcaggaattatcagaacaattttattttgaatgctttaaaagtctcctacagtcttcctctccagaaagtcttctaaagatttctcctccagcgattttttaaaggatgcttagaaaaatttctccagaatttgcttcaggaaatctttgagaacttcaaagcttctacctccagaaatttcctcagttattactgtgatttattttacaaagctatcctaaaatttcctccagatatttccactaatctttcaaccgaattctgtgacactgggagagtgtttgaaaaaatagggttttttttaaggaaccctggaagaattcctccgcctgttcatatgggttgcttcaagaattcttccacgtttcctacaaaaattcaatatttcttgagggtatcttcgaattaacctattttttttctagaaatttctcctgcatttcatataagtattacagttttaccaaaacaatcttgaaaaatatgtaaaaaaaatcccatgcaatcttcatatcttcagtttttactacagtaatttctacaataatttctccgatcattccttcacagtttctattcaatgttttccgagaattttttttttagaaaatcctacagaatactatcccgagagtcgattgatttgtttgattatcttagtaaattatctaggaaatcttcttcaacttgctatagagtccaggagttatttcagagatccttattcattaagggtgactttaaaacttatccaagttttatcaaagttttctttaaaaatgtgaggtgttttttacaaaaaaaaattcttagcttttcattggagacattcctggaagaattctcgacaaaaatttcaagacttacttaagaacatgtcaaagaacaactggagtaatttatgtagaaaccttcgaaggaatttctggagcaattgctgaaggtatctttagagaaatcccttgttgaaatctaatataaatcttgaaagacaatttagaaggaaatccctcgaattttctggagaagctattgattgaattttaaaagtcgttttgctcggaaatcatggagaatgtcccagggacattcttgaaaaacttctcaaagagttcttgggggaagataatttttgaaataatctttggagaaattccattgctgtggttctccttaagaaaatccaggttgaaatcttgaggtatcctaaacaaaattcctgtagaaattcccaaggaaaattcggtgagaaattccttgggaaataatcattaattgaacttcttcagaattttctggagtaatatctgaagtaatggcatgaatatggaattaaaagctaaggggcgtcagtgacaaaaagttttatagttttatggaaatctactttaaagtttttcagctatttttcattcaatataaattgtaatggagtcaaaaaaaaaaacgaacctgtcttctaagcattttgctatttttttttcttctgagcggaggaatcaccttcctggttttggcaagtgttttttttttatgatactgggaacctggcaatagaagcaggttcttgtgtcttcttgtgatatcaccgtctggtaaatggtgaggtgtatccgaaaagaacaatgctcactacggtgcaagcttgcaatgaagctacttacacgttcaaatcaatgggcgaagataaatgaccgttgtagaaggtcggtcggttcaaagcggtagttgatgtaaaatttacattctggagagcaatcacccaagaagaacttacgccagttagctgtgagctgtgcttttaatgctaaggcgaaatgacttgatgtggagagcaaggacaccgaaagttcttgaataataccttttatcaggatattgagatacatcatcatcgttgctgctatcggaatgagtccagaatgtatgtagcgattgggcgagtcaccccaagaaggaggctctgtggtagcggaatttgggtcaagtgtgccaccttaagcaaattgttctctaactttgcccaaggctcataaaaaccaccaatttagcctcatgatgatagtttcacatcttttcataaccactgtgccattttaaatgaaaataatttcaaaaagtattagttttggagcttctcaaatatcatccaaaataacctatttttcgacactatggggcaagtgtgccacccatatggggcaagacggccaccgaatgaacatcgcatgtaattcgacttgtaatgaaattttctttatttcatattaatattacttaaaaagcagacgctaatcgataatttaaaaaataattttaagtttaccgtaataaggtggtgctttataacaaggttcaaaacatgcgtaactccctattactcattcgaataactaaaatgattatttttgtctccattcaatacaatataagtagtacccttatattatggcaaatatgtataatattacactagatcagcacttaataacggtaaaatattgatgtagatatgtaaaacggtacttaataagccgaaaaaaaaggtttttattgaatattttgagataaaatcactttggggggtaaacttgttagttattcccctactatacttcagaaaccactaccggtgcctcattttagtttattactatgattttgttgatgatgtttacatttttataaatttcacttcaacaatttttgtttaccaaataggtggcacacttgccccaataactatacatttcaaccaatctggattgtgtatgtaaaactaaatacttttttcgttcaaatgccacaataacttacacatttgaatagtatcacgatgtacagtacgttaggaaaatctgttaataatttaccttttaccatgctatttggaaacaacgaaatcttataaaaatccactcaaatttggttgtctttgcaaaaatcgatgtaaatacgtgtaaaatagagcaacgttcatcatattttgattattatattgtgaactatgaaggaacatattgttaagctcaaagaaaaaatatatattgtagtttttataaaaagcaggggtggcacacttgcccctatggcacacttgccccaaagtccgctagtcttgactacggagaccaagttacgtttgccgtatgaaccaggagtaggagccatggagtagtcctaactaaccgggtgaaagtgcctgtgatacctcaacgacgaggtggtcacccagatgcggtggaaatgtgcgttctaccactgtacaaaaacagggtgttgataagacatggcaggtcgtctaataaggatggcccaggattgcctactaatggtggcaataaaacgatcggtgtaagggacactgcaatagcaatagtgttttcgaccttttgttttagatatattgaataaaagctaatgtttggcagaaataacgaagggaatattgaaacccccttgtttattctgataaaaatcatatatcttatcaaaactatatacttcttagtagatgtatagcgaccaagaatcgaactgaacgacaaaactcccactgttgtaccgattaaaataaaatgcaacaaattacgcccgtcaccacacatttagtacgaggccttttatgccaaccaaaacgagcatcgcaaaagacgacgagatcgctaggctcagaaacggaagcagcccaatgtcagtggcgaactcataaataataattgtcccttggtccgaacttgtctacacactactggagctaaatagccttttagtcaaccggagccggccaccgaggagagcacgtgcaatccccacagatgcataaagttgcaaaagttatgattcgcctcgataatgacctgaccacaagggggcgaaaattatgcgcatataattgctagctgctaccgaacatactctcgctgggatgatttagcatataaacggcggctgtctgagccaattttcagccaacaatgacggagcaaatctgttcgcgaagagattgacacgagtttaactatgaattggatgttttttttcacttacttattcgcactgctcgatttggaactttatgagtaaaccaggcatatattattgcgtgatgcgtcgtcagcgccgaagagtcccataattcaacaggagattgtaaaatgtgaactgcgattttagtgcacagtgtttgacattcagcttataggtcaaaccaattttgaacagtgtcaagtaatgtttgatccaagtttgaactcgtaccttaaaatgcaaattcacataccttcaacaatgaccataagtaatcgttgtgctcttaaggatgatgatgtttcttaaaagttgaaataaaccaagacatgccgatttgaccattcatatctgggataatctgtaatttaaaatcaaggatcactgaagaacagactcttcacaggtgtgttccgtatttattaacacaatcggcaattttcagttgacaaaaattgaagaatttgcttagacaaaatattttacaaatttgaaaagaaaattgcagttttcacaggatattacacattatcaccatacaaattcaaaattaattcaatcacattacttattgtaccacttccacaacgccccaaatgaattgacgtaatattgatcattttcgtttcgttccagataatcatctaacgaggaaggcaccaccggcctactccgacggcgtttacgtcctagccgggtcaagccgaccttcgcctcggaagctgagtaggctgttcatgcggggcaaagatgggctgccctccatgcacaatcgcactgccatcctggccttcttcggtcaggtcgttaccaacgagattgttatggcctccgagtcaggctgccccattgaaatgcatcgaatcgaaattgagaagtgtgacgaaatgtacgaccgcgagtgccgtggcgatcgatacattccgtttcaccgggcggcctacgatagaaacaccggccagagtcctaatgcacccagggaacaaatcaatcagatgacagcgtggatcgacggtagcttcatctacagtacgtccgaagcgtggttgaatgctatgcgagcgtttcaggacggtttgctgctgaccgataaagacggcacgatgccggtgaaaaacacgatgcgagtgccgctgttcaacaacccggtgccgcatgtgatgcgaatgctgagcccagagagattgtatcgtaagtacgaaacgcctttcgataggcaacccacagagatatgcggaataatgatcgttgtttttcattcacagttctgggcgatccacgaacgaatcaaaatcccgccttactcacgtttgccattctgcttttgcgttggcataatgtggtcgccaagagggtccgaaagcagcatcgcgattggactgatgaggaaattttccagcgagcccggagagttgtagtagctagtttacagaatgtgataacctacgaatatctgccagcatttttagatgccgaactgccaccttatacgggttacaaggccgatactcacccaggcgtgagtcacatgttccaagctgccgcgtttcgtttcggacattcgttgattccgcccggtttgttccgaaggaatggaaggtgtgacttccgcaaaacgaacatggactatccggcactgagattgtgttccacgtggtggaattcgaatgtaagtattatagaaataatcacaacaaactacttctttttatctttgctttggttacatgctttaaaaagtcatgacgagtagatcctgatagactgctacaaaacggcaagtatcaacatagtgggagatcccccagtacattatcactttcaaattataatgttttttttttactattatttcgagatgaaaattttgtgtccatagtcaaaatcattattacgtaagttcatatttaaggcggtacttttcatcggttttcaaacatctctgtttatttttccaaaaaagcggccgccttttgctttttttttggtaactctcagaatgatggaaatgtataaatactttcttcagctcttcgcgattccgcttggtttccaacgccagcgtcaagctggaatcgcatattgcaggatcgatgatgaaacgctagctacaacttcttagaagacgcttctgctattcagcctgtctcagtttgatatgaatctcactgatgggcaggcttgatagaaactcctctgcgatgcaaagaggaggcgattttgccgtttttctgagaagaaaaaattgaactcaaaattttcaacacggatcctcaagcgattcgagtgagagtgtgaaaaaatgcgagtattttttcagctactctctctctctctcgtgttgcgatgctcacctttactcacacttaaaaaaaaactcttgagtctgccgcccgaacaaacagtcctcgggtaattgtgcgagcactctcgagctctgtccaaattacgccttttatcgattatctttgactatattgcaggctgatgttgaggatattttttccatgagttccttgcgcgtatttggctagtcacagcttcataagcttctacaaaccgttctccaaccgcttcaccattctctctctacaaaccgttttcttcacccatgataaacagtgaccctagtgatctcatagttgtcattacaagttgtaccaaggtttacttggtttttaaggcgtaccgtgttcagcttcaaatcggcgcgattcagtatttgcatctgaatcgactaaggcaacgacttttaaccatgctacgagatctgcctagatttaactgggacgaaggcgacagtaccattatcgtacttgccgcttcgcagtggcgtcattttctatgactatgaatagtacggatgtcagttctgttgcgccaagttactatatacttaacgtatttcatgatcttgtctgcatatgtacctactttgtctgtttatgtatgcgggcagtataccagctggtatccgtgtgctggatgattgcttaaaaaagggcatgagtcacatgcacagagctgcttgtagacctgtggatttttataaagattctatagaacacgaaaacatttatgttcacggaattcaataaagcttccaacctgattctcgaccggcgggagtcgaactcgcaactctgagtattttttttgcaaaggggaaaactgcaaacagagaaggtaacccttatcttcccggaaccatcttacggtatttcttcggggaggagccagtgcaataatacttaacacatgtagcagaagcagcctagacagactgcgtcttctatccgacttaaacaatgttgaagtggaccagccccggcagggctaattctctgcagccaactcttgatcggctcgccataggcgctgaaattatagcataatggaagtgacagccgtagttactgcattccagcactcggcatccgcacacattctctggattatattgtccggggacgcggccccttccgcatgtagcgagcatgcgatctctcacagacactctttgtgcctgaatctattcaagtgctgtctacagcaacctaacagaaactgcgacaggcagaagttcacttccccatggtttcttttatatcaacctgactcatttggtatcagcggatgggtccatctacctttagtgtagttatcccatacctactgcaaacccttagcgttgtcttcttacacgcgttgcggactcctctggtaagtatctctttggttaaagcattgaacatcttacttgatggtgagcccgatgggcatcatcttggctatgatacacactgcctctttggaaaccgttccaaatgcacttgctgctcttaagcacatgatcctaaacatgcttctcaaccgcttaaggttctgctcgttcaaaaagcttttaacaagattagtcctccatatctcagtatggatagcgccacgtctgccacgagcttgtgtttgctgagaattacagaagagctgttagacatcatacttgaaagctatatagccgtagattcccttttacaggaatagtcaatatggctagcggagctgagcttgttatcgaacattaccccaagatgtctaagggatcgcttggactctatggtgcaatcacctactgagataagcgctctatactcggacttgcggttgttgaccaccaccaccttagtcttgtgacgggccagtcctagtttcctagacttcatccattcctcaactatggcgaagccaacaatcttaacacccgtcggaaggggcagcctcagtacgtcatcgtacatcgcattccataacagcgggcccaggattgaaacttgaggtactcccgcggtaattcgaacgcttttctgcccctcctctgtgtcatacagtagaatcctaccatcaaaatagctttctagaagcttacacaactgcaccggtagcttgagacggtgaaatgcgtgtgctattgcttcccagcttgcgctgttgaacgcattcttcacatccagaatgacaaccgcgcagtaacggatgccgctcctttatgctcgattgccacctcagctgaacatgtctagatccgctttcactgccgcttttgaggcaacattcgggataccatcgggtcccggtgctttatttgacgcgaatgatttcacgatttctgccaactattcgttcgtcactctcgacacttcttctccttcatctgccgcatacggcgctgggggccatgggcttatgggatagtgcgggaagagtacatcgattatcaatcgcagcaactcggacgacttctcttggggcgctatggcacctttgatctgagccattaccactctgtaggcgtcaccccatggactagaattggcactcacgcatagactatcaaagcatgcccgttttcgacgcttgatttccttttttaagaggcaactctgcctctctgaatgctgcaccgagtccttctctttgtgcttctgtacgtgcgcattgcattcttcgtctagcccgaaggcagattgctcgaagatttgcaattgattcgcaccaccagtacaccgacggcctgttctctctaggggggcttttctcggcatggaagcatcacacgctcgtgatatcacagcaactagcttttcaccgtttaggatcagagtgttccgttcacgcctcaggacttcagtgaatacttcgccgtcgaagcgtgctgttttccatcctcgagcttgggtcgagttacatcgcgctgccgtccgcccgcctggtattatactatagcgaatcgattgatgatcgctatgagtataaccgtcgtcaacgcgccagctcatggtacctaaaaggttaggactacaaaacgtcacgttgataatcgattctgcaccatttctgcggaaggtactcattgtacccatattcgccagatctacatttaatgcagccaggaattccaacaatagctggcctctttgattggtgcagcagctaacccactccactgcccatgcattaaagtcgccaaatatcactactggctgccgattagctagttcggctatcaacctgtcgaccatgtgggaaaattctcaatcgaccaccttgggggcgcgtaacaactgcaatagaacacgccgttgatttttgctatcgcaaaaccgtcatttgagctagagactacttcttggattgggtatcgtcctgtcgtccctatagctgctagctgttgagacctatccgccacccagttcccgttgttggctggtatgcgatatgggtccgatagtaacaccacgtcagtcttggtttgcgagactgactgccaaagcagctgctgggctgcatcacagtggtttaagtttaactgtgttacttccgttttggctgctttgatactccgcttgtgcccggacatttgagtccacccgttaagtgtccgttgtctgctctgtcgacacatattaggcacttagcgatttgcttacaatcgcttgccccatggccttcggtgccgcattttctgcacatcttacttctgtcgggaccattgcaattccacgacttatggcccttcccgaaacacttgaagcaaacttcaggaggctgttgtatactcagccggcaaaccgaacagcctaccttgagtagtattgtgtggtctccgcatataaaaacacatggtgatagaatcgaatcagtacagaagcaatttcttttatatgccttacgcaaattaggctggacaacgtttccactgccatcatacgaggctcgatgcatgcttatcgatattcaaaccttaaatgagcgtcgcgaaatagccatgattttaggggggtctgtagccttgaggttacgctttcgcttcataagcggaagatcatgggttcgattcccagcccctccacaaaaaaaacctgtccagccaccagaagacgcctcacggaggaccgtgctttggggagcacatccatcatccgtcagtatcagatggtgactgagacaaactgaccctcttcgcaggcagctagcctcactaacaacagagctctctcctacctgctcggtgtgagagtaaaagagtaggagagagtgaaaacaagatgtaaatatagataagttaaaaatagatctgtatcggtaaagaagatgctacagatcaactgattccggcacagtagtagccacgagcacagagtgcctcaaaaaaaaaaaaaaaaaatagccttgatttcatttgtcaatgatattgtatcgcagcgtattgattccaccaattttatatcatgtttgaatttctacacgcccgctagacagttaagaaatcggaatttgtttgcatcaaataatcatcgaactaactatgcaaaattcggcccaatgaatcgaatgatgtctctttataatcagcattgcacagaaattgatctgaccatgtcgcgaacaaagctaagacaatattttaattccttaagatttaatacaacatagaattaagcaaacgtgtagtctactattgattgacgaaataaataaataaataaatatactatgcccaagttcttcgctttgttggcctctgcgaccggcagcctgatcgccacctcttgggtgccctgcgggccctttctaagctggatggccttactggctacgtcgatgtcacactgctctttgagtgacctccgctgcgtcggtgacctcatccagatttttacactggagtgtcgcttcagcagtaagggatcttacatcaacctcgtcgccaagtactttttatgccagttgcttatagactgcacccttttccttggcatcctgctttaaaactaggatcatttcaccaagccctccttgggctccgttttcagtttcctctgttttttcttatttccaacttgtatccactggttgctgttgccttgcgcccgtggttccggtggatgcactgcctggttcgggttatctcgtggctcctttttcttggctttcttggccttaggcttggtgttggcctctcctttgttgccatgtcctcttgatcgcggggcttggctcgtgccagctcttccgctctagaggacggtcgcgtaggtcacttttcctttagcaaccaaaagccttttcgccacgtattcatcctcggatagtcccctctttcgcatcgcgtatcgaataatatttgagccaatgtgctcaaagcactcctattcgtagttccatgccttgtccgtttgtatcgcgaccagtatgccataatcaggatctgactggcatcaatcctgatgtgccgcttggcactcctgttagtttgggctagggtgcattggtactttaagcggcacagttgctgtgacagagttgcattcggatttttgtggtttttatgaaggttcatcagagcccactgcgaacttcaccgcatcctgggcaactccccaactcgcagaggtctagggggggggtccgttaagcccctggactttcgtccctgctgcccgcagatggggtgacttgcaacacccaacattttttatgtttttcactgaagtatgaattgcaatatttttcaattcgcaaattgaacattgttttcgtgatatcccctcaggacgtactggacgacacccccatcgaggagttcctgatgggcatggcgtcacagatcgccgagcgcgaagatccactgctgtgctcagacgtgcgggataaactgttcggtcccatggagttctcccggcgggatctgggagcgctcaacatcatgcgcggcagagacaacggactgcccgattacaatacagctagagttgcatacaaactaccaaagaagaaaacgtggcgcgatatcaatccagaggtgttcgaacgacagccagaactgttgaagtgagttattgatcttattattcaaaatcgctagataactgagattctttccataattttcagtttgctaattgaaacatacgaaaaccgattggacaacgtagatgtatacgttggaggaatgttggagtctgatggaaagccaggagaactgttcactgccgtgatcattgatcaattcacacgggtccgagatgccgatcggttttggttcgagaatgaggataacgggtaagattcacgttaatatgctcttacgaggctaatttcaaagtatttttgaacatttgcagaattttcactaaagaagaaattgctgaattgcgcaaaatcacaatgtgggacataatcgtcaacagtacggatattgatccggatgagatccagaaggatgtcttccactggagtgaaggtgatccttgtccacaaccagagcagctgaatgctactttgctcgagccatgtaactatctggaggggtacgattacttctccggatcggaactggcgtacatttattcgtgtgtattcctcggatttgtgcccatcctatgtgctggtgctggatactgtgtcatcaagttacagaacagtcgccgtcgcaagttgaagattaagcaagaagcgttgaagaatgctggaaacagcaagcaatctgttgagaagatggtagcccgggaatggctgcacgcgaatcacaaacgcttggtaacggtgaaatttggacccgaagcagcgatctacacggttgatcgcaaaggggagaaactacgaacattcagtttaaaaaatgtggatgtcgttaccgtggagcaatcacaagaaaactacaagaaaaagaaaccatacattttgctcagggtaccaagcgatcatgatcttgtcttggagttggaatcaaattccgctcgtcgaaagtttgtgaagaagttggaagatttcttgcttctgcataagaaggacatgacatttgtggaggtaccgagagacattatgttggcgaaggccgaaacacgtgagcgtcgtcagaagcggctggagcatttcttccgcgaggcatacgcgttgacgttcggattgcggccgggtgaacgtcgtcgaaggtcggacgcatcagtggacggagaagtgatgaccgtcatgagaaccagcctgtcgaagtctgaatttgccgctgctctgggaatgaagcccgatgatatgttcgtcaggaagatgtttaacattgtcgacaaggatcaggatggaagaatttctttccaggtatttccttgtggtactcagagaaatgcattgaaacataatttataaatttctgtaggaattcttggaaacggtggtgctattttcacgaggtaaaacggatgataagctgagaatcatttttgacatgtgcgacaatgaccgcaacggagtgattgataagggagagctgagtgaaatgatgcgttcgctggtggagattgcacgaacgacgagcgtgacggacactcaagtaaaggagttgattgatggaatgttccaggtatagccacttttagaccctagtttcaagtcataggttttatattgtttgttcgatttcaggatgttggattagagcacaagaatcatctcacgtatcaggatttcaagctgatgatgaaagagtacaagggtgactttgttgccatcggtttggactgtaagggagcgaagcagaatttcttggacacttcaacgaatgtggcgcgtatgacttcgttccatattgagccaccttctgatgcccgccgaaattggatgcaggaaaagtgggatagctatacaacgtttctggaggagaaccggcaaaatatcttctatttgtttttgttctacgtgattactattgtgctgtttgtcgagaggttcattcgtaagtattgtggaatcaaacagatggcttttaagtaactcctattcgttttttcttagattattctttcatggctgaacacacagatcttagacacatcatgggggttggaatagctatcacccgaggttcagccgcttcattatccttctgttactcattgttattactcacgatgtcaaggtaagttcttgtgatatatgtttttttttttcataattaaatgcttcatgataataggctgccaaagtcaagtcaaggacacccgctcttgctttcatgtttcactgttcggtaactccagaaggattggaaaatgagaaggcctcatagttatgcatttttttatgaaatgagatgatggtctgaaatgggctggacttaccgtaatattggaaaaaatctcaagactcactgctgtactttccagctgtgacactatggtgtaagtcctcctcgactatggagctggagcgtgcatctgcacttctatcacgctcttgacgttttcccgctctgtgctcttgcaccctgcgcagtctgacagtggtttgctcttgcatgttgagcagactactttttcatcttccttcgcctccctgtctccttccgtcatttatccttcttctcctcctgacttccttcggcgtcggaggttgtcaccaatactggttggggagacgtccgcactgatgatgccccgactaccggcggctatcgcacacggagacggaattcaactcaattttgggttgtttcaacgcaattccgtaattgagcccaataactcaattttggctaaatttccaaggtccccactaggtagtttggctctaattccattagaaaaataaactcaattttgggttgatttaacgcaaaattgagttctttcgacccaaacataagaaaagttgcatttacccaaatttggcttattgggccaaagtacccccattgggtagatgcagctctctctctatttttgacaacattcgtgtgggagaaagagaaaaccgagagattttgggtcgaaactataatcgatatacttaattttgggtaaagttaactcaaaaattaggtaaaaatatttctccgtgcaggggtgattttcggtttctgtcaaacgattccggttgggggttgacttccggttcataagcgtctcgacgactcgatgctaggcactgctctctgcctctcggtttgctgcttttccggccagtttctttgcaagatagatgttatctccacctccatattgttccccagattacaaaggttagggtcgcttaccattccgtctgcattgaagtctgtccaaaagcagacaccgccgcgcttcgttccaactcgggcaatcgaagacaacatgttccggtgtttcctttctctcattacacacgggacagaacggtgacagcgcgtgtccgaaccgatgcagatactgtttgaagcaaccgtgacttgacaggaagagtatcagatggaggttcactatttacccaggacacattcgggatgagtctgtggatccacctacttttctaggaggcatcccattcttgctgccacttgaccagcgatccacgtcaatttcctcacctgcctagtgcctctccgctgatagcactcgatgtcttctcccagggtgatgcaattcggaatcatctcggtgatcacacatactgcctgcgacgatattgttctgtatgcgcttgctgctcttatgaccatgagccggaacgtgctgttgagcttgtctcgattgcgcttggtttgcaatgctgtacctatctcagtatcgacgttgatacgctatccagaagaagggacgaatgaccttcgggttaaagtccctctcaaacaacaacaacaacagaagacgccttctaatgctttttggaccatgagcgttcggcatgctccttgtaagtgcgttggtcgctgttgccgccttctcacatgcatagtgaacgtggctattgaagtttagctgatcgtttatcatcatgtccaggaacggggttaatggtctaatggctaccgcttctgctttacttgcagaaggtcatgggttcaatcataggcccgtccctttcttcgtgctttgtagttgtatatttcgcttgcttctatcgttcactctaaatctatcacactgaaactattcgttcatggcaaacgctagaaccagagacgaacaagaaaccgtttccctgcgcttccatttttccatgattatatcacgccttactttacgcctgatacataggcagtctgcttaccaaatagaaagcctctctgtcatacttttcccccgacccatacactcccgcactatacgccagatgcagttggaccccacggtctacagtgggccagtgcaatatcaattcctcccccttctcctcgttggttatcaatctgacgtggcaggcgccattgttgcctaaaaatagaaaatcatcagcacttatacacttagggtgtctgttagtcccaagcattcatctggttgattgcttgtgtaaatgcagctgatctgacgatactggagcagcaaccaggtgactgagcgaccgctgtgatgctatgaaaagttatccctacgccaatctcagcgtgttgaatcgctttacgattactgactagtagcacctccgttttgtgatggactatcttcagcatgactccatccatccagctgtccgtggcaagcacttccacttcctccagcgtttcgcctattacttttaggacgactcctggcttgagggcaagcagtgcggatggcgttgagtgcctcgttccatcacatgcccttgccatctttattgtcagctctaccgcatccaagtccagggcatcgctgtcggtgtgaagtgcctcaaagaagaaatcttcgtcgaaagccttcgtctcactgccagtcgccaattgtgttcctctgcactgccgcagtgttccgctggccaaccctatcgtatccgtatcgcctggtgatcgctatgggtgctctcttttcttcccccttcccagtttatgttgcccgccagtgatgggctaaaaaatgttaggtcgatgatcgactcctgtccgtctttccgaaatgtgctaacggtgccttcgatgcacaatcgtagatcctttgctagagcctccagtaggttgtgacctctggcattggttaccctgctacctcactccacggcccatgcattgcagtcacctcaaatcagcactggttttcgaccaactagctcgtccaacatccgactaaattcttctagcgtccatcttggaggcgcgtagcagctgcaaaagtagattccgttgattttggcgatcgcgaactccgcgtttgagctggcaaccacttcctggataggaaatctacccgtcactcgtatcgccgctgtgcctgagctatccgccacctgattactcgatatggttcagctattatcgcaacgtcgcacttagtttcagttgtcgactgcgacaacagttcgtccccttaatgctacaactagataactcgaaaatcaaaattttgggatgtgcaactttgaaaataagaccttttcacaaggtgacggttaatcgcagaggatatggttcaaaaataaactttaatttgtgtattttgaatcacacgcttatgagctgtaggtattttacagatctaattaagaaaaatgttttggcatattgaagtcaaaaatttcaaatttcgagttatctagttgtagcatcaatgggacgagttgcggagtggtgtctcagtgatttaaattgatctgcattacctctgcagctgttggatttagcacgcacggcaattgaagctgcccgtcgaatgggtctttccttcctccggtgagcagagcaagcaccttggtcgattcttgcagtctttcccaaaatgacctctttctccacatttcctgcacagttcggttctgtccggaccattacagctcaccgccgggtgtccgaagtctatgcacttgaagcatcgcatcggtggcctatctgctcgtgtgaccagtctcagtgggcatatcaaccagccaattctcttcttgcctttctccaccaatttgttccgaatcgtcgttgacggtatgccgtcgtacgacttcctcaccatggcctcctctcaaaggctgcattgcttacgcagctcttcactcacttcgtaacgcttttctgttcctcctctgtgtcgtacagtagaatcctatcatcaaaatagctttctagaagcatgcagtacttcgagcaggtgaagtgcgtgtgcttgtgctgttgaaggcattcttcacatccagagtgacaaccgcgcagtaacggatgtcattctttttatgctcgattgcctgaacgatagcagatagcggatagcgtccagaatagatgtacctttcctgaatccaaaatagttgtaagacaggtcatacgcaccttccgtatatgttaagggtcaattccatacatccgcgatgattttttgatctgtgcaacattgcatcgcggtactgagcatgtttggattcgagttgattgccgcatttaaggcaatattcgggatgccatcggatcctggtgccttgttttacgcgaatgatttctatcagctcttcgttcatcaccctcgtagcttcttccctttcatctgccgcatacggcaccggggaccagaggttatggctttatgcggaaagagtacatcgattgttgatcgcaagagttagagcgacttttcttggggcgccatggcccctctggtcttaaatattaacacgctgtaggcatgccgcttacgaattccatttcgcactgtcgaagcatgcctgatgcttacccactctaggagggaggggtgtttggtttgatgttggaaaaagtttttaattgtaaataagtaaagtgatcgatttcgttatatagataacggaaaatttctttgattggtgccacttgtattgcgagttagttcttcttatccttgattacaatcacgatcgtgacagttttcagatgtgtgtgcgaattgattcactggataaattgaacgcagatttcgcggattatcaatctgctctggagatacgatgatccagaagcacatggcgtacacatcgacaaacgtgtggtgttagagttacgttactgcaagtcaaagggttttcttcgtgcgaagcgctgtgcagataccaaccagtcgttgctcaacgaatcaataatagcctaagacgtgcttgctcgtcaacatcatccaaatttctacctctgcctatccaaaaactaaatgctgaagttcaacggtgatttttcacgctggatctcattccgggatacgtttacgtcgatggtccacgtgaacggtgacattcctgccgtcgccaaactctaatatcttctcttgagggtagtgccaagaaaccctttgaatagcattcgcgaggctgacaactacgcaacaacatgggatgcgctgctgaaaagatacgacaaccgcaagtacctcaagaagcagctcttcaaggctctctacgggctatcagcaatcaagcaggagtatgcaacgcggctccacggtttggtcgacgattactaacataattttcgcgccctatcccaactgggcgaaccggtggacaattgggatgtgccgctccataatccagcctcgttgaagatggccggctatccacagaagaattccaagcaaaaagtctcagctaacgcaataactgcttcgccttcaagctattcgtgcccgctttcctattcggacagccattcgctccggacttatccggtgttccttcggaaaaaccttaatttatttcgtcaagcataggtagactacatacaaaacatttccagccatccaagcaaattcagctgatttaccagtggcatcaaagcccgctgtttcaacggctccattgcaatggttcaacaaccgctaccattcacgcctcaacatgtggaagcttctggttcctgcaaggtcagcatggaggtccaaactacatgtaccatgactcttctggaaacggttgttcccaacatcgtcgatgaccacggtaacccgttggcgaagaatctctacagccgtcggtctacagtggatgtgtccgtcacagatatcggataatctacatagaagattagtagtgccattactgcaaccatcgagtcgggagatcgaacgattttgatgaaacgacaacgccgatagacagcttgcaaatcatcagttcagagattgcatacaggacggaatatatctctgggcaaaggttttccataagtagttgaaactccatttggttgggcggtatctgtttccggttgctgctacctgtatccacagttatgctatctttctactgtcgataatcgactggagtacgttctacaaaaattctgggatatggaaacatttccattgggtccagttcaatccaccgaagaaagcagttgtgaaaagctgtacgctgcaacgacggcgcgctatgcaactggacgataggaaaggttttgggggaatccaaatcaatagctgatcgtcactttttgagcctggaacgccgacttgaaagacatcctacaaccaagaaatcatacaatcgattcatagcagagtatctgcatctccagcacatgaagaaggtgcaagagcctatggataatagtattccacactgctacattctccatcacatcattttcaaggaatccatcacgactacgaaggtccgggtagtctttgacgcgtcatgcaagacctcgtccggctattgtttgaacgacacgcttctcgctagaccggttgtcttgaagcacaaatcgtcgctgttgtagcagacgtcgaaaagatgtacatgcaaatgttgcatcatcccgatgatcgtcaattcctccatattcgtccacgcagtaaaccttccgatcccatcgatacgtttaactacaatgtatgttcaatgttcatttctttggtcggtcgaaaacatcgagtacaaattccaaagtgttaagcaaagcagccaactttatctccgacgcgtttctactgtctgtccatagtgcagaaaaatggcattaagaaaactctgtggttggtgcacttgtatcgtgagaagcatcacaacctcgctatagttctacatctacgtcgtcactgtgcaaattattccgttaatctggagcttactttgagtaacttcacactgctctctgcccgccaggtgagtataactgatactgacggcccagttttgactacagaacgtcacgtatattatcgattctgcacaatatctccgaaaggtgcctaatgcatccatcggctctgcatttaacgctgtcaggtattccaacaataactagcctctctatttgatggctccgatagtaatttcacgcttgcagaaaacggtatttattaatttcaactctatcctttttttcagaaatctcatcaccaagttgaaggaattccccatccaacagtacatcccgctggattcgcatatccagttccacaagattgccgcttgcacggcactgttcttctcgttgttgcacaccgttggtcatatcgttaacttctaccatgtatctacgcagtccatcgagaatctcaaatgtctcaccaaggaagtgcatttcacttccgattaccggccggacattacctactggttgttccaaacagttacaggtcagtatcatgcacacatttagaatgttcagcaattttatcgttttactttttgcaggtgtcactggagtcatgttgtttgttataatgtgtattatattcgcgtttgcgcactccacaatccgaaagaaggcctacaagttcttctggaacgcccattcattgtacatagtattgtacgcgctttgccttattcatggcttggcgcgtctcacaggagcacctcggttctggctgttctttattggacccggcattgtttacactctggataagatcgtttccctacgaacaaagtatatggcgctggacgtcattgaaacggatttgctaccctcggatgtaatcaagataaagttctaccgacctccaaatctaaaatatctttccggccagtgggtccgattgtcctgtacagaaatcaagcccgaggaaatgcacagtttcacgttaacttctgcaccgcacgagaacttcctcagctgtcacattaaagcgcaaggaccatggacgtggaagctgcgaaactatttcgacccgtgcaattacaaccccgatgatcaaccgaagattcggatcgaagggccattcggcggtggtaaccaggattggtacaagtttgaggtggccgtgatggtgggcggtggtattggagttaccccttatgcttcgatcttgaatgatttggtatttggaacgagtaccaataggtactcgggagtggcctgtaagaaggtgtacttcctgtggatttgtccctcacacaaacattttgagtggttcatagacgtcctgcgggacgtggagaagaaggacgttaccaatgtgctggaaattcacatcttcatcacacaattcttccataagttcgatctgcgaacgacaatgctggtatgattattaaactttttctatgaggatttccgggattttaactaacgatatttttgttacagtatatttgcgaaaaccacttccagcgtctatcgaaaacgtccatgttcacaggtctgaaggccgtgaaccatttcgggcgtcctgatatgtctagtttccttaaattcgtacagaagaagcactcctatgtaagtaatcctataccatagcctatctaagtgtttttaatgtaaaccgttgtacttgcaggtatctaaaataggtgtgttctcgtgtgggcctcggcccctcaccaagagcgtcatgtcggcgtgtgacgaagtcaacaagggtagaaagttgccatatttcatccaccacttcgaaaactttggctaagccaagcagagcgatgaacattttcattaaaaaaagaacttaccaccacacccttcgattgctcatttaggattttattattttgtcaattttatgtttttatttgttaagcctagcgaagttacacctgcgatccttaggataaattatcaatttccctagtgttaagaagttaagctgagtatgtgtaaagttttcccgttacagatgtcggtttgtgtcaaaatgtgtcgtcgtgaataaagtattagcttctcgtgcctcaaaggaccccgaagcgtatttatttgattgttaattttgttcaagcgaaaagatattcatcgataagcaatgtgcttcgtttcagtgttgagcacaaacgatctaatccattgtccagtgcatcatttacaaattgataatgaaacgttagtgatattaccgttaattcgcctgagagaacaaatgcattccagttgtgcaaacgataacccttttgtacatcgaattagtataagagacacttaccactgcacgatgccgaattaccaagcatcgatgtaagccgcatgatcaactgcccgatttcatacaacgaatgaagaaaccatcagtgaa

SEQ ID NO: 62 - DNA, 17233 bp, Aedes aegypti
  misc_feature (12140)..(12239): n is a, c, g, or t
gatggccccttcaatatagagcaataaatagttgactgtatttttagcgtagtttttacgtttactcccactaaagtacaatttttcttatttccttctatttattgaaagtagttttgtgaataagctttcgaaccttacgaagatttgtataaaatattacgataatgcagtatatttcattcaacaacaaaaaaaatgtgtttcattgaattctatgtttttcttaaaattcctaaccgtgtttactgtagcaacacaacggtaggagatcctgctctgatagtccatgaatatgctaatagaagtatttactgtgagaaatctctaagaacaattctttttttggccacctgaacgtccatagtgaaccctgcgaaccatatggcagtgctcattgcatttcctttattcttttcctgctcgctccacctaggtatggacaacagcgccaaaatcgactgcaccaaaagccgaaattcgctgctctgccgtggaaagcgtggcgataagcttgtggcatccgccctgaccgccgcttccccccaatcggcaatgctgcccactggtgggccgtccctgtcctcggatgtcgtcccggtacaaatcgttgaccatcccgtcaacgtggtcgttaatgaaagtgccccggctatttttaattgtggcttccagtcgctcgttggcaacgattccggtccgttggtgctgaagtggcgcaaggatggcaaggtgatccggaagtgggacaacgtggcagcggatttggatggggagagtggacctaccgagagctccgtgtatcgtgatgatggtgagtttttggaaattggaggaaatgtatgatttgttcatctttttctctgtgtaggtcgaatccacgtggacaggaacaacggatcgttgatattcaattcggtcattgccagcgatgaaggcagctatgattgtcaggtgactaacaatggaagcgaattcttggttacgtccaatgcggccgaacttcagatcatctgtaagtattttaggttacgaaaattatctgatcattcatcaaaatttcccaaatgtctagcaaatcttcgtttcactccgaaaccgccttccaccaagaacctagagctgggatccttcgccaaaattcattgcaaagcacaaggaacccctaccccatcagtccactggacgatcgaaggaaccaaatccgagctaccggatgcggttgaggacgtgaacggaacgctcacgttccgcagcgtatccacggagcatcgaggaagttacacgtgcgtggcatccaacagccaaggagagatcagtgcctctgtgcaagtgcacgtggtcgtcgcgccaaagttcgaaatcgcaccagagggatcgatccaagtagccgagatggggacggtgttcatccactgcgttgcgaccggtgatccaaagcctactattcaatgggacaaggatctgcaatacctgcacagctccaaccagaccgaagaggagaggtacaggatactggtcaacggcacattggtgctgaccgaggtacatttggacgatgatgggaactatggctgtacgattgggaacagtgcagggcttaagcgtgaggaggttcatctagttgtaaaacgtaagtactaattgtgccagaaatacaaatcagacaatacagttgggtctcctattatgcgcatttcaactacgcacactcctataagacacggctgatcattaaccctttacctcccacgtctttgatcgactgtttctctatgaaaaagatgttttcatgaaaagtgcttgaacaaccagtgttgcaaataggctaaactttttgaaatcagtttatttttttttaaatttgtttttcaatagttactattgcaacagttactggactattgggtgagtctgatgagtatgcaatcatattgtagtaactattgcttactatttatttaatttggtttcatcaagatcgtcgaaaatcaatgcagctctgaagctacgctgaagaatccctcattgtaatcatcgtcatcaccgaaacttcaaaagcagtttttctgttcaaatcctaaaattattcgatgaaaatgtgtttcggttggagaataagatacaatgaacaatgtctgaatacatggaatggatagtcacaaagctgacatgcgatgataatagggttgtgagtttcgtggctgtgcggcattattcgatgaaccttaatgtgagtttcttaacctcagggttaagaatgaatacatgatagtttgtactgaactgacatggacttttttatggcaagtcttattttttaacagccttattttataggtttgtgaatttccactctaattcggccttttgcggtacgctacagttcttcagttttatgtgattcaattttctgtgattcgggcttttgtggtagtctagaatactgcggcattttgtgattcggccttctgtgattcagtcccgttcagtgtgagtaaatttaaaaacggtctaaatgttctttttatattagagtctgaataacgtaaaaatcaggtattttcggaataatatgatactgtaatagacatgaatccatttgattgtcagcgataatgagcatgcactttttttgaactccatgcagttaatttttgtcaattgataggtatacactgtatcttaatggagtagtgtttgatctgttgaatctgttgcatgctcctatgagggcgagcgacggaatccggatcaattgtgtggggtcatgcacaaattacgtcacgctccaaggggggggggagggggtcgagccaagcgtgtcaagccttacaatattttcggaggactcatacaaaaagtgtgacaaagggggaggagggggtcaaaaaagttgaaatttagcgtgacataatttgtccctgtccagctcgcgtcgcggaagaaaaaaaaaacgaaaacaaagtgtgcgggtgaaaaataaatcggatcgtgtccggttggcatagtaaccgcactatcagtatcgatcatccgtgtatatgttcaagtattcatttaaaattatatatttatcgtttaccaaaacgaatcctttcccatatccaaactcccagtgttttcttgtggaagtgcagaggactcctcggcttccataaagcaaataacacgtcaacatttccctcccatgatcaaattgacctgcattcggacgcagccggcgccggtattgtttgttataataatgagagcacattggaaacacattgaagatgcacctgatcctgagtagcatctgttggttccctgtgtaagtacagctgttcttacaataacggagtagcaactgcaggtggtcaatcatgctcatgctcatacactgtatcttaatgttttctctatctcgataagttgcgctagtaattttttacctttagagagatacctctcttattaaaatacttgcaaatcggactaacatgtttcagcttccaaagaaatatgtatatgacacaaacagagtttcaaacataatctaaagcgtgttctaagggagtaagtcgcatgatcgatttctttcatcgatcctcgcttcagtgaataaaggtgtcaaggtgcaaacgttttagcagtttcccatttcaggatactagacgacgatacaatcttgcgtcatgagaagaaaaattgccaacaaacttgcatcttgcccccttttttcacagaagagaggatcgatgaagagaaatcgatcatgcgacttacgcccttatactagcacatgttttaaatgttgatctatctgcgttgattgtttagagtcatgttctttccttagtacacggagaaaacggaaaacccatatttgagttattggtattttttaacttagtattgagttatttttctctccctgtttcattcgctccttctattgttgtcagagagcgaatagcaaaacaacccgaaaaccgaacctttgtgcgttaccttaaatttgagtaagtggcatagtactggaagttgagttatttgatctgccggttgattgaaaataacttagccagtggggtatttttttcgcatggctgcaaataaaaacttcttttccatcaactcaaagattaggttaatacactaacccccgaattgagtggaatgaactcatttttgagtacttcattttctccgtgtaaagagatcttcacaaatggtgctcaggcttagtatactttagcgtgtcatatcaagattttcaatcaagtagataggtcgcgtggtcctggggacgcttagctggaactaatattttcccatctagattctggagaatacttgtaggatcctatgttttgctagaattttagaagtagatgaaaaacccgaatttagtactataccatttaattcaactagagtttgtatcctttgacagataggcgtatttcgacctcaattgtaaggccgtcttccactgacacttcgtgtactagactcgacttcgaatagtagaattttagatggattcttgagtatactgagcgcaatctggagattcctagcagacattgtacgttttttgcgggatcccaagaatgtataattaggtattgcaaatgcccgtaaatcaaacttcaaagcgatgacatgtaccgtaaaatggggtgttaagggatgaaaaaaaaaattctacctaaacttcgagcaacttttagtacgtcaataattgcacaaaatacagtcctaccattctcccgacgtgtatatcaaaagccaattacaatgaagatgatcctatggcagatttctgagataatcataaaaatgtgtgatgtttgacgaaaatgcaaaatggggtgttaaggaatttgagctttgtaaataaaactatattttgccaacagcaaaaaaaatattattttggtcaatatcgatgatgtgttcaatctaaagatgatattacttcaaaataactcaaattggaactcctgcaagcgttaaccgttttaatttacctactaaatctctcatacatattgattcttttttcaacttagctataagtgcatcgcacaattgtcttgaaaggatttgtatacttatatgcagtattcgtatcctagaataatgcagagcaaccttgtcatgacttgtcaaaagaaggataatttcaacaagctttcagtttgaagagagtaagtgtccaatttgccttttcaataaagcaccacaccaaataacggatttgcatgtaacacctaatggcataatcgaaaaaaaaaatctttacgaaaagtttccaatataaagcggaaatagcacacactatactacaatgtattcaatgctcgacaacacttaacacatgaccacgagtaaaagttttccaaaaagagatcggaaataaccttatattattattgtttatctaggacgtaggtagtttttaaaaaaaatcaatagctccaaaaccatctcatttaagataaccattcctatttccaaacttttcaccaatgctatggaacaacttttgaaaaaaatacagtgaaacctccatgagtcgatattgaagggaccatcgactcatggaaatatcgaatcatggaacagaaatgctttggaaagctttttcgagggaccatcgcagtaaccatgaaattttatttctagtatggttccatgagtcgatattgagtcatggaacatcgactcatggaggtttaactgtatcattgaaaaccccatatttagattaatcagtttttgtcttttaggttatggccttcagtctattatgctcaaaacggatttcaagttttcatccgacgtttcggacataaacacttaaaatccgttttgagcataatagagtgaaagccataacctagaacaaaactatcaaagtcgtatccccaattcagttttaatctacattttcctaacaattttacctaattttgagataagtcttttctggtgatattcagtgactaacgaaatagatcccttaactttccatgcaggttaacttcacggaacaacccaaaactacagttaaacctccatgagtcgatgttacatgactcgatatcgactcatggaaccatactagaaataaaatttcatggttactgcgatggtccctcgaaaaagctttccaaaggatttctgttccatgactcgatatttccatgagtcgatggtcccttcaatatcgactcatggaggtttcactgtatattgaaatacataacggcataaaacaaatgagttaagtaacttagaaaagttagaatagataatcccttaacaccccacttattttcaaaacgagacttttttcataaaagtttctcaaaatcgaaacccagatataattttaagaagtttttgtctgcactatgatctcaattaaatttacttttcttctacgttactcgcgaatttgtctcaaatatatttcatggttttgtaaataaatgtatttagcccataaaattcgaacaaaaatgttttgaacagttttcaatatctagcgaacacaatacttcatattattagatagctcctattacataatgcagctcacaatcctccgaacaaattgagcatttcagatgatttatacatcgattttccacgtttctgtgatttgtcaaacttgactgagaagttcaatcccttaaaaccccacgagtccttaacaccccattttacggtagtttttttttttttggcacaaactggagcagaaaaattgatttgattatactcaaaatgtttttcaataaaaacctacgaaaaattttaaattttcatcctgcttgcctctaagtcaaaattcaaagcaaaatatgtttttattatattttttaaaagtttaaaagcgatgtcatttaatttctctacataaatttaatcgtgcagaaacagtgcatatgtttgagaagaaagataaattttggatttcacttaaacattcttttacattaaaaactgcaaaaatgcttttgaacctgattacgagtaaaaaatagttaatagtatctacacatacgcaacctagttgaataagaaaaaaaaaagaggtcgagcactccacactgaagaagtttataagtttataagacgaaattatctgtcaagataagcaacatagagtttaaagttatttgctcgcatactactgatttatagtattttattttttcttttgcaaaagcgaagtgaagtgttaaagttcaattaatagtttttacttaaacatactctaaaaatcccttccttagccgagtggttagagtccgcgactacaaagcaatgctatgctgaaggtgtctgggttcgatccccggtaggtcaagaatcttttcgtaatgaaaatttccttgacttccctgggcatagaatataatcgtacttgccgtacgaatgcgtaggcaaagaaagctctcagttaataaatgtggaagaaatgtggcaaagaaagctctcagttaataaatgtggtagtcataaaaacaagctgagaagcaggctctgtctcagtgaggacgtaatgccaagaagaagaagaaattttgaaaatgtgtaactagttgacgaagttcagtgtacgtttttgggattaaatagaaatttttgattacactctaaatttctcttataaaaaaaactatgctaaaccctacttcctacaactacttgcctgtaaatccaaatttaaagggtcaatatgtatttttttacataaattgtattgtagataaccattgaacatgttttctgtttttttttcaggtgataaaatttggagtgcatccaaaatgtctattttatcttaaacgtgtgcactggatttcaactacaaatttaatgttgataaaattataattcgtcgattttaattctgatttacagaagaacatgttctaaaattgaagatatttttgtgattttttgagtaaaagaagtttttagtctgatccaaaatttctctttctgctcaaacatagataatattctttttcaataaaatttttgtcgaaaactacacgtcgtccctttgatactcgttttaaaggcacacaattgaagcaattatttttttcgcatttttttagggtaaaaaaaatgttgattgtttgcacaaattattatttctgccgaaacatattcactagaattcctacaaaaaaattcatgccacaaagctacatgtcattgcattgaacattgtttaacagaaaacgggacgaaaatgtataatttgtcgtagttttttttttaagaggttttgagtgtaatccgaaatttatatttttgctcaaacatgctcactgaactcctacacatcatgttaacactatgaaatttgaagttttttaattaaaataaatttgaagtgcaaactcgaaaaaaaaaattttaaatgttggtttataggcaaaaagttagggaaaagggtatttctttattcttttaagcaccataaattttgagtgtaatcaaacatttatattccagctcaaacatgttcactgtacttatacaagaaaattcatattgcaaaaatgtcaaatatgtaatttaacaacatgatacaccgaagtttttaactaagattcagattaaaagataaagctcatctagatcagttacaagttatctagctcaaaaccaaagcaatcaaaatgtagttcgaattattacgaaatactttgtcgaagataccaaacctcaagcgttcatatccaaagtactacaggttttagctgccgaaataagtgaccttcccaaattttcctcgctgaggatgctcgaagtattttttttaaaacgcatatgttatttttcttattattcacgattattatataaactgaagataattacttttttggcaagatttgacatgattctcatgtggtttcagttaacaaaaaaagtatttctcgaaaactcattcatacagactcaagtcaaaaatatgtgcaaacctactttatcgattctacgtgtttcgcagacgaaattctacacgtttcgctctgaaccaactcgatttttcacttatagaacgtttaatgtccggatttacaaaacgacgaaagtgagattttcaactttcgcaacctaaccgctactttcgtcgctctgctgtatggagagacaaagtgacttaaccacgaatcaaaacaaaacactacttgagtcgattttacactggtacaaaaacatcgcaagtaactgaataaaacggcttatcattatgtcataaaatttttgtgtgaaataataagatctccctagtttttgaacgcgagctcattgcacagtggtccaggaatcagttttacgcggaaagatgcattttgagctttagaatgaaacattagacaataacggtcttctacaaagttgtttgtattagttaagccctttgtttggttttattgaaaattagggtggaccacattttcatagaaattgtgtaactaactttcttatttgtagaaattatattatacatgcttgagcaaagttatagaccattcaatttcaagcaactttgctaaaacaagtttttttctatctcttaaattgaccgatttagagcttttttcctgcagtgacatagggtggtccgaacaaaactggttttctggctctagagttttcaattcaaatttctcatcaaagtagtccatgaaacacttttagagctttaaaaaatgcgtaatttggtgggtgaagaaactcgctatctgcttccgtttaggagttattgttgtttttctctcaaaaacatgcctactttgattatgaatatctctgattggggcaaacataaaaaatatcttttgacggcattcaaaagacaaaataaatttgtatattatatcaaaaaattacagatgtgttatttttgtaactctaataaaatgccttgaaaaacaaaggattttaaatcaggaaaattttaataacttttgaactaaaatagatatcatcaatatttttacatgaaaatttgcgttttgttaagttcttaaagtcgctcatataccgctttgacgagaaatctgaaataaaaaagatatgactctaaaactgttttgaagattttcatagtatgtatttctttattattttgcattttgagcatgaaaataaaattttagacaaaaatgattttctacaaaattgtttccaaaaatgtaagctttcatactgtgtcatttgaaattagggtggtccacaatgtcacacatatcatataaacaacttttttatttacaaaaatactggtatatgctcttagacaaagcggtagaacttaaaatgttgatcaactttgccaaaaaaagtttttctgtagctcaaaatttgaccaatctagagcattttttcctaatcatcgcagggtggtccaacaaaaataagtttttcaactctagtttttttaatattattttctcgccaaagtcgtctatgaacgacttttagaatataacaaaacgcaaattttcatgtaaaaagattgttgatatctatttaagttcaaaagttattaaagtttttgtgataaaaaatatttgactttcaagacgttttattagagttacaaaaataaaacatctgtaatttttttgatataatatacaaatttattttgtcttttgaatgccgtcaaaatatattttttatgtttgccccaatcagaggtattcataatctaagtaggcatgtttttgagagaaaaacaacaataactcctaaacggaaaaagatagagagtttcttcactcaccaaattacacgttttttaaagctctaaaagtgtttcatggactactttgatgagaaatatgaattgaaaactctagagccagaaatccagtttttttttcgaaccaccctatgtcaccgtaggaaaaaagctctaaatcggtcaattcaagatatacaaaaaaacttttttggcaaagttgcttgaaattgaatggtctacaactttgctgaagcatgtataatataatttctacaaataagaaagttagttacacaatttcaatgaaaatgtggtcccccctaattttcaataaaaccaaacaaagggctcaactaatacaaacaactttgtagaagaccgtttttgtctaatgtttcattctaaagctcaaaatgcatcattccgcgttaaactgattcctggaccatagtgcattgtatgcaaaattcaagcaatgtacacgacaaaaaatgtcaaaaaggtgattcttatgaaaacagttttagaagacaggttgtgattcttctgaattgattttctaaaaaactctatggaaattacgtcgattgaaaaaataatcgagatttgttctattgctctaggagaaatatgaacacccctagggacagtttcttcaaaccttacaaaactgtaggatatggacatgcgataagtgacagaatttcgaaaatcgattgaatcatcgctgagatatagccgaaaatccatttagaacttttttgatccgaatgggtgaagccccctctagacttgagttacagtaatttggtaatggttgtaattgctctattatagcatgtgtgttgtttcggaacttctttctctccttatccacttcttttaaatcattcttaaaattcttccttttgggcacctttctaaaaataacaggaaaagtaaagtcccggagttcaaattctgacaaataaaaagttgtatgggattgccacacgaacatcaaccaatttccttagctttcatttactgaatcactttaatcaatgatcaatagttcaattttaacaatactcgatgtgcattgataatgcaatattttagatcaaatgatcataggagtaatgaaatagttggatttaaggtgaagttcaaatgccatcccctgcgcgggacctccatccctccgaatttccggcaaaaccttatcatgcaaacacccaatattgctacctgggccgccgatgcgggccacaactcaccctctcgcgatgattgcactctccgacttttatacatgcgaaatcacaactctgttaaaactcggcgcatccatcgatcattaccttccaagttgaggctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggagctgaaacttgatcgattggtcaccagcagtcagtgatcaatcgattaagtttttagcttaaacggatgtttggttctccagatttgtgctctagaaaatttgaagtttggcttcgattcatcttcaccttaaattcattaaatctctcttgtgcaatgatgattttggaagattaataataggggaaggggtggtaaaatgaacaccttaaggaaattatcttgtttctgatagaaaaatgaggaatttgtatagttctatctagggacgttccgatattgcaaagtatcgatatttaattcgatacgattatcgaatcaaagtatcgataccaccgatatattgaatcaaaatatcgatatatcggaatatcatatgatatatctaaataaagcaaaattcctaaatcgcttagagacctgccgttttgttttctaagattcgaaaaaaaatctttgaatactcaagattattggtaatttgatcgatatagacataaacattttctgttaagatacattatagtacaattcaaatggtaattacatttttaaataccgtaattccgggtaaaattgatcattttttacggtttttctgatctgttttccatactgttgtctatgcccaacaactttattcaggaaaacgagtacgatggtgagtcttattagctcatgtaccgaaattttctaacaaatgtgattttagtgttaaaaattatttctaaaataaaaaatcggggtaatcccattttggggtgaaattgatcacttatcaatacaataattgttagtttcgaaaactactcaacttacttaatttgagctcactgaatccgaatatgctttttaaattcttaacaaattaatattacatattcaacatacagcagaaaacgcatcaatgtaggcaatttccaaaggaattttcaaacatctaacagaaattcaattatttcaacaaaatgagcaatttggtacaaattttgatgataaaatctattttggggatatataaacttacaagcttcgagaatggcaccatgttcaaatccttttttagaactagaagtttatggaagtcttcgaatacccgcccgaacatgatttttcatttttacattatttccatagaaataaatattctttaacagaaaaaacttcacaacacacaattcaacaacagttaagaccaacaacgttcattcactataagtttgattgtttttggtgctctatttgtaagaataaaattgtgtgacatgatgatcaatttcaccctaccgatcaatttcatccgaatttacagtacataaaatgaattatgaatgaagaaaaccctacaattgttttccttatattaatgtacgatatatcggaagaaaatatcgataccaccgatatattgaataggaaatatcggtaccaaaatatcgaatatcgaaagcaaaatatcgatactccgatatatcggaagtatcggaacgtccctagttctatcacacaatatcaaaaacagggatgttatctatagcagcgacacgaattcagactaaaattgctgaacttttatatatttttgtcgcaagcaagaaacgatgttaatgttcattttacctgcactatgtgggtaaaatgaacagctattggtgaacgtgaacgtcatgcaacaaacgtgagcgaaacaaatatttctgaaaatttttattgccctaccaaaactatatccattaatgattgtaacccattcaaaaataattctaaaggtatctaacgatattcacctcactgaaaaaccttacgtcttccgagctaaaagttacgtcagttctaatttgcaaacgcggttttctaaaatcttagttttcgttgatattttcacttcaattgaccaacgtatcaactcgaacactctgattaggtatgctataaatcatccgtgcgtgataaaaaatcatcgaaatttgtttttttccgataaaaggcaaggtgttcattttaccacccctgttcattttaccaccacttcccctaccctgaaacgtgatacccattctgagccggaatactatgtcttaattccatctttgctagccctgcctagcggcaaaaagttgattcaactggctcgaataatgacagtttttgaccaactgatcaactttgccgaagatgccatctttcaaagtagtcaggattttgaggtatgtaattcgtaaaacaaaaacgtcatgctcactagcgtcggctggtggcggaattctatacataaattaccatcgaatatcagcccttaatatactgagcaactttgccgaagatgtaaaccttccaaatcaccctgatctaggtcccatacttatcccaaagttcataaaatgcaagttagaaaaagcaaccctagcggtcaaattctcaactaaaaggataatcctcagcttttgaacttagatcgtactgagtacagacaattctctaaagacagtaccgttaaggtgcagataaatcgaagccaaacctcaaatcttcaagagcacggatgtttggttctccagatccgtgctcttgaaaatttgcagtttggcttcgattcatcttcaccttaaatctctcgcaaatcgcaaccaataatcccttcgtctcctaactatagctcggattactataacgcccgctgaccatgtgtctaaataggatacctgaccgtatttgaatacatttttcagccgccgacagcatgccccaaccggaggaatcgtccgaagatggcttcctgatcacgcgagccgtcctaatcaccatgtcggttgcattcgcgtacatcatcctgtcgtcgactaatgctgtgtgtcgtcatcgatgggcacctcgtaaggcacgcctcagcatgagttgcaaggagaatggcgatgtggatctgaaaaactgcgagatccaaccatgcctaccggaaaatcctcgcaggatggatctaaggccaagacctagtccaaatccgggcgtcataagaatggttccactgttgaaggacaggagaagagcgacgatacggtcgactcgaataagtccaagaaatccattatctcgacttcgattctggatcgattggccgtgcctcgatcaagtgtgatcgaaatgctgcagattggaaagtgcgactttggcgatgtgttcatcggtaaaatcaaggagaacgattgcaagactgcgaaggcggaaaccgtgaaggaacctgttacaggagatgaagtgactcacgcttccaatactgaagtaacaactgaggatgagaaaattaccaagaagccgtccaacgaggagctgaatgagattaaaccggagaacgactacaaaccggtgatggtgaaggcgttgaccaaggtgaaggatgaacattgctgttcggaattccggcgacaactggacctgttccgaacagtttcgcacaaaaacgtagtgaagttgttcgggttgtgccgcgataaggacccgcactacatgcttctggagtacaccgattgggtaagtgacgatcgattgcattggatctaaagtatgatcattgacattatatgatcttttcagggtgatctgaagcaattcttactggcgacatcgccagccatcccaccgaatggtagtgtagaagcgaagaacgtcaacaagcctccaccgctgaacgtgccacaaatacttgcgctagctcaccagatcggtcgcggaatggatgccatctacaaagccaggattattcacaagtaagaacaattgaaagctattagagccatgggtttgaatgggaatatatctgatttgaattgggatatagaatggattgcatttggattgaaattaattgtaaaatcttccttcacagggaccttgccacgcgcaactgtataatcagcagtgacttctcggccaagatctcccttccgggcctgagccgagacaagtacaacaaagagtacttcaaatacaagaaccaattgatgccagttcgatggatggctcccgagtgcctccaggacgacgatttctccatcaagagtgacatcttttcgttcgccgttctgttgtgggaactgttcaccacggctacggaactgcccttcaaagatctcaccgacgaagagtacgtcacgcaagcccaatccggcaagttggagtggaagctggcggacaagacgccggaaaatctgcacaaaatactggtgagttgattactacactgaaacaaatatggtcatgattcatgactcatgaaactaacttcatttattgttctaatttcagacttcttgttggtcggtgaatcccaaagagcgaccgtccttcagccagctggtggtggcgatcgggaattgtttgcaaagcgaatatccaaaggaaccgactgaagcgacgccggcagcgcccgtgacccccaccccaacgacggaataaagcgcagcaccgttacggtatccgtttcagtaagccatcttttcccaatcgtgattaactcaaacacaacgaagttagtttcgtccccgaaatgttttttcttcgaataattctgctattaagtgtaagctgtaatatattagtatttattgtcaaacaatttagtagatcttatacactgaggcaagtttacatcgcgaagtgatgtgtgaagcggttcgattttatcagagagaagtggagttgagttgaatgaagacaagtttgtgtttggaaggtgagtttaaagaagacttataaggaaccatactgccgtatgacacaacacacagaaatatgacggatcaataatgtgatctgactgcatttaaagaaatcaagacttgataatcttattaccttctagcttttagggttaaagctgataaagcttacgcaaatcgtactgtattattataaccagttagtattatacatttgtaattagtattgatccagtccgtaatgccgtacgaacgtttatacacatcttattaaacg

SEQ ID NO: 63 - DNA, 36348 bp, Aedes aegypti
aaaaaagtaaaacctacaaacaattaactacaatttcattaattttgcatgcgtagactgcgtcgcacagctgcttcaaattactataaatgattcccaactatttttcacccataaatgggtttttaaacacccatttttaaactacagttgctttactgtaatgggtatttatttaccctttttacatttctgaatttacccgctttctgacagatattgatgctattccaaaatgagtatttttttacccattaaagggtatttgcaaacaaccgtgtagtcccgcattgcgaacgagaggggattttagaaatgggtaaatttttaccccttgcgagattttaaattcacccatgttttaacagatccgtgccctattcgaaaatgggtatatatttacccattaaagggtattcgcaaacaaccgtgatggttaccaatggcttttagggtgagatcagaagttatgcgaaggttcttgtttttttatttgggtagtcattttctgttccgtgtagatagttcatcgatttttatttgctgatcctgcatgcattacacctctctctgtccagtctctttagtaagtgcctagctgtcatctcgccgtcgcctgtcgttctcagtttgtggcatgcatttttgttgtacggtcacggttggacggacagtgttattataaaataatcttcattttggatatttttacattatttgcttttaacttgatatcgacaatttggaagtgcttccattccattcgtaccgctaaatacttcgaaccgcaggtacttttcaactaaaactataggaaatgatccatattttagcaaatagaaaaaactcaaatttccacgtgtttcgccggagtgaaatttgttttcgaataaaatgcaccattatctgatgatgttgatttaaataacttcataattttcatatttccagggaatagctttcaattatggcaatggctaacggagacaatcttcaggatggtttgtcctgtgaagacctatttcgcaacagtgatggattaacatacaagtaagagcagttttttgttgcaaaaaaaaaaccgaatctttacaacccctttaatttgctgcactaataataattaatatatataagaattattcttccatgcagacgcaaacttgaacatttgtttgaaagaggccaaaattagaccaggacggagactggtgctctcaccctatcagggtcgtacttatgaggaggcatgacccccacattttagggccttcacaatttacgacaaaaaatatgtgtagtaaaatattcgaaacaattagagatgataacttaatccgggggaaatttgatcactatattacaacgttttgctatgttattttttggagttcatttattgtcaaatttatttcgactaaacttcattgatctctatctgtttctgtaattgatatttttgatcaaatcacatttaacatttcataaacttagttttaaaattataaatgactggggcgaaattgataataacaaagcaggttcagaatgaaaaaaagaatccctatttactaaatttgggtctcctgaatctaaaaacaatttcaaaattcttacaactcgtgttcaagtccattttattgcaaagttaaactgtttgaatttgcataatacgcctgaatgtagataatttcccttaaaataagcacgttactcgaaaagccctcgccaagtaaaacgctacagcaacagacagtaatgaaattttaaattatttagtattggtaacaatgatatattgtaacaaaaatgaattaatatgaaagtggtgtgatataattttgataattttatagctgtgatagtaaatagtgatataacactgagaacagcgttgcagttgaaattattacatatattagagggttaaatcaagcagactaaatttgcatttattgcaaatattttgtgcattcaatttttccatggcaccatttcgacagtaaaaattactatggaccgatgcaagagttcactgtttgacgtttgagcggtgccgtgttatttacgtgacgaccatgacaacgagtgaattcagcaccgctcaaacctcaaattactgaacttgtgcatcggtccataccatggttaaatacttgcagcaggccagaatcgaaccgaggatcttgcgattgtcaagcgcgaacgcttaccgctcggctatcgatacgcgagagggagcaaaacgcaaataaaaagctttctttatagctcaatcgtgattggaatagtacatttaaaaacttgtacatggttctcattacttcaatgcttgtttcagtgaatggaaagtatcataagtcaagcgtggactagaataaggacgtaaatcgcatgatcgatttatcttcatcgatcctctcttctggctacaaaatgcgggtttgttagtattttttcacttcaggacgctaggcagggatggaatcttgcgtcctaagatgaaaaaaatgcaaacaaactttcatcttgtcgcctttattcacagaagaaaagatcgatgaagagaaatcgactacaggacttacgcccttatttttgcaaacttttgaaatatggaatcgcatcacctagtacagtactaacccgattttgtctgcccccgattttgtctaccgccgattttgtcagctttttgacccgattttgtcagcctattttaaatttgtcaaaaaattgttatcatcatgttttatcacgtttacattaaaattgatgatgatgtttgatgtcatgcacgcatgggcgtagctagaggggacaatggcaacgccttttattaagtgttaaaaatagatattaccaatataagggagggggtagctcctgataaaaaaaattggctacgaccatgtccatcgtcctcttaaaagtccatgtaaccatgcaacacgtcaaagtttaaaaaacaggaacaaaataaaatgacccgattttgtcaggttccccattttgtcagccaaaaattcatcgaggggctgacaaaatcgggtccttactgtattgcaacaccccagttaaatattgcagcagctccacaaaaagtttagcatcaactttaataaatacagtcgaatttcgttcgttgcgctatctttaagtgggctacgttttaattgggctcccgttagttgggctatagcccacctaaaacgaaggcaaacgtcgttttctgacataagacacaattgatcaatgttggtagctctgtttttcttttgttctatgttatttgacagctcgaaactcagcccgattagtgaaagtctttcactaagtgggctacaggctctaggtcatgatcccgatcacctagaaaattcatgtcttcggcaaagtttttcagaaactcgaaagcaatttgcgacagcactgtttagatagtaactttcccactacgtggcgccaattgcatgtaatatggccatattctagtacactctagctcatattctagatataggccacatagaaagttcgtttgttcagttaagttgttcaaccctgtttagttagcagttttgccgctacgtagcgctagtgtgcatttaattttgtcgtgttctagaaggctcctgctcatggtcctggccagtgtcgatagactcacactcaaatctcaatcaatacgctctcccgtgagagcaaactcattagaggtctgcttcgtaaatctcacgcttgagattttgatgcaaaatcatttaatcaactcaaaccgtaaaacaatgattcagtcgcaaaacccgtcaaaagctcgtgaaacacgaatgttgatgtttacgttagaaaggattactataattttaccagacttacaataaattattgccgtgtgtgagtgaactgtggaaatacgacacaatgagtcaaaaaggtgagccaactcatccatgatttgttgactgctgagttgcgtgattgacaactcaagctaagtatgctgttcctacagagagtcccctttgaaatgacatttcttctcaactgcgtactgcgatcagaaaaatgtgagtttctgtactatttctgggaagaaattttccacgcatcgagataggcgattccttttcttgccagtagcaaaccagccttcacgcatgaaaaatctcaagcgtgagttatgagaaattgagtttttcacaacactgatcctggccacctggaaagttcatgtcttcaggaaatttgttacggagcttggaagcaatttgacacagcacagtttaattaacacttttgccgctacgtggcgctaggtgcatgatatttcgtcatagttcagtagactctagcatatgatcctggccaccgagaatattcgtgtctcgtgcaaagttgctctgaaatttgaaagcaatttgaggcagcgctgtttggttatcacttttctggaatatgaccaaattacatgcacactagcaccgtagcggcaaaattgccaactaaacagtgctttcttaaattgctttcaagtttcataacaactttgctgaagacatgaactttctaggtggtcaggatcatgaactaaaatgtactggaattcaaccaaattacatgcacactagcgccacgtagcaaaaaaaaatctcaccaaacagtgctgcttaaaatttctttcaagcttctgaacaaatttgctgaaaacacgaaatttcttggtgattgggatcatgagctagagccttctagaatataaccaaaatacatgcaaactagcgccacgtagcggaagaattgtcaactaaacagtgctgcttcaaatttatttcaagcttctgaacaacttcaccgaagacacgaactttctaggtgcttgggatcatgagctagagcctgctagaatatgaccaaattactatcacgctagcggcaaacatgcgctttcaatatacagggtgtatactacctgtaaatcctagaattatcagagaattttattgaacctgaaaaaaatctgtgattctcagggaatttcgataacaattagtaattacggaaattcattcgaggcaatgattaatggtagaattttgatgacaaaggattttcgcgtcaaaacccgccaaaaattacggctgcgccgctatcgaatcattcattgagctgttcagtgagtatcttttcgggtatgaaattttatcgacttcccaagacgtgattgaattgtatgaataaggtaccgtggggcaagtgggtaatggaattcgcatagggggcccagatagccgtagcggtaaacgcgcagctattcagcaagaccaagctgagggtcgtgggttcgaatcccaccggtcgaggatcttttcgggttggaaattttctcgacttcccagggcagagagtatcttcgtacctgccacacgatatacgcatgcaaaaatggtcattggcacagtaagctctcagttaataactgtggaagtgctcataagaacactaagctgagaagcaggctctgtcccagtggggacgtaatgccagaaagaagaagaagagattctttaaatcctggagactttaaattaaaacaaatgaggtcgtgtatatttttagcttgactcccaccaaatataagcagtatgctgaaatttattttaatgtaaaataaagaaaaaagtacagaaaaagtttttgaaaaacgtctccttgctgggtaagtgaaaagtttatcgttttgaacaataaattcaaaaactaacctttatattcactatttctattacctttaatatttgaacaataacataagtaacatgtaaacaaagagaattttattattgttacttaaattctcttctgttcagttatgtttgttgaaatgattcgacaacatttccatgcatctctgctctgcagaatttacaccgctcgttatttgaaatgaaaatcgagtatgacgtcggataactcttcgggagaaatcaaacggaatccttcaataaattatttagaaacttttttatgtggatacacctataccccattttttatgttttgaactaccttcacataggcattccactaggtttccatgcgttctcttattttggaacttttcaatcaatgtcttccttttattcggctgtccgaagtaaacatattaatatcgtaatatttggcaactttttttagcgaagttttatgatttggccatgataatagcttttaacacttatagtggtaagctccatcgaagttaatacgccaatcgcgtattatcctcgattttactatagtaaaatcgaggatgatacacgattggcgtcgtaacttcgatggagcttaccaccattagagtatagtgtttcttgaattatcagcacgttttgttgttctatgataattgcgaaccttgtatacttatagctacctgaagagaaaacacaaattcaatctctaatgagaaacttttcacttgccccacgtgattagaaaattgacggtgtttcattttagttatttttaggtctatgtcgaattaattctaaaactttttttattgcagtttaaaactgtcagaggggacaacttagaagtggtacagaaaattattttccgcaactttttcccgctgaaaatattaaaataagattgcacgccgccaacttgtttcggagtgatagtttacaggttaacaatctatcgctctattatgcaataatagctgaaaaatctcagaaatatcttacctatcgtaatgttctcaatggcctcaaaggtttacgcatgagtttaaaacgataattcacatattcagttaaatatgccaattattttcacttaccccatttacccacttgctttatctctaaatttgatcagtagggtatccgtcctattatggaggacttaagcacggtgttgaaatttaaatcgtattttagtgtccaaaacctaaatattgtagtattttgcattttgaactgttataactatcctttatctgaagtatagtaaagtaaaaaaggaaattttggaatcaaacatacatttttttaacatatatctgaagcttttcctctgtcctattattgcggtatttcgtcctattattgcggtagtgccgtcctattattgcggtataccaaaaatcatagattttattacattcagtatacattcaatgccacacagtgttctagaattgaaattatgctccctccatgttaatgacactacatggtactgtcagtttgtgtgactttggacatatctataaataaaactaattaattactttatgtcacgattcgaaaacaaatcaacagaatcgaatgattttctgccggtttcgtctcctcttccgtcgtagctggacaatataatgcactagtgcactagtcgctttataagaaatgcatttttgactcaaatataaccacaatttcggtggttttaaaaatattttctactagtttttaccaatccaatgcaattttaaaagattgtttccttgcgataatcttgtatcttagtttttcaacgcatttttggcatgtgttccgattttcaatctgtttatatgatttttcgctaaaacattgtgtttatttgcaaaatatttgtaaataagagcaactacagggtaaagatgaatagaaatcttgtgtttgactaaataaatgtatgaatgacacaaaattatgtcacaacatagtatcctaataatataattaatgcttccagcaattacatttcaaatgactattgaaatatcgaatttttgaatgtgatttacagataataacagataataataggcaaaaagctattttcattgtcctattattgcggtatatgctttttctcaaaaatatagaacttttattcataattcaatatctataatgttactacatcgatactgaatttataaacccgctgcatagaattgttttggttctaaacttagaagttcagttagccgatggttagagtccgcggctacaaagcacggccatgctgaaggagcctgggttcgattcccggtcggtccaaaatcttttcataagggaaatttccttgacttccctgggttgtggactgtgctcatacgaacactcagctgagaagcaggctctgtctcagtgaggacgtaatgccaaggagaagaaggagaagaagaaggatgcacattgggaaagtaatctcaaatttagaatgtcgaaacaatcaatttattaatgctgatgtagcaggtctctttttagagcagtagtcaccaaactgcggcccacgggccgcatgcggccctcagcaaggttttgtgcggcccgcggagtgattttgaatattgtagtagtgcggcccgtatcttgtgattttagaagttgaaaaattatcttctgtaatatccggcaaatatttatttgtagccattcgataattttccagattttctctttttcatgcgttaagcagtggaatagttatcgagaaacaaagggaagttgatataatttcttatttctggagtttatttgataacccagagtttctcgtgcggcgtgtgcggtgagtgaggtgagacgagtcgaatgaggtgacaattgtcgactcgctcccatttaattaacattagtcgtctcacgtcactcgcggtgagagcgactcgtctcgactcacacgccgcgcagaataggcacgtctgtatgtcttatataatcgtttcttcaaaaaatcaaagttttcaacgttctagtagcgcagttttcaaaattcaagtaagaaaatgattttttcaagtatataaaataattccaaaataacgcagaagttatagtttttatgtggctaaggttttttttattatatggaggttaattgttgacattattataatgttacaataattgtatcaaaaaacgttgataatattcgaagtttatcaaatctattctcatctttgacataataatccacccgcctcttttgaattgattatgatcatgatgtttcattttcgaaaatccaataatttttgacatttaccattgcacgaaagatgaactcttgaaaatccaggaacatcagtgttatttggaaagattattgaaatcgctagttactttcagacgcaatagacatgcatatttcagaaaacacctgtcgacccctaagacaagatgtgacacctggcttctcttgtatgatccttgtggtgtcagaaaactggtacacataattggaaattgaaaaggaaagagaagaaagctgagctcagaaggtgctgcagttaccgtacaatcatcattgctggtaacactgtctggcggaccaaccagaggctggttcattttggcacgaaacttagatacgtgttgtcaagtctcgtttcaggtcgaccccaatagtttcccattcaacttgtgtaacaactgtcgaaactgttttggtcgacactaattctaaccaagttgttgtgatcggatttataaaatagatattattaacatcttgtggcccgcgtcgtattttaagagcaaagtggtggctcgcacaaccagttaggctgaagaccactgttttagagactttgtcaccattttaatgcaagtctctaacaagcctctaaatgaatgaattgatgaaagatctctgaaatctttgttttaaatcaaaattgcatataaagtcccttttttcagagactgttacgagactattaaactattttttaagaatttcatattagatttttcgacgaaaagcgtcaggaattatcctagtggtttctccagagatttcatccggaatacttttagggacccctacagggatctctccagaacttcttcaagggattcctccaccatttatcccccatattcttccagcgttttttgatagaatatcttgaacaatttcttcagaatgtgctctgggaaattctcgataacttcaaagttgctatctccagtaatttgcacaggctttattaaaaaaaacactatcttagcacttagacaccgacacgtcaaagtattcctcaaattccctgtttttcaccattcctatagatttatttcttctatgaatttttccagttccagaaatatttttcaaagcgtttctcaacaaaatttcatggaatctaaaaaaaatataatgttccactagctaacactgcagcattattttcagaaaatcctcctaaacattttttaagggattccgtttgatgtttttcaaggagttcctttagatgatgctgcagcaggattttattcagatcacttaagaacttacacaactttcatcagaacgaaatttttgaactttttttcaaatttctggatgaatacttggacaaatcttcgtagacttccttgagaaagtaaataaatctgtgagtaattcctggagttatcctcatggaaattcctagttcaaatctaaatgaaattatgaaggacaattttgtatgaaatcactaaataagtatttggggaaatttctgtccttaggaaatcgatagaagaatcaccggataaaaccctggaggatttaggttttttttaatatctgaaagaatctttaaaggaattcctgatgatctcagagttagtttctgttattatatatgttattaatcagttgtactcttaaaacaaaactctttgatgaattccttaggaaaattctcaaaaggattccatgggaaataatcactgaatgaactcctgaaggaatgctagagataagctagcttcggactgcaaatctctcaaataaagaatcctaacctgagataatctggaatgagttctgatgaaattctttgagaaaatctttaaaaaatgcatacagtaatacgatcagtgttctttgtcgtcatgttacgaaaaaaaatagaaatattctcagagaaatctctggatgacttcatgaggaatcaaacttttttctcctggttcatcatgtgaggtttcgtttagttttttttttattcctgtttggtctcattttggttccggttttgtttttttttttgaaaaaggtctctaaagttcctatttttaagacactaagtaactactggcccagcaatatagaaaacttgaatgttttcgaatgaaatgccatcaattcattatatttaaaaaatacaaaacttgaatgttatacagactgaacccgattatacaagggctcatttaaccggggtctcaaatctattcaaatatgtagcgaaataattttgtaacattaacacaattcaatgaagtggtaatacatattttgaaaagattggtttttttgcaggtgattacaattttatgaatacaatttcaaaaaccgcggtaaacgtaatttttattgcaaaatattatcacaaacataagttttttttcctttttgcgcccattgagctgtcttaagtatccaaacgacccgtggataccatttgaagtttcttcactgatcacttttgacctgaattagttaattgattactgcttgggtactcgtgtggaaacagatcatgcactattcagtttcagtgaccagtgaagaatgaatgaaataaatgaatggttcagaccagtgatcagtgaagaatgaagtacactgatgcactttaaagttgcgttcagtttacaatgatgatcagagctcttacaaacgatataaaaatgttaaagttaccttatcaatttcaattgatggaagctttaaacactgttgaatcaaaactatgttgtcatttattttttattcatctgaaattagagtatttcttgaacctgaaattatttcttaaaacctgggaaaaatctggaacaataagggaatttcatttctgtaaacgagtaaacaccctgaaaatttcacctcatgaacgccataaggcttctgaacaactttgcaaaaaaaaaataaggattccgagatactgcatcatcaatattatatttttcagatgatgctaaacttttcggggtgctgcaatattcaactggagtgttgcaatattagataatgcgattccacactccattatatcacttttcactatcacagctacaaaactatcaaaactacatcacaccactttcattttaattcatttttatgaccatttgccattgttatcattactaaataataaaaagatattcaatttaaatgttcgttattgtctgttgctagcgtcattactattcaaactacgatttagcactacgatatatacgataatatgtgaagaactaggcaatagtgtttatattcagagaaatgattgcaaaacgtattgctgtttgcatttgaggtgtaaatgttgagtaggggcctttcttagccgagtggttagagtccgcggctacaaaacaaagccatgctgaaggtgtcagggttcgattcccgatcggtccaggatcttttcgtaatggaaatttcattgacttccctgggcatatagtttaaacgtacctgccacacgatatacgaatgcaaaaaagggcaaatttggcaaagaaagctctcagttaataactgtggaagtgctcttactgaactacactgagtacccggctctgtcccagtggggacgttaatgccaagaagaagaagaagaagaagaagatgttgagtaaacatcctccaaatgcggtaacacaaaataatcaaaggacacctagcaacgattacataaatcaccgccgctctagcaagaaacatctatctttgacatctcatttcttgtgaaaaatcttaccgcgtttggtgttcccgcatttgatgcttgcatttcaaacgcacacagcaatattatagccattattaaactagtagggcatattattattattatgtatgagacgtctaaggggcccagatagccgtagcggtaaacacacagctattcagcgtgaccatgctgagggtcgtgggttcgaatcccgctggtcgaggatcttttcgtaaaggtaattttctcgattcccaaggcatagagtatcttcgtacctgccacacgatatacgcatgcaaaaatggtcaatcggcaaagaaagctctcagttaataactgtgtaagtgctcataagaacactaatctgagtagcaggctttgtcccagttgggacgtaacgccagaaagaagaagagacgtctaaggaagcaggacaaatttacatagatgtctatggaaaattcttaatacaagtgcctcgaaagtgagagcttctgatctgcaaacagggtgtccatccatccgagaaatccgggaaaagcgggaaaaacccgggaattccaaatgaccgggaaaatacgggaaatacccgggaaaaagttgaacacaccgggaaaagcattagaaaatttttccaagcgatgcacgactggaaaaaaagaaaattcaaagagaaggaattctttcgaaacataatatagattcttagctaggttcttgttgagctcaaaaatttttgggaaattaattggaagatctaagtggttacccaataaaatattggacataattgctttttggatacttgaaaaattcttgtttggattactaatttaacaaatccgctatctatgtacttgcaaggtccttgacgaaattttgtatgtctgattttgtttatttattgacgacaaacttcgccaattttttaataaattcccggaaagatgcttgtttgtatttatgtcgttttttagcaagcaataaatcaaatgttttttttttgcatctcctccgtattttgaaaataaatactctaggttgtacttatcacatcacttttttccaatgaattccaaagttaaatgcgatatcttgacaaacaaattaatttatatatctaaatcgataagccaggtgtaaaggtaacttcagcaaacattatgttctgaaaattcatgaaagtttgcgtaaaacatctttagcgttggtctgttagatttttaattagtctttcatacctgtgtgtccacaactctttcaaaattcaaaacatttatcccaaagtatcagaatgtacttaaagtaagacatccaaatttgactgtttcataagacaaaactaaaaagtggcaaatgttttgatccaattcatcaaattttgatcaatatttgatatccaaaagcagctggtgaatttacaaaacacttttaagatttagtggttgatctaaccgctaaattttcaatatctatggaactgcaatggtattgctaatttgttttaatatttaaccctatttagcaaagaaatgaaatggtgttctgaatgctcagacttattgaccagtaaaaaaaaacttttgtatttgaagatatttcttccaaattcatagtttaaggtgaagatgcattgaagccaaacctcaattttacaggtcgtcaccagctagtgatcaatcgatcagattttcaacaccaatgattgtctagttctctaaatttgtgctcttgaaaattctaggtttgacttcgatgcatcttcaccttaaaaacgaatagattttttgaaactcgtatcggatatcacaactttctatcaaaaaattctaaaaaatatgcaatcgcagaactatgatgttatccggtgttgaatttttaggcatccgggaaaaatccgggaattgaaaaacttattttgaatggacaccctgtgcaaatttcgaaacatttcgtgtgaaatgtttcatgagcatgattgaccgcccgcagttgctactccgttattgtaagaacagctgtacttacacagggaaccgacatatgctactcaggatcagtatcatcttcaatatgtaagtactggtgctctcattattataacaaacaataccggcgccggctgcgtccgaatgcaggtcaatttgggaatgtgagggaaatgttgacgtgttacttgctttacggaagccgaggagtcctctgcacttatacaagtaaacactgggagtttggatatgcgaaaggattcgttttggtgaacgataaagtttgaaacgaatacttgagcatatacacgggtgaccgataccgatagtgcgattattacgcgaactggacacaattgatccggattccgtcgctcgcccacaaaggagcaagcaacagattcaacgggccaaacactactgacgcgttttgtttatcagccgcacactatgttttttcatcagcgcaacgtgaaccggacacaattgattcggattccgtcgctcgctcataaacatgcaagcaacagatgtttcccatacaaagtagagtttgaagctctccgtataatgaatcaaaaaggttgtgcaacaaacaataatacattctgaatgaatgaatgaaggaatcagttctgataaatagctacgagatcacagattaattgatttactaattgtttcgctacatgagtagatgtttttcatttaacatctttcatgttactattctaagagtttttttttatttattaggtttgattagttggtttcataaatttaatttaattgaaaaatataagttttccattaccgatttatttttatatgttcaaaacatattctcaaatattcaatagaattgtttgacctcctgatttattatatttgcgtttgcgtggtcagcatagactattcagccattatccctcctatcatcggctttgaattgatttgcgatcttattgcaccaccaaatgctgcaaaatgaaaataaaatgcttgctcgttatttcggaacgaatttgattttttttaaacgtccttcatgtttgttctgaaacgaaaatttgaaaatttcgattcgtcgtatgaaattgtttcaccaaacttatcccagaacttgctagtttcagtaggtggccactgtatcctaagctaaaaaattctgtatatttctccctgtcggaaagctaattataatacccgaactaaaagttgaacatgataaccttatttaccaattattctattctagtgacttcatcattcttcccggatacattgactttacggccgatgatgtagatttgtcgtcgcctcttacaaagaagattatgttgaaggcaccactggtatcatcgccgatggacacagttactgaagctgatatggctatatcaatggcggtaagtgaaaagttctttagttatacagtgactcaatttcattttcgtaggggcactttttttcttatcaagtcggtaaaactatgaaatgatctatagatttcgacagtgttgcgatggatcttcttcgcgaacgataatcgacgcatcttcgcgatccaacgttcgctaacatacatttttcatttttgcgttacaaatagcatcgcaaaaagcgaacgaatgcaacgccgaagaagcaaaatgaacacaccgatagtggctcactaagcctttccactcgtaggattcatttatccacgcgctgttcaaactatagaaaaaagcttttgttattttgttgttgagttgaattaaatttacccagatattgttgaaaaaacatgagaggtctggaagatttcgatttcaggttttctactacagtcgactcttcacatctcgatgttctatatctcgatatatctccctatgtcgacgatttctttggtcccttcattctgcatacatttccactctccgtatttcgatatctccctatctcgatgtattcctagttgattttcgttctcgattgcctctccatatgtcgacatgccccaaggttactagacccaatttcaaagattcaaaattgttcgggaacacgaagtgacgtctgcttttttattatattcctggtaacggagtgattgtcaatctagtattcattaaaagtgcgttctttgcctcggtcttttcctatctcgatggttctttcaatatcgagatgtggagagtcgactgtatttaaataaaccaaagtaggtacatgcaactcaattttctctttcaaataaataaattaatattgctgtatgcgtttgacgtgcaaatccagcccaactgagcttcaaacgcggtagcacaaagtaaccaaaggatacttagcaaccatgatccatatcaccgccaacccagcaaagaaaatcaaactttgacatcgccttccttgttaaaaatcttaccacatttggtgttcccgcatttgatatttgcatttcaaacgcacacagcaataacaatgacaacacgcctttcatagcgcaccagcttgttgcgagcccgcatgaagatgatcgaagtgaatattttcctgctcttcgcgaagagcaggcagcgtagatcgtaccattcacattaccgagcgatggaaaatcacccgatgatagcgtcgggagaaacatccgaaaatgaaacacgaacgaatgaagcgcccgaacggttgttcaaggctgatacaaatataattttcttttatgtcacctcccccccccccccttcaaaaatccgaaaattttgaaggggagaaaaaaaagattcatcatttttttaccttagttagtttttttttaatttttaatgcaaaaaaataggtgaaataatgatccagatgacaattgctaaaagtttaacaactatcgttaaaaataaaaatttgaaaaaaaaacttttttttcaattttatttttttgttccttattaatttttgtcacccccccccccccccctcgtacctttcaaatggtctcggacataaaagaaaattaatatttgtatcagcctaatgacggtcataggtgtcttctattgttcggcaatcataaactttattcatttgcttaaatctttgggctaatggaactagttgattgctcaagttctttattgcgttattcagatgtattacacacttagatcaaataaccgaattcggtaactggtttaccgaaatctcaacagctgactgttcggtaatcggttcggtaaaccaaccgattactgattgatcggtaacttgcggattcgagcacagctgtcaaaataaccgaacgattggtaattgatcaccgaaaatctgtaatttcgctcctcatgatgttttctctgagatttaccttctcatgtggaaaatgaaaattgcgacaatagtaattacctaatcgcacttctttatttggctggaggtctgaataaaatgaattacttatcgtaataaatttaagagtaaagcgatccatattgaccaccggacaccggagatattccggattttccgaggtcatgtccaaatgccatttttttctgccgcttgtatttttgtgcggtgtgaagttgtatagatgtttacaattttcctagaaactagaactaataagaagttgaatgctggtgaacgcattgagattcgttgaaactcttcagatatatgaccgtttcagtaaaattggtgccggaagatatggtcagtcatgttagtattaccaatcatgtaaatattatttggagctatatccaagtgccatcaatcttcaaaatgatgcttccagtagcatattcagaaccattagatgcactgaccactctatagtaggttccaggtggccaatgtggtcaatttggaacatatatggagccatatcaatatgggcatcaaactttaacattttcaaaggtgatgcttctggaagcattttcagcaccatcggctgccatggccattctatagttggttttagatgccccgagaaagcatttccggatttacatcaaatatcaagattttagatggtgatgcttccgaattgccacatgagcatcatgttcgaaaatcttgaagcagtgttaatagactcacactcaaaatctcaatcaatacgctctcccgtgagagcaaactcattagagatctgcttcgcaaatcgcatgtttgagtttttgatgcaaaattaactcaatcaactcaaaccgtaaaaaaaatgattcagtcgcaaaacccggcaaaaactcgtgaaacccgaatgttgttgtttactttagaaaggattaacataattttaccagactaacaagaaattattgccgtgtgtgagtaaactgtggaaatacccgacaatgagtttaaaaggtgagccaactcatccataattttttgactgcggagttgaatgattgacaactcacgcatggaaaatctcaaccgtgatttgtgagaaattgagtttttcacaacactgtcttgaagtttgatacccatatttatatggttccagacatattcccaattggccacttcatccagggcacctggaacctactatacagtggtcatagaaattagttcctctgtaaatgcttccagaaacatcaccatcaaaaatcttgatgttttttacccatattgatgtgtttcccgctaagcttcgaattatacacatccctcggggcacctggaaccttctatagagtggtcatggcagccggtggtgctgaaaatgcatcacctttgaaaatattaaagtttgatgcccatattgatatggctccatatatgttccaaattgaccacttcccccaggccacctggaacctactatagagtggtcagggcatctaatggttctgaatatgctgctggaagcatcattttgaagattgatggcacttggatacagctccaaataatatttacatgattggtaatattaacatgactgaccatattttccgggaccagttttacggaaacggtcataattctgaagattttcaacgaatcctaatgcgtccgccggcattcaacttcttattagttctagtttctaggaaaattgtaaacatctatacaacttcacaccgcacaaaaatacaagcggcagaaaaaatgccatttggacatgacctcggaaaatccggaatatctccggtgtccggtggccaatatgccaagcaagttcctgaaagtagaccaaatttgccgtcgactgctctcggatgcatccaatttcatcaatttttcataaagttataagcatttgaatttaggcaaaattttgcctatctcaatcattttgcctatcccctgtaataattgattcgaaaaaaaagttataaggttgaaaatcaaaaacgagagttaccacacactgaaaataaaaccgatcttaagaacatcataaaaaatatgaaatttaaacacaagaaaaagttttgtgttataagaacaatgtataattctcataaaatacttttcataatttttataagattattgaaccacgaacgttgatatcagagagcgacacacgcctctcggcgcttcggaaatatacttcttttaaaagctattcggtgagatttcgatcccacgactctggtatactagacgagcgccttaccaactaagctactgagctggtatttaactcagaaggtcgcttgctcttgcgcgcgtgtgaatagatgaaatggatggatttatggccattgggacttgaattcgaaggtaccaattctgagttcagcaagcggatcagtagctcagttggtgagtgctcgtctagcatacatggattttttttttcatgaattcattttttttttcaatgaattcatggcgagatctttgatgaacagatggctatgcctttaaggtagtcttaagatggtagtttttctagtttctaacaagatgtttgggaaaatcttcaataaattcttggaatatccaacaagagtttcaccagatccagaatttattcagaaacaggctaatttcgaaggcatccttagagaaaaaataaataaataggctatcaatctttgcccttaatctcgtcgaatttcatacggatgctaggtggatcacggcattccttgcgccccgtatcgtaggttttcttcaacggatccgaaagtttcgagggattgcgtgtcttaagattatgtttgttattcaaacaaactgaaccgaaaaaaatgatattttttgtttcattccagctttgcggaggtattggcattattcaccataactgtactcctgaatttcaagctaacgaggttcacaaggtcaaaaagtacaaacatgggttcatccgtgatccgatggttatgagcccagagaacaacgttgcggatgtcctggaggcgaagaagaaaaacggttttaccggatatcccataactgagcacggccgtcttggggagcgtttgctcggaattgtgacatcgagagacatagattttcgggaagaagatgtcgcccttaagttaaaggacatcatgacgaaggtggaagatatggtgacggcgcccagcggagtgacattgcaggaagccaaccacattctggagaaaagcaaaaaaggaaaactcccaattgtgaacaaaaatggagaattagtcgcgctgattgccagaaccgatttgaaaaaggccagaagttacccaaacgcatctaaagacagcaacaaacaattgctcgtgggagctgcaatttcaacgcgagatgatgataaggagcgactggagcttttggtgcagaatggtgtcgacgttgtagtcttagattcctctcagggaaattcctctttccagattaacatgatcaaatacatcaaacaaaagtatcccgacttgcaggtaggtggattttaatttatttgattggtcgatacaaatatttctttgtcccatcgaccttcgaacggtcgagagggggggataataaaaaataaccaatttaagggggcaggatccgtcattgatttcggaattttcaaaagcagttttttcgtttaaaatcaagaatgtttttaggataatgtgttcactgtattgtattctccaaccgaaacacagtgaacacatttacatcgaataatttttagttttgaatagaaaaactgcttttgaagtttcgatgatgacgatgattacgatgacggagcgttgatcgttaattgaaaaaacggatttgtttagaaattttctgaaaatctccaaattttgaatagttattgaatatttgatatttcgaaagatattttgagatattcgtaaaaaatctgagatttccaaaagaattttgcgaatccggtaagattagcgtgcattttggcataataataattatgtcatttcttaggaatcgttggatgtttgtgaaaattcaggtatttataaagtaatactgaactttatgtcagaattgtgacatccaagattctcggattttctttggaattccggtatttctgaagaaattatgggattccgatagacattctgggattcttgtggaaatatttaaaaaaaaaatccggtatttgattcggctattgatctttaaaatttattttgatatctttgagaaggtatttctgtaagaatccatgagagtttcgaattttacatcataatctcagtactgacatgcacataagggaatgctagatttatcgcaaatttacactacaaatcgtgtaaaaacataacctacataaatttgtgtccatgcccgattacgcgatatatagtcggaatgcaataatattcatattttcacatgatttgtgatggtaacaagcgacacatttgacattctttttatatgtatgaaaaaagcgctagttcttgaagccaccctccatctgcgtggcgatacactcaaaataatccaaacgtcaaggctacgtgaaaatatggaccaatacactagttcactatttgacgtttgaacggtgccgttttatttatgtaaccatggaaacgagtgaattcgacaccggtcgcacttttcacgtagcactaacgtgattcacaggtggcagcgaatgaacacacggactgatgaacttttcacgtagcagctacgtgttgtatgcgtaccttctactgagccgtttattgagttcaatacaatttcccagtattttttttcagaaattttgaataaaaatgacgttgaattttggatcatttattgctgttctctggaattttgttttcattgattggggaggtatccgaattacatttactgaaaacaatgtttttttttctacacaaatgcacattgacaaaactatcgggttgagttgagttaaacttctaacattgcagtctcgattgtaagcaaatcgaaaaaatgcaagccattactggcggtgctcgctgctgaaccctgttgaaaaggtaaaaataaaccaatgaagagtaaaagctgatcctgaacgaagcttactcaacattatcatttagggaaaagtggggcaatttggccaccttaagaaaaagtcgataaaagtgctgaaaatattattaatttttcgcatgtttgcatgattttagatgaatacactagatccacatgaattcctttgttttttaaagttcacggatgaatgattgatttttcaaaatttgtcattcttcgagtcgattttttactgatggggtgatatgagcaccccatttttggttgcaaaataatatcatataatctaaaacttcatctattttgttactacacttaaaatttattagtatttatgaacacttcgtgcaagaaaatatagttttttaagaagattctaacagtcaaacatcataattctgaaatgataaataacaacttggcggcgtgcaatcttattttaatattttcagtggaaaaaagttgcggaaaataatttcctgtaccacttctaagttgtcctctctgacagtctcaaactgaaataaacaatgttttagaattatttcgatgttgaccaaaaaataactaaattaaataccgtcgattttctaatcacgtggggcaagtgaaaagtttctcaaaaaataaaatttgtgtttgctttttaggtaattataagcaaacaaagtacgcaattatcataagaaaaatgagcgtgctgattattcaagaaacatttaaatatatagatcaatgttgtgtgttgtttgttgcttgacgtgtttacaaaacgcttttgatgaaacgctattttttcaagtttttacgccgattttaataagactgtgctgaaataaacaactattcacatgtgagctacaagtaccaaacgttgaaaattgtattcccgtggttaaagcatcaaaattcggcttgaaatatccaaaattctgctgtatacgttccttgcctgcaactgctccattgtgttcgctatttacaatggattgccacaagtgttcgcaaatcatcaccgaaggagatatgtataccgtgtgtgaaggcaaatgttccaaacgttttcacgcttcatgtgtcggtatcgatgaacagcaatggaatgctttgtcgaataacgtcatttggctttgtgactgttgtatggcggatttttgcaaataccgcgatcgtcgggaaccggtgcagatcgcaactcgatccgtagacgaggagattaaggagttgaagatcaaagttgcaactataatggaaactttagctgctattactgtttctgaggagccttcatccgatgggaacacgcaacgtcactctactcctgtgtcgtcaccctatcttcgtaaagcaacaaattcattgtgcgattactctaaagctgatgtgtgtgctccaagtgaacatcatgcaccacacgactctaatgaaacattcgatttatttctaacgaacattgatccaattgtgaccgaacaagaaatcagtttaatggtagctcgttgcttaggtatgaattcggtcgaaaatttagttgttaaaaagttggtgtcaaaagaaaagctttgctctaaacttgattatgtttcttttaaaatacccttgcaagaacattatagagagttagctatgtgtgaagctacatggcccaaacgagtcaaatttcgtgaatttgttaatcgacataatgatacatggaagccctaaaattgtatagtaatcgcgttgaatgtttgtaaatgtttgcatgtactgattttttttttctgtgaaatctcaatgatgatgattgttatgataatgaattattgatgttttggtttgtatgcatataatgtcatgttgtattacttttgaattagttttaagctttcattgagaccttgggtcagatggattaaataataaatacaaataaatacaaactcaggcctgcccaagctttttggctctttctcgtaataaatggttggtgcgttcgcaaggatagaccaatatgaacaaaattagtctcaaatgaatgctttgtagtatatctgtctattccatgctgaaaattttaaatttatataaaactcttcgctagcgatgcaagcaagcccgcgggccggatcattttttgtactaaattgcaccgttagtaaagaggatgaaataaattttaaattcgcagcatggaatagacaaatatactaccaagctatcatttgagattaattttgttcatatcggtctattcttgcgaacgcttcaaccatttatgtgaaaaaagagccaaaaaggttgggcaggcctgatttaactcaaagcgtaaaaagctattagaaataatggaacttttctgaaagaggttgccaaacattacaatattaatgtgtctgcttcggatagccgattgaatagaagacgttgattgaaaagttccaatacaagagaacgctatggctatggctctatccacacaaaaaaaagattataaatactttattgaaggattccactccatgaagagatttctccatatctgactttcttaaaaacaaataacgagcggtggaaattctacagagcagaaatacaattgctgtcccatgatgttagaactaacattgaaaatgttgcagttataatgttgtcgaatcatttgaactataaataaccgaacacaagaaaatcgaattgacaagcataaaattttctttgtttacatgtcacttatgttattgtacattgggactccttaataaatgttaaagctaatagaaatcgtaaatataaccgttagtttatctatttattgttcaaaacgacaaacttttcacttcagtgaaaagtagtgaaacgttttccaaaaactagttctgtattttttctttaattttacataaaaatcaatttcagcatatcgcttatgttaggtatacacgacctctttttttcaatttgaagtctttagagcttgacgaatctcaactatacgattttcattacccacttgccccacagtaccttaccgaatttttacttaaatttgtgacatttttcaaaaaccacgctggaaaaacatggcttatttcctcagcattggatcgaccagcattttaaatcaatgtgtcattggaatcgtaatcttatattctttgaagagcgctcaccaaattttggtggatagacttaaaactattcaaaatcaataaagcagtcatttaacccgtataggcctgagtaaaagaaaaataattaaaactctcaccgctcagcgaatacttaacggatttcaattatttttgtcagtatactcgtacacatatctagtttctaaaagtggtaaaagaatctcgggattgttcctgtggccggagttattccggtggatcactgggtcaggtcgggtgactagggttttgtgcttctgtgcccctggaggtaggcaaatttcaagtcacagataatttcaagaatcggcaataatgtggccactatatcaaagagttttaagaccctggccacgatcacagggtttgacggtgccaaagtagaaggtgcaccataataatacccgtctgtgaaacatatcaccttcccaatactttggcacacctctaacggttcatgatttatcatgaaacggctgcattcaggcgggggatctgttaatatgtttcggcatattatcaggtcctcttcgaacggagggaccgccagggctcattagttacttataaaccagtgctgattgttgatgtttcagttcgtttacacgagcacgagctgtagcatcctttgtactaatcagcaatggtggttaaccctttctttcccacagctttgtttgacagtttaactatcaaaatggcgtttctaaaaaaagtgtttgaacaaaagttgttccaaataagctatattattcaaaaccacaataaaaaaaattgattgtttttcaatagttagttgattgtttttcaatagtttgacccttaggtcacttatttcgatgattgataagacaaatgagcgtataaatttattccaattattattgagctactcgtaccaattcgatttagcccgcgttcgttgaaaatcggtgtgctaccatgggaaagagagggttaagtttcgaagccaacgtgtgatcaatcgttttataatgcaacataagaattagtgtttggtggaactgtgcattacactcgtcgttataaaatttagtgattgtgaaggtgctaatagtgattttataataaaatctatggtgatgaaaatttgaaatggaagtgattttgatagttttgttaaaaatataataataatgatgtgaactcccctggccacgatcactgggtttgacggtgccaaagtagaaggtgcaccataataatacccgtctgtgaaacatatcaccttcccaatactttggcacacctccaacggttcatgatttatcatgaaacggctgcattcaggcggaggatctgttaatatgtttcggcatattatcaggtcctcttcgaacggagggaccgccagggctcattagttacttataaaccagtgctggttgtttgatgtttcaattcgtttacacgagctgtagcatcctttgtactaatcagcaatggtggttaagtttcgaagccaacgtgtgatcaatcggtttataatgcaacataagaatgggtgtttggtgaaactgtgcgttacactcgtcgttattaaatttagtgattgtgaaggtgctaatagtgattttataattaaatctatagtgatgaaaatttgaaaattaaggtggaagtgattctgatagtgcaatcatttttctgaatataaacttaattgcctagttcttcaaacgtgcatgataaaagtgttaatgtaatgacagcgagtgcagaagaatggatcgaagtgattttttttaatgtaactttcttgatcatagtgctaaatcgtagtttgaatagtaatgactctacagcaacaaaaataatgatacatttaaattgaatatctttaaattacttagtaatgctaacagatggtaatgctaacagatttatatgaaaatggtgtgatgtgaaaagtaatataatagaaagtatatctgaagtgtattacgaaagttgatgagtgataatcggtgatatacgtgatagtgtcgaaaataaaagtgacgatagtgagtgatgaaatgaaatggggaatgaggaccttttaataaaactatttcgttcttcactttaaccactctagtagcatttcaggccttatcatagtttgatagtagtctgaactactagactgcaaaactacggcaagggctgattgctgctagcgtacacagtgaccatttgagcaacattgcttaggaacgtctgtgtgatgaacgcaatagaggcttataaaagcaaatgctgggaaggagcttagggcagattaagagtgccagtactacccctatcgctaccgacaaaaaaaaaaaaaaaaaaataatgatgtgaactctactaattttataatggtcataatacattgtgcaatcatttctctgaatataaactttattgcctagttctttaaacgtgcataataaaagtgttaataattacagcgagtgcagaagaatggatcgaagtgatttttttactgtaactttcttgatcatagtgctaaatcgtagtttgaaaagtaataactctacagcaacaaaaataatgatacatttaaattgaatatcttttaattacttagtaatgctaacagatggtaaatggtatttatatgaaaatggtgtgatgtgaaaagtgatataatggaaagtatatctgaagtgtattacgaaagttgatgagtgataatcggtgatatacgtgatattgtcgaaaataaaagtgccgatagtgagtgatgaaatgaaatggggaatgaggaccttttaataaaactatttcgttcttcactttaaccactctagtagcatttcaggccttatcatagtttgatagtagtctgaactactagactgcaaaactacggcaagggctgattgctgctagcgtacacagtgaccatttgagcaacattgcttaggaacgtctatgtgatgaacgcaatagaggcttataaaagcaaatgctgggaaggagcttagggcagattaaccctttccttcccatggtagcacaggtgatccaccactttgcgtatgtcgtatataaactgtacaagttagatcatatccatttttacaccacatgttcacatatgtttcatgaaataatgtacaaagtttcataaaaaataatcatttggattttcagttaaagcataataaccgaagtaaagtcagcattttttctaatttaaataaagtggatttccaaacttctatatttagaaatataaacatgattttcatcaaacaaaaaaacaagctaaattgaattttccaagattcagttgagtttttagaatattctttacacaaaactattgattttgcggaaaattaggtggatcactggtgatccattgggaataaaacgacattttcgtcaattctgttctaacctctcttttcgaaaacaaaactatcatcatgtcttggaaagtgattttaagttggaaagaaaattgtaagacgctgtgggcgatcaacaaaccaaaatactcagcagtagctataagcacggtatgacggagtaaaacattggcccgttgaataccgttctgtgcaaatatcaataatcattcagttcatttaaatacattaagtgtgatgtttgcttgtgtctcaaaaaatacaaaaactatttcccagctttttattttattccagaattgacgagaggtgtgccgaacacactgttcaaataaattgtatgagtaaaaacaatgaaatagaaaaatattgatacttctgttagatttgctttactaagcttaaccctttcccgcccatggtgtctgtagagcaccaaaactttcaacctttgtatcttcaaaaataacaaacaaaattaaattgttttcacgctacttcataattacacatctcctctttcacttcaatgccttattttagggatgcctacaaatttaacatgttttttaacaaaacatatgtatgaaggaatgggttttaccggtcaaaaaatattacatgatttcgaagcctgatataacaaagagaatttatcctcaaagtaacaataaaaatatttaccgatagatttaccctttattagcactaacatatgttcagaaatgcacaatttaattcgcaatcattgaatttgatggaacttgtatggtgcacatgtgcaccactgggcgtacggcacacaaaaaagcgtaatatccaaatttcattattgtttacattaaacatgaaattgttgttattagctcattttgcaattttactgaaaattcggcatgaaataaggtaaatctttacaaaagttgtgcggaaagtgattttatcggatattccgatgaagattctctgatgctttgagtggatttgacgaagttaccgataaagtggcgaaaatcgttaagcatactccgaaatcgattagatctagaagtaagttcaaaactagaatcgtatcgtaagcggaataaatatatagaactatattacagattccgatatcgtgcactttatcattgtcccaaaggagatgaaacagaagatgagaatttggatatgagcgatgatgacgatgaagtaatccagttgacggttcttccgctgtctgaaaacatcgaagtattggattatacttatgtaacgagctaggtaaatgaaaagataagaaacaacaattacaaaagcgtttgaagaaagctcatctgaaaaaaatacgatgaagccataaagtactccaagttcctggtggtgcatcagagcaccaactcatatatgattttaagttaccttgaacactaattgatagttcaaaaataaggttttgttctacgattttgcgcaaaagtgtacatttctatttttaatcatgaataaaagtcatgggcgggatagggttaagagatagacaattgtttcttgctagcactcgaatagtaatgatttatttttcttttccgtttgaccaacagacctctcgttggtcgcttctgattgttcttgaaaacatcgcatttcgtttatatcagagtacacgggaaaaaattctgtggtaaaaattactattgtagctgactacgcccattcttgaaactaccatggaatttcagaccaatttactatgtttacggtacatcccaccacattactggtacatttgacagaaataatttacaacaatctgatttcgacaacagacatggtaaaatcaagcgcatttctggtctgctgaaaattgccggtgcgagcgcttaagttaaccccctaaaatggtagtttttaccgcacaatttttttgcgtgtatgcgtaaggcaaaatggatacactcaaaatgaaaacacatcaacttctttcttaccctagttgcagtcatcttcccaatggatcacaggtgatccaccacaaaaaatatttttttcatttctattcatattttcgagtaaaactttacatcttttgttctggtgatttatccagatatcacattttctattttaaaactacgaaaaacctcgtgggaaagaaagggttaagagtgccagtactacccctatcgccaccgacaaaaaaaaaactatatcaaggagttttaagaaaaacgcatcagcgtaaaccatctgataatcgattaaattgaatgattatgtcaactgcatttgattgatcctacatatgaccattttcgggtccccgggatgcatcaaatttatgataaagtgtacaatttgtatctcaacatctgtgtcaagcgtatgggaacgcattttagtgaactattatgttcgatctatacttttagagatttgaaacggttcaaaacctaacaaatctagagcctgttcttcaggacattaagcccgagttgccgcatttggtacactctaaacggtgcttaacgttcatttataatgttgaatatcggatcttaatgatttatgcaaaataaaatgaatgccattggaaataaataaagataacttggcatgtcccaaaaaatctcctttttctacccgacttgacccagtgacccaccacaaaaactccggctacatgagtattcccgagttcctccggccatttctagaaacaagatatgtgggccagtatactgacaaaatattatttcaatccgttaagtattcgctgagtggtgagggttttagtatttttgctttcattcaggcctatacgggttaagtcatcgtgcaaaagtttgggttcactccttaatatgatgtgtatcgtgcaaaagcttgggatcacctgagtcgcacgtaaattatttttgtccatatatccgccattttaaaaccgattttaattttccaaagctttttcaaatgcaaataacggtgcatacatgattggtttgagatttcactgaattttcgtgttttaagtaagttcaggtgaacccaaatttttgcacgatacaccatactgaggaaaggggggtccgtaggcttgaggttacgcttccgcttcataagcggaaggtcatgggttgaattcccagcccctccacaaaaaaaaacccttccagccaccagaagacgccgcacggaggactggggagcacatccatcctccgtcagtatcagatggtgactgagacaaactgaccctcttcgtaggcagctagcctcaaacgacttaggaacacggcaaaacgaaaaccaccgcaccgcaagagcaaaggactatggcttatggaaatcgattggactgaacagcagagctctctcctacctgatcgatatgagagtaatgtcgaattcgtttttaaacctaggttggaactggcgcaacccgttctgaatcacagttccaaccccaacccgattcaggttcgaccgaactacaatttgcttgacgtttgtttgtttatgtcttgatcaccgacccagttcctaaaaacgaaaacgacataagagtagaagagagtgaaagcagatgtaaatatagattagttaaaaatagatttgtatcggtatagtagatacagacaaattgattccggtacagtagtggccacgagcacggagtgcctaaaaaaaaacaccataccacagacaaacagacgtaacacttagaacaaatctcgatctaaatcatagtcacgaagacatgtacgcccaatgctaaaattagtgtgtctggccgacggaccaacagatggcggtagtgtgtaaacgtcaaacgcgaacaaaaacgatgcgagcgctgcgggtggcggattggccacctagcatatttttgtatcgaccgttaaaaaggtggtcgatggacaatggtgagagtgtgacgtctgtttgtctgtgaccgtactgagggatgaactcaaacttttgcacgatgacttggatgattgtttcattgattttgaataattttcagattttgaatagtttttagatttttccgcaaacatttcgtgagcgtccttcaaagaatataagattacgattctaatgacacattgatttaaaattttggtctccaatgctgaggaaatcagtcatgttttttcagtgtgttttttgaaaaatgtcacaatttaagtaaaaatttagtaaacaaaattaaaaaaaatgtttttgtacgaaataagaaaaactcattggctttcggatgcgccattaagaatttcaattggagttgtaatcacagagatatggacaaaacacttttgtgttttaaggggtgatcccaaacttttgcacgatagtataactgctaggtgggatgtttttgtaaaaatacctacgaagtaagaaaaactcattggctttcggatgcgccattaagaatttcaattggagttgtaatcacagagatatggacaaaacacttttgtgttttaaggggtgatcccaaacttttgcacgatagtataactgctaggtgggttgtttacaaaatggatctatagatgcgcttcaatttactaagaaacttctccgaataatcgttataattattaaaatcaacgctttagatgctattcaaaaagcgcataaaatccacagaataaaccattgtttgctgccttcctacacctagtaatcctcattcattatccgttataggtcatcgccggaaatgtagtaacgcgacaacaggctaaaaccttgatagatgctggatgtgacgcacttcgtgtcggtatgggatccggttccatctgcattacgcaagaggttatggcatgtggatgccctcaagccactgctgtgtatcaagtcagcagaatagctcgggaatttggtgttcctgttatcgctgatggaggaattcaatcaattgggcacatcatgaaggctctttccttgggagcatctagtgtcatgatgggatcacttctcgcaggtacatcagaagcacctggtgaatatttcttcagcgatggcgtacgtctcaagaaatatcgcggaatgggcagtctagaagcgatggagcggaaagatgcgaaaggagctgctggtgcacgttattttcatactgatatggacaaattgcgtgtagctcagggagttagtggtagcatagttgacaaaggatctgttctacgattcttgccatatcttcaatgcggtttacaacacagctgtcaagacattggcaccaaatctttacaaaatttgaagtatgttttaaaatttagatttcgttatctaatactaaaatatgtctttatttctctttcaggaaaatgatttatagtggggagctacgttttatgagacgtactcattcggcgcaagctgaaggcaatgtccacagcttattttcctacgagaagagactgttctgaaagccagttaaacgatgagtctgaagagatacgaatcatgtttttttctatatcgtttagttaatatatcatgcagaatcgatgtgtcaaataattatgttaaaattattccgtttaaatagcgatatttccaggatttttttaagcgtaaaattacattatttaggtataaaattgacaggaaataatctacttaaatttaagacgcttggcttcaaaatctctgaccaaccattttcaaagtattggaattataattctgaaaagcaaaactattagttagacatgagcattaaggaagtaacagttcatagtaattttttataattttattgtgtatcaaataaaacaatgtgatccaaatgttagcactttattccaatcttctgacagaaaatcccttcaacaaaaagcaatggatcaccttcctcgctcatgttcacagcagcacaactagtccacgaacgtacgatgctgccatctggaaaaagtttagtgaagaaacatagaaaattttgcctgacaacgtagaggaagtcaactttcaaatgcttatgggtaggcggggcatagtgagcatatcaaacgttcggtcacaaatagtagttcagtaagcaatattaatgtttttttgtcatacgcttcttgtcttccatgaccttccgcttacgaagcgaaagcgtaacctcgaggctacgagaccccccaagaaaggattttaaagaagattcaaaaattacgtccattattcggcatatttaaactttgaaagggtggtgctttatggagatgaattagccacgggctgaaaatctccctaataaagctaataataataataattcgcgtctacgaaggaaattaccacagttgaccctatgcgtgaagctccgattattttacatggcaaagcataggaagtcaattttcaaatgcttctaaacaactcaaaacactttttaattaaattctgttaagtgtacgggattagactattgatcaactatactgcccataatcgcataacagtcccatgtcgaattttgaccgatttgcgtttgttgcataaaccaactcaacatcgtcagaagatcgataaaaactgctaaaaaagtagcctttgttccaaacttgtacaaaaacaaaccccatttgtgttgtcccatcttgaaaatattc

SEQ ID NO: 64 - DNA, 6120 bp, Aedes aegypti
agtaattttgacagccgatccagtatgagcgaagtgtcacttttacttgcggaataattgagcggcacatttttccgtacggaaaagtgacagctccatttgatttgtacagcaggcgttacagacgttatgaaatcagctctacttctcagcagcgtacagctcaagtaattttggtataggaatcattccttgaccgttccttgtcctatccttttgcacagtacttatgatcagcgtaccgcccataacgctaaaattggctattttggacacccacccacccccttgtaacgctttttgtatgaatattattcagtttttgtatgggccgtaacatcgtttggacacccacccacctcctccagcgttatgaaatttgtgaatgggcccttacacagtacttacgaagtggataccaaccattacttgggatctttctaaatgcatttagattttctatttccgtgcaggtatctcgcctttttcaagtgttgatcgagattttttgcccgcgcgatgacatgctgccgcgtcgcggcgagggaatgtcaaacgccagcgctaccaacctttccggacgaaacttccaatttcattcttttccggtgcagaggtgtcaaaatttgtgaaattttcgctagttctatcagaaaactcaattttaccctgcaaaaagctctgaaacgtgcccagaaatggccaaaaagaaaggcgaaaactacgacagtgatgggggtgacgatcaggactacgacgaggagcccaatttcgatgatccggagggttttgtggacgacgtctctgacgaaggtaagctgctttgaggagccatgggatgggatgtcttcttattcttagcggcttgtcatcatgcataagcttgatttatagagggaaaagccgcttgaagtgtccacgtagcagaatgtgatatggttttttgaattgttccagaattgcttggtgattttctgaagcaaaaaccttgcgaatcggacggcgtagaaaatgttattgtcgtggataatattccggttgttggaccggcccgattccataagctgcaaggagtattggagaaactgttcaagacggccggaacgattgtcaacattcactaccccaaggatgatgaggagaacacccgaggttacgccttcattgagtttaagaatccggagatggccgaagaagccgtgaaggcattcaacaactatcgtctggacaagtcgcatacgttactggtaaatttgttttccgatttccaaaaatactcggacattcccaaagaatggagccctccggaaccgcagccctacaagatgcaaaacgatctttataacttcataactgaaccggacgcacaggatcagttctgtgtgatagccgaatcttcgccgggagcggtgcaggtccagttttggcaaaacacccaacccgaacccgtggaactgctgactcgtgatgtaagtactttgatcaccagtaatatgtgaaatggcattgcaacattttcaagatcatcgaatgtaaaatgttgtttatgacttcagattcggaaagtgcacacctaaactacacacacagagtgtaaggctgtaaattttgaacaaaagtttttttttttgttacaaaacttacaaacaaacaaaagttacaaacgggtgtgtacttttaggttctaagacagaatttggtttacattttgtgcgttgtgttatgaatgtaacatttatcttttcctctttttcagcgtttcacggaaacatacgtcaagtggtctcccctgggaacgtacatcgtgacgttccacaagcaaggtgtcgttatttggggtggttccaatttcaccaaaatcaacaaattcccgcactctggaactcaatatgtggacttttctccctgtgaacagtatttggtgacctacggtccaaacggccagaagatcatcatctgggacattcggaccggaacggaaaaacgttccttcatctcggacggcacttccaacatgtcgatgttccgttggtcccacgacgataaatacgtggcccggatgggtgacaatgcaattcatgtgtatgaaacgtcgactttctatcttttggataagaaatctattaaggtccaaggcattcgcaacttcagttggtctccaacggataacattattgcctactggatgtccgaagatctggaggctcccgctcgtgtgactctgttggaaatacctaggaaaaacgaaatccgtaataagaatttattcaacgtagctgattgtaagattcattggcaaaaatcaggagattacctctgtgtgaaggtcgatcgttactctaagtctaagaaagataagaaggacgccgatgttaagttccttggtatgttctacaactttgaaatcttccacatgcgagagaaggacattcccgtggactcggtagaggtaaaggagactatcctggcgtttgcttgggaaccagttggatctaagtttgccattatccatggcgatccagcgtccgcaaatgtcagcttctatgaggccaaaaagggacaagaacctacaatgttgaagaaattggagaaaaagatttgcagtcatctgttctggtccccgcgggggcagtttattgtgttggcaaacctccaggctggatcgtttgagtttgtggataccaacgactttaccatcatgaagagcggcgatcacttccgtgcttcggaggtggaatgggaccctaccggccgatatgtggtgactggaacctctggaaaggtgagtggtttgatttttgtgaacagttttcgaacggagagtccattagagattgtcaaaatgattgattctctcttagtttgcctccaagattaaacatgatttaatatttttttcaattgttagcaaactatgccataacaattgcacattaaatcagacaagtgattccagtcttgggtttagatatcgtttcataatagttgccaaacatcaagtggtatttctatagactagggtaactatgctataattcgcccattttatgacgcgaaattgtgggtttcgtggccgtgcggttagtgtcgtttggcattcaagcgcatcgtgtcatagagtgtgggttcgattcccgcttcagcaattggaacttttcatcaggaatggttctaggctgcaccactggagcatgcttgtccgttgtttagtgttaagttacagtctatgcagctaaattgctaaagacggtgtccgtgtcttatttttgaaatgaatatattgagttgacggtagttacgacccctagattaattttcgcccacctttggagcgaagaaaaacatctcagctatagcggtccatgatcggcaatgtatcgcaagttggaacaagcttaataaataaaggcagcgaacgaaagccccaaacagagagcgatgataataggactttacggaacaagttgcagtatgatgatttttacagaacgagtcgtaaatttatcctacgaggcttgccgagtaggataattacctacgacgagtgctgtaaaaatccagttctgcaacgagttacgtacaacattttttgcaatttcgtagaagaccacttgagggtatcagaaattaaatcggaatgcattcaccatcattttacaatttctgggaaattgttgtgttatgattcattaggcaattaaaaacagttgcgtaatgagaaagcgttgcgtaatgaatcattacagcactggtttcagttaggtaatggctattcccgcactgcatacttcagtgcaggaaagtaggctgctccatgacatattggcgtgatgaaaaacagcatattacgatgagaaattgcaaaaaatgaattttagcaatttctcatcgtaataggctgtttttcatcacgccaatctgccatgaaacggccggggctaccccgtttggtataaagtcatttggcataaaatcgtttggcataatggtcatttggcattatggacgtttggcataaaagaaaagaaattagaaatttaaacagtgctacataagagaagatctggtgatcaaaaaaagggaaaatcattgatgaaaatgttagtagttataatgccaacgaaggcaaaattgtcaatgaaaatgttagtagttacaatgcaaaccactagtttaacaacgtaatgagaaagaacagcctataaccaaaagaagggaaaatcacatatgagaatgttagcaatcgtaatgccaaatacacatcaactcagttttcaatgattatgccaaacgtccattatgccaaacggatttatgctaaatgactttatgtcaaatggcgtcccctcgaaacggcctactttcctgcactgatgtatgcagtgcgggaatagtcattacgcaactgaaatcagtgctgtaatgattcattacgcaacgctttcttattaagcatctgtttttagttgcgtaatgaatcattatacaaggcaagcctcgttggataaatttaccactcgagctgtaaaaatcattctgcaacttgtttcgtgaactactatttctcacttgtttaccattgcgggtttattgggagagttgcatacttgtctgtagccttaaaacaaattatgttaaaatttatcaatgctcaatgcagaactgaaaataaggtttactgagcgcgcgaattatagcgtcgttaccacaatacaatcgattcccaagaattggaactatcactgtcactgtcaacagttcactgagtaacaatgtattccattattaaacattatattttatcacttttaggtcaaggaggatcacggttatcacatttggtccttccaaggcaagatactgaagcgcgtcaatctgaagaacttcattcttttcctctggcgtcctcgtccgcccactctattgtcagacgaaaagcagaaagaaatacgcaaaaacctcaaaaagtactacgcacaattcgagagcaaggatcgcatccgcatgacccgtgcctcgaaggaattgttggaaaaacgtgccaaactgcgagagcagtttgtggaatatcgcaccaagcgtgtgagcgaatgggaggagcagaagtaccggcgtatgcagctgagaaacagtaggataagctatataacgtttagtccttttgcttacataatatttcttctccacagacatagataccgacacattggacgctgatccagataacgttgaagaagaaatagtagaaattctagtacgtgaagacaccaccctgctcgagtaatccgtataaggcatttcctgttcgacttctattgagaatttatctctacccagcggtaaaaaaatcagatagatcatcagcgctccatgataagcttaaaatcgtggccctgcaagacagatatatgagtgattattctctgtcttgtaagaagaaaaacatcttatttcatattgtagaatgcgactcttaatttacagtatgaaacataaatggttcttagcttattctaaagttatttgttttacttttatataatatttgaaattcctggtacattgcgctctgctctctggatgggatttggaatggggttcatatgagttagtcctccattttgatctaaaattccctgggcttggaattaaggcctcagacccttatctgtcctgaaccaccttacggtatttcatcagggaggggccagtgcatataacatttaacacatgtagcagaagtagcctaggtaaactgcttctcctctgcagggctattcttctccagcctctgcagccaactgttggtcggcgcgccataggagctgcaattctagattctagcataagagcccatttataaatttcatggtgggtgtcctcgtgatgttttttttcggtataaaccactgcgaccagttttctttgatcttttgtggtatacccgtgtcctttgtttagtgcatgtcgttctactccattactattgagaaataatgaagtagtcgttttttatacaaatgtcattctttaccattttgcatagagcctctttagaaaaaaataccgctatttataccttttggagaaaacagtttgtcaccattaaactcccaaaag

SEQ ID NO: 65 - DNA, 9532 bp, Aedes aegypti
gtgcccttgtttggcttcgttttataatcaccttaagctgagtgtacgccatccagtttgggggcggaatgacggtatcgaagtggattaaaaacaattataggagaacgtgtggaaaatacatatgaactgcgcagaatatatcagaccgatttagcattgctgcgcacttctaaaagcattttatttttattaaaatgtttgataatagtagaacgacaatgatcatcagttgattttccgctactgttttttttaaatcacaattgttatttctttccgtgcaagcgctcgggaaatgaatctggccatggtgcaacaaccgcgctacattcgatgaatcctatgcgacaaaaattgtcggcgctatccgtcaaattcgctcaccaaagctagtttggtgactttaacatcacagctcttgttttatcgttccgacaaacgtcaaaacaaatcagaaaaaaatattgacgtgtaagttttcctgatgggagatctgcggcggtcgttttccaaaaactcgtagatttcgaagtggaattgaagctttctggcgaagatattcaaatatttggctcaggctgcagctgacgacgattaatgaactttctgaaaagtggtctccaaacggtgctgggctcgcaagagcctggcaccctcccaacgggagccgaaaccgtaagttggatttgggatgggggcttatcagtatcagtgtacatattaattcaatgttgtcttatcactatcctaggtggaacgattggtcgagcgtgtcagctcatcgacgttgctggaagaccgacgggatgcttgccgagcactgagggccttgtcgaagaagtaccgtgtggaagtgggagttcaaggatttccggcactgctgcaagtcatggaaatggaccgtgccgatccggaaattatcggatactgtttagacacattgtgtcatgttacgtcaagggaaccgtttgaagaggaagcagacaaccccaacataacggttaatataggagagcaatttacggaaatattcatcaaatccagtgaaaacgtaacactggtgctgagctgtttggaggaatatgatttccgtgtgcgatggtcagcgattaaactgctgactgggctgttagcgaataagcctaaggaaattcaggaaattgttctggttagccctatgggagtgtcgaagctgatggatttactaattgatagtcgggaggtgataagaaacgatgctcttctactgctgattcaactgacaaaaggaaatgcaaacatccaaaagattgtagcgtttgaaaatgcatttgatcggttgtttgacgtcatcaaagaagaaggaagctcagatggtggaatcgttgttgaggattgcttgctcttgatgctgaatttgctgaagaacaacccgagtaatcagcaatttttcaaagaaggatcttacatacaaaggttggcaccgatgttcgtcattccaccagaacaagaagaaataggaatgactcctcagaagatttcaaatctgttgcgcatgcttcagatagtgagggctttggttagtcccagcaattcccaacaggtcgtttcatcgtgtcagaaagctatgcgaagttccggtcttttggaaggtctgtgcaacataatcatgggcagtggggtgtctccagatattctcaccgaaacgattaacacggtggcagaagtcatacgcggagatgtgaataatcaggagtatttcaactcggtaatggcgccaagtaatccaccacgaccagcgctcattgttctcctaatgtccatggttaacgagaagcagcccctaccgttgcgttgcgccgtattgtattgtttccaaagcttcttgtacaaaaatgaatctggtcagaatgcactcgttcaaacattactaccgtcgacagcgcaaatatcgtcactcacatctggccagttgttgtgcggaggtctcttcagtacagatcctctatccaattggttttcagccgtttcattagcacatgctctgctcgaaaatcctacgcagaaagaacaactgcttcgcgtactgttggccacatccgtgggaagcaccccagtgtcgcttcttcagcaatgtactcagcttttacagcaggccaactgtaaattccagagcaaagtcgctctactcatgcttttagctgtttggttaagccactgccaactcgctgttaaaacattcctatcgtctccaggaagtgtagcatatctgattgcgcagatagctgccaacgagcacgacgacaacgaatatctgattcaggggctttgtgcctttttgatgggaatttgcatccagtttaacgataacagcgtccagggtagcaaacgcgaagacctctgtcagttgctgatcaaacgcatcggactggaaacgttcagtgccaagttgggcgaagtgtccaagcatgagaactacagtcgttcggcgaagcagccacaaattaggatacgatccagcacggatctgctgctggattatgaattttgcaaattgttcaaggcactggaatgtaagtgttcagttcaatcaattcgaaccgattaaacataatattttaacaatacgtttcagccgttattaccattacggtaaatggctttggcagtggagctgacaacattaacgagctcacccttagtcaggaagcatcgggactggttggacagtataaggatatcatacgggatcaggatagccgattacaaaaacttcaagaacagatgaaaaactttgaagcggaaaatgtgcaattgaaggtatttaccaccggaaatgtttatttttatttttctagtgcgataacttttcacagcgacgatcataaaatcatttcaatcattccattaaattcttatatcaaatttgcttgtgttgggcaatggtaaagattaaaactattgttcataattcgataataaataaatcgcactctccctgcgcgcgtgtatagtatacatgagatggatggatatgtgatatgagaaggatctgcgtaatctgtggggatttgaattcgaaagcttagttggttaagcacttgtctagcatacaaagtcctttatccatctttaccacgcgtaatgagttaataaatttgatttgaaagttgttgatgttgttagaagataaccgcgcgaaaaagattgcgttttacacgaaaaatcaaattttgcactagtgagcgataattgggttgttgagtgatgaaaaaatcacagtttttaaaaagtttcatcgaaagagcacattttactaagtataacacgactttattgcgcttcaatatcacaattttgatattataaataattattaaagattttattccgtcgattcaataacattccaatttacacaatgacagctcgtcccgaagcaaaatttgccgaggggtgattcaaacgtgatttacatactaatttcaaacgtgtttggaaaaaaaaatccaagtcacagcattaatcgtagcaatagaagattgcaacgattttgcctaacattattatttattttatttgaaatttgtttcaatgtctcgacattagatattatatgtaaccccttaatactaccagggagggagtttcagaatcattttcaaaattttattttgaatcctctgcagagatttcttcctggtattacaacagctagtccatattgttacagctggcctgaaaatttgtttgaagatcaaaagcttgttcttaagacaaagttttgatttgctatttataaggggataaagacattgtacataaggactgttcattttataaagtggacaccttgtgcatgctgtatctttcttattaatcaatgaaatttcaatcggttttttgcacatcgttcgactagtattgtacaatgttgtgataataaaaattctccaaaataattaaatttcacacgaatatggaacaacgattagatcggtcgatttttttaggttatcaaaatcaatgattgtaagaaattggctggaaaattcgacaatttatattttttactttcgaaaaaggcttgttcttcgaaagcatcatcaatcagaaggctgatggaaaaaaatcaagttctttttgaaacaattattttacagatacaatatattttttagagaaaactattttaaatttggagggaactgatatatgtatttttttttggtttaaagtacgtcctgacggaagtcctagtagagtattaatatgaaaaataacttacgccttcatagagttacttagtaagtccccacgccacattcaaagcacaacagaaacacaattgttttattcttagaagacctatcaaagtacattgacaatcatcaaaattggtaacactgctgtaataaaatcgattttattttccacatattattttcataatatgttattctgagatcaccaattgaaaaattcggagaaaactgtttacaatttgctgtagatcgataaatatgcgtacatgattttaaaagtatgagactttttagtaaaactaccataaacagtaaaatttatacttaagactgtagtttcatctcacgatttagctttcgtttatactaatatagtttctttagtaatccaaactagttttgaacacgctttttacttttctcttttgctgggagtgaaaggatggtgtatcagcaaatttggccataaatgggtaaatcactaaagttacctaatgtcatagagtggtggaatataattgatatttttaaagctttatttttagtagaatagtaaaggatacaaacatacaatttgttcataaaaataaggatttttgttttgcgaaaaataatgttaaactttgacggacagctttttttaagagtttttggaaaaactatttagctcttcaaccaaaagcattttcaaagattttatattttcatagcattttagaataataggtcaacgatacacagaaaaccgattacgattttatcaataaataaaaaagatatagcataaacaaagtgtccactttataaaatgaacagtccttatttgttacatttggcttgaatgccctcaatgagatttttaaaaagttgggactagtaagtcctaaatttaaattgtgcgcgctttcaaattgcatagtaattttggagctttttcgcaattggttagtaatcatttgttttcctctttcaatgccggtattggcgtctgaggtttttttcaaaattttagataatttccaaaagggcttagagccagggtccaattgagtaattttatttcaaaatttttgtttcttaattgtgaaaaaggtttttttatttctttcggcaaatcctgccatataattttcatatcaggattgcgagtgcgttaaaattgccttctcctcacgtttttaagacggatcaagagtttaagatcatcgtctataatcacggattcaagattcttattttggaattgcaatgctcctggctttaacaatggaatttgttaaagtttcaagagcattgtcaatatcaagttttgtttgtaaataaatgttaacatcaagattggagtcaatatatgtttcatatatattccagtcggctcgaaaataattgaaagtggagctgataggattgagaatcgcttcatgggatatttgaaacgtaacagggacatgatcagaatcaaaatcagcatgagtaactaattggctacaaagatgactagagtcggttaagacctaataaatcgtcaatggatttctagaagaggaaaaacatgtagggctatcagggtattgaattgagaaatatcctgaagagcacttatcaaataaaattctgccgttggaattactttgagaattattccatgaccgatgtttggcattaaaatcaccaatgacaaaattgtttgacttattgcgagtaaatttttgcaagtctttttggagaaaattaacttgctgtccagagcactgaaaaggcaaataggcagctatgaaagtttatttaccaaactgtgtttcaacataaacacctaaagtttcaaaaactttagtttcaaatgacgaaaacagttgatgttttatacgctttatacgcctatggatgatgattacaactcccccacatgccccatcaagtcgatcattacgataaacaaaaaagttaggatcttttttaagtttggatccagtttttaaatatgttttagttataactgctacatggcttgctttagtcatagtggtggctttgaacattgcctcaaacattagattcaattgttcagttagaaaattaaaatcagaggcagacatatcacttgaagtgggtacattatctgatgattttccgtttcgatagaagaagaggcgaagtagatgttacctgtgacggcagggttttttttgccatttgatttgaaactattagaacgggtactcgtagtatggaaaggggaggagttcaaatgacctacgttatgcttatgctacgatatcggcaaaggattttccttgggtagctttgggtagatacattcgaaattaaaagattcgaacggctacccgacggattaaaattagtttgtgaatgagcatgattataatcttcctgatgggtatgattcctaatcaagcgatcgttaacctaaaaatgagcattgttcgaaactctaccatggaaactccggaccgttcatctgcctggcacgagcctcgacgactcgcctacgcgatttttagacttatgattgcaccgcaatttgcgcatatgaacttatcggtatcttccttcactggacagacgtccttggcgtgagaagaacctccgcaaatcatgcttttagcatccttgcggcaattttttgtaccatgaccccacttttggcaccggcggcactgagtggggttctggtaaattcctccaggtttctggaaatgttcccatgtcacacggacatcgaccataagtctagctttttctaaagctttcatattatttagatcttttttgttaaagtgaactaaataatattcttgagaaaacctttccgaacaatgccagattgggttctcttgttcatataatgattacttggaatgggtaaaatccaagtaaatcatttattccatttttgatctcttcaagtgacttatagtcacttgagagacctttcaagacgactttgaacaaacgttcggttttgtcgtcataagtaaaaaaaaaaatgtgcatcttctcttcatgatgtttgagaagaagttcgcgatctttgagagtttccggcaaaacgcgacagtctcctttctttgcgatttggaaggataccttgattcctctaatggagctcaagatctcctgcctaaaccccgctaattaagaacaactgatcacgacaggcggcactctttgtttcctcaattgaatcaaaaagcctgggctagagacttcatcgatttggtgtttgtaaaatttgtctagagtatcgaacagattgctcatttcgatgcaattatcaacattacccatttcacccttggaagaaagttcgtattccggagaaacgtcctttattcctttcttgccacgtttagctacagttttaaatctctatttttttggaaggaagttgtgaattcagagattcactcttccttttgtttgtgattgcaaccaccttctttttgccattaacgtccccactgggacagagccggcttctcagcttagtgttctaatgagcacttccacagttattaactgagagctttctttgctttgtggcaggtgcgatgatactctatgcccagggaagtcaaggaaatttccattacgaaaagatcctggaccgaccgggaatcgaaccggccgcggactataaccactaagaattgcaaccatgtttagtgaataaaaaagacgaaagaagacgagacctcctaagaggttctttctcaaaacggtgtccaagaaggattaccaccgctagctttcgccaacaggtccaacgaaaaatcgaaggcgcgggtccaaacaaggatcataaagggatcaatagtagaaaaaatagtactgaaaagtactgttttagtagcactgaaaagtaccgtttttaattttagcactgaaaagtactgttttattgctttaggttgttttttatagaaaaacttccaagagcagagagaaatcgtgtaaacacactaatatcaaactctaataatcattttcttctaggtacaacttgaacaagcgcacaacaccaacgctcagttgtcggatcagaacatattgcttaaggctcaactacaagcggcctcagatctgcagaaaagccaacaacaatctccattccatttacttcctactcaaggcgagaacgtaaaccaacaagtggaagcactcgaaagcaagctggcggcagtcaccatccaacagcaagatcagcaatcgagagctagctactttgaagcggaaaataggcgattgttgggcgaactggaacaactcaggcaacgggtaaccgaggcggaaaaatccgccgaagaaggtaaaagcgacctggaaaaattgcagaaggatcaggaagatttgatggaactgctaaccgatcaagagaacaaaatgagaagctatcggcagacgttgaaaaatctgggacacaaagttgacgacgacagtgaagaagacgaaccagataccgatggtaataagaacgtggaccttttgcaataagtatttctccaaacaaattgatagcttgttattccttgtttttttgcgtatacattaacatagaaatgttgcatgttcgaccttggtagccacattgataaatcaacaatatgcagaacagaaaacttgcatatttaccatccgcttattaaaataaagtatttcaacccaagtttattctattcaataacctgattgagaaaatccattttgttacaggctttcttttcctctacctcgattaacgtttgcttcaaaatattaaaacttaatgattatttcttacctcatcattttgatcaagggaaatgtcggataagtattgcagacgcctcaagcgcgctggttgataactggcatgattacattgagcatctgtaaaaatattcaacacaagaacttcaaatattagcttaattcttaaacttttatattcatcaaacagaatcttacctttgttttggtattgaactgggcacttatgcgggacccatcaatttggtaatccacaaatgcatccaacaggtagcctttctttctggcttccagcaggattcgatcctcgccaatatccaaggtgatttctttcgccgaagtctgcaaagttgatcgtttgtaagtgaaaaacgatagtcgtaatttaaacaaatctcgtaacttacgcattccggcaagtagaactctccaatcagtgtcttcactctaccacttgcaggctcacggaacaatcgacaatcaggtttcttggaagcagcttgcgagatggcaac

SEQ ID NO: 66 - DNA, 15726 bp, Aedes aegypti
acgactcgtctcgactcacacgccgcgcacaataagcatggcatgaagagactagggcactgggttgttcggttgacgcctaccaaaacagtactgaaaagtgctacttttcagcaccgaaaagagtgctgaaaagtagcacttttcagcactgttttatttggtaggaaaagtaggccgttatgttgatcaacttctcaatgaaaagttgattgatttgcaacggaattgcaaaaaattgtttttatgatatctgaaaaggaggcttgttattgattattgttttaaagaacaaggcctttattaaatgaatataatccgttgcgaactccactttactcattgtgaatgttaaataaaggtgaatgtcgttcatagcttaaccaatgtttcacgcaaaaatgggcagaggttgtgtataatgatcgtttatgcaagaaattccttaaaaaaaattttgatcaaaatcattgctacctatagaaatgattaaatgagtagagcccttttaccccatcagtgcgtattgagctatgttcccctacaatatgggctcaaagacgttttgtggaatctcttttgcttcgtagtcgcgaattcaactttcttcgactttttcccaaaaacgaccggaaagggtgtcccggcggcggcctaaacccagcttgatcgttttatttgttttgaaacgaaacgtcaaaatcaaacaaaaaatccatccacctggcccgacggctgacgcgatgatgattctccggactgactgatgatggtttttgttgttgctttttagtggattcacaactcgtcgtttgtagagcagcgttaatgtcgcattttgtcggcacttttttacgcaggcagagtggaataatcaaccaggaatcaactataatttagttagctagtgaaacctttttttgggtatattagaggaggagatccttgaagtggagccgtgtatggcaggggtagtgttgtccggtgttcgcgattcgagggtacccgcaaaagacagtggagcaaagtgtgaggttcgagtggaacataatcgcgcagggatagtttaaagcccgggccgtgaaatgtccgatcacggttgtgctcactttgcggcgtttgtcaaggagtacggactggaatcgttcagcgtggtgcacgcgtatttcagtgcctgcatcaacaaggaagcccggcgtcggaaggctctgtcctgcttgtgttacaaatgtggtggttccggtccgcagttgtattcgtgcctgcactgtatctatttcggatgcaagggggctcacattaacgaccactgtaagcagaccaagcattacatcgtgctggaactgtgctacgggatgatctactgctatcagtgcaaggacttcacgtatgatagcgaatgccaagcaatagccgagaagcacatccggaaggaggccaaaagtctgaacaaaagcctatcctggagaccgtggtcaccttccaagctggagattgatttgctgctgaagaatcccaagcgtagacatgtgaccgcttttaccagtattggactgcgaggattgctgaatctgggatcgacctgcttcatgaactgtattgtccaagctctgattcatacgcctctactcagagactacttcctttccgagaggcacgaatgtacaacgaagactgctgccaaatgtctcgtttgtgaggtgtccagactgttccaggagttctactccggcgcaagaggtcctttgtccttgcatagattgttgcatttaatatggaaccatgcgcgtcatctcgccggatatgagcagcaggatgctcacgagttcttcattgccacactggacgtcctgcatcgccactgtaagatatcgatgaacgaaattgccgcagcttcggcggacaaatccaaacagcaacagttccaacagccggacaatccaacccactgcaactgcatcatcgatcagatctttaccggtggccttcagagcgacgtggtttgtcaggcttgcaacggagtctccacgaccatcgatcccttctgggacatttcgctcgacttgggcgaagcgcagaaccagggctacggtggcccgccgaaatcgctcatagactgcttggaacggttcacccgggccgaacatctgggttccagtgcgaagatcaaatgttccagctgcaaaagctaccaggaatcaacgaaacaactgtccatgcgaacactgccaatcgtcgccagcttccacctgaagcggttcgaacattctagtctggtaaggatatcctatatattttgggctggtagaggagagtcattatgaagtctcttttttgaaggcatttcaactaaggtcacttttttgtacaatgtgtaaatattctcaactattttttgcaaacatttagagaaaattataaatcagtatttttttgttaggttagactaagtttcaaattatatcataccagagtaattaaatggcagtctggaacaattattttaagcattttttttttttgaaaaatcacttaaaaaatttcagggaggaaatttattagataataatttatgtatgtgcccagagatttaaatattacttcgattgtttcacatgtaattccgctaaagattttcataaacaatccctcaatgaattttctttcggatacctcaagaacctcttttaatttttttcaataatgaccacagaacacagaaatcatcttggagatcatcaaaaattcctccaaactttctttcatgataaatcaggagataatcaggaactcctccttcagtatttgatcaagttattcttttatcgctatccctaggacatcttccaagattcccgtttagaacatcttcaaaaattcaaccgatatcttcttcaatagatatctccaggaatttcccaagtaattgttttttaggatttcttctagatttctacttttttaaaagataaattcaggaattactcctgaggctgctcctaagatgtcttcataatttttttcagtcaacctttgcgatgtttatcaaggaagtattcaataatatctccagggaaatgtcaagaacatttttcagaaactaagataaattcttgaaaaaaaaaatcgtgttgtattcttaaagaaaaatctaaagacgctagatccctagacgaaacttgtgtaaactctcaagtcatccgagatgaacaagattttttaagcaactcctgaacacatgtggaagatttcctagatggattgatgtgataattgataggggaaactggtccaattcggaccatcaagcatttctcaatactggtgctactgtaaagatcgtgtgtatggtttttctaccgaccgtctggcaaggatctaacacaaaatatgacacctttcagttaattcgtttgatttttatattagtttgttgttttgaagttctctagtgtgttatcgattggcattatttctaagcttctgtaattgacaataattctccaatttttatgcgttattttaaaatcgaatcccccaaggccaagcttttatctgaccatatggttatgatatgtataaggactgttcattttataaagtggacaccttgtgcatgctgtatcttttttatttatcaatgaaatttcaatttgttttctgtatatcgttcgactagtattgtacaatggtgttataataaaatatcctcgaaaataaatcaatttcacatgaatatggatcaacgtttggaacggtcgatttttagaggttatcaaaatcaattattgctagaaattggctggaaaattcgaaaatctatattttttattttcagaaaagctttttcttcgaaagcatcatcaatcagaagcctgaaggaaaaaatctagttatttttggagcaacaattctacagatataataaaaacatttgcttcctatattttttagagaaaaatattttaaatttgaggggagcagatatgagtagaattttttggttaaaagtacgtcctgacgaaagagctaaaatagtaatcatacagaggcgtcgcgtgacctaattattcacctgtgcaccgcttacttaactttatctctttttttgtcatgtcatgctaagtttttcgtaagaagagcgtaatcatcattcaggattatgattttttttcacttagtcattcaatagaatcaaaacattgcatattttaattactaatcgggggacggacctggtgtagtggttagaacacacgcctctcacgccgaggacctgggatcgaatcccatccccgagatagtcactaaaaaattcagtgacgatttccttcggaagggaagtaaagccgttggtcccgagatgaactagcccagggctaaaaatctcgttaataaagatagaaaaaaaaaatactaatcgggctgttcagttaaatttatcaatagaattgtatatgggtattcagcttttatatattctgaatctacgttaaaaattgaaacacaactcgaagtttcaacatttaaggtgccctggaactatctgaaattagtatggaaatcttttttgatctccttggtaaattttactacggtacgagctgtcgggatgagatgtcattaagcctgaaatttcaaatttgagattgaaatctgtaaatggtcaatcatttacaatatagaaattaagatatcgagcataatgaaatcgttaaaaaaaatgtccgctttcgattaattataaaaactggtaaatttgtcattactgaactacccaatttaatcaacacgtattgtatgtgattttaaaatcagacatcattaaatgataaattctgaggaagtattgcaatttcaacagcactggtttctaactaatcttgtaattcaaaactgtgactaatggtcaccaaatctttacatagaaataaaccaacagttagtatcgtgtaaaatactcgatttttattgaacgtacactaaatgacccagcacaaatttcgtagagcaaagtcgctcagaaataacgcgatttgtgcaaaactggagcttccagttgcacagaaagcctctcattgttagaaaggtcgttttgaaaagtttttcgtgattttcattcggattgcaacacttcactaagctgaaccagttcggagtcctcgcctggaaagtaaatgaaccaccctaatgaaatatcacatataatatgttttcagtggccaacaatgatataggatatgtttcaataccattgccttgaatttctcagcaattgaattcaaatcgttcatttcaaattaaattcactcccccaactcaaaaatttactaagtcccaaaaggtcgatttaaaaaaaaaattgttttccaaataacaccagatcttgacgtttcatgcatttctaagacatctgacatcaaaaaaaaaattcgatttcggaaatttcatgtacttgtacccttgggagatttttcatgggtcaaaaaaaccaaactttgaccgctttgggggtccacttaatgaggtccgattgagctcaaattttgcatggggacttttttcgaggagacaaaacttttgagcactaccattttttgaaattcgaaaaatcgattttcattggcaccctaatgctctcatttcgcttatgcgattttccctcttcaagggatcccactcctatttcctcccatctttcccttcccatcggatagatgatgaaataggctcaaatatggcgatggcacaaatctcccaactggggggaatgtgacattggagacggccttctgatacctgatgattattctttcgaaatttgtatgaactgtaacatcctagaaacacccacccacccttttcagcgtaaaatggctttaatctttagataccgttttggttataataaagactttggagacctttttttttaaaaaaaaaaatacacattttagagatttgctttcaaacagtaaccaagtatctaaaaagagatctactaccagtcctgaagtctcaataaagcctgtctttaattgaagatctcttttaagctgaagatgcatcaaagttaaaccacgaattttccagagcacaaatctaaagaatcatacaaccttttgagcgagatcaaattttcatcacaaacagttgtctggttctatgtactttgtgcttttgaaaaattgatgtttggcttcgatgtctatttttcaaagcgacatggccactttttatgtctattttatgtctgcagtaaaacctggtgtagaattttcgagacgattgtatagttcagaaatttgttcatagattaaaaaaagcctcaggaataaagcataaatcggagtgttcaagttgatacgtaagtcaattaaagtgaaaacatcatcgaaaactaagatttaagaaaaccacgtttgaaaattagaactgacgtaacttttagctcgaaagacttgaggtttttcagtgaaatgaaaatcgttgtcatgtgatgtcaaatctgatacttttagaattctttttgaatgggttacaatcattaatggatatattttcggtagggcaatagaaattttcatatatatttatttatctcccgacttttgcatgatgttcattttaccaccaacagctgttcattttacccacatagtgcaggtaaaatgaacatttattacggttgctaagaaaattttccgttttgcggtagccgccgagttctaccgcagctgtcatagttctaccgcaggcttcgaaatcattctatcattgaagcaaacaattcaatcatagtatgcttgaaagagaaagcgctatgaaaaacaccaacaaacaacaatcatcaagacggtatccaaggtatcattgaagcctactgatgatttaccagtgcaaatctgtgatgtgacagctgcggtagctttccgttgaattgtaaaacggaaagttttctctgaaatagcaatacatagtttttttgctagcgccaaaaatatgtgaaaattcagctattttagtctgaattcatgtcgttgctatagatgacatccctattttggatgttgtgggatagaactatacaaattcctcgtttttctataagaaacacgatgatttccttaaggtgtttttttccaccccttcccctaaatgcagagacacctccagattattttatccagattctttaagtaattattgcagtgatttctcaaggagtgcttagatgaattattccagaatttgcttcagaagatcctccgctgatccttatagtagaacatcttccaaattccaattttttagtaattcttccagttgttttcatacggattgctacgaggattcctacatgaattcccccctcctagcctttcttaaaggttccgaagtcccttcaaagcaccttgcacaagttctctcttgcaagagtttctcatatatctcaccaagtgtgtcatcagtgattacatgactttaagacttcttttagaaaaacattgcagactaaatctcagacctataagaattaaaaaaaaaatgttgcgaattccctggagaacttcttggtaagttttaaagtgactaaattctctgaggacttcatttggaaattttagaaagaatctgttaaagaatttctgaaggaatctctgaaatgatttctgaagctaggaaatttctgattgaaacacaaaagaaaatctgaacaaaaattgtttattgagcaacctaactcggtagatgctatatatatgatacattccgggatttgatgaaaaatattacagtcaactctccatcagaggcgtcgcgtgatctaattatcaacctgtgcacttctaattttatgcactaatgtacttcattttatgtttgtcattactaggtaccttgggttcaaacattttttttaagtaaataaactagtggttactaacaatcgttttcaaatacaattttcttctgatctttctgatgattcaaaaaatttaagaatacatatgctaatcgagttgcttagtttaatttaaattcaacaaaaaaatttcaattttaacgattagtcatcattatggtaaaattgtaaaattgagtatgaaaataattctaggtatgcgggtgacgatttataatgtactggattctagcaaatattgctgtaatcatagcttatatatctttacatagaattaaaagatcgatagcatcgtgtactgagtgcacacatcatgaaacatgctcgcttgtaaaacttgtagtgagttgcgtcaagatgctggcgatgatggagggtatgaccgcttttgagttaatttttaggttgtcatctgattgactatcacaagtaccaccgcactaatactgtatgttaaaagcgaggttcatgtaaggtttacatcatcagaagtcgaactattttataacgttcaaaaatgctttagatctcttatgaacgtataccaattttaaatttgaaataatgttactaatgtgttctttagtattttatgtatccttgtagatttcatatgtttaggtcaaaatattttttttattgagtttattcgtgaacaacaaaattcatttggttattaccttcttgtaggtacctttattcgaatttagcttattctattcatgttttattattcaagttgtttaaaatacagatttactaatcagttttgagtagaagaaattggtgttgggctggaagcaggtctttttcgccgaggaaaaacatcaagaaatcttgtccaggaactcctacacggatctctctagaattttttgtagaggttccaataccagttctcccagattacatgttttttttcttttgcaaatactatactaggggttccttcagatatcttttcactaatccttcaaccgaattctctagttgttactctatgagatctcccatctttgaagatgttctcaacggaaaccttgtagaaaatcgatggatgaatcatcggataaaatcttagagaattagattttgaaaataaataaaagaatctgtgaagaaattcctgatggaatctctaaggtatttttttggttttccttggaaaaattcaggttaatttcttgaggcatcttcaaaattttttagaggaattctacttgcaataataacttaacgaactcctggtgaagtcttcggaattatctctgaatttttgaaaaaaaacttgaattttcatgaaacccattgacaaaatcatgaaagaaatacatacaatattacgaaaagcaatactgtcgtataaatataatatataatgaataaattgcattcggcggcatgaactcgcgcgtaaacgacttccgaatggccgtgtcggattcctgcttcgacattatcgtcctgacagaaacttggcttgactcgcgaacgctatctagtcaggtgttcggaactgattacgaagtgtttcgctgtgatcgtaatcctaacaacagcaggaagctcacgggaggcggcgtactcgtagctgtccgttccagattgaaggcgaagttaatcgaaaaagaatcgtggaaatgtctggaaaacttgttccatcaagcttggcgatcgatctcttttattgtgcacgctctacactgctcctgatcgagttcgtgataatgagctcatagaggcgcactgtgactcagtcatcactgcaatggaatccgccaatcccgtcgatgatttttcatcttgggcgacttcaatctaccaggcatttcgtggatatcatctcaaaacggcttcctttatccagaccctgtacactcttctttgcatgattgtgcagtcagtcttctagacagttacagcgcagccacactagcacaaatcaaccacgtggtcaacgaaaataatcgtagcctggatctttgttttgtttctgtgcaagaccaagctccattcattggaccggcactctgtgagcttgtaaaagcagtaccgcaccaccctgcgttgattattgccgttgataataaccaggtccatgatttcgacaactgtcctgctggtgtgtcatatgacttttctaaggcggatcaccgtagcatagcagccgtattggccgacatcaactgggataacgttctcgatctcagagacattaatacttctgcgcaaactttttctcacatcttgacatacgtcatagagagacacgtgccgaagaaagttctccatcatgactcccgccctccatggcaaactagcgaattgcaaaaattgaaatcagtcaagagagcagctctaaggaggtatacaaagtatcagacaccttcattgcgaagctactacctgagagtcaactacgagtaccaacgtgtcagtcgtcactgctttttgcagtaccagcgaagcatggaactgaaatttaaacgcaaaccaaaatcgttctggaagtacgtaaatgagcagcgcaaagaatcgggctttccttcttcgatggaatggaatggcaaatcctcgtcctgcttacaggaaatctgtcagttcttcgctagcaaatttgccagcgtattcagcgggaaaagtataagcaatgatcaggacatttgtgcagccaacaatgttcccatgaatggccaagctttggggagtcttgatttggatatttagatttgggggtcttgatttggatatttggcttcgaagttgaaatcgtccaaccatcctggaccagatggagttccctcagcatttctcaaagagcatatcggaaatttgcttgcaccgctctgctgtttattccgactatctctttcttcaggaatttttccttcctgttggaaagtggcaaacatgttcccggtgcataaaaaaggaaggaaacgcgacgtagataattaccgtggaattacgtccttgagtgctgtgtcgaagttattcgagtttgttgtaatggaacctatgctctctcactgcaagcacctgctggattccgatcaacacggattcaccgccggccgacaaacaaccactagcctactgtgcttcaccactttcattaccgacagtatgatcgctcgagtgcagactgacgctatggaccagtgcacgagttcactatttgacgtttgagcgttgcccatgttatttatgttgttcatggtaacgagtgaaatatggcaccgctcaaacgtcaaaattcgtgaactcgtgcattgctccatatatactgacctgtcggccgcttttgacaagttgaatcacgatattgctattgccaaacttgacagatttggcgtctgcggtaatcttctgagttggttcggctcttacctaaccaatcgtcagctaagagttgtgataggcgattgcagttctgacagttttcacgctacatccggtataaggtaccccggggcaagtgagaatccggggtaagtggggcgtttcgtcatagctcaactaggaaaagtttttcatgggggtattctcctagaaagttgaagatacaatgacaaggaatgtatttagtactaaagatattgttatttttattaccatgtggttcatgtaacagttgttagttcagcgccattttcaacttgcatgacaaattgtgacacgtttcacgtcttgcattgacttgcaaaaaataattgtgttttaaatcgaatttccatcagtaagctataacttttagtattattacaagctgctaacgataaaccagtattttgttttcatttcatatgaaattttcgatggtctatcttaccccaaaatatatttgtacctggggtaagtgggacctatcaaaacaaaaaccagaatcaaaacttttcgtacacgtttcatacattttgctagagagtagcactaaaacattcaaacgaatgatttttatcaaaaaagatcaacatcaaattacgtaattgcataagagggagaagaaaagtgttattattctttattttttaattatttttttatttttgaaatacgacttcaaaattgaacaaacacacagctgaaatttgaaatgcatcatgagaacgattacttttctatgttatttgaactttatttgttatttctaccaaattacaacaattccatcccataaggtggttttctgccatgcatataaataataacaaaacatatttataatttcgtcaattattgattgtttatgtgctatattttaattaacaacttataaataatatattttgaacatgttcaattcctctttacgcttttattgagaaaatgttcagttaatattaaatatgaggtgacatactattaaataaagggtttcttcctataacgtaacgtattttatggttgatcccttatgtacatcaaatatgtacttaaaattaaaaatctataacttatcaatcctattattgtaatggttgacttactgatgtggattgacgcatgaaactggatgtgtcccacttgccccgcttaacgtggtaactgcgtctattggctcattctaaaactttcttccaaggttttcacactttcgaaattattcaattagtttcatgcacacaccagcaaatatgttgccaaaacgtgattgtgttgttggatttgaaaaatattgacatttgaaaattttattgaacaatttgtttgaactatcgtttttttcgttcccacttgccccgcggtaccttaccacaaggaagccacctgggaccactgatttttctgctttacttcaacgacgttcatctcgttatcaaaggcccccgcttatcgtatgcagacgacctgaaaatatttttacggatatgctctgttgccgactgtttatacctatatcaacaacttgatcgtttcgccagttggtgctcgctgaatggaatggtggttaaccctaccaagtgctccatcatcacgttttctaaaaaaaagtaaccaatcacgttcgattatagtttttttggcacgaaaattgaacgtgtgaatcacatcaaggatttgggcgtgttccttgattcacagttaacgtataaacagcatatctcgtataccgtcagtaaagcgtcaacgactttgggattcatctttagaatcgccaagaatttctccgacatttactgtctaaaattgctatattgttctctcgtgcgttccacgttggaatatggttccgctgtttggagtcctatttataataatggcgcagaaaaaatcgaatctgttcaacgccgatttctccgattcgcactccgtaagctaacttggagagatccattccgcttgccgagctatgagagtcgatgccgattgatagacttggacctcctccggaacagaagggatacaatcagagctttaactattgcagacgttttactgggtcgtatcgactgtgggacaatcctggagcgagtccatttaaatgcccgtccacgatccctccggaacagcgtcatgcagagattgcctctaactcgaacaaactacggacttcacggagcacttagtgggttgcagcgagtgttcaataaagtcgcatcattgttcgatttcaataccacccgagagatgcttcgccgaaggttttcatcattttttgacgaacgaagagtttagtttattctaaatattcttgattgcttgcattgattctaattattcgtaaaagttcacccatacatatgtttgtcgagttttgtggggcccgggggttaacactttcattagtgttttttccttcttttaatcaaaggctgttctttctagttatattagttatatttcacagcggttattaggtaatgcaaattatcctgatctaacaactaacaatccattcgacctgaaaattcatccggcgacttctaggtgctcctgacgtatccctgataataacccattagacctcacgattcaatagaactatcggccattttcggcctaacgacattcggcctaacgggatggaacccacatatttgctaccagccttgccaaatccgcgttgtagcgttcaccactaacttgtttacttccttcctttcagatcgacaaaaagatctcgacctttatctcattcccgtcggagttggacatgactccgttcatgtcgaaaaagaagtctgaacagcagtcgcccggaacgtcgtccggttccgcgtcttcgtcgaaatcaaagtcttcggatcggaagcacgccgctggaagtagcggcacaagtggcaccggtggcagtgaagatgaccacaaccgatcgcaccacgataccagtgacttccgctactcgttgtacgcggtgataaaccacgtgggaacgttggacgccggccactacacggcctacgttcggcaccagaaggacatatgggtaaaatgtgacgaccacattataacgactgccacactcaagcaggtgctagatagcgaagggtatggacatggtcgagataatcgtaaccagatctgaaatttatgatccctcattcttttagctaccttttgttttaccataagaagatcctagagtacgagtaagtatagtgagcaggacgaaatgctctgcacagtgagtggccaagccaacagagacgacagagaagacgagaacggtgtgagtcaaatacagggtcgtaggactagttgctagcgccggctctgtatgagattctgttccagaacaaactctcctaaaaaaacaacctattttagtattagattgtatcgataattgtggaataaaattgacttttgtttttaaaagcaaagcgcttgagttaaattatttatcaggaatgattgagaaagatttgttttcggctttgcatccaaatataactataaatgaagctacaaaaaagaaaacaaagttacttcgaaagaaataaagcgaatttttatatactttcattaaaatagcgacatctaataaaaaaactgctaccttctgtattatgacgaatggatacaaggtgattgaaatgtggaaacagtatcatgaatgatgaacatctaaatggtgcagaagctgttgcatataatcatagaaggtcagtgcagcagcaggtaacaatagaaatcaaccaactcccaacagctcaagaacaaggccgtatggcaccagagtagagatggtcgggtttcacatttttcaaacccgaacccgacttattttattcctgcaaacccggacccgacccgaacccgaaaaattttcgctgttcaaacccgaacccgacccgaaacccaaaaaagttttgtaagaaaaactggttttaaaacccgaatagaatatgagctcaaaaagataataaattcatcgtttcagatgcatatggaagctttccgattgttactttgtgaacaattatccccaaaccagaccttttttaagcccgaacccgatatttttttaaccttcaaacccgacccgaaaatatagtaagaatgtggcaaggcaaatatatcatgtcagaggcgcgtccacgttcgcaaccatgggtaggacaagtgttggcaaatatttttgcacagtgaagcaaagaaaaatttaaaccctgtactggaaaatgaaagttactgtatttgaggagctcaaacgcaaagagtgtaagtgacattttgatcggttttgagttgagtcaaggaaatttttctgttattaagcgttctaacgaaatgtttaggtgattttttcgctcaatagaaaaaaagcaacacaattcatagaagaccgtctg

SEQ ID NO: 67 - DNA, 84017 bp, Aedes aegypti
tatgccggtccccccataaacttcgaaatatcttcaaatccagatcacaaattatcaataccgacacagcttctaaaaatagaagagtttttgttttgggaacttgtgaatgtttcaaaaaaatcaagatataaaaaagctatcgcgacttgaatattatttgtggtaagaaaaattaagctgccgatagagaggttaaagaaaaagtctacattagactctgctttccagctctctgttatctatttgttcgaatgaaatttatagacatcagaaatttgtaattcacgattacgttatatcggcgctatcctgtatcaagagtgacaaaaccaattgaatgaagtttgtcgtatttgtacgattttatgatgaacaaaacggtaaactagaatccggcgcagcgtcatgtgtgggttgttcggatcaaactgagagagacgaaccgtataatcaagacaaatcactgcataattctgtgataatgtatcaacatttgcgttcacatatgtgtgacagctagcagaagtgaacgagagcagcaaaaggcaaaagttaatgagcttaatgcattctattttatcttcgtttcttccacagatgcctcggactgaagtcgcctttcatccagttccggtcggagttcgaggtgctctcgaataacagcatatcattgaacctcacagaaatacgacacaagctgaaaagtgtacaaaatttggaccacttcattcgtccagtggataatggacgaaaggatgatggcaagagacagcttctctctggttctggacaatcttcatcgactggtgtggtcaatacgcttcctagcaacatgacgattacatttctgaccacaacaccaccgtcgttcgtgaatcatttcgaaataacgacagagaatggctattcgaacgatatagacgtagagagaaaaagctttagcgaacatatgatatctgatgatagcagtaaaaaggaaagaaaatacatcataccactagcactgaagacttcctccaatgagaaggaaaaaacgtcgtccgtatttcatggatcatcgaccaatattgacgacctgaaacgccatattttgatgctccaaaatctgactcagtctgataaaaactttcagagtaaatttgtggttttcccttcgttacagaagaatggaacggaatcatcaaccatcactgcagtaccagccacgacaagtgttcctacgacaactacaacttttcgtcctcctttccatcaaatgccagtgctgcaaattagggaagatcaaagtgcggttaaagcgttccctgaaaagttcacacgactgcgtccaacgatcaatatgcctcgacaaatcctgcccaactctcaggatatattgtccgataataaagacgacatgttcaaaatggaaaaaattacaatagtcccgcaggtttttttacaaaatgaccaaactccggattccacgacagatgaagaaaataataacaataattacggccacaataacgacagaaagaaagagatcaaaggaaatgacggagagagtatcaagaataaaaaaccttcgccgcccgtccatcatggtaccggtctcagcagagaagggacagcagaagagataagtaataaatctcctctgtcggccacaatactaccaccagcttggaaactcggacgctacaacaaaaccacatcggcggcattggcgtctagcgcgatacaaacagccactgccgtcaaagatgctgaatttgataatgcctctacacgtggcaccagcattgtacgaggaaacggcaagaagcggaatcggaaaaataaaaagccatccgaacaaccaattaactccaatccggttcatgatatccacgttggtgtaacgaaccaaagctcaaacaagaccaaagccggcagaaaaggtgctaaacggcttcaaagacttcagcagaaagcatttatgttgcagcaattaacatccagctcatcgactgttgcgtctcctcctgcaacgactgctgccagcttcaatcgaaaactttcgcgtttccgccgagccgaacgaatcacgaacaaagctatgcgatctcagctggagcatacttacgccaaagatagtacaatagttccaatatacggatcaattaacgggtccagtgtaagtgccataaccggtctaggtagtagaagtgttagtgataaaaataccacagttttttcaattgatagcaacaatagtaatggtggcaatcacagtgaaaaagatataatcaatctaaacccggacctatgctacaaagtgaccggcttaagtggaggacaacagaaactctgcgctcaacatacaagcgtcatgccggccataagccgcggagcaagagccgctattcaggtaatttacaaaatatgttattagaaaactataatggacaagtttaacactcaatctatcttatttgactctacaaaaatcgattagggtatccccgagcaagtgctgaaaaaaatgtagttaaggcaaattgttccatataatttcaaaatacaaataaacttacagcagcatattagctgatgtttgcacgaatgagaagtaatggttacacatcattgaaaactttagaagaaaatctgaaaaaatgggttattattcgcagttacctcgctctgtcaggcaagtgagaccaattcaatttaaatatattaaaatcatcgtcaaaatattgattgttgctattatacggaatcatacataaagcattggacgaaaaccatttcaagcatacaaatttaaaaccacacgcttgtgttgaaaaaagttaagcaatcatataaagcaaaaatataacagctgaaaaagaaatcaacaatccaacagtaaatggaaaatgaaacatcaagttctttatgtacatcaatatttgctacaacaataacagctttagcttttcaattagctatattatctaaaagtgatatttaaatattttttcaactagtgagaattcttaaacgaatttgctcaaaacccatcgaatatttatgtttcgaaaataagaaaaaatacttaaaaggaggagcaaaaaggatttgcagaaacaaattcttctgaattcatgagaatgtgttcaactttctgaatattttttttatcttttttcaataaatagctaaaaagtttgtacaaactgtgtgcagctacttagctaagaaattcaattaggcgctgtgatcatcttttaatttaatgttaaatcttttatcttatttctattccttagtcaattttatctgcgcaagttttcaaaaatacatgttttaaattttcttttcaaactcagtgcaattgattttttcataatttcacccataatttatccatctttacacgcgtaatgagttaattaatttagcacctcctgttcaccagtttcgaacagcttgatttgttacatgatatctgtgttagttttgcactagtttctcaaaatacattcatttttaatggatttcatcgattatggtattaaacatgcaataataataagtagaatgaagattcagaacaatacgtaaaatatgtaatttttcatcatatatggaagaagtttcccgctgctaggtgctgactaagtaaaattcatattgcttttgtaaatgttgctgatgcattgaattagcaatatcatcctattcttgaaatgatcaatgtaaaaatttacagaattcgagacatttccatattgtgtccggtattgggaaccaccttttaaggttactcaatttggtactaaaatacaaaatcaaaatgcaatgtcaaaactcgtatttatattttcaaattcatttttgtacgctgcaaaaatgataatatttataataaatgtgcaactagattgcattaaaccaatcattattgaattttgaatttatcggcttaggtgtccgatactgggggatacgtctattggtataaaatctatctctatttcaggttgcatgtgattgtggtgctggaataatatcaatactgctttggttaaatcgatacgcgaaaattccttctggattaattctttcagcatttttttggcagaataatgttaagagaaagtattataatttttgatatttttttacagtattctgtgataaagttacaattattctgtcccatcaagaattcttacaaatgagttgttttatgaatgttttttaaaattgcagcaataatatttcacactttcttaacaaaatctaccagattttgagaatgggtttctttgtaataaaataatattaacaaattgttggttcgagttttttcagttactttttgtctgttcatcaagtttggctgaaaaattatttttatgattttaagaaatgatcccgcaaattctgaatatctcatgtttgtattatatattttattttattttttttttctattttttctctaaatttaacgagatttttagtcctgggcgcgttcatttcgggaccaacagctttactttccttccaaagcaatttatcactataactttttatgtcaaaagactgtatcgaaaagcaggcaggatcaaacatgtcgcgcgtcggtctcgtaagtgaaaaagtggcgtgatcggtgagtacggttggagaaagtgaaaaagtgccgcgatcggttagttctgtttgatctttcgaccttgacacttgcttttgctggagcgagcgacgagggcaggatcaaacatgtcgcgcgtcggtctcgtaagtgaaaaagtggcgtgatcggtgagttcggttggagtaagtgaaaaagtgccgcgatcggttctgttctgtttgatctttcgaccttgacgcttgctcctaagcagtgcgtcaagaaagcccgagcagtttcttttttttttccttttcgggtcgcgcgcctattttttttttctgagtgcttttttatagccgagcaaactagtaaagctgaaagtggattgtggctgctcagtcaaggataacggatcaattggtgagctcgtttcatgctactatttctaatctataaaatatgtatgactgcacattcaatcgttacaatggtgggatgtaaatatgatttttcaacaaactatggatggttcgtcactgtgagtgtcgacacaaactctgattcatgatttatttatgtttaacatttttttttttcagaacacctcttatgtacctttatttttgtaattgaaaaaaaaaactttgaatggttcgacactacaagtgtagacttgcaaaagtttaactttatttaacaaactttggatggttcgccactgtaagtgtcggcataagaatagaagtgttctatgatgtcccaaccaatcgagttttttgtttcttttcaaatgagtaaaatataataatacatgctttcgtcctgaccgctgtaggaatgttacatttaggtatttgttcaacaaactttgaatggttcgtcacctcaagtgtcggcataattttcctctacatagaaattgttcatatcaaatgaaaatattatatttacgtataagcatgtatatatctcacaaatcattgtttatcatggtctaatcgcttatcaaagtgaatcctgtgacccaacgatcctccccattaaaaaacatccctcccagtgacctttgtggagatgcagaggcaaacacggtctccaaatagcaaaggttacacactaacattccttcccccaatcccacctgactgcaaggacgtggccggcgccgttattgaccctgtataaatagaggcactgaattatgcacactgaagaagattctggccaatcccagccgaacttctagttgattctttgtgcattttcactgacttcggtcaatcacggaatagcaaccattgatatgtgtagtcagtctaagctaagctaacgaccctttcggcctaataacccttttggcctaacggcaatcggcctaatgaccttccgcctaacggtagtccgcctaacgggataaaccctatggccttattaggatcctgataacttcaaaaatcatcataaatacagtgtccgttagattttggcaacataacaaaaattgctatgtagcctaaattggaaaattatcatagagcaaaatgcgaaaaaaaaatgcaaaaataggttgggcaagttttttttaaagatttctgtctcaattcaaagctaatgttataaatgacatggtggttcaaatgttattcaagtaagaacctatcactccaaatattagagaaatcgtttgagattcgaaaaatttatggcgatcggtgtttgtatacgtgaaaattgttattttcggtcgaacttgcaataagtgaaacataattaaaattaattttctatgtaatggcgtagctgggcattagtttttgcataaatgctttgaaaccattttctggcccacagcggggccaatgtccgagccatatattatctcccagacaaataagaaaattaccttcaatccaaatattcccatttaatccagcaaaatattcctaatcctgcgcaaaagtcatcaaaatttcacgctcttacttagttttacgaagaactgctttttttattaaaaaaatataaaagcctctggcgatgatggaattttttacattctcatcaagaaacttccagaaagtaatttatcgttcttagttgatatatttaacaaatgttttcagcttgtatattttcctgacaaatttactaattttaaaaacagtcaaaaatcctgcagaagcagctagatatcgtccaattagtttgctttcctccatcaaaagatcattttgaacagaatgatagtccacataaataaaaatttttgccaatgaacagttcggatcccgacatgaacattcgaccactcaccaacttttacgtgatacaaatttgttaccttccaacaaagctgaaggcttttctagtgctctttccagccaaacacaatgtacatataacgaaatcaccttttgcgttatgcgatgcttatatgtgtaaaaatgtcgtcagtaggccttttgcgtacaaaagtggaggcgatatacactcccgtgcataagtttgggttcaccccttaataaacatacaaaagtgttcagtccatatctctaggattacacgtccaattggaacaatctaagccgcattcgaaaggaaaagagttattcttactttgtatgtagttttccagaaatggtagtgtttggtccgttgaatctgttgcttgcttctttgtgggcgagcgacagaatccggatcaattgtgtccggctcgcgttgcgctggtgaaaaaacgaagtgagcgagtgaaaaacgaaacgcgtcagtagtgtttggtccgttgaatctgttgcttgctcctttgtgggcgagcgacggaatccggatcaattgtggttggtttgcgtagtaatcgcactatcggtatcgatcatccgtgtaaatgtattcatttcaaattatatctttatcgttcaccaaaacgaatcctttcccatatccaaaatcccagtgttttcttgtggaagtgcagaggactcctcggcttctgtaaagcaagttacacgtcaacatttccctcccatcctcaaattgacctgcattcggacgcagccggcgccggtattgtttgttgcaataatgagagcaccagtacttacacattgaagatgctactgatcccgagtaatgtctgttggttccctgtgtaagtacagctgttcttgcaataacggagtagcaactgcgggcggtcaatcatgctcatgctcatgctcatgctcaaaagactgtatcgaaaagcaattagaaacattttcaactatcccagaaaacgtgaatcgatcttacaaactttattattgttctgagtgatttgagatcttttgaggcattgtgcaaacaatatgctgcaaaacatatccaaaaattaaaaacatctattttgcggtttttaagaacaatgaacttcaaattttcatttgaaaatttcgtttatatttttttaccgtgcatacttttttaaatactttagtatataggttttgatcaaacaataaacaattcagctacgattcactcaatcaaaataaaatatttctggaatggagaatcacgaaatatgtttgaaaagggcctattttacttattttatttgaaaattttatataaatatgagtatatctcgaaattgatgcaaactagaaaaaatttacttaagtacttttcgattgcaatttttctgtacttaaaataaaaaaaatcgaaactgcgtttctggagaaaatcgattttaaaattttgtttttgaaataaaaaataatctgtaactttttttaccgtgcatatttttctccatatagtcctaagcaatacctacaactttgtagaagatctcaaatcgatcggacaaaccgttttcgagttacagttttttaaagatttgctatgcatttttcgatacgcccttctaaaaaataaggcgaggttcaaaatggcggtctgaaggtgcaaaatggcatttttggtcataaagaatctgtatgcaaaatctcaggtgattcaaaaaatacaaaaattaaatttaaaaaaaaaatcgtcatgttcggtggaattgctctatacaaaatacaccacggtagtaaatttctataacttgtcataatattttggaccaattctaaacaattagcatatgtttttggctactccatagatccaaatttatgccaataatatatatatttttttttttgtaaaaaaacaattctcaacatattttttagcattggagcagcaaacaaaactttaaactagttgtttatggtagatctttcaaggaagatcataattatttgagttttgcagaccattatgcttttttcaaataatacattttctggaagcttcaattgaaaaaattaaatcttttttagtggtaatcataattgttttttatttgtatatgtctgcaaataatcatgatcgtacatggttaaaaaatcacatggtatacaaattcaaaactgatgtagttcgaaaatttcaacccaatttttaatacaccaaatcattttaaaaatcttattgccttatcttaaataatatataattttgaaggtgagccagaaatttcgatacaaaaacatgcattgagcttagaaaacatgcatctcgaatgttgctaatatattttcgatacagtcctcaattgactgtctcagggatgaaattcaacccaggtccgtcccaattttttgtattatttattttattacaaatatttaaaattcatgacaatctttttagtctagcaagccccaggctgcctaagtagtgttattcgaaaaatacgccaagccattcccataggggacgttagccacaaggaaggacgttccaagtaatactgttttcatatggtatgccctcttcaacatctaatccaatttctctcgccattcccttacggtgcctattattctagttttcattgctttcttctccatgctccctgttacttcgagcaaaataaaccgatatgccggtaaacaaattaaatacttgaacattaaatttacttccttctagttaagtggtatgttccataaataatttgcaataaattttcaagtaagttacccaaaacctacaacacatactttacctttctatgcatggactcaagataaaatcaaagacaaaacactcacaattgtatccgccacacgctttaaggtgcaagtgaaattaaaaaccttacgcacacatgatcgcttggttttgcgagtgtttttgtaattacaggaatagattttttcgaaccatatcaacatatgaatgacggtattaaaacaaagcagaaataaacttatgaaaacaatatccatatgaacattgttatcattacgcaaaatgttcaattgccgtggaaacacacatgcttgcaaaactaagtatcgtaatccgggctaaaattgataatttatctgaatatttcttaaaatttgcatttgaaaatgcaaatgttgcaagtttgtgactatatactgtattttgttttctgaaagttcaaagcaagtttaaaaaaaggttttaaatatttttttattcagctgatatgatatatcattgaccacgcatgaaaataacgttcagtaatattgaaaatagcattacttactaaaatcatggtcactaagccgaatatgaaagccaaattcttacaagtcatttactttttgagttatttcaatataaatttaaaaatttacgcatgaacacaaccaaatttttgcataaacttcaatttttattagcatatgataagaaggaaaataaccattattcatgcattggaaatatttcatagattaatgttgatacgatcttctgacgaggagggtcattgcgatcaatgttgtactcgcgtgtgccactatgggcagcttccatataggctagtggccaatatattgctgccatctcaagtcatatatatgagtattttgatacaaatgttattttatgtttaaaaaaaaaacaagatttcaagacaatcttttggcaagagcctacagtgaaataatgagtttttactcatattgcatataggtcacttatgcaattaacgtcgcgaaaaccatttaaaatattagaacatacatagggatgatgatatgaactattttgcgatacactatttccctgatttttttttaactgttgtaataagaactgttaaaaaatattaagaaaaaatcaaaaagccctaaatcaaataagtgcatgtatgtgcggctaaactcttcacgatcctttagattacatctttgaacgcccttggaaatgaattttagcatggaacaacttaagacaaaaaagtatgggatgtttaaagttttgataaaaaatcgatttttttttcagtgtgggccttatatataactgaacatatttcattttatttttctaagatagctttttcaataagctttcgaccaatgtttatagatccgtataaaatattatgattatggagtatactttttgcaaaacaaaccttggttttgcaaaaaaaaaatcttttatttgatgttatttgaatatatttcaaatacctagttattactagattttgagacatcgtcttttttatgcaatttcattcaatttttcttgataactaaacctggtattattgtcaaagtaagttatttgaatgacaaatccataacttggatgtattggtttgacattcaaaggaaaaaatgatataattatgttattaacagaggaaagtttttatcattgttttccattaacttttattttcaactaattatttatctatgtatttatttaacaaaaattgaaaaaaaaacctgagtgattttcagacatgatataaactccactgcgatgcaaaaatgaggcggttttgacgtttttctgaggagtaaaaactaaactctaaatattccacacagatccttaagcgattcgagatagagtgcaaaaaaatgctggaactctctatcttgttgctatgctcacccttactcgcgcttcaaaaaaaaaaaacttctgagtgtcccgcccgaacaagacaggccttggggagttgtgatggcactcttttttatggaattttactctgttgtgttttgtactgcatcttcctcgctcatttttcgttgcctctctgattaacagttcttcgctgcctcgcaaagatgcaaaggcagcacgcagctatagtatgtcgccaaactctgatgatgtttaggagtattaggcacaaaacctcttctttttttccaaaacgttacaatgtaaatattcaatcggaaggctccaacggaaataaaccataacagggccagaagcttgtgtgatttctgtggtaacaacactcttaaaaataatggaaattactgtggacgtaattcatagtatgactgaatgacacatgatgtaaatgataaaacgacacaaaaatgtgtatgtgaagatgtattgaacaaaaaatgtaattttacacgttagtggacacgaaaacgatgtcactgtgatcggcatttcccgaatcagacgctatggtatttgaaatgtgacataaattcgcgtcattcggctcgcttcttttatgtgcatccaaaagacgtaaaatcacatgattttttcggagtgtgaacatcataagaataaaggagtgtcatcatgaaagtatggtttgaatctaaaaataaacaaaaaaaaaacacaggagaaacaatgtatgaaatttcctttgaaaaaattgaataataatttcaaaatagaaggccaactagcgacatactcacaccattccagttttatttatatagatagataaacaactcctatttaagcagctttattattaacctctactagggtgatgtataatgagtccagcattccttttatatttctcaatctatgttaatcaagctaacgcaactttttgagaattttggaatatttttgcactacattgaaatgaaatcgtaaaatcagaataatatataatttaggtcattccaaacggagtgcccacaaaaagtttcatttcatttcataccgagtaaggaaccttaactgattttgaacaatgccgatcggacgactctgatataaaaaatatgctatgaaattcaaaacatcaaaaagtatgaatcatccatgttaaaaacttttgtattgcacaattactatattaagattcctaattgctatgttttatttcaggaatgcaagcaccaattcaagcatcgccgatggaactgcagcactatagaggacgacaccgtattcggaccagtttcaaatataggtttgtaaacttgtcctatcaacggactgtgaccgtgtctatcctacatatcaggtttcttttccttcatgccgcctttgaggttctttattctcatgagtatacaaaccgccaatagagctaagctgcctcttacctgccctacctgctactgctaatggtcttcgttataggtgccactcgaatcacggtccattcatctcggggtatgttggcagatgattcccctactcattttctccgtttcgtgtggccaaagaaagtgtccttgaaccgtgcccatagtgtgcagatgtgaatgtatcataatccttcgtaagtaaactatgaataatgaaaattatttggctctgtgttttgagttcccttcttcaaaattagacttttagaataatgttgaagaagcctaaatcaacagattccaaaagatgagatttatatgatcaatctcaggtccatccttttatacttcaagtgttccgatgtgtaaccacgaataatgtcaagcaagaaaacttttaactttttttaattttaattacaaacaaacttgacagtggacatagataatggatgtatctacagagttcataaaaaaaacatattttaaatatggatcaggcttatgctaaaacaataaaaaataaggaacacattttcaaaaaaaaaacgttttggagctacttatttcagcgctgaagaacaaccattgaagattttagcttcaaatagtccttgttatttactgaagtcttctagaaaactccgttttaatcaaatgcactatttttaagttttatgagcaaatttagcaaaattttgttgggaaatgtcatattctacaccagaactttgtcaaattttaggatttcaaatttgtggaaagtgtaaaaaagttctggacctttcttcctaaccggatgtccgcgaatcgaatccctagggggctgtgccgacttttcaaaaggtccgcgaagcccttgcaacaaaaagtgtagaaaaatatatccgtattcgttcaccagattttctaaacctgtttttcgaagcaatggtgttcaaattctatctgtgctcctttttttttgctatctagaaataatggtgcccacagaaaaaaaataaaagaaaaaaaactgtttttttattattgctgataatgtaatgtcagattcttgagtactaatttttaaggaaatttaataaattataaaataaagttatcaacttacagaaatctccagtgaaattaaaaaaaactgaatttcttttccgacttattatgaaattatttggattttccttctattgtttttgaatgtttatattcgaactattgaaatgacatgcatttatctcggagctatcaaaagagacaatacaatatactacgcgagtttaagtttatttacagactcttcggaattttttggcagcttgctttaaaaaatctctctgaattcatagtgtcattattgactaaggcttgataagaaattcttgatggattttttcgccaactttgacgtatttttggtaatgggttttcgttgattgttctggcatatccgattttatctaaattgtcatatgagcaattctcgctgagaccggcccactatttacatttggtctttcaaaatgttcaaatgtatgcttattagaaagctcctgtcgagtatgtaaagaaactgcattcggttggtcaaattgatggacccctcggtagttataattgaaacagtttttgaggacccctcgatttttgtcaattcttggtttactcaaactgccataactcagaaatttcttcaataaactctagacaataacatggttttggaacgagaaaacataggagaaaacatttgcaaaaataaaagtatttagcggccatattggatttggccgccatattggtttttatcggtaaaactgaattttcattgtgttcgcaaccaccgattttaaaagtttttgcttcattggaaagttgagctaagtttatacaaaatgattctaccccattaccccgaatgccatttcccagaatgccatcaccccgaattccattaccccgaatgtaccattaccccgaattccatcaccccgaatgctatttccccgaatttgcaattatcttcacaagatgattttgatgacatttccccatgatataggaattcggagtaatgtcattcggggtgatgggtcgttcggggttttggaattcggggtaatggcgttcgggttaatgtcattcggggtaatgggattcggggtaatggggtagaatcatacaaaatatgaaaaaatcagaggtgtatcagaggtttattgatcaaaagttatgtgcgattttgtgaaacatttcttattgcgctggtccaatttgaggacaaataatggcgctatagcgatttacgctcgcagtgatgtatttgacatatctcaacgatgttttacatgagatattataaacattcatattaggggtcatccaaaaatgacgtccattatctgggtgaggagggggtcaataaaagtgtgacagtgcatgtgtcaggtattggagaaagcgtgagagaagggagaggggtgtctagagttccggaaaacaatggacgtcgtatttgaatcttcccctataaggtgaaaatgaatcgaaaccacttaacttaaaattttcaagagcacaaatgtagagaaccgaacacctgtttatgctgaaaacttaatcgattggtcattaccagctagtgactaatcgattaagttttcagcttaaacagatgtttgattctccagatttgtgctcttgaaaatatgaagtttggcttcgattcatcttcaccataaaagatgggggggggtgggctacaaagagagggaggatgtcaatataagagaaccccccaatagtatgaaaatattgttttctctcggtatcgagcacacatactttgttcacagacaaacagacgtcacactctcaatgctgtccatcgaccaactttttaacgatcaattcgaatatatggtaggtggtcaatcgccaacccgcagcgcttgcgtcgtttttgttcgtgtttgacgtttacacactaccgccacctgttggtccatcggccaactacagagtttttagcattgggcgtacatgttttcgtgactatgattttgatcgcaatttgttctaagtgttacgtctgtttctctgtgctttgttgttctcagtctagataggggtcacacgcaaatcatgtcacgctccaaggtggtggaggttaggcagagcgtgacaagcgttaaaaaatcttaaatgatctgtggcttttgtcggttcagtaaaattcatccaaggcattagcattcgatattatttgaagaagcgaggaattatggggcgtgacatgatttgcgtgtgatccctctgagaacaacaaagtatgtgtgcccgataccgaaatgagtgatcattgtgagagaaaacaatatgttcatactaggacatattgttctcctatatcctatatctcctatattgacatcctccctctcttcgtactcctcccccctttctaggggaagattcaaatatgacggctatcatttttcggaatttctataccccgtctcccctctctcacgataaattctaatacctgatacatgcactgtcacactttcattgaacaaattttgaaatatttccagaaaatttagaacaattaataagaaacaaataccacacagtggtactcaaatatattgccaacaatattactggaaaaattgggtcgaacgaaattttgccctagcaagaacagtgaattcagcgaaatgaaattttagtattttttcgcacgatcaggcatattttgctaaatttagagataatagaagattttagacaattttgcaagtttttctttgagaatatatattagggaagaacttttgccccgctgatttgaacgtttgccccactatgggcaaaaatgttttccatatgtagagtaaaatggggttaaagttcgagtgggccaagagtctctttttaagatttctaaatcaattcaaaacaaaactgatgacatcaatacatcatgctattcaagtaagaaactttcacttcaaatatcatgaaaatcgattgatatttggaaaagttatggctatttgtagtttttagacgagaatattgtaattttcggtaaaaaaaaaactttcgttgcatggaaccaaataaagataaaatcttttcaatattttatgtcagggcgtttctaggcctatcataaggatgctttgaggtgcattagtttttgcataaatgcttgaaaactatttttgacccatagtggggcaaaagtttgacccatgtgtatagtctctgaaaaattttcaaattgcctaaaatccacatattatcttccaatttagcgaaatttgcctgatcgtgcgaaaaatgtcaccaaaattttacattttcgcttagttttgtgaaaaactgctatttttgggtatattacagttaaccctgttttagggaattttttgatgaaaatttagtgtgtatttttctgcaaacataagtttacggctggtataaagtgtgcctaccaggaaagtatcgatattatgagttttagccagcgaacttttgccccacagttgattcgaactctggccaccagtgtggcaaaaactcattttagacaaacaatgtttaaactttaataacttaaaatgggtaaatattttgacacaagtttgttcagcaaagttgtagccaatatgttgaaagttcactgtattgtatttattttgtttcaactgctcaaaaatcaagaaatagttataacttttacaaatctcaatcaatttctatgatattttgaatgaaattcttgaaaatcattcaaaccatcatgatatttgtgttgaattaagctagaaatctgagaaataaacttttgccccactttactctactatattttgtattctgaaagttttatgtgattattttttaggctgatttgggataacatcaatcacccgtgtaaacaatgttcagttgcttacgaaattcttgtctcccgatgacgaatatgaaaccgactcttacaagtcatttacttctggaatcaggtagtcagtcactttcctaggcaatttctgcattcttcagagtaatttgttaatttttatgaattgaacatacatttgctaacggattcgtttttggtgcttccatttttagcaaaactattatttacttgtttataccaatttcagatctaacgtgattcgtgaatttttggtagtagccttcttgttacgcatgaacaaaactcagttttcaggaaaaaaaaaatctatataagaaggtataagaaagtcaaacaccattcacgcatttaaaatgttttaaaaaaaatggtaattccaactttttacaaggacgataattctgttcaatgttaccccatttacggtaacggtacggttggcttcgtggccaataacagcaccctaacgcatcaaggaacctaacatttgtgatgaagctcgacacacaaacttcattttaaatttatttgtatagatttaacaaattgtgatttaatattgaattaaaatatttgaagcaaatattgaattaaaatatttgaagaactaaacaatgttttcatattaaaagtcgattataattaaaatatacagccaccatttagaaatgatgacaccacttataaatgcacatcttttaaaacgatccacaacacagtctaacgaaaaaatcctttgctttgatagtcaatgaaccatcaaatgaacgtttttcgatgcatggcagatttccacagacatgttgttatcattctccaacgtagttcttctcgctaaactcacaattctttgtgtattcatacatacttcgggataaatgccaacccctctgtataagtcgattccgactgcgggttgctcacaaaatgtacccactcgcttcgcaaccaatccaagcgatgatatctttctatctaaccgtatcttgcatgaatgaaaagcaagaaccatgaacaacacagtccgccactgccgatcaaaaacagtcaatcctagtcgacccgtattgaacgcagaggaaagtaaggttaaggataaatgcagtttcatgctcagcacagttattgttatacgtataagcatgatatgagagggatctgtcataacgtaaaccgattataaattaatcccaacgaacagattcaaacgcaaacaaccaaaaaaatattatcttttcaattaaaatccgataccgctcgatgctgagcaatgagcattaaaactgaaacacaagcatgatcaaacggaagtaaagccgacctcaagttacgcaaagtcatcgccgagaactactgcccacgataaatgatgaatgtctgcatcgtcatataggaatagtccgtcttgtttattctgaaacgaatcgagtgggctcgaatttaagaatcgaactcttctttgttcgctgcacatcagaattggtgctagtaaggtctcaggcttttcaatcagttgatgatttgaaatatacgagtgacagattttttttttctaaactgcagtttttaacttgtgtgtagcaactgaacgtaattgaaaattaaagcatcattcttaaaattccgagtaacaaacaaagaattttcacctcacactcaacaatcgaaccatttgactaagaggaaaataaccatcatcgcttttcaaaaccagttttttcgctcaaaatcgaggcagtgttcatgaaaatctatcattgcattgcacttacaaactgtaatttaatgatagatttttatgaggttttctttaaatctgaacgaaaaaactggtttttagttttcgatgattgagccttaagaataaaatacgttatgttagcttttctacagtggggatttccttagccaagtggttagagtccgcgggtacaaagcacagcaatgctgaaggtgtctgggttcgagttctgatcggaccaggatcttttcgtaattgaaatttccttgactttggtatactttgattcatgctgatttgcttcgtaaaattcgggtgaaattgatcttcgtgtcacacgattttatttcttcttaaaggagcaaaaaaatcaattgaacctgcagtaaatggacgttgacgaattatgttttgtgaagctttttgcgttaaagaatgtttatatctatgaaaataatataaaatatttcatttatttatttatttcattcaacggatctcttatgatctaattgaatattgttcttaatactagatgaaaataaaagacccagatagacgtagcggtaaacgcgcagctattcagcaagaccaagctgagggtcgtgggttcgaatcccaccggtcgaggatcttttcgggttgggcatagagtatcttcgtacctgccacacgatatacacatgcaaaaatggtcattggcatagtaaactctcagttaataactgtggaagtgctcataagaacactaagctgagtagcaggctctgtctcagtggggacataacgccagaaagaagaagaagaagaagaagaagaatagactagatgaaaatgcacaaaattacacaacaatcaatagcaatatgaatgcatccaatactttagaattgcataataatactaatctatcgacgaaatttcatattcaattttacagtttttcacaacacgtgctattcgtatttgaggttcccacgtataacattgttctttgaactctctaaaacaaatgcctttgagccaagttgacgagcacaatgcacgttcacggagactatcaccaacaccaactttaaacgacacatatggaaggcgaggaagaggataaggagtgctacgaagctagtagtactagaggagcccggaagattgcccgagccgacacgatggtgaaatggcaacgcgagtgggataccgctgagaagggaaggtggacttatcgccttattccaaatctggcgaaatgggtgagcagatcccatggagaagtcaacgtccacttgacgcagttcttgtcaggtcacggctgcttcaagaaatatctgcacaggttcggccacgcagagtcgccgctctgcgctgagtgtccagtcgtagaggagtcgccggaacacgtcattttcgagtgtccacgttttgctgcggaacgtagcgagatgacagcggtctgtggtgctgacgtaaccgtagacaacgtagtggatagaatgtgtagcgatgaggtgatgtggaacgcggtgaacatggcggtgacgaaaataatgtcattgcttcagcagaagtggagggaggaacaagcaagtgcgcgcggcgacaactcgggtcgggtttcgtagcccggtcgtatactgcccgagccgcgcacaaatgttggagagctaaatggctcccggtcggtttcgggggatcttcctacgtcggggaactctctgttggagtaggatggatccgccgtcggggaccatccgagtagagcgcgagatgatggagcgctaaatggcgcacgcggcgcgaccggagtaggctagatccaccgccggggactagaccgagcagaacgcgacgcagtactggttctgggtcgtcgaggcgccggttaaccggaagtcagtctccaaccggaatcgccgaaccgacctcggcactagagtgtccatcccgggacatcccgggacaaaaaatcccgggatttgacaaatttcgggatttcccgtttcccgggattttatttctgacatcccgggaatcccggaattcccgaaatgtacgtagaatttgatgaaaaccactaaatttcaatgaaaaacaatgacattttttctcactatcacttatttgataaagtagaagagcataatcaaaaagagaataagcgtgtaattattttcattaaaagagcaatttacgaatcaacgaaacacaaacacctttccaagaaaaatataatgatgaccaaataacgatttatttttgtgttatacgatgcgaaaatctgcagtgtgactgacatgcgtttattttttattatgggacaaatcgacttggtgttttttcctaattttactgaacaaaatgtgatttcttgttagtgcagctaaaacatcattagaagatataataacaactgatataactcaattttcaccaaaatacagatgggactgacttgcgattcacggtagtatctaaagattttatgacttttcaaatgaagcaaattgctttaaaattatgacttaagttttcaccatacttccattcataagtgttatagagaatttgaaaaaaatgaataaatccatagcaaagccgttattagtcaagctaagttttgatatttgtggggtatttcatcaaaataagaaagtcttatctgaaatgtgatatgctataattaacatattattttgaaaatttacattagagtaaagtggggcaaaatttcgaatcagcgggacaaaagttcgacccatgtataaaatcacggaaaaatttgcaaattgcctaaaatccacatattatcctcaaatttagttaaatttgtctgatcgtgtgaaaactgtcacaaaaattttaaattccacttagttttgcgaaaaactgctatttttaagtatatttcaattaacccagttttgggcaattttttggtgaaaatttagtgtgtatttttcgtcaaacttaagtttacggctggtgtaaagtatgcctgttataaaaggatcgatattttgtgttttagccagcgaactcttgccccacactagattcgaactcttgccccaccggtggggcaaaagttcgaataagacaatcaattttgaaactgttataactaaaaatgggtaaatattttgacacaagtttgttcagcaaaattatagccaatatgtttaaggttcactgtatggtatttgttttgtttgaactgctattgttttcctggaaactttgattataccactaaggtcgaacttttgccccaccttactctatctgtttatttcattgaaaaaatggtagtgttagatttgtatttccatttcaaccgaaatgctagttttattgaaaatttgctaaatcccgggatttcccgggacaagcatagatttttgtcccgaatcccgggacgagcaaaatggccgggaaatggacactctactcggcacccaaccggcaggtaggcttgatccaccgtcggggacaagaccgagtagatcgtggaaaagcaccggaagttgtaggcttcgtggccgtgcggttagcggcgtcagtcgtttaggcatttgtgggttcgattcccactccagtcggtggaaacttttcgtcaaacgaaaaattcatcattggactactggatgtttcgtgttgtccgttgcctaatgtttgtgattgttcagtctgtgcagccttgagctgaagacggtgtaaattgtcttgtcaaattggtcgtcagggcacctgtgaaccggaagtcatccgccaaccggaatcgcaggatcgaccttggcacctatccgggcagcatcggtaccggaaaaacttccacctccggggaactcttcgtcgggatagggtagattcaccgccggggactatccgagtagtgcgcgagaacctggagtgctaaatggcacgcgtccagcaccgagagaacttctttcgtcagggagtttctggcacccatggtatcgtgagccgaatggctgaatatggcatgtttagatcacaaactaggaacactaacaaattattaatggagccgaagggcttaatgaagggtgcgcgtagcatgtgtcgcctcttcttcgaagtaataccgcaaggtggtgccggagaagaattatttacggtgacggtgtacctaggagactgttttttagtgggtaggcgccccattgcgaatcccacacagtgccaaaccatacactgtggcatgagcatgaacaaatacaggccagttttaagaagatttttttttaactcctagagatgcatgaaaaaaaaacatatggaaggcgagacacaactgttcagctagatacaagcttcttaacaataattgcatccgtatttccaagggattcagcgaccactatggtactctgattctccttttgatcagtcaggcaacgagacatgtgatgaaaaagacttaaatttagcttgtaaactttccgaatagcgaattttcgcgtaacattgtactgtaggcagtgaaaattcaaaaggtatgaggatacacacttaaacggattcgccgagaacccaacagctgatatctcggtaataatttgacgattctcggtaaaacttttaccgagatctcggtaatcatttaccgaatctcggtaacgttcgccgagatctcggcaaaaaatttggattgccgaaatctcggtaaaataagtaccgagattcggcattgaaaattaccgaattctcagctgttgggttctcggcgaaaaattttactgaggtcggtgaaataatttaagtgtgtactttttacagattatattttcattccgtggataaatttatacacttagcatggaacccaccgacacattttcaccaatagtttttgacattttgcaactctggcagaccattcgatagtgtgagagtgaagaatgcgatgcagcaactgagtgctgtatggcggattattggtagtacttcgaagatttttttttttcgaactttttggtgaaacaatcacaaatttgatattgactgcagttcttccgggatgaataataggtagtcttactatcaaacgtaatgaaatccattaaacatagtagtaacagtacagtatatagaattcgttcgctaacagcaggaaagcaacattcgacagccagacacacacttatactcaaaatcatgtacggtgcagtattgacaaacatccgtaaacttctagttcgaaacaagtatttgaacatggtaaacctgaaagtttgtgaggatgcttaagatatatctccgaaccagattatatcaccaaagctggtaacaatttgatcattcgatcgaaattattgaacttattttagatttcagaaaattccttaagaaattgcatacatttaggcgtttccacgtaattcttgaaattttactattcattattcctataaatattgtagtgttaagaatttagcaagcatattcggattcagggagctcaaatttattatgtagagttgtttcgaaaactaataataatcgcattgacaagtgatcagttgcaccccgaaataagatcccccgatttttcatattagagatgtttcttagcactaaaaattacatttgttaataaatttcggtgcatgagccaatgaggctcaccttcgtacttgttttcctgcaattagttgtttggcattgtcaacattttagaaagcagacaagataaaccgtgaaaaatgatcaatttaatccgaattacggtaccgtaaaacggggtaactttgacagttttttcgaaggaaacttgaatatttatgcatgctgtttcaaaaaattattatttgtattttaaaaacaagtactggtatcctaactatcgtttgcagttgatagattgccaaaaggtttattctgaatggatatataatttttcatataatcgaatgtcggttttcggttttggggttactttgatagtcgcacaaaattgaatgatttacggaacatttatagggcgttgcatacctctaggcgtttaacgctatatgaaaatttatgacttcgattacaaaaatggtcccagtttgtaagactggtattcgctaagaaatttgagaccaaatttatgttctactaaaactagactgtcaaggataagtgacgaacttattatggcttcatcaaatagtaatcgtagaacagattgtttgcaagcttttaaaaaatgctaaaatattataattttttaatatttgcatataaatcctcaaaagtacttgattccaacgaaaatagctttgacgtgaagtgtcatactaatactctttacttttacattcgttttgcttaacggattaacagaaactttgttatttcgtttagtatgttgtgggtctcgcactatcgaagttacccgcattatcaaagttgccccgttttacggtacttctgaattcatcaagatagcagaaaaaacatccacatatttctaaatctggatcgtttgatgagaaggtaaagtcttcctgcagaattgaaattaaactgaaaaatatgagtaaagatagaaatatatgaaccatagtttgaattaaattagtcataatcttaaatgtaacatgcatgtaaatttcacataatttctcgtccttttcatcatgagctattctactgaagtcggatgaacaagtttatatcaactgcaaaactaaggcggcgtgtgcaggtttttcttctaatcgttaatcacattgcaattatgtaatttatcatcaacattttacattaccctcttcttcatttgtgtttctacaacagcgtgtcggtgtctttgagatgtgagcagctttttcacgattctctaactccaccggacaaatagcttgccgatggcgtgctccgggccgggcacatgttatagattcttctttacgatgattgagattatatgtttcctgtttataattgagtttaatattttctctgctatggatagtacctatatgcaactccaaacataacctatatatgcacacaaagctgccgatatgttgccctcagcttcgtgcagctcatctatgtgtagcgtgtaaagagctcaccccgtaacccttccaagtataatggtaaaacgttcacttacatctgattcgtcacgtcactgaaatgtgttagattatggcgagtttctcttttattttgtgccgctcgctatggttcacaatttcctccgtacctagatttcgttcaaaccctgtagcagacctgctagatctctttgcaatccccgcacttttttgtgatacttcgcccatacgtgtatattgaatattagctactcttccaatcacgccactcagctggagtcatctatcctggggagatcgactatttgcgtatgaaaacggattgaaactcatgttaattagtttatacaatttaccgagagcaactgcatggtaaaagaaataaaggtactcttcacatttgcatcacgtagcgacagtaccgtaaaccgagggcaaattgatcactatttaaaaattttctgttactaatttcgccaaattgagtactttgtggatacctttcaacctaccgaattgtttttttttctacgattctataagcctgcttttcagcttagagttcctatgatcacttccaaagttattaactgagagtcgaggaaatttcctttatgaaaagataaccgaccgatgggattcgaacccacgaccctcaccctcagattgatcatgctgactaactgcgcgtttaccgctacggctatctaggcttctaatgtttaacccaggataagttgtcggtgttcagacagactgaaccaagtgccgtttaatggtttcaggaaaacgtaccccagacatttgaaatgaagaaatattggcattattcgctgtaataatgtaccttatctatttgatgatacatgtgtatcaaaacagcatcgtaaaaaatcaaaatttatggggtccttaacgtatctttagaacactaaaatatcatctagtccggtctgtctgaacaccgaccaagtataaatgaagaccaccgtaaaacggggtaactttgaaagtttttggaaaaaaatcaaaatatttctgcattctgttgtaatgaaatagaaagcattacgataagtatattgggcgttgtcatgcataggcgtttcacgttacatggaaatttataactttgattacaaaatagctctaatgtgtaaacatactttttgctaagaaatttgggaccgaattccaattctactagagctaggctgtcaaggataagtgacgaactgtttaaaacttcatcgaatattgaccatgaaacacttgtttgatacgcacaggaagtccataatccacgaaatcctattttgcacaattttggtcttttcctctcccatgtcttactaaccagcctgcccctatcaaatcaatttaatttctaaatttatgatcaaatagcacgtaactttgaggtgatatttcttattttcagacagctgaaaaatcgaaagcaacacagctcaccttgcgaattcgatctccatccactttttacttggattatcatagtcttttgaagtgtttgcagagggggtgggacatttcgcataaagacgtttcgcataaggacgattcgcataatattatgggtggacgtttcgcataatggacgtttggcataaagagaattgattgtgctacttttccccgaatgtcgtttccccgaatgtcggttccccgaatgccagttcctcgaatgacccgtttccccgaatgccatttccccgaatgacccgtttccccgaaaagtggagcggttcaaataggtgctggaatagttttcagtggcaaggtggtgaatagaaagaacgataagcaatcaaaagaaggaggtatttggtcattttcggggctatacacatgttgccaaaaatgctgaggacggtaaaactcgtaagaaccgccaaccaaataaagaagggtgcatattagatgaccagtacgttcaccaccctgaaatgtataaatatatgacaattatgagttctaaaaacttttcggggaagtgggctattcggggaaacgggatactcggggaactagcattctgggaactggcgttcggggaaacgacattcggggaaccgacattcggggaaaagtagcacaaccaagagaattatatgtcttctttaaaatgctacctgttcttatatgaaactgctttttgcgaaacgtccattatgccaaacgtccttatgcgaaacgtctttatgcgaaatgggtcacccccgtttgcagatgcttttttcatttttattttagctcttgttgttttttgtcaatgacatattataattcaccaaaaacaagtcaagttatgtctgctgtgctttgcaaatttctgaggatagtttcataaataactaaccgcccaaggttagtcacaaaatgtccaatattgtaaataaatcagaaatctgtgatgcttatattgttggaaatcgtgtcattccaaatattaacttctctaccggcagcttcattttttaccgcaaaattcaaattcaaatcgttaaaacttttttgtttttcaatatttttgcaccattttttcacaagctctcaaaaaacttttctagttttaggatctgtgtcgatattgatcattggtcatctggttttaaagatattccaaaattccttgggggaccgacccgtaactacaatcccccgttaatttctcaggctacagaattttaatcgtgttcggatattcactcttcgaaacaatacattaatgagactatgttgtgaaaaaatgaagcaatttggtgcagccgcctttaagtaatgaccatttaggtttctggaaccacgctggccaaataaagatcttaaaaacttcaaaaaacatcatatcgtaattttcagttatctccaagaatactgaaccgatttgtatgatttttttcagagaagctcattattacctggcattatatagcccacattttataaatagatcaaaaacaaaatggccgccaaaggcattttatatggaaaatgtcaatcccccaaggaattttggaatatctttaaaatcagatcaccaataatcaatatcgacacagatcctaaaactagaagagttgtttgagaacttgtgaaaaaatggtgcaaaaatattgaaaaacaaaaaagtaaagggacgaatgccgtaatacggtaaagtctctataagcaaaaaaaaaaacaaaaaagttataacgatttgaatatttattttgcggtaaaaaatgaagctgccggtagaggggttaagaatccatttcactttacaactaacatctaatagaagcctattttgaaataaatgattggtacagtgccgtgtcaaattgttcttgctttgcttatgactaatttcaaaatttcccactgtttttgaaccaaaattacaattttcgcacagtggtggacctttatacagaggttggacgaaatttcaaatacgtcccaaatggcttgataatggtaatctaagaataatgtaattatagccaaatcaaaaacataaaactacgatttcaaaggaaacctattgagcttaaatcggccatggtttcgttgagttacaggagtttgaagtttgctaggtgataaattagttggttgatgaatttaaagcagtccaattttgcggactttcccacacttaccatgctgccaaaaatagaaaacaaaacacaatctcaaattttgagaaatcttcactcaagggtatagaagtccataaagaatattaccaagtgattttgagaacatgaatttgttttgtacggccatgcgccactgtgcgatgtggatttttgagtagcctgctatgataaaacattttaagcttagaaagtaccttactagtcatttcttatttaatgtttgaaattgaaagcttatgacaccttctcgcttgagatatattcttcaaatgaatgtgcatatacagtcgaagcttgttataacgacatcgcaagggaccgtcgtaatagagaaatgtcactatagagaccagttataacatcaaaatatttttcaagggaccaaaaaatgtcgctatagagagcttttgtcgcaataaaagttgtcgttataacgagcttcgactgtatttgtaagagccgtttcgtaacgtgagagccataactgtttggcactattcaattttttgggtttgaggaaatgtaattcaagtaaaacaaacgtattcagtttaattttgataagctggacatacagcaaatatgcgataacattaatttggccgcaaatgatcacagctgcatttatgcgcaaaatgtaatgtaactatatgagcaactttcatggaagaatgcctgatgggattagaaggagaaacatttttttttcggcccgttgaatatttctggaatttcgacattatttaaagaaaaaactgtatattagtgatgcagtttccaaacaaattccaatcatttccaatcttatcattgaaaccttattgaaaacaagttccatcgttgacgtacttttaaaacatcgttcacatttctgatatgaaaatgaaagtaggtacataaaatgaacttttaattctattattttccagtagataaaaactagatcgaaaatcacaattttcacatcaaaaaacaataaattgtcacatttttttccaaacctcaatcgatttctaaaatttctggagtgtaggattcttacttgaataacatgccgttgaaaaacaatggaatcgttctggtgggcttcaattccactactccagttcactagacagaacgtgttgacctacaaggaattggattgaaagcttccgtttgacgtatgtgtagtactggcaggggttttcgtatgtttttttgtaaatattttctctcagactgtccgaaaccggtgtttctaccctaacgattcttcagtgccgccagctaatgtaaactcgaagtcaattcaggcttcatgctcttttccacaacaatcaaccttggaattggccttagaaaactctaagtaataatagtcatttgaaaaggtatagtcaaaaatactgatggtttattgatcatatcatattggatttttaatattctggggttgctgttcttttatgtcactcgacaccaaagctaatttttacccaatacgtaattttagcgattgagatcacgtcccctttcttctgcaataaaattttcccatacggaacactcaacgctacccatcccggaaaaaagcatgacaaaagtggttgtaaatccctaatttgttccggacgtatggtagacattatggaaatattacgttgacgctggcgacgtcatgtagcttcggtgccaaaagggtgtgagttgatattttttttttcttttatattgttctgaagcaaccctcgcctatgatgcatccactttttactttcgatcatatagaaatctgatttacatatcgccaaatcccctttgcttgtcattagtcaggcttaacaatggtaacagttgctgaaactcgatgaagaactgttacaaagggttcacttttattgatctaggtcaaccttcgcttattagggtacgcataaaattcagaaatattattttaaatttatagacagactgaagctcgtccttcttaacttaagcagcataaaaacaacacaatgtggacaaatgtgtcaaaaagtgatatacttacagaagagactgcgttgatttcatcctcttttcataatgcggattcaactcaacaaaaacacttggacgagatttcaaactttatcacacttaaagttctaataattgaccagaagtattcgatttgatagaaaactttgaactgttcaataaatggtagttggaaaattaaagttttgttgaattgttgaattttatagttcaatatagaatgctcaatctgtgtctagaagagcaagacctgttgtaaagcctttaatttggattggattcgttacacgttacacgttgtaattgctttgaaaattgattcacgagtgatgtttggcattgaagtctctatgcacaaaaaataggcctattgcaagacaatttccgcaatgaaggctaatgcattgaaaaagcaaacagccggctaagaaggtatatttttcaagttgtgtatcattgtgtgtattgtgaaataaaattaaaatgtatttgtctgatggctgagatatgagctgtgaaccattgaaccgctatttttagggggttggccatttttgctcagctccttatggaccgtataccttgctacgacttcattgttcactttgaattatgaattggctactgttatgttcccaaaagataacgtattcattcactttatcgattgtacgtgtttcgcaaacgaaattctacgtgctccactctaaaccaacaagatctttcacttttagaacgtttaatttccggatttatgaaacggcgtaagttagttttccactttcgctacttaaccgctacttttaccgctccattgtatggagagacaaagtgacttaacaacggatcaaaacaaaacactacttgagtcgattttacactgatacaaaaacgtcgtaagtaactgaatgaaacggcttaccactttgtcataaatttttggtaggaaataatagatattacctagtttttgaacgagagctgattgaacgcaaaatttaagcgatgttcacggcaaaaaaaacaattttagaagaagggttgtgattcttcttaattaattttctcaaaaccgtaggaaagttacttacgtcgatttgaaaaagtaatcgagatatggagagctgactgtaaaacatcaaatttcaacgaatcaaattaaatatttcaaaaccatatcagggggcgaaatatatgttggcctcaagagggcgaaagtcaaacattttggttgtttcaaactggagtattttttctccgtgactagattctactacaccacactgaaaacggcattgcagttggggtcaaaataagcgtaaacaccaaaggacacgaactgtagtggaattcgttttcatttacttggtgttattatgtttaatgtcgtttcaaaacttctgccaatatcaagaatgcgcacatcatgcatgagggtacgatgcgcattgatttccaggttatttgttttccataatgctaagagatagacaaaaatactaaaatctgcgtacaacttgataaaatttcttaaccgtaatgaatgaaatgttttcctttagtaataaacgtaatagacagtattaaaatttacatactcaatatttacgcttttgcacggtatgcatcccccgtgcaaaaacagaatcgggtgtattataaacttgtacataatctacatttaaagatgtatcgaaaagaaattagcaacactcaagattattggtctccaagtttaatccatccttttgtatcgaaatttctggcaaaccttcagttttagatagagcatcaagcttcttaaaaatatttgttgtattagaactagattaggatatgaacacattctccgttttaaatttgcacaaaatgtggtttttgaatcagtctcgggctattcgttgatcaattggtcggggttctgctaaaccgcaccaagtgccatttttcccaaattgagtttttttacaccagaggactcaaataatcatagcctttctaccataaaaatttcgagtaatttgaacaattccttgtaatcttagatcacaaattctctttggaaggacacgtaaaactgtaattttgtttagccagagcgaactataaaccaacgcacgtcatcagagggaattcatttttcagatgtaaagctagattcttccattttttttcaattcaattcaatttccttaaaatttatctattccaagctactcataaaaacagaggccagtaaaattgggcagcaattgactaattaaaattaaatattgttttggtggcgttgatctattttcattgaaattttatccagccacaccgcactaagtactgtttatctgaaaatcacattttgacatgaactgaagacattgacatgcaataaatagttacatttgcttgttatataatatgttaatcaaacaacacaggaactaatttaatctgatactgtgtaaacagctgaggtggacttggtgcgctttagttgtacagaaaattgcattttcgccatcaaaccccgtcagacagagtgcacattacttgtttcaggtttatcaccaatctttcaagaagtgaagatgacttagtggcatctcactagattaccactcagaaggcacgagttcgaatcccggtgaaacgtttttttctgttgttccatccgacggtaatgaaaattaaacaacttttagattagtggttatttttatattgcagtaaaacatcagcaggttgatgtacagctgaaatgatggtcattcctgatgaacacttcacgcattgaactgtggacttgatcagcaaaagtgcaccaaatgggagcaacttggtgcgctttagcaaagctaattcatggttttcttcgatcattagaaactatgtatggacacgtgaggaccttgatttaatacatacgaatctttcctatcatagtatataaacacttgtcacatggattacaacatgcacggtgatgataaacatcatctgtctccaattttactagtgttattgaaaactatgaaacacatccaaccataccgaaccaagaaccatatttttcattttttgttcagccagagtgaattgagtgcttcatattttttaataaaatccaactacatcgataatttatgatgatttacttgtatatttaatttcggtttacttattggacacttttaatcgcatgtgagcgacaaaaaaagtaaaattaatcgtccgcgaaaaattagtacacgataagactttgaagtaaaatatcttggaataaagtttttggcacttggtgcggtttagcagaaccccgaccaattgtagactgaatttacacgtttttttttttggttaaaatatcaattatgttatttaaaaaaacacttaaaaaaacccgaaatttcaacagaaacttcaagaaaacgcgttatttgaaaacaaaaaaaggctagtcaacaaaacgcgaactaatatgatgaatctttgagaccctgctacaagataactaaacagtaaaaagtttcactgcttcaaatgaatattaaaaatcatttccaaattataacacctttacttttatgtagcggtcattattggcataaacttggatcaatggaaaagctaaaaaaggagtgtgttgaaaaaagcacttttttcaatgtttgttattgaactaacaggcggatgaaatatttttttgtgcaaaaaatttcgccatatatttggaaacatttttaagagcatgtaagcgtgttttactgaagaaaactgcatttccgcacagtaattgtaatttttaacagtttgacttgtgcgacaaacactatttattttggaacactttacaatattatgacaaaaaatgtaaaaatgacagcgtggaatgtaaacacagcatttagaacaacttgtatgattaacctaacttttagggattgttgcaaatgtagctaattactttccgatacagtccttatatggggccttccttagccgagtagttagagtccgcgactacaaagcaaagccatgctgaaggtgtctgggttcgtctcccggttggtctaggatcttttcgtaatggaaatttcctcgttttccctgggcatagaatatcatcgtacttgcctcacgatatacgaatgagcaaatggcaacttaggccaagaaagctgttaataactgaggaagggctcataagaacactaagctgaggaacaagcactgttccagcgagaacgtaatgcgaaaaacgaagaaccttctttttatttttgaaattcaaccattaagagctatgcatgcaatttacaataattgcataaatcaattaattttcattgcgatttccaaaaccataaacactgtaaatttccaatatcaggagcatccacggtacgaacggaattaaattatacaactttaatgaattgagctggtgaatgagcggcagagaaagaataagagcaaacttctttctgctgctgccagtgatacttacttttatgaaaaggatggacatcaaaaatgtagtccattgaagccttcgtgagctgatttcttgcttcttttagaaattgaatgtaaagaatttaacattctgtagctgctcttgggcatggactccaatgggagaatgggagatctgttgaaaaaaagctatggggattatacaagtcaaactcaacaattctcgttaaatcattaacgagtctacaatggtagacggttgctcttcggattatgatctgtttactttcaactttttggagtcatcatataaaatttctattgatgtaagatgaaatttgaacaacatttgtgccacattgttagtaacgtctacatccacaaggtttccttgctatgaaaacgatgctatcctgtttttagtaatgttgcgatagtagtgaatcacagcatgatgataattgtttaatgatgttgaaaaacatctacttcagtgagacagacgcaataggattgcgtttgaataaattgattgctcgcccctcttgtggacgtttatccgcgttgtctggtgcatatggttcagaaaggaaggtttttcctgcattcctgtaacactgtaaacgctgtctgggctcttgaccataacacataaaatatatcaatctctaacactttcaacggtcgtattcattagggttgatcaaaaattatctattaaggctgaacaatttattttctttcatgttatcacccctctcaaaaactcgaaaatattgtaggggagaaataaaagattcattgtttggttcaaccctattcgtttttttacaatttaaaataaaacaaactctgaaaaacaactaccccaagaacttgagaaggtataaaacagaatgttacttttatcgccactttcttaaataaaatttaaaatgtttgttttaaattaacggaaatatatttttcaagtttgatattagtacgacgtgctacattcattcattataataaaaatcatataatatgtccgaaaagtgagatagaaaattgtgtcgaaaacaaaactggtcaaaagacatcgaaacaaaatgaacacttgcgtgaaatttagagtttccaaactatttaacgactgtcagttgttccgatatgtaaaagggcactccctcaatcataatagctaaaaagaacctatctgggttcgttactttactcaaaaattagatttttccaccgccttgcttatatgccaatttgctgagaaaaacttgaagtcaaatttgaaaggacgattgaagcaaaaactaaacttttataacatcaaacatttcaaatgcaatacagatttcatgtagtgtacgtacttttgttgaagtatgcatattctcagagattaagggggtatccattagtgtgggacaaaatttagattatcgctccaatccactttttggatagcattttggtcccataacaactgtgcaaaatttcagctcgatcggagaaactatattttagcgccagccgttcaaagtttgtatgggatttactatgggaaaacttacttttgcaaagaaaaatcgccagaggtcgcccattggcctctataaaaattctgaacacaaacctcgataggtatttttacgatgaagaatattgcgttggactggagcgagaatctaaattttccatataaccgtgtcccaggctagtatccatctctccccgtgtgttcgttatgccccaaatcccctaactgttttgactttttttccactggagtgattagtatgttttcagttttcgtgttttgcagggctgtgcgcttgtggggcccagatagccgtagcggtaaacgcgcagctattcagcaagaccaagctgagggtcgtgggttcgaatcccaccggtcgaggatcttttcgggttggaaattttctcgacttcccagggcatagagtatcttcgtacctgccacacgatatacgcatgcaaaaatggtcattggcatagtaagctctcagttaataactgtggaagtgctcataagaacactaagctgagaagcaggctctgtcccagtggggacgtaacgccagaaagaagaagaagaagggctgtgcgcttcgaaaagctcaagaaagtggtttcgttcgtttgtttttcaccgccggagcgttttgttttttactttttctttttcgttgcacagcaatgcggagtagtagataaatcgtgttaagtgggagtgtcatacacccttattcttgtttcatattattttaatatacacaatattaaaatattacatctttttttaattttctaccaacatcttttcatcgcgagagaaaaatgcaaacctagtttttagtaagagtcgtatttttcctcctaatccgttgatcgcatcaccgaccaaagctgactcctagatctttttcctccctcactaataaacacccctcccgtggtaattgtggagatgcagaggtattctcggtctctagcagcaacaatcattacacacaaacattcctttcccataccaattgactttgaggactcgaccggcgccattattgatcaatattattaaagctgctaaaatgtgcacttcaagagtaagcagaaaatcccatcccttattcattcggatcgagatgtaattcttacccgttctgatcaatcttctactccgtgatcattgccattaaaagtcagtctatgctatgctatgcagtttaattcaccagcagcattcattttctgcatcgcactgaaatccaacatttgttaggttttgactttatttgttaaccattgctacaatttaatccataatataggatacttacgtatttgccatcccatcaatgttttttttattattgaatgaggaacatttcgttgcgaatgacgaatcttgagcggaacgtgatactaggaattattatttcttgtaaacagtcatatagatagacttttctgtatcgaaatagatcaactattttcaaaaagaatacatttttcggttagttcttagaccttaatatgaatgatgaaaaatcttcagataccctttcccacaagcttgattatttttataataggcaaaagctttacgatttgactcatatttggttttgtatagcctcggaactgattgatttttttgtgaaattaacaggaaaacaaaacaaacggtttgaattattttattaaaacttttacttagatggattgtatagtatgatagattttattatttattcgctttaatgttagcatatggactacatcgtcaaaatgtatctgttttcaggtaattttgccccatttttctacatgttactgaaaaattcgtttgtttttaagatagtttgccctgattatgatttttggtcgtctgatttcagacatttcttactgttcaacagcgtggccataaagcgtatgaatatatctggcttcaacattataagcttttcgaaacaacgcatttataacagtgtgttgtaaaagcaagcaaatttttacaagcgtttttgtgtagctaatgagctctagcaattttggtataaagacacgattttgtaacttagaaatatttgagcggtataatattataatataacgactttacataatttcgaccatttttttcttctcgttatgcagggttttatcgataaaatattctgaaattcggcagtaagatgtaattaaaaatatttttgcatatttttaacccactagcttttaaaacaccagctatgatgaagaaaacaaatctgtcaaaaatacaacaagtctttatcaagtgaatgatcatttgagcatcagggttcgaattccatccccgagatagtcacttatgactttaaaaaaaaagttatagtgacgacttccttcggaagggaagcaaagcggttggtcccgaagtaaactagcccagggttaaatatctcgttaataaatgatgaaaaaatcataattacaaaactaatttatgcaacaatacatagctaacagtagcttgaaattttgaatgtgttgaaaaattcctaaatatgttatgagtagtactacactagatctacaactcgtaattactcacttcgaaaggttttgaaacattttgcatttgtaatacaacgtaatcatcagaagttttactcaattaccaaataaacatccttaatggcaaaaactgacatagcggaagagacgatttcccctttccataaacagagtagctcatagtaattattgtcataaaggtgcaaacagtcaatatactctctatgctagataaagttgtaatatcacctctccatagggaaaatatcctgaaagattttaggaagctctgcatacgtaggatgaagatagaaaactatttatgtatgtatgcgtatagtaacacgacactttctattaatattccctttagttaagattgatataggtcgccatgtcagtcggtcgacctacgtagatcctttcataacgtgatgacattgacgaaactggttctttgcaaattgccaagaggagccaatgaatcttttataagcaacgatgttttattcgttgtcccatcagctcggaagtaacaggaacgataataagccattgtctctggagagtacgtcagtcgcaggcaactggtggtcatatgcggggtatagcgtttagcgaagtatctatatttaccaatgagaaatatgaaaaaaatgatatcgacattcaacttgtttaaggcccaagtaaaaatggagcaaatttcagaactgaaaaagcagttttctccttttaaaccaacaaatcgaacaaaattaaagcacacagttgttttattttccaaatgaaagagctgtgtgtttttattttctttaatttgtctgtttaaagagagaaaactgcttttttagttttgacatttgcaacatttttacttgcacctcaacgttgaaacaccaaacaaatctacattttgattcgtgctaggataatttgttattggctaatgaggcgaaggtaatatttaaaatttcttttatcgactgctcgatgatcaaaattggcacttgagtaaggggagatcccccagtaccgaacagcacccaataccggacattgtcaataatttgagaaatcatggtccaaatgagatggtgtattagaagaaaaggaagctatcatggagaataatgtttgcgtagaataatacatccttaaaatatgcacgcgttttcaaaaaaaaaacggagatgttcgaaagcagataaaaagttgacatatcgccttaaatttgaacttcatcagtaatgattttaaataaggaaaaataattttgaccacgctagcgtattgcaatacaatcataatttgaaagtatgaatatgttttgaaccatatttaaactaaatgtggtcaagctacaaagttgttctgtcctccagtttcgaacagtttaatttgttatatgatatctttgtaatgtttgcaccaatatctcaaaatacatccatttttcatggcttttatcaatcacggtatcaagtatgctataacaataagaagaatgaaagttcagaacaacatgctaaatgtgttatttcaatatttcatcatatatgaaagaggtttttcgatagacgtcttgtagattaagtaaaactccaattaatcctgtaaatttgcgaatgcgttagattaacaatgaaatactagtcctggagtaaatacatgctataatgtacaaatttacggaattcgagacatttccagtttatgttgagtgccaccttataagattggtcaatttattatcaaaataccagggttgttaacgttaattaacgattaacgccgtttcgttaattcgttaacgttgattgtaacgcttaacgaatcttccgttgactcgtttcaaattgttgaataacggtaacgttaacgtttagcgttgatttaacgtcaacggcttcgttatttttaacgttaactatatggtatctggatattgtgatacctagcttaaacaggattgaaaatctttttttttaatgcaaaggaatctaagtgacagtttgaacgatttttagttaaatatactgaaatgttctcatgttttcaagctatacaacaatatttcgaaatgattttttccttgaatatttcttttagaataatttgtaggagattagcttgtttctttttactttcatatgttttgtatgctggaaaactcaaattttctcagaagtaaatttttgccccctcaactgagtacatgagaaaaagcatagaataaaacagtttggtcaatgtaacctcaataaatatttatttattatataatacattataaaaagctgatgtatgtatttcgaagtgctcaacaagtgccatagagagtgggtgcctcatccatcgttgtcttttaagagtaatatacttttacagacaagaactgcctgcaatacgaagtgttgttgaaaacatggccttgaattaaaacaaactgaaagttattcctggttcatacagtacttaggtaggtacatgaattgatccttgatgaagcagcgtgatcagggagtttttcgtttcatgttcatactgatttttggatactttctaccagatcaatttctgtcggtcaacaggagacaccatctggaagacgtaagcggcacacttgagatcggcgtcgtcgtttatccaatcgagaactcggtttataggtataccattatcggtcttgctatagaacgggtaacaaaatggattaagggctagaagtctcctttttatggtggaatccgaattcttacttgatgaccactcaacgatcccgttccaatatcctagtgctgaaattttacggatcggcgcgtgtcgtgacttggagccacttgagtactggattgagacgacggaagccaccttctgattggaaatacagcgaaaacgtatgacagatcggtacaatcaagctgactgttgaatgcagaatgatgaattttccttagaaacggacatgcatagaaacgatttgtttacggaaataacaaaaaaattccccgcagctccagctgataatcaacgttcgattagcgatacccgttaacgttaattaaacgcaacccgttgacgttgacgctaactacagtggaaatcaacgcaacggtgttaacgttgaccaacaaacaatttaacgttaacggcgttgatcgttgattaacgttaacaaccctgcaaaatacatcatcaaaatactatgtcaaaattcgtctggatctccccctatttctcgctgaaacgccataagcacatatcgttagaagttcagttttttaactctgttcggtaaaacatgctaaaacttaagcgttaactcaagttggtggacctatcgtgagccagctaactaaatagtttgccaaaaagaatgggcttttttaataaatctcaggcattccatcacatgatatgtcacttttcttccttggaacacatatgaaacacagtggcatcgtatagaggacgatgtagcttttatttgaagccaaaaaaataggctggcatcttcaatttttccagaaaaccccgtttttaccattagtgcaccgatcgttttgatttctgagattacgagattctaatcacgcatcgattttaaattatagtcgatccaacactgagaaaaatagtcattttttttttaatctcacaactttaaataaaacatgagtaccgttttgattcatattgcgggaaacttctaattccggacactctactttatatgggaaacatttcacacgaaatatttcaatttttgccattcaaaagttttcattttcgatgctattttaataagcttttcaaatagatattattaatgcccaactgccttaggagtctctttagtgcaggcctgcccaacctttttagctctttttcgaaattaatggttggtgcgttcgcaagaatagaccgatatgaacaaaattagtctcaaatgaaagcttggtagtatatttgtctaatccatgctggaaatttaaaatttatatcaatctctttgctaccgatgcaattaagtccaaaaaatgatccggcccgaaggccggactgatttttacctttgcatgcatcgctagcgaagagtttgatataaatttaaaatttccaacatggattaaacagatatactacaaagctttcatttgagtctaattttgtttataatgatctattcttgcgaacacaccaaccattaatgtcgaaaaagagccaaaaatgttgggcaggcctgcttaatggtttgacgaattgatttttctatatatgatttcaatgagctgtctggaattcgaatcacagtgtccggaatatgaggcaaaaggaaggaagcgtccgaaataagaatcatgaaaagaccacacatttcttcttatttaaaattgttcatattacagaatcaaaaccttcacccaccattcgaaagttgagtgttttgaaggcttaataacgtaaaaaaaatattcttcttcttcttcttggcattacgtcctgggactgggacagtgccggcttctcagcttagtattcttatgagcacttcccacagttattaactgagagctttctttgcctgaattaccatttttcgcattcgtatatcgtgtggcaggtacgatgatacttaaagcccagggaagtgaaggaaatttccattacgaaaagatcctggaccgaccgggaatcgaacccagacaccttcagcatggctttgctttgtagcctcggactctaaccactcggcaaaggaaggtaaaggaatcatatagacggatttattttatatgcttttctatgagttatacgtcactaaggccttaagtgtccgtaatatgaatcaaaacggtaaacacaattcaaaaactgtttgatccaaatgcctaagtaggaataactcattgctttttgaatgcgccaaagagagttttcaattagacgtgtaatcgatgtaatatgtaatatggacaaaacactttcgtatgtttttaaggagatcaatcaaaacttttgcatgggaatgtacaaccagattaattcagcattaaaaacaaaatattgcacaaattggcatttgcaattgtgtctgcaatgatccaagtagaaaaaaaaataatatcgacaaaatatcgtatcttatgtcgcattagttgatacctattcctgattttcttatattttcgacttacactgcggaacacgtttttgtctcaagcaccgaaataccactatttacttaattaacctttcggtcgtcgcgcgaatttttgtaacgcgagtagtcgcgcgttgtactttgtacaacacccttggttttgcgaatatcccaggagtctgaccacttagaaagatggcgtcttcggcaaagttgctcagtaacttatggactttcattgttagagctagttgattcaaaattttgccaccaggcggcgctagtgagcttaaaacatttgtgtcgcaaatatctcaggagcctgatcacttagaaagatggcgtcttcggcagagttgctcagtagctcaaattatttctttgtttaatccttaaagttcgagattttgtaaaataatgatagttcctgagcttctaaacaactttgctgaaggtgcctgtctaaaaagtcaagattctgcagtatccgaaatacaaatatttaatgctcaatagcaccgcctggtggcaaaatatcctatttcttggctcaaataatgatagtccttgagctactgaactactttgccgaagacactatctttctaagtggtcaggctcctgagatatctgcaaacaaaagtttcatgcacactagcgtcgcctagtggcaaaattttgaatcatctagctcgaacaatgatagtccttaacttacttaacaactttgccgaagacgccatccttctaaatgatcaggatcctgaaatatttgcaaaacaaaagtaaaactttcatgcctactagtgccacctagcggtcaaattcctaattaaatggggtaccatcagatagcgcttcacctccagaacaactttactaaagaccccaagtttctatatcatctggattttgagatataccgatttaaaactgtggtttactcgaaccgtacatagtgcgttcattattatgcgactttcatgtacatttgttgattttaccgcaatataaagggtcatactgtaaataaaaactgtcgagtattgttcttaaaaagattcttgaggaatacattttggtttggtgtcgatagatatctttgttgcaaaatgatagcatataaatcacaactgttgtacaaagtacaacagcgcgacagcccgaaggttaagggttgaatccattgccattttcataaatgtcatagcacgtctggttttcgagatattagctgttgaaaatgtaaaattttactaaaaaaaagcttaaaagttattttttgatggttgatggaaaagtattatattttgtcatataagagaaacgaagaattttgtatggagactgcaagtatgttgaataaaaacgatttaatccaaattttatcgtgcaatttcaaccaaattatatctaaaatgaaagttaaagtcctattctgcatgtttggtggattatatcataaagaaagattgataaatcattgcttaaatttcatgtaaacatcaatgaaaccagtgttttaagaaactttcgcgacatgtagctaaaaattgtaaagtgctggagcatttctaagactggcatcagcttcagtgaccccaattctactggagacacgcaaaaatgtcatttttttacgcaatattatcaatcagttgtaagattcaagttcaataaccttaaattgagtgagttgcataactttttaattttggaaacctactgcagcaattgatcaagtttatcatatttaagtggaatgctaggtatcctgatcatcaatttgtttgtaggctaaactcatttttgttttaacagttggtgactatttttcaatgcactccttaaacgaagctaaagaaaaaaacaagcatacttgagattacgattacaaaacagtagcatgttcccttatagttcacaatacaatgatcaaaatatgatgaaaattgctctatttttaacgtattcacatcgacttttacaaagacaaccaaatttgagtatgttttaataaaatttcgttgtttccaaatagcatggtaaaagataaattattaacagatttttctaacgtacttagaaacgtaagttattgtggcatttgaacgaaaaaagtatttagttttacatacgaaatccagtttgattgaaatctatacttattgggcaagtgtgccacctatttggtaaacgaaaattgttggagtgaaatttataaaaatgtaaacattatcaacaaaattataataataaatcaaaatgaggcaccagtagtggtttctgaagtatagtaggggaataactgagttttttgtcctcaatgtgttttttttttctcaaaataacatgattttcggcttaataagtaccgttttacatatatacatcaatattttaccgttatgtagtgctgatctagtgtaatattatacatattcgacgtaatattagggtaatacatatactgtattgaatggagacaaaaataaccattttaggttttcgaatttagcaattgagagttacgcttgtcttgaatcttgttataaagcattcccttattacagtaaacttaaaattatttttaaactatcgattagcatctgctttttaagtaatattaataggtaataaagaaaatttcattacaagtagaattacatgcgatgttcattcggtggccgtcttgtcccatagtgtcgaaaaataggatattttggatgatatttgagaagctccaaaactaatactttttgaagttattttctttttaaatggcacagtggttatacaaagatgtgaaactaatatcatgaggctaaataggtggattttataagctttaggcaaagttagaaaacaatttgcttaaggtggcaaccttgccccaaattccactatttcgttcaacatactcagggtacattcatatattttatgacgccaaaaatgatcattttagatacccactcactccttcgggacgctttttgtattcctataaattttgtatgagttgtaacatcatgaggacacccacccaccactttcagcttttatgaaatttgtgaaatagccctcaccagatgacgatgatgtgaactgggcaatggattttaaagaaatttgtttccagtgttacgtctctttgtctgtgtttacatcgcatagggtgttttatgtattttggacagagcgttactcgtaaataatttggccacctccatttgattttgccgcaaaagtccaaattatatacgaataacgatctgtccaaaatactttgatcaccctaaagctttacttagaagacttcaaaactggattataacaccgctttgcaatccaaatttactccacttcgatatttaccatataattctggtgttctaacgccaaatatgaacctgtgttcctatcaggtatataaacaaatacgggtatctatttgccaatccatattagtaatatctgtgcagttatcgaacggatacagtaaattcacaaaataattaacctaacacggtcgacatggagatcacttctccttcctcccctgatttgcataattgaaaacgattaattcaatgccgccacatatacactcacctaaccaatcgggtccagctcgaacatgaactgaggctgatcggtggtcaaacatgattatgtgtgaacaaggagaaaatgccacaaggcacaaaatactaccgcatcacacaatgtcggcattccgacaaaatattttccctttgaagttgcggtacgctctctttcggcgtgaatgtgtcataaattatgctttattattcttctcgacactcgttctgccggtatgccacctagaaggaagcttattattcgaccgtacgtgtatcatatcggttcgaaatttgaactgaacaaggggtctctgcaaagaatgggtctctccagcctacctaattgatggaacgccttctcgttggaacatttctcttttttttctcagacttgtaaatgattaacttttacgtgcacgctcactaatgaaccgcagcgaattgtttttatgttatctcatcggattttgtccttcatccgaagcttgaaactaacagctccaaaaattcaatcaaccatacaaacaaatttggtggtgctaaatgctgcgctgcatttatccttggcaaacaaccgctgtataaggtaaccgggtaaaatacgccaaaatgtttgaaattacaacgctttatttacaagggattcaaacttattgtgtacgtaaatttgataaggaatttaaaatacagcggataggcaaaaggattgagataggtaaaattttatataaattcaaatggttataacattttggaaaaaatgatgaaatgggatgcgtccagaagcatttggaggaatacttggtcaagtttcagtatcttgcttgaccatgcatcttggccaacgaacaccgtatatgttccggatttttggaagccaaaacacattttgtctaagtgaatgagaaaccgaattgagtactataccatttaatataaactagaagtcgagtctagtacacgacactgaagacggtcgaaatacgcgtatctgtcgaaggatacaaactctagtggaattaaatggtacctatagtactaaattcggtttctaatttacttataggtattccactaaacagctcaaagatttattatcaacattttttctatcgctcttgtatttgtgtgatgtaaagtttaattgaaattcataattttcatagaaactagaaccaattgatatttgaatgccagtggagaggtttttttcaattagggtaaaagcgccggttttggccagtctaagagaaaatgtcgataaaaattaaatggaaagccgtatttatactacaaatatgtcaaatgcaagctttcaatccatattatgtgtgtaaatatcaaaactgagctaaaaccattttttcgctttgaaaatcccgttggtcaatataggtcaacggaaccagtttcggccagagatttaacttcggttcctaaattggccaatcacattgatttctcataagagtggccaaattaggagtgccctggccaaatgaggtgtatgggagttaaaattataaggaaaattaattgtttttcttatgttttgaatcaatttggacgggtaaatgaatgtagctctatctagtgaatgtgatctactgaacacaaaaggtttcatgctgattggctatgtaaaacgatgtataatcccctatggctacaactggcgtatggccaaaaccggtgcttctaccctatgctaaagcgaagatgaagtttaacaatcttccatctacaatgactttggatgatagagcagcaggtaatccaaggatcgtttatctttttgttacttttttccaagagactcatacaaacttttcggataataagctccgcgaggcctgttttgttcggacgggtcactcaaatattcttttaatgtgcgagtaagggtgagcattagagtgatgcaaattttgaaatgtttgctcccctatacttaaacgattttaattatggtaaatagcatcctcccaaagtttgaagtgattcggaagaaatttgactgtgcacacgctatttgaagtttacatggagattactatggaaaacgccaatcttttgtattcggccctctatctcttcgtcaaaatattttatggaaaagtgaacaaattcttctaatgtgaaatcctcccacctacaactttgccgaagaccactttttgattggacgtcaggataaattgttattcatcatcataaagttggtttgcatgtagcatgcttcaccaacggttcggcaggcaacagtggtgctcctggcgggaagaatagatcaaagtattccaggctactatgttctacagcaaaaaagcagtgttgctctgaaagtaattgaatgatcatctcagcatgatttagactttgttatcaaaaataataaattatccttacgtcccatcgaaatgtggtcttcggcaaagttgtagctgggaagttttcacatgagatgagtgtgttcacttttccatagattattatgacgagcagttagaggaatgaacacaaaaggtttgcctagtaatttccatataaacttcaaatagcgtgtgcacaaccaaatttcttccgaatcacttcgaattttggaggatcattttcatcataattgacatcgtttaagcataggggaacaaaaacttcaaaatttgcatcagtctagtgagcatagaagcaaaaaaaaatctcgcatttcgatgcacttgcactcgaataatttgaggattcttgttgtgagttcaacttttattgctgagaaaaatctgtttctgtaaagtctgctggtgatataaaactttatatagaaatcaatagcaagaaagacagtgacatttttctgaattaaatacgttaatatcttataaaaggtgtagcaaaatcatacttttattaaacgtcaaaaaatgtattctaatcacatacagcagaaaacgaagtattccacagattactatcactttcaattgttgaaaagtacgataagattagagatttaagtgttatgctagattctaaacttaccttactgacagcatttatcctttcatttgtaaatcatgtatttagttaacatctaaacagataacactgaatcaacaatttcacgccacaatactcagtacgtggccgcatctctccttcctcggttctgccccacgctcgccaattcgatgcgcacttgatccgcccacctgctcgctgcgctcgaagccttcttgtaccgaccggatccgaagcgaacaccatctttgtagggttgttatctggcactcttgcccaacacattctacgtcaaataaataaataaaacttcaacctcaactgtaaggccgtcttcagtgtcaagtctagtacatgacagtgaagacggccttacagttgagttcgaaatacgcgtatctgtcaaaggatacaaactctagtggaattcttccagctttggccaccctctggatactggattcgccgtagagttgtgcgagctcgtggttcattcttcaagtgcttgcaggtcctcctcgagcatcgtccacgtttcatgcatatagataacacaggtcttatgagcgttttgtacatggtacatttggtgcgggtgtgcatcttttttgaccgcagcttcttgtggaggccatagtaggcctgacttccactgatgatgcacctccatatttcacggctaacgttatcatctgatagagagagaggaggcagttggctcagattgcgagctcttaaaagtcaagggaacctatcacaaactgttactggaaaactgcacattcgaaagactgagcgtgaaaaactgtctaaattcaagtaaacgtaattaaaatttctaggtatttttcgataatttcacatttcaaaaaagtttaatacctaaatgtagttgtgtgttggcaaactgctattgatttttttttatattcatatcctttttcataaggaacaacaacaagcgaatatgattttgaccaaaataaattcatccgaccgttgtgcacaacccaagaacaaaagaaagaagtcaaagaaggcaagaaaacatgccaactgtcagtgagctgtctcctctctctcaggttgtcatcagccgtcagcaaagatcaaaggttgacaaacatcttctaggggaaaaccaccaattttcgacccagcactaaattttcgacccatccatacgattttggcctactttgtatgaaaatttgaaaattggcacagaattcttgaaggtcgaagattagtgcttttcccctacaagttcttccacataaaaattaaagatattttttttttataatatgtacagaaactttacaagcttttttgtcttattttactttgattttttatgatcaattgaattgatttgaaagatacttccatatgtttctgaaagtatgaaaaacaattcacaacagttaatttacctataaccgcatatcagtaacaactgcgaaaattaggtatcaaaacaaataccaagttgttttgtcttgttgtggattttaatgctagtaagaaaattgaggcattttcaatcaatttgtttttggatctgttcatcttaatgaatttcttgaaaaaatgcaaaaaataggtatcgttaaaattttattgaagaaaaacgatacattttcgatgaatttcctaaacattgtattgatttttatgatttgatattctcattgagaaatcatgcaagtatttgttctgagctagaaaatttataagtcacatttttcaaataaactttcggtattcctgttaacgttaaacaacattgcatttttccgagttttgtagaacaaatttgcaaatttcaataccactactgaatgcgggattaactcaaaatgggcaaaatgcaaatgttactgatcaaatacaggattatataaaaaaatttaagatccttttcaagggaatgtcgtacaatctgtttattatttattgacaatatgtaagaacaataaactctctctctctctcattagatatttattagatcatcaagttaataagataattagttattgaacacaaaatcggtgcaactttccatgataaccaacatttactggttctataactcgatattgagttatgaagagaagatagtacattaggttagctataaatatttccaaccaagcgcactataaactagtcgaatgttaaaacatatattttatcgtggcggatattctccttccatcgaccccttcaatttaatccttaaaaaacttttggatagttggctatccgtgatgtagtaatattattttttattaaacctgcaaatatttatggttccgttacaggttcaccggagatggcattcgtccatgcgctggcggcggctgctgctgccagttttatcgctcgcgcctgccgtgacggacagttagcatcatgtggatgttcgcggagctctcggccttcacaacttcacgaagattggacctggggtggctgtggagatgacatggaatttggttacaagtaagagctaccacatacaggacaagggccaactttactgaattttatgtaataatttatgaggacaatttccagcagtgatacgacaatgcatatcaaatcgatgttcaacggcaccaaaaagcgagagcaaactaagagcttaggcttgtgtgtagttcggctgccactatgccactgaagagatgcaataatttcacatcctaaatgacacttcacgtcgaaaacacttatggtttttatgataccctcgcatgtaatcgttagaggttgaaatttgtgtgcgaataatgcgttaccaaagtcatccgacgtgtttactttttcccctatatacccttgcttctggtagtatgatatcaagtatatgcaccacgagcttcgtatcatacaacgttcaacgtataatccgctatacgttttatgcattcgtattcaaaatcaacataggcgtaaaccaatttcgtgaagaggatgaaaaatgtttcgaagatataaattgtaacattatttgtactgttcattcaagatcatccatataaacatttttttcttcacgtgtacgtgtttttatgtgtctcatacgaaaactgtatcgaaaagtaactagcaacattcaagatgcttgtttactaagtatatagtataaaaaacgacaataagcttcttaaggaaattagttttatgaaataaaacgtgtataatttgcgcaaaaagctatttttagcattttcagcttgagttattcactacagagggattccgttgttttgggcatgctcggcggccatttttaattaagccgccatcttgaaatttaccagaaaaacattttttcacctaaattcgtattgaactcagagatcaccatcagaaagttgagagaaaactgggtaaaaccagcttcaaaaacaaggtaactatttaccctatgaaatgaccaattttcaagtccagtaaaaactgaaagtattattttggaggaaaaacatttggcggccattttggatgttaaacatgttgaatactaccgttacgcttcctcgtcttattcttgttctttttcttggcgttacgttcttagtggaccagagtctgcttctaagctgtgagagatgtgtaacaaatttactttggatggtcaataaaaatcgatataagtgttcagtcacagaggaccaagtgcttatttccataatagcgaaaatgatcaacgcgcatagcaatgcgaggaaatgaaaaacatttcaagagatttgtcagatttttcttcaacgaatgattcatctacttatccatcaatagaaatttataaataatacttaattcgatgcatttgattttgattattgaccatttacaatatttggatgggtggtcagaaattgcaacaattgctgtgcagacagagcggaccaagtgttgaaaagcactaaactgattgattattgcatttttttgagtcaatttcagagttcgatagaagcttatggtatttctatggtgtatgtatggaatgtgctagaacccgcttattggatcagtatattttggtcgctattcaagattttcgcttggttcactctgactgaacacatatttgaatatttctggtcccatgattttttataatttttatttgtaacactatgaaattttgtaaactatctgaagataaataaatgaactactactacttcaatgcaatgaccctgtaataccttaatgttcaagctatcgtaatgccactgatttcggtattgacggtatggattatagaagaatacacgatactggtgtcgaagggtcttgataatctgcttatcttatagatatgcacacagtttgactattgaagcattatatgattattattttcctcgaaattgttcagccagagtgaaccaactcactgaacgatgatgtttagttcagtcagagtggaccaagtacacatagtccatcgaaaaatcgttccattagaggtttggattatgatttttcatgattatcacttcacattatattgtttgaaagtaacacaaagatgtgtagaaatattgaaccaaaatttaaacgagtttaaaaattacagagctttacactttaaactcatttttttcaaaatatgaaaaatgtcacttggtccactctgacttaacgccgaccatttcatctcaggaccaacggctatactttccttccgaaggaagtcgtcactataacctttttgtcataagtgactatctcggggatcccaagtcctcggcgtgagaggcgtgtgatctgaccactacaccaattaattataaaaacaaaatattaaataggaagacatttttcctcagttgtactgaaaaaacatggcttcttttctctgcattggatcaaccaaaatgttaaaccagtacgacattagactcatgatcttttaagagcacttgaaaaattagattataattaaattttgcttttatttatttgatttattttcaaaatactaaattttcctaatcattgcgaataaacaaatttcttgaaacatgaaatttgacaaagtacttgaactctttcttacgaaattttaatggaaatactcataagtgctgaactgtaacgtaacacgccagaaaaaagagattgttatctgagtacatccaaacaaagattttcgaaaaaaaaaacaaatatttttacatgtttcaagattaaaactgcaaaaataaccataaattcatttttttctccataaaatcattagtcaaatcaccctttagctgagcaattctcggcaaccatcgttagaactccaattttatgtcattaatcgctagttttcgataaaacttaagggtggtcctatcagttttctcaaattggtagacccctcgttcgccagctagctaaacagtttgcgaaaaagcccattttttgataaatcttgggtatttcttcacatgatatgtatcatatttgccttggaacacaaagcacacatagtggcatcgtatagagaaaggatatagctttcatttgaagttaaaaaaaatttggcggccattttgaatttggccaccatcttgaattttgttagaaaaatcgatttttcaccattagcgcatcgctagttttgaattctgagatcaccatcagaaagctgaggaaaaatggcgtaagataggctacaaaaactagatgacaattggtatttacgttatgaaatgaacgattttctaaatcatgtttcacgattttaacgtatatgcaacgattttgacgtgtatgcaatcaatgcaaacatatttttttgtaaacaaagaaacgtgttttcaatcgttggtgttttattcgattcagatgaagaatatgagtagggtaagtgttcccttagttgtgggtgttcctatagttgcggtagtgtcgttttcactgattttattacattagccacataaccgatactgccaatcgacgtattggcttgtttatgcacggaatagttgaaaagagcgttcaatttgctttaaaactgatgaaatatcactaaaattgctaaaactttacttacttgtaccaatagttgcgataaagtgttcctatagtggaggatcccataagaaaacaacggataccgcaactataggaacacaaatttaaaatataccgcaactaaaggaacagtgtaccaatagtggaggtattattttccactgatatgccgtggattactgcgatgaaatcatttttctcattaagtcaatggccgttacttcccgttacaacattaacatgtagattagttgcgtttcttgaatttaggcggttaaatgaagttcaatcgtgcttagtacctccactattggtacatctaccctactattttgaaaaaatctggtggccatcttggatttgacgccatctcggttttagaatgagttttcaccttgttagcacgcaacatgttaaattttaatgttaccgttacattaactcttcttcttgtccttctgtttcctgacgttacgtccctactggaacagagccagccacccagcttaactagcgttaaagacaaattatcaaataggatttattaacgcttatatactatctgaatgattcttctgcatatcttcgagttgaaaaatagcattatttggtctaaaaccattgatagaaatgaacaatcagttgaacagctgagataagataagaaagaaagaatccgattgttttttttaacgaaggcttcaaaattcaacaatgagcgctagatggttaaaaggaattcaattgctaaaaaccaagatggcgttgaaatccaagatggccgccggatttcccaacctcaaaattatacacctgcgtttcggcataacgtccacattagaacaaagcctgcttctcatcttgcaatttcactatttttcacatgtatgttgggcggtagtaaaaacgatactttatggctcagaaaatcaaggatttttttgctcaaaaacttaagatttccattctaaattaatgcacttttaacaatgttttacgttaaaactacagatattaccacaagacttactaatgtcccaacgcgcaatccataaacttcatttaatgaaaaacaatgcttatggtaaacaaaaagtttgtttatttcaattaatgtttttggacggttttcctttattgagtttgtttaatcattattcctgaaggcaaagatatgtcgaagaattattctgttttaaaaatttacattataaaagaaaatttctgttcagtaacctgtgtttataactaataaagctgagaacagtctcggttccgttagggacgtaacgttaggaaaatgaagaataataagaagaagagtatacgtaactttgtttttgtttggtaacctctaaattcgacatgttgagtgctatcaaagtgaaaaattaattctactacttaaaatcaagatggcgtcaaaatccaagatggccgccagattttattactcaaaataatactcttattcttcactcgactcggataaaacaccaacaactgaatacttgtttctttgttgtacaaaatataatgtttgcattgattgcacttgccatatatgtcaaaatcgtagaaaatgatttagaaaattgttcattccatagggtaaataccattgctcacctagtttttataacctatcttacgcaatttttcctcagctttctgatggtgatctcagaattcaaaacaagcggtgcgctaatggtgaaaactcgatttttctaacaaaattgaagatggcggccaaattcaaaatagccgccgaaatttttttaacttcaaatgtaagctatatcctttctctatacgatgccactaagtttgctatgtgttccaaggcaaatatgatacatatcacgtgaagaaatacccaagatttattaaaaaatgggctttttcgcaaactgtttagctagcaggcgtacgagggatctaccaatttgagaaaactgaaaggatcacccttaagttttatcgaaaactagcgattaatgacataaaattggaattctaacgatgggtgccgatggcgacctggtttcagcgagaattgctcagcttcaaaaagttcctttacacttattagccatttaaaatatttttattcgtttttatgctgctaattgctttgatacatgccttagattctaacatcatatctaaggtttagatgatacatctaaaacatgcgtacaacgatttgtcaaatcgaaaaaacttcaaaatgggacatatccttccaaaatacgagattcaaatgacaacataacgatgaaaccaattgctaaattttcgaaaacaatgaatacatttatttttctctttcgttacggcttacccttaattctaaaagtgttgatattcaaaggcctgaattcgaagaacaacaaaataaattacacggctggtgccaacctcacacacgcctatgataattctaatatctgcagcgtatcttttgaaagagcaggcaagaattgggatcattggtgtcgcgcagtgcgcatcgtaccttcgtgctgtgcgtacacgaattctctctgctcttggaagttttcttaaaaactacctaaagcaataaaacagtacttttcagtgctacaaaaacagtacttttcagtgctaaaattaaaaacggtacttttcagtgctactaaaacagtacttttcagtactatttcttctactattgatccctttacgatccttgtttggacccgtgccttcgatttttcgttggacccgttggcgaaagctagcggtggtaatccttcttggacaccgtcttgggaaaaaacctttcgaaggtcacgtcttctttcgtttattaattaaacatggtatcaacaacaaacaaaaggaagggtgaatctctgaattcactacttccttccaaaaaagtgggttttaaaactgtcactacacgtggcaagaatggaagaaaggacgcttccccggaatgcgaactttcttccaaaggtgaaatgaataattgtatcgaaatgagcaatcagttcgatgctctagacaaattttccgaacaccaaatcgaagcagcctctagcccaggctctttgattcaagtgaggaagcaaagagtgccgcctatcgtggtcagttgttccgaatttgggggatttaggcaggagatcttgaactccattaggggaatcaaggtttccttccaaatcgcaaagaaaggagactgtcgcgttttgccggaaactcttaaagatcgtgagcttcttctcaaacatcttgaagagaagaagcacaaattttttacttatgacgacaaaactgaacgtttgttcaaagttgtcttgaaaggtctctcaagtgactataaatcacctgatgagatcaaaaatggaataaatgatttacttggattttccccagtccaagtaatcattatgaaaaagagaacccaatctggcattgttcggaaagggctttctcaagaattttatttagttcactttaacaaaaaagaactaaataatattaaagctttagaaaaagcaaaacttttgtttgatgtccgtgtgacatgggaacatttccagaaacctggaggaaattaccagaaccccactcagtgccgtcggtgccaaaagtggggtcatggtactaaaaattgtcgcatggatgctaaatgcatgatttgcggaggttcttctcacgccaaagacgtctgtccagtgaaggaagataccaccaaattcatatgttgtaattgcggggctaaccataagtccaatttttggaattgtccttcacgcaaaaaggtcattgaggctcgtgccaggcagatgaaagataatatccgttacgataacggtcgtttccggaatttgcctggtagagtatcgaacaatgctcatttttcagttaacgatcgcttgatcatgaatcatacccatcaggaagatcataatcatgctcattcacaaactaattttaatccgtcgggtagccgtttgaatctttctatttcgaatgtatctacccacggtaaatcctttgccgatatcgtagcaggaaattcgaactcctcccctgttcgatccatgggtacccattctacttgtttcaaatcaaatggaaaaaaccctaccgccacaggtaactccgcttcttcgtctaccggaaattccaatgggaaatcacatgacatgtctgcctctgattttaattttctaactgaacaattgaatcttatgattgatgcaatgttcaaagccaccactatgactgaagcagtccaagtaggtgtaaaatttacaaatcaaattgttattggattacgtttttctaatggatccaaataataatttaaatattttaaattggaatgctcgttctctgaatggtaaagaggacgagctgtttaattttcttacggttaataacgtgcatatagcagttattaccgaaacgtatttaaaacctggatctaaactcaaaagagatcctaacttttttgtttatcgtaatgatcgacttgatggggcatgtgggggagttgcaatcatcattcataggcgtataaaacatcaactgtattcatcatttgaaactaaagtttttgaaactttaggtgtttctgttgaaacacagtttggtaaatatactttcatagcagcctatttgccttttcaatgctctgggcagcaagttaatttgctccaaactgacttgcgtaaattgactcgcaataagtcaaaattttttgtcattggtgactttaatgccaaacatcggtcatggaataattctcaaagtaattccaacggcagaattttatttgatgagtgctcttcaggatatttctcaattcaataccctgatagccccacatgtttttcctcttctagaaatccatctacgattgatttggtcttaaccgactctagtcatctttgtagccaactgattactcatgctgattttgattctgatcatgtccctgttacatttcaaatataccaagaagcgattctcaatcctatcagctccactttccattatttacgagccgactggaatatatataaaacgtatgttgattccaatcttgatgttaacatttctttagaaactaaacttgatattgacaatgctcttgaaactttaacaaattccattgttgaagcccggagcattgcaattccaaaatgtgaagtaaaatttgaatccgtgattatagacgatgatcttaaactcttgatccgtcttaaaaacgtgaggagaaggcaatttcaacgcactcgcgatcctgctatgaaaattatatggcaggatttgcagaaagaaatcaagaaacgttttgctcaattaagaaacaaaaattttgaaaataaaatttctcaattggaccctggctctaagcccttttggaaattatcgaaaatcttgaaaaaacctcagaagccaataccggcattgaaagaggaaaacaaattattactaactaattgcgaaaaagctcaaaaacttgctatgcagtttgaaagtgcgcacaattttaatttaggacttactagtccaattgaaaatgaagttactcaggagttcgaaaatattctcaatcaagagaacgttttcgaaaatgcctgggagactgatttggaagaagtgagaactattattaaaaaattcaaaaacatgaaagctcctggcgatgatggaattttctacatcctcatcaagaaacttccagaaagtagcttatcatttttagttgatatatttaacaaatgttttaaattagcatattttcctgacaaatggaaaaatgctaaggttgttccaattttaaaaccagacaaaaatcttgcagaagcttctagctatcgtccaatcagtttgctttcctccatcagtaaactttttgaaaaggttattttgaacagaatgatggcccacatcaacgaaaattcaatttttgccaatgaacagttcggattccgccatggacattcgaccactcatcaacttttacgtgtaacgaatttgatccgttccaacaaatctgcaggctattctactggtcttgctcttctagatatagaaaaagcattcgacagtgtttggcatgaaggtttgattgtaaaattaaaaaactttaattttccaacatacattgttagaataattcaaagttatctgtcaaatcgtacacttcaggttaattatcagaactccagatctgaaagacttcctgtaagagctggtgttcctcaaggcagcattttgggaccaatattctacaatattttcacatctgacttacctgagttacctcagggatgtcaaaaatctttgtttgcggatgacacaggcctctccgccaaaggacgaagcctgcgtgtcatctgtagtcgattgcaaaaaagtttggatattttttcttcatacttgcaaaaatggaagatttctcctaatgcttccaaaactcaactaataatattcccacataaaccaaaagctctttatttgaaaccttcaagtagacatgttgtcacgatgagaggggttccaataaattggtcagatgaagttaagtatctagggctcatgctagataagaatttaactttcaaaaatcacattgagggcattcaagccaaatgtaataaatatgtaaaatgtctctatccccttattaatagaaaatcaaaactttgtcttaagaacaagctgttgatattcaaacaaattttcaggccagccatgttgtatgctgtaccaatatggactagctgttgtaataccaggaagaaagctctgcagagaattcaaaataaaattttgaaaatgattctgaggcttcctccctggtatagtaccaatgagttacatagaatatccaatgttgaaacattggaacaaatgtcaaatacaatcattaataatttcaggcaaaaatcgttacaatcttctattgccacgattaatgcgttatatgtttaggttaagttaggttaagtatattaaaaacattttttttctcttataagcaggtgaaatcaactcacctgtaaaaaaactgaactgctacggcaaatgaaatgtaatatgttgttaacaaaatgttaattaaatcttaaatttgttttaccaaattaggatgatagtgttgtcaaataacacagaacacctagatataagaaatgaatgtaatgtttggaatgatactaataaagaaattaaaaaaaaaaaaaaaaaattggtgtcgcgtttgttgaagtgtgttgatctaaccgtcaacgacttttccccctctcatccttaggaagagaagttcgcaacaatatgacttttgggtgaacataagaaaatccatgccatacagaagtgcaatcctacttaaacgggaaaataaatacctacccgccttcccaatgttggcagcgcagatcgtttccgtttacacaagtgtaatgcaaagaacaaactttcccagactggggtacataaattatgctttaagttgtttttaatattgcgaaaatgtggttctgaaaaaaatgattttgtttaaggagcgatatttcatttcatcaaaaggcgcatatattaagcgtcatggatgtcacatgtagggagactgttacgctgtttatctcgtgcttctatattcatctttttttgaatgaacagtcatagcacgtgctatcgtttaacaaaaaataggaaacaaagcaagtctttgtgttagatcaatatgaaagaatggaaatataatttcaagtaaattcgtcatattcttagcactaggtacgacaataatgaaaagtctaataccggaatgtgttaattggattgcttattgcacactaaaataccccacttctctctgtttgataacgtatggaaaacataataccacacaatttccagcagtatccatgttaaggagaaatataatttttattttattgtttagaaaacctaggttggatatatttgatgctctaacttcctactgtgattaacttaaagatatcactgcggaacacgtttttgtctccagcatcaaaatacccctatttacttaattgagggtagctgaatccattgccgtttacataaatatcatagcacgtctagtttttgagatattggttgttaaaaatacaaacattgactatttcacccaacttgcatgcaagtgtgctagcttgtaaggcaatttatgtgcttaatttgccacagaattcaaactttatgtgtataacaatactaatcatcaaagtttacaatacttttggtgcggaaaagttattttttgatggtttagaaaagtattgtgatttgccatattagagaaacgaagaattttgtatggagactgcaagcatgttgaaaaaatcggtttaatataaatttaatcgtgaatttcaaccaaaatatatctaaaacgaaagtttaagtactctttgcatgctcggtggataatatcacaaaaaagtttgataaaatatacttaaaataggtaaacatcaataaaaccaatgttttatacaactttggcgacatgtagctaaaaattgtgacgtgctgggaaatttctgaaaacggcatcagattcagcaaccccaaatctgctagagacacataatttgatccttgagacacgcaaaaatgtaatttttgttgcgctgtgtattttgacttttccttcaagtttcaatctgtaaacttattttcttgtttataacagcaaaagaacccaatcaggtagagttgaaaacattataaacattgttattattacgtggaccaatttaaaaaaaatccctagaaatcttgatctgagttttcgagtaaaaattccaatataatccttattaaaatatcgcaatagcactgaaaaaccctataaaacgctcaaaaagttggccacactattctcaactagtatacaattgttatcgttgttgtaattaaacatatttacaactgactcaactgactgagttatgaaaaaaccataactcaaaactttaagtatggttttttcatagtttactggtttaagtttaattgattgttgttttctatgataaaccgattgaaaggttaaacaattaaattaacaattaacaatgttgtttttttttgaagcaaaaggatctgagaataaaagtaacacaaaaattgttagaagataagccatgtgataactgactgttatagtcgaatagagcaagtatcaatcgtttgtttctaaactggaatgatttggttgctctgatacgctcacgtcaatatcagaatgaacatacacggatgacttccacggggccgttgacctcaacctgattgatgcaactttttcttccgccattcgaactaattgaccagctcactgaagtatgcctattttattcgcctaatagtctttcaaataaatgtgcttagagagccaaaaatcagcgttttgtacaggaaacattgacaataatgtttcatttgggcatgcttgcattcatcgttgctctctttgaattattattgaaaactgattcagtgttgtacgataaaggaccgcgaggtgttttggcgaagttgttaactaaataatggatctatgaagtcagataagcatttatcatgcaacagcgtagaaatgtcgtttccctttgcaatttgcgggtccctgagctggtaacatcaattgtatatttatttatttttttaattttattctattaaactaagctaactggtttaagccatgtaaaaatatacttaagccaccctggtaagttaagccaattgtaaatatttctaattacagtcgactctccacatctcgatatctctccctatgtcgatgattttttcggtcccttcattctgcatacattttcactctccgatatcctccttatctcgatatctccctatctcgatgtgattttcattcccgattttctctccgtatgtcgatatgcccattaaaaaaattactaaactggattttagggattcaaaacaattttcaaagacgaaatgccgtctgtttgtttttaattttcctggtaacggagtgattttcaatctagtattcattataaaattgttctatgtctcgatctctccctatctcgatggttctttcgatatcgagatgtggtgaggtgactgtataataacggtaacaattgtacactagttgaaacagtttgcccaactttttgagcatttttgtaggttgtttcagtacttttgtgtaattttaatatggattatattgaattttcaagtcaaaaacttcgaatcaagatcttgagattcctcctagggatttttttttaattcgcccagagttgcagaatgatgagttgttttcaaattctccttctcaagaaaaattgcacgtttaatacggatttaaaaggtcagtttagcaattaaacggttcaattgactagtggaaaaattgtgaacacctctttcaggctcgatttttttatcaaaaatcattcacgtgggttgaaaaaaaacagagaagtgctgaagtaaactaattatcaatgccatgaatctcaacgctaatataacagaaagttatttatttaagacaggcgttttcagatcttttggcttgcggagcacttttcagtattgaattgcgcgggcacctgctcatcaagaataagataaaaatataagttgggtaaaactttatatacagttatactcagggattgaaatctgcgaaaatttagagtatctctcacttatcgctctctgtaacaatcattatccactacacatcctgagagtctgtttatcatctacagctctgagtatatcgaggagctagctgggcatgataagaacccatctaaacatgttccaaaccttggggaaactattactaccagatgctcggggattgtttatcatgccagtagagtaaaacatttactcccaatatggcaaataagcgagaaaattgggttttatcatcgtactctctttggggctcagcttgttacaacttgcgatacattgccgattatggaccgatacagatgcgtttttttgttcttgctttgattctgctctgatatcaatcaagaaagcattctgcaatgcctgtttatactctataatttaaaataaggtttttaaataacgtttttattcattttgtttttaaatttaaaaacagtcgaatttaattgttcatattatttgaattttaaataattctaacgcatcatcaattttcaaagcgatattgtgataacagtaaatgaatatcaaattctggacgggtttggtgacccaatggctaccgcttcataagaagaaggtcatgggttcaatcccaagcccgtcccttttctcgtactatgtatatgtatctttcactcgcttatatcttccactggtaatctatcacatttgatctaagcattcgttcatagcaattgctaaaaccagagacgaaaatgaaacctttgccttatgcttccattcttcttccacctaatacatcggcagtcttttacccaaaagcactagaggaatatttcgaaataccgtaatccggggtatcattgatcagcggagtaacattgatcggaatgacttatctcgtaataagttggtaacatctttcttatattaatgagctattaaaagatttttgcaaaaaatgcgttaactttatgcgtaaatttgtgaagtttgcgaaacaatgatttcaatggttgaggatgacactaccgaagattcatgtctcacataagttctgcaagccatattagcaagaaaaaggtggttcttactacaaatggcatcgccaaaaacgattccgctgtcaaaatttttataagtgtgttcaattaggcaacatgaacgaattactgttaaaaatgtagaattcccttaggaaatagcctacctttaggcgtattccgctgttcgagttgttttaaattttaaaataactcaaaaagtaaatgagatgtaagcgtttggacatcatattcggcttcaggggccatgatttatgtaagtaacgacattttcaatattatcaaacgttgtttacatgttaccccatatcagctaaatgaaaaaatcacataaaatatttttgtaaacatgcttaaatctttcaaaaaacaaaatacagtatatagtcacgagctatgggtggcagtacttgttttaaaaatataaaactctcaacatttacatttttggatgaaatatttaagaaatatcctaaaaactgatcaatgttaccctggattacggtacttaagtttaaggggcaggcgtcattgatttgagaactttcaaaagcatttttttcgttcaacatctagaaagtttacatgaaaatgagctgactgttcaattctccgactgatacatagcgacattttcgtcgaaaaaaaaatcagttttgaacagaaaaactggtttttaattttcgatgataactatgattacgatgacggattcttgaacgttaaaacagacctaaatttcacttaaaccgttcgttttggaccctcaattgaattggttttccatcatattttctaaaataaagcgattcaagcggcagaattatcggcatgtagaaatactcgtttatgttttttagcgtttttggcaaaaaccttatattttcagttcatattttttcttaatatatttatagttcatattttttcttaatatatttataaaaaataaacatggaatgttaataaagtatgtgccaactttatcaataattgtcttcttacaaaaaaaacttaaaagtacaggccggactcgattatccggagactcgattatccggcgactcgtttttcagtttttatgcataaaattgaaataatttagtattgcaatatacaatatgaatgatttagcagttttgaacgtaggtaagaaaaagggagttgaaaaaagtgttttttgtgtatgctggtcaaaaaattgtttttcttttcaagacccttaatgtttctagaaataatttctggctacgccactgcatcatacaaataaaacaacgaaaatagataatatttaagttctattattgcagatttaaatttttctcttagtgattgattatttggaggattcgattatccggagtgaaaaaaatcgatactccggataatcgagtccaacctgtaatcataaaacaacatattaaaaaaacaaaaaaatctattgaagaaatccacctgtttctaagaaaaaatgtcatcaaagatacagcttttggttcatcgatttgataacttattaatattaagatattttttcctgatacggtacattgtcaaaatattatttcgctcaaacggacgagaagtgatcgtctccttttcggattaaattcggcgaaaaaaacttggtaatatcaaattttgatatggacatctgcaagtgatatttacttcaaagatataagagataaaggatctgcaaataatatctaaattttactcctgcaataccattaacagcaagctattcattagatccgaaaacatcaaattttgctatggctcagaaataaaataaaatttagatattatcttaaaggggcaggcgtcattgatttgagaattttcaaaagcagtttttttgttcaaaatcatgtaaaaagaaagtttgaaaatgtattcaattctccaaccgataaacattgacatttttgtcgaataagtttcagttttgaacagaaaaacaggttttgaattttcgatgataactatgattacgatgacggattcttgaatgtttatttcttgaatcctttgattttgggccctcaattgaatgaatttcccatcaaatatttcgaaataaaacgattcaagcggcagaatcaccggcatgcagaaatactcggttctattttttagcattttggcaaaaactacgagagtttataatttttcttaatagatttataaaaatggaacgctaataaaagtacgtttcgtttgaacggacgagaagtgatcatctccttttcggattgaattcaatacgtaatttcgacgaacccatttttttctctttttttaaataatccgacatgttaatgtggacgatttgccctttgaaggatgcaccacactagacaacggactagtatgcaacgcccagtggcacagtcgaaacacattcctgacgaaaagttttccggactgaagcgggaatcgaacccacacaactgttttactcgatgcggctaaatgattggttacactaaggagtgtatcgaaaagtagtcgcaatttttcagaacggtatatctcagagcatagttcatatttctaaaagcttttttcacgcaaatcttcatcatgtcatcaaatattgaagcaactaaaaaaatattgaacaatatgcagtcttaatttaaatacaacaaggtttataaagcatagaaaataaaatcttgcacaaaattacatttttgaagtgtcttctgaagattctatgatttgtattgaataaaatgtatatcaaacaaaataggatgaaaagcttattctatcggaaaatatgtttacttcacacagcacgtaaaacggatttcaaaaaaataaattattgctctaaaaaagctcaattattgcaaaaaggtcggtttaagaaagtcacttttgtgtaatcaacttttgaagctctgtcatatatagcggtaattatatagagtacaattttttgcttacgttacttcataaatatgcaaagaaacttttccaatcaaaaaacattttttatttcgttacaatcgttcgatattaccataaacgtaaataaagaaaaaatcaaaaagcgaggtccttaaaaatcgagttttttcaatgtttgtatttgctctcaaatgcttgttaatgtatttttcaaaatattttctacactatgtcatgagaattgtggcacataatatattagcataaacaaaaaccattttttcttcaaatttgacacatttattaccatatgaatttttttagaggtgtgcaagattttcatcgacatctattagtaatttgcaaaattatcatacacaatgacactttattgaaacaatatcaccgcatcattatttttaaatacactgaaaagcgtttctgatcaaaaaattgtttttaggttcaacccaatatttttgagactgttttgaatgtttgcgactacttttcgatacactccttaaccgcacggccatgaagcccacaatgaactttcagggcatcggcagcaattttaagaaatatcgcagagcatttgccaaggcttcgcgaggccactaatgacagcttccaatagttatctattatttcttaaagatgatatttcaggcattccatttttttcatgtaggtactttttaattgattcctataggtattacttcaaaaattattccgggaatttgatgagaatttcctccaacaaataataaagtaaacaactcctttacatcctggattgcataataccctttttttttgtaattcggttaaaattttttatagaaatttcccaaccacctttcaaggattttttataatttcaatttactaaaaatataaatggaggttctttgaaatacgctaataaaattcttctgaagatatctcaataaagttctcgatggaattcttaaagtattttttgtataaacttctaaagaaaccccgaaataaatactaaaaatatttccttaaattttctgaagaatctcagaaaaatgctcagaatggagaattctctgtgaaagatcatagaacaaaaccggacaaatccagaaacaaaagctagagtgacactagtaaaaaattgtgaaatgacttccgtgattttcgtaaaatcggatcctcctaaaaatattaataaaataagtacaatagattttattgtaacaataccatattttccaacaggttaaccataaaatgaaacgttatttttactttattcacttacactctgttttattgttttgtaccaatggaaatgtcatttttacaataaaatttcgaaaaatttaacatactaaatccagatcaaaacaataaaattgatgataattttatttaatgggtttcaatgcattttcgcgcagaacaataaaatttattgttttttctattgtgttaccattttgcacattcaaatgcacacaatttgatcaattacagtacccctttgcttcattcgtcgcttcgctcatcgattgaaagatatccttcttgacttgtcaattgtaatccttgtgatcccattgtattcctcgttcaatacatcgacaacatgtgcgtttcatatcaaacgaatcttttgagctacacctatcagctcttgcacctgttcaccggacttatgattgattttcttcgattcaaagcgatccctgcaaatctcaaacgttgtgactcgagggacatgacaataattcgaagccagacatgattgcaatcacgtttgcaataaatctttttccatctctcaactaaatcgtgatgatttgtacctccttagcatgatatcctcactaatagcaaatatttgtattttattctcttgcccaaaggttctcccaaacattcattgacatcaaagaaaaggaacgaaaacgtggtacccgaggtctggtgtcaatcccggcaaagtaccccaaaatagtggaaaggctactagaaacgttaaatgacacaagtgagcacatcttgaacggaactgataccttattccgtccagaggatctacagaagctacaagataaaatcgccaaagaaatttccagctcaaatctggatcccaaagaaatgaacgaactacaggtacttgaaacattcatctatacaccatgagatgtatctaaaactccttgttttattttatttcaattgcaggataggataaataaagaaataacgaactccgaagtgttcaacttaaaacatttcaacatatacgataaactgaaaaagatgtttaagaagccagagaagacgctgaacggagttaagtttagtgcatcagcaaaggcacgtgctctgatgaatctgcacaataacgaagccggtcgcagggtaatatcttttcacacaactcttgttacattcgattaataattattacgaatttcaggcagttattaaaaagtcacgcatcatttgcaagtgccatggtgtctccggttcgtgcagtctcatcacttgttggcagcagttgacatcagtgagggaaattggtgagtttcaataactttaaaaatatatacatttaaagttgaatattgcgaatttaatatcggatccattgccctgctgatgatgatgcttataagactacttgcgccaatttctatgaaaatcttatggaccacgagacaaacataaatagaatagtagctatatgaaacataaatcaattccttttcaaaatgccatgtattcataaatggaaaaaatattctataagtattaaatttgtcattattcattaaacaatacattgtattttgaagtaacatgatgcttatatcatatatagtttttattttcgctaaaaaaaactataaaaacgctttttttataaattttaacctaaacctaaatatataatgacaataaaagtttgctacgatttttgcctaaaattattggtaatcttatttgacatttgttccaatttttcaacattggatattctatgtaattaatttgtactacagtaacttgatcggcctaaatacttgttcgaagatcgaaagcttgttcttaagactaacattcaattttatgttaatacctaagtggactttcttgaatatttattacatttcgcttgaatgccctcaatgacatgcaaacttcgtcctctagtggagagcctgtgtcatctgcaaacaaaaatatttgacatccctgcggtacagttgtgttcagaacaatagtagtaaaagccgattttcaaataattagttcgtgaaaaaatgcttattccaaaagaaattgcctacctgcaggtgtatgacgtagattcccaaagtatttaagttcaatggtgttgtatgattatttttatcctttccatattcttagcttccaaatttactggatagtgatatttgttgagtaaaacatgttttggggagcccagatagccgtagcggtaaacgcgcagctattcagcaagaccaagctgagggtcgtgggttcgaatcccaccggtcgaggatcttttcgggttggaaattttctcgactacccagggcatagagtatcttcgtacctgccacacgatatacgtatgcaaaaatggtcattggcacagtaagctcttagttaataactgtggaagtgctcataagaacactaagctgagaagcaggctctgtcccagtggggacgtaatgccagaaagaagaagatgttttgatattttgccccaaagtttcactgatatttagcattgtatgaactgtgaaatatgttgttttataaaaaaaaacaggtaaaaaataaaagaaacactgattttatcaaaattagtttgacaaaatctgattacttaagtatgatgaagcatgaagttgtaaaatagtgacaaattttctacaaattcactgtaatatttgatattccacaggtgattttctgcgcgaaaaatacgacgaggctacacaggtgaaaataaacaaacgaggtcgattgcaggtcaaagatcctagatacaaaatcccaacgccactggatctagtatacctggatgaaagccccgactggtgtcgacacaacaggcaactgaaatggccaggtaaataattgtcaactcatcctgcttatgcttgaatcttgtttgttcaaacagtacatatattcaaccttgatagccgtcctcagtcttgggcaatgctccttcagttcctccgagcctttaggattgcctggttctcttgtaatgcgtatactggttccctgcagaaaattatgttcgccattctttctgccgacattttacacgcttgaaaaacatttcacggaagcaaaacaattccaacacttccccataaaacactacctgaacactaaaccaactaggcaacttgataaccctatctgcaaccttgtacttcgttttggtaaagttgatggccaatcctacatatacttgctgtagcctcggcaagctgcttctcctagccgacttaaatattaaagaaccaaccttggcaaaaagcgccgcctggaagaagcggaatgtgaagcaatggagcagctgcatcgttcactagaaaggcgaaagttctacgagaagcttaacgcataccgaaaatgcttcgtgccgcgagccgaaatgtgtagggataaggacggaagcatcttgacggacggacgtgaggcgattgaaaggtggaagtagcactacgatgaacacctgaatggcacagtgaacacaggcgcatagggtcacgacatcggaggaagtgactacgtcagatgaaggaaaccaacctgttctcactttgaaggaagtttaggatgccatcaaccagctcaataacaacaaggccgctggtaaggacggtattggagctgaactcatcaaaatgggcccggagagattggtcgcctgtctgcaccggctgattgtcagaatctgggaaacggaacagctgccttaggagtggaagcaaggggtcatatgccccatctacaagaagggcgataaacttgaatgtgaaaactatcgtgcgatcactatcctgaatgccacttacaaagtgctattccagattatctttagtcgtctatcaccaatagcaaatgagtttgtgggaagttatcaagctagtttcatcaacggccgctcgacgacggacgaaatctccagtaatgccgtgaataccaagacccaacgtatcacctgttcatcgattttaaagtggctcatggatgagtacagctttcccgggaagcagtcttcccaaacgaacaccttacacgtgtgcaaaccgaaacgctcgagcctgaacctaaacccaaacatgtgtaaagtgaacatcggattgaacgccggttcgaaaaccggtccatttgtaccttgattaaaaccgcggttcaaattttggtgcaattttttggtttcatgcgagggtcagaacgatggcacaaacggacagacagaaaatagttgaaatccacgcttatcaatttctacttatcgtgtcttgttgtatgatatagtaaaatccttgtttttttttcataaatttaccgctaaatgttacctaaaatattgattttggttgatctgaataaataaaccatttattcaagcctcaagggtcttgcgatttgtaccaagaagttccatatatgatcgtagaaatttatctgcgtggatttcaaccgttctctgtctgcctgctttgtcttaatatttgaaccaaagtttgaaccgaagtacaaatgtaccgagtttggtacactgatacagagacgaagcgtgtctacggttcaacgcaagttgcaaggttcaaaccaaagtttaacatcggttctgttcatggtaagactgccgggaagctcacaagactaataagagcaattatggacggtgtgcagaatagcgtggagatttcgggcgaacattccagttcgttcgaatcccgacggggacctcgacagggtgatggactttcgtgcctgctgttcaacatcacgctaggaggtgtcaggcggagagccgggttcaataaccgaggtacaattttcacaagatctagtcaatttgtttgcttcgcggatggtagaacatttggaacggtggcagacctgtacacccgcctgaaacgtgaaacgacaaaaaacggcctggtggtgaatgcgtcaaaaacaatgtacatgctgataggcggaaccgagcgcgatagagcccgcctaggaagcaatgttatgatagatggggatacttttgaggtggttgatgagttcgtctacctcggatccttgttatcggccgataacaacgttagtcgtgaaatacggatactcatcatcagtggaagtcgcgccttctatgggctccagaagaagctgcgatcgagaaagattcacccccgcaccaaaattaccatgtacaaaacgctaatacgaccggtggtcctctatgcacataaagcatgggacatgctgaaagaggacctgcaagcacttggagtgttcgaacgaagggtgcttaggaccatctttggcactgttcaggagaacggtgtgtggcggcggagaatgaaccacgagctcactaggctctacggcgaacccagtatccagaaggtagcgaaagccggaaaggtgccctggccaggacatgttgcaagactatcggacaacaatcctgcaaagatggtattcgcgtcaaattcggttggcacgagaaggcggggagcacagcgagcgagatggcttgatcaggtgcaacaagatttggagagcgtgggccaaaatcgaagttggagggacacagccatggaccgagtaaattggcgtaacatcgttaacgaggttttatcaaattaattgatgtaacaccaactaaataaataaataaataaataataaccaaccttgacagcgctaaccctctgcagccaattcgtgaccggcacgccacaggggctgcaattccagcttaatctgagtaagccgtagataccgggatttccacacatcctctggatcacatgatccagccttttacaagcatattcagcctggccagtgaagctaagcatgtcgctgatcatcaaccagagatgcataagggatctcttggactctatgcaaacatcgaccaagataagcgccctttgcacagaattacggttgttgttttcttttggttcctatattgatatattctagatgatgaaacttttactctcttttactgtatagcacaaaaattattattcaaatttcagaataacaaatattttctttctcccatttcaacaggaacgcatggtcgtgtctgtaataaaacttcatccgggctagatggctgtgcaattctgtgctgcggacgaggttacaacacgaaaaaaatcgtagtcaaggaaaggtgcaactgtaagttccagtggtgctgccaggtcaagtgtgatatatgtacacgacatatagaagagtacacatgtaaataaatatttgagtggagacaatcgattaaaaaataagttttatgaaggcatgcctacatttaataaaaaaatattgtacaaataaaaaacatttttttttttcgatgtttaactagaaactcttttatatacttctgctgtagcccgtttatgaattgtgatttgcatattttcgttattattcaaagataaagattacacaggtatgccttctgtagcagtttaagaatgtaaaagagaaatgactgtaagtttgtatgaatggtattatttatttatttaaatattgagagaactattaggaagaattacttggggtagaaaaaggaacgctatctcaaagtaattagattgcttaacatgtgctatattagtaacactagatatgagtggttaacaataatccttttaattaattcaacatatcttgagtcgtccatactataataaaccttgatgttattttcattaaactttcaaagcatatgagtatgaagatgctctcagatttattgtaaatagcaatgggaatatctgttgatagatcatttccaccaaatctaacccccacatttcattctgaataatagttttcaatgacaatgattgaattgataaaaagtaatcagcatatttaaacacaggcaaatagacgtaacacttctcagctgggcatggttcacgcatttggcgtttaatttgaatttcatatgaactcgtacaagggtttggtttcagagtttatatagttgcaccacagacaaacagacataacatccggatttatttcatcatacagcaaaagtagtagtagtagtgtgccacatgctcatccgatgttgatgttcgcagtacctactatgttttaaaaacattgtttttaattgataatttctctaactgttatgtctgtttgtggttgtatgttcaaggcagaattcaaatttcaactcattatgatgatccatacacgagtccacacatttctttctagagatttatattaaaagtcacctctatttttctgtgacctaatttatattgtatgtttgagccaaaaagtttatattactttctaatacattcaatttaatggaaaaaggaaacaaagatattaggtttttaaagtttgctcagtattctggtgtacaaataaatgtatggaaaagtcaatggtcgccaaaaactactgtcaatcaaagaataatctgaaatgtggggaatagaaatgacggaagtagatatgctattctgaaaaatctcaaatatcatccttctgacacaaactcaaatttcacaatgaaagctgtgccaacctaaaagaaatatatttcagattatttttaacggagaaattctgttcccatttgcaacaaaaatcccttggtctctgatgctattgatgaatgcaagtaatacaaaaggaattattgcataaaatagatcgttttcaaataaaactgtatatattaggtgaaatacttgcttcaaaccagtattactaggtgatttaatgtacgaacttcatgaaatgtaatgtactttttaagttaactagaacatttattgcatctttcatagttttacgaatatttattatagttgtagactatagtataaccattatcattcataagcatactgtgttcattggaatgcaaatgatatataaacgatgcgatatgtaatcagaattacactttttactatcacgaattgattcaagtgtttatattgatctttataatgactgggcctaccttttgtttaagattactcataatctgagcaaacatgtggaatttcggacaacagccaagaaaatcttcatttcgtttgtattgtttattgaaaacttccatcaatcttttctattgttccagtaagtctaaacgcatggtagaatttgtaatgtttgtcctaatctagatgtattatatcttttgaaatgtaacgatgaggcaatgtaaaattagacaaaaaaataaatatatattcgttctacagggcgtttatgttcttattgaattcaatcaactttatttctattgtaaagatatcacaatcccataaatgtgaaaattaataacttccccaaattccatatgaatacatacatataatcgtaaaatattcactacagttgtttcaaatctctaaatgtaagctccaaaacaaattaggaagtaacatattttattctcccttttttattccacaacaatgatcacggatggtattttttaaatacttcttcttattcttcttcgtcttcttcttcttattattattattttttttatttattaatataatttgtagctaaaagttcataacaaactgttatcagctactctaatagcgattctacttattattcagttggctgttctaactataaattacatgttacacaaatattgttttgaactacgcttaaacaacctaagattaagagatttcatttcatttggcagcgagttatacattataattccctgataaaatagatttttccagccatattgggtcctaggacagtttacaaagatcgaattttgctgtcgtgtattatgtgagtgtacatctgaaacattaaacagtacgacatttgtttttatcaaattgttacggaccttataaaaatgaatcatcatgttatacttgcagagtgatcgtatagacaaagtagattcgctgtaaagctcgactgaaggaaagtgtataggtagatttcttataattttaactactttgttctgaattatttctaggggtttcaaatatatactagctgcacatccccataagcagctcatgtatgtaaagtgcggcaagataatagtagtttacggaacaagttgcagaa

SEQ ID NO: 68 - DNA, 43239 bp, Aedes aegypti
gcgagaagttagcattgctttttcttcccgagtgatgattgttttgatcgtatttcactgactattcagaacgatttgaaaacaatcattatcatcgactgagaaaaagcagtgctaacgtgttcatttttttcattccttgaagctcatggtggtgttcttggcacacccacagcggatttacgaatgtgcttcctgataacctatttttacaatttattttcgtaagataagaggtatctttgaatagaatatagttttagaaaggcatagtcattatgttctggaaattcaaaatccaaaattttcatacaggtatttatgtttatcagggagaacactccccgaaaatagtgatttttagaaccttgaagcacaaacctcaaccaaactatgtttaaacttgctccaatcataaaaccgtgttcgacaaaagtttgtagaattgaataaactattactatgtagaggtatttccgataattttcaatgttccgttcagtagtttcgaattttcaaagcttgaaaatagtccaaaaacacataattgatttgaagcacatctaaattttctccaaattgactgaaattttgaccagaagttcattttgacatgaaaaatctaaatacctaatttaataaatacctttccataaatcgagacataagaaatatcgattatttgaaaacacccataattgggtttaaaccaccaatttgtgtacaacttggcggttacgtcagttcagataaacgtgtacaggctctgctcgctaaccttgctggtcactgtcttgactatgacagatccagtccagtgcaaattttggaatggatggtttgatgtttattggataagaagtcttgtgtaaaatataattgttttatcatttcatgtcctacataatgtatttaagtaaaagtggatccaacagttaaaatgtaacattcgcatagtttttaagtaggattatctggtatgaaggtgacccaatatcagtgaaatattttcgttggaagttttgctcaatttcgcatatgattagattattgcactaatcgagctgctgcacctgtttcgtgaatctattaaactgtataatagtatgtgacgtggtaagtaaataattaggataaaactagcatggcgactatttgatttgagaactacctttgatatgtacaaatcatgttactttctacaatatttttgatcagttcgatatccaatagtgcttattgagtggataatagttatattacactaatattagcagcttccccataatattatggtagtgtgtctctcgtctaaaactaggtcaaaagtgatgcaaaagcaagagaaatttgtagtgattttatatatttttccattgcctaaaatattttcttgatacatgaaaggtgtgtttcagttgatccttcaatttaagatcaatttaacaaaacagtccctttggcaagctgtcaatgcattgtgaatacatgtgcacttggagtctgcgtaccatcgacctgaagtgacttgtaccacttattttcgctttcactatcaataatgataaatgatttattgaacgtgaatatatctcaacctcgattcattcagaagtaagcacctcttccaagtgagccattggctaaatgtgtttcgaaataggtaccgttccataatttcatcttattatatatttctgtgttgagcaatcaaattataacgccacattaagcgcaagctcctcggctacgcttcaacttgcaacagtgtgagtatgtgagcgcctcaacagcagtgattctcaatcttcggacgggtggcaaatgaagctgtgttgaacatgtgcgtaatccttacaacgtgttttttgtggttttcacacttcagcctaattagtttaaattgtgtgtcatatgaattattgattacactaggcaacactgattcacactttggccattttgaatgaattcaatagattttagcagtgtgcctaacacctggaaaacttaaaattcgcagtgaattttgaccacaaccagataaattattgtgaagcaatatggtaacggtcgtattttgcaccctttaatgattttgtgtttttttttgtctcaatttatttttcgcacagtgtagccacgtcaatgaacatgccaaaatgtagagaaacaagtccatgacataaaagtggtcattatagtccagaatgcgtcgaaaataatgcaattgtgatgctatgtttgtcattagggactgtttattaattattttttgaatttttgaaactccaaactcctcctcttcccatggtaagactttctgtatgaaaataaaaaataaattgcatggcgcgtaaaaaatctcaaaccccctccgcccatagtcccttatgtaatcaatggatggccctttattttggacacctcaattgcccattgcacggtgaagtgataagaaaatcgcttttcttcactctttcggggaatctgaaaacaacggtgccagtacctgtcaaagtttacattcggaaaacaaaaaaaaaaccgcttcaatctctgtgtgtgacgtgttgcctattgaatttattaaatttagttaatttcagtcaaaataaagataattgtctatgcacaaatggttaatgtaagagtataacagacttatctatccaaatgacatccgaacatagttggtattggctcggaaagtccaaaatatataggcgtctatattatattggctacactgttagggcgcttcaaaatatcgtttttgcttcacactgcttatccgattctaattcagattctgagtgtcctcccaaaatatgagcttgttagagttaaaactgagactgcacaagacctctaaagtttgtatagaaattactatggaaaaagcaaacaattcattcaaacggtcttattgtttgttcatgtgctcgttacaattggtattgagctgatactgttagacacgcttgacagaaacttctatgcgatgcaaaaattatcaatcaaaaatcaatcaaatcaaagttttcaacacagatcctcaaacgattcgagttaaagtgcaaaaaattgcgaggctttttttctgggacgctttctctcttgttggtgagcatagacctttactcaaacattagaagcactcttaagtatcccgcccgaacaaaacagccctcgcggagttgtgctcttcctcgctcatttttcgtcgcctctttgctcagtactttttcactcccttgcaaaaaggcaaaggctgcacgctgctctagagtaatatttcaccaagcttgctgttagatatattcatcagctactactttgcgaagaccgtagtgaaatctggattagaatcggataagcgatgtggagtaaaaacgatattttgatccaccttattaccctatgtgtccattaaatgagtacccacggggcgtttcagagtttcagggagctaacaattttgaaatcattacgctgcccataaaagtaagaagtattttgaaactttccgttacctacgtcttaacaataattcaaaacaatcaattacactgcagaacacgtttttgtctcaagtgccgaaataccgctattgacttagagtgcgctccggaatcccaagcaaacggtttcgttttttcaccgcacggagtaaatgtttgttcatttttcgcattttgctgggctgtgtgaagtgcttcgtggaagcccaagcattcgtgattttgttttgtgccatcagagcgatgttttggcatgaaaagcaaaagtgttatttttctcgagcctccagagtgatttctttctcagttagtctgtatgcgttaagtgaagctgaaagtggattgtggctgctcaatcaaggatgaaggatcaactggtgagctcgtttcatgcttttatttcaaatctgtaaaatatgtatgactacatattaattttgtcatgcttttatttcaaatctgtaaaatatgtatggctgcatattaaatcgttacaacggtgggatgtaaatatgatttttcaacaaactatgaatagttcgtcactgtgtcatacactctgaaacataaattatttattgtttcgcattttttttcaaattacttttatttttgcaattgaaaacaaaactttgaatggttcgacactataagggtagatctgcaaaaggttcttttcattcaacaaactttgaatggttcgccactgtgaatgccggtataagagtgttctgtgatggccatgataacacatgctttcgtcctgacagctgtaggaatgttgcgtttagctatttgttctaattttgaatggctcgttactttaagtgtcgacattactttcttctacataatttttgtataccgtaaaatggggtgttaagggatgaaaaaaaaatcaactcaaatttcaagcaactttcagtatgtcaataattgaacaaaagacagccctaccatgcccagatagccgtagcggtaaacgcgcagctattcagcaagaccgggctgagggtcgtgggttcgaatcccaccggtcgaggatcttttcgggttggaaattttctcgacctcccagggcatagagtatcttcgtacctgccacacgatatacgcatgcaaaaatggtcattggcatagtaagctctcagttaataactgtggaagtgctcataagaacactaagctgagaagcatgctctgtcccagtggggacgtaacgccagaaagaagaaggaagaacagccctaccattctctcgtcgtgtatatcagaagtcaaatacaatgagcagttgacagatttctgagataatcatgaatatgtgcgatttttggcggaattgcaaaatggggtgttaaggaatctgagtttcgtgaataaaaccatattttaccaacaacaaaacaaaatatttttggtcaaataagttccatgttttcattcaattttataggttatgttcaaccttaattagatacatcaatattattgaacttggaactcctccaagcgcaaaccattttattttaactgctaaatctttcatagtttttaatccaatttgccaatcctatatgagaactatcaatacatcgtaaaattatcttgaaatgaattttgtacacatgactctgtgtttgcacggccgtgcaaataaagtttccatgcatttttttcgccaaaaccttatttttgcatgaaacgtcgagacatggtgttactttttttgcacggtttttgaaattttgaactgaaatcattttttgcacggtacgcatcttccgtgcaaaatcaaaattgggtgtacttatgtacaacaggatcatagcctatatttttgcagtttacgaatcctagaagctctgcagagcaacttcgtgaaaaacctatcatataagtataatttcaacaagcttttagtttaattggggaaatggccaatttgccctgtaaataaagcactatactaaacaacgtatttgcatgcaacacccagtaacatagtcggaaaaatactgaagaaaagtattccagtatggagcggaaatttaacgcacactttatagcacaatgggtttagtgcccgtcgaggccgcacagtttctcaaaaagagcttaataatgacaaaatactattattgtataccacaccataggattacaacttaacggatcaatggcttcaaaaccattcctaagaaaaaagaatcattcatgtttccaaaccttttaccagtgtgattgaacaggtgttgtaacggtatcgagagaaatcctatattcactttgatacgtttttatcaagattttcttatcagttttatcgattgtcgagattagacatttttggtgatatttaaaatagacccctcaacttttacaaacccattaaaaaaatttacttcacggaacaagccataagtatgttggaatatattacggcataaatcgaatgagtttagcattttgtaaaaagtagaaaagataatcccttaacacccctcttatttaaaaaaagagactttttccataaaaatgatcaaaagtcaaaatctagaagaaattttcaaaattttttgactgcgttatgatcttaattaaatatacagtcaccccacgcagttgaatcacccacaatttatgaatcagctgatttcaaaagacaaaattattatcaaacttgtcacaaaacatcacagaattatttttactgataagaagttatgtgtaaaaataattctgtgatatttgtgacaagtttgataataattttgtcttttgaaatcagctgattcctaaattgtgggtgattcaactgcgtgtggtcactgtacctaccttctaagttactcacatgtttttcttaatattgtttcatagttttgtagttaaatgtatttagcctataaaattcgaacaaaaatgttttgaagggttttcaatatctagattccacaatactttatttcaatagacatcccctatcacataatgcagctcacaatcctccgaacaaatcaagcatttcagataactgatatatcgattgtagacgtttttgtgacttgtcaaacttaattgagaagttcaatcccttaaaaccccacgagtccttaacaccccattttacggcatcaattgaaattattaaatttaaaggcatgtttgtatctcacaaataattgtttattatggtctaaacgcttatcaaagtgaatcttctgacccaacgatccttcacattaacaaaaatccatctcagtaacctctgttgaaatgcagaggtacacacggtctccaaattgcaaaggttacacactaacattccttcctccaatcccacctgactgcaagatcgtggccggtgccgttattgaccctgtataaatagagacactgaattatgcacactgaagaaaattatggccaatcccagccgaacttctacttgatcttcactgacttcggtcaagcaaccattgatatgtgtagtcagtgttgtgaaaaactcattgagatttttcatgcgtgagttgtcgaacacgcaactcagcagtcaaaaaatcatggaagagttggctcaccgttttgactcattgtctcgtatttccacagtttactcacacacggcaataatttcttgttagtctggtaaaattatagtaatcctttctaacgtaaacaacaacattcgggtttcacaagtttttgccgggttttgcgactgaatcatcgagtgagaaagagttaactgtatatgcagtgttgtggaacaaaaaagttaaatttacatgaaaatttacccatttttcaggctaaaatctgctgaacccattggtaatggtcagtgtttaaaaaagttttgattttgtcgcctagtgttaaatacagtcaccccacagttatggatcaactaaggatcatttatcagaataatatagagtaaagtggggcaagagtttctttttaagatttcgattcaaaacaaaacttataaatgtcatggtggctcgaatgctattcaagtaagagactttcactccaattatcatagaaaccgattgagatttggaaaagttatggctatttgttgtttttcgacgtgaatattgtaatttttggtcaaacttccgttgcatggaagataaaatctttttcaatattttatgtaaaggcgtttctaggccaaatcataaggatgctttgaggtgtattagtttttgcataaatgcttggaaacaatttttagcccatagtggggcaaaagttcgaaccagcggggcaaaagttcgacccatgtataaactcacggaaaaatttgcaaactgcctaaaatccacatattatcttcaaatttatcaaaatttgtctgatcgtgcgaaaaatgtcaccaaaattttacatttccacttagttttgcgaaaaactgctatttttgagtatattacaattaaccctgttttgggcaattttttgatgaaaatttagtgtgtatttttcggcaaacttaagtttacggctggtgtaaagtatgcctgtcataaaagtatccatattttgtgttttagccagcgaacttttgcaaaagtttgtttaagacaatcaattttgaaactgttataactaaaaatgggtaaatattttgacacaagtttgttcagcaaaatgatagccaatatgttgaaggttcactgtatggtatttgttttgtttcaactgctattgttttcctggaaactttgattataccactaaggtcgcttcactttgccccaccttactctatgattaaaagttaaggtgacgctgtacaaaacaatattatctctctgatactacagaatatagttgttgtcaagaatacaccagaatatagttattttcaagaatgatccatacttcctggcttcatatggacaaaaaaaatatgcttgagctgcgatgctgtacagatttatggttaacgtaggtaaaatgtgttctgcgtaatttctactctgtttaatgtgatattctccgtttaatccagctctgatctatatctgtgtgctacccataattaagggacgaccgtacaataacaaaacataccaactcacttgccgactattttcaatttttatcaggtgtacatacttgcataatcctttgcaaaaaataaggtttgttcattgcttgaaaatttgaattgaactactttataacttaatactttcaagtttttttttttataacttaataattttgaactgaatattcaataattgaatattaagttcaaaagtattgaacactgaaattagtatttaggaaatgctgcgtcacccgaggaggaataaataacttgcaataatctacccataccatattttggtatcataccataattaggtattgtccagtagtcaataccacattttggtattataatggtattgtaattttttttaaacaatttaaaatacttcattttggtattcgatagctattgaggactgctagaggtattgaactactattgaaaaattttacttttatatgaaaatccatcatgtattattatggtatttcaatacctgatctagttatcagtttggtgttagtagaatatgcatgagatattatatgaggtattttatttcttatgcagggctcattcatacctcattcaggttataagtattagaaattatctggtatggaataccttagtttggtattcagtagcactttccttctgctcgggtatcgacgcgttttgtttccaaggaaacggttaaaacaacgaacggttgtctatgtgaatgacgtttcaagcattttttggcatagaacggttatgatgaagatatacgtcttatgacatcatattttcaagagcatgggggtaacgaaccagatacaacgctaatcgaatatctgccgacaacaggtgatcattcaattaacggttcatttatgtatccaaaagattagcgctttcggagtcttattgatcgattttatttcgcaaaaagtggtttgtgccgtaggcgtgttcaccaccgttttttatagtattagttgttgacctgagttaggaaattcagcttgtattttgtggcatgctgcatcccattacgtctgtctcgacgcaatggttatgcgtgaacaaatagcgacgatggttgcgttgttcgacttcgaagaagagctcggtcaaggatttttcaaggtttgatttttatgttttgtttgtcacatcacgggtacagtgtgcctgaccattgggcgaaatgttcaaagaccataaagtcaaaattggttcgcgtggagggcaattttcctattcaaaatgttttgacttttcgtttcgcctttctttgtttctcttagatcttttgtcgtttcaaccctttatctctccatattttgtctttccaatcttctgtgctttcaacgaagtctttcgattttttgtcatagtgtaggagattgaagtaggcaatataatcattagggaggtcatagtaggcttttaaggatcatttcgatgtatgacagttattaatcctcgagacgccaaataaataagatcgatttatcagaagctctctgtattttgtacttcaattcagaagtgggatcatgattctacgcgacatcccaagacgaagagctggtgctgacaatttttcaaataacgagggcgaatcgaatgaaaacacagaatatagaaaccaagccagaaacatgaacgttagtggagcaggagacggaacgcgacccgaaaccagttcaatggttgttggagaacgcggagatgtaacggttggtgttagaagcgacatggaacagaatgaagctaggaacaatactggattgcagcagatcgaggggacggggattcaaaacacctttcaaatgttcttacaccctgaggacgttcgtagcctgattcctgaattcgttcctgggaagattgctgtggaaaaatggttaagaaaaatcgacaatttgaagaacgtttataactgggaagaacggatggctcttcactacgcaacaatgcggttgggtacggtacctaagatttggtttgaaggcgttgatgaagtcgtgtgcggttggaatgatttcaagcaaagaatagcaaaagcatttccatcaagaatcgacgaagtggatatccatagtgctctcaacagacggttcaagcatgcagatgaaacttatgaaaactttgtgtatgacatcgtggccaaagcaagaatggtagaccttacggatggagctataatcaaatacgtcatcattgagattgaagtaggcaatataatcattagggaggtcatagtaggcttttaaggatcatttcgatgtatgacagttattaatcctcgagacgccaaataaataagatcgatttatcagaagctctctgtattttgtacttcaatagatttgtgcaagtgaggtaaaatttcgaattttagctttttatctcaccaaaattgttattgttattgcattttgctgcgataattttgtgatgataatctaactgactagaaagtccttgagatgaactagatgcatagggggagatcccccagtgccggacagcacccaataccggacaaagtcgaaacattgagaaatcatggtccaatcaagatggtgtattagtagaaaagaaagctattgtgtagactaatgtttgcgtagaataacacatccttgaaatatgcatcccttttgaaaaaaggagaaaagtttgaaaatctttaaaaaattgacgtatcttcttaattttgagcctatttagtaattattttgaatatgaaaaaaatactttggatcccgcaagcatgatcgaacacaatcctaatttgatagtatgaatgtattttgtaccataattgaagtaaatatggacaaattacaattttggttaagcacctcctgtccctcagtttcggacagcttgatttgttatatgatatctttgcaattattgcatcagtgtctcaaaacactttcatttttcatgggttccgtcgaccatggtatcaaacatgcaataaaattaagaagaatgaacattcataacaacatcgtaaaatgtgctatttttcatcatatatgaaagaggtttttgataggcatcttgcaaactaagaaaaactcaaattatttttgtaaatgttgcaattgcattgaattggtaattataaacgatttctatagtgtacacattcaatgatgttcaaatttacagaattcgagatcgtgtccggtattgggtgccacctttcaagatcgatcaatttagtactaaaatacatcatcaaaactcaatgtcaaaattcatatttaaattttcaaatttatttttttacactataaaaatgataatatttatcataaatgggtaacacgagcccatcaaatcaatatttttcgaattatgaatttagtggcttaagtgtccggtactgggggatcttcccctactaaaaaaagagctgcatgttcaaattggttcacccgggttgtacgtagttttttacgttttctgaggttacgtaaaaaataaaccagaatccaaaattccaaagttgttggtgctccttaaaactatatgtaaaacacaaatgaagttattagtaaaaccaattttgaatcacccctttgcaaattttactattttagctctgtcattatgtgaatcgaagtgtcagtgtgctacatatttaaatctttttcaattatgcataatatcaataataagatattgaagcgtaataaaattgtgtcctatttagaaaaattagcttgctagagaaaataaactaaccttttcttgggtagaataaacacgagtagattaaggtgatagatccaggtcacgtatatcgaggtgacaatatattgcttcgcgactaaaaatgggtgaaccaacgtgcaaagtacgatttttgaccaacttcgccgcgtcgcgagtcgcttagctatagtgcgcatctatgccctccgccgtgtgcatcatgcgcactattgagaatcgagttggtcaaaaatcaaatttcgcacgttggtaaacccatttttcaacgcgaagcagtgtactaaagtgactcgccgtgttagtcaaacggggactcacattattcgtgacgagtattgtcactacgccacacgagtccgagttttctcacttcacttcactcatataataagctcaaagttactggctggataaagagaaaatacttattctcctactatttatgaaagatattcttgacataaatcatgaccgaatgctctagaaaacaattctagatacattaacgaaatgatccctgcaagaaaaataaacaaaatccaaatagaaatatcttgtcgattttatatggaatccggggatgttttccttaactaatctctggatgaatcgatgaagttacgcgaaacatcataagcgaaattgctgtgtgaaatcttggagaaactccaaaagaattctatgtaaatcgctgaaaaagatcccttgaattatcaagacagaatttcaaaaagaattcgtggaagaatccttatttagaatcctagtagtgtaaatccaagagcttttagaaattccttcagatattccaaattccgtgatttccatcataaattccacgaaagagagcttaaggatttcttactgtgattactccagagattccttcaaaaatatcagaggtaatatgtaaagcaagggcgcgttcactactctggcaacaaagtacaatgcacacacattgatgtaaagtggcaactgattcctgttttgctcaaaatgacccaggtttaacctttcagttgtcgcgcgaatgtttgtaactcgagtagtcgcgcgttgtactttttacagcacccttggttttcgatgttcaacatgaaatatatcgtgatctagtttaaatatagaaatatcatcttcggcaaaattgttaaggagatcaaaggctgacatgagatggcgctagtgtgcatgaaagttttgctttgtaaatatctctgatgcctgaccacttagaaagatggcgtcttcagcagagttgttcagtagctcaaaggctatcattgtacgagctagttgattcaaaattgtaccaccaggcggcgctagtgagcatgaaagtttcgttttgcagatatctcagaagcctggccacttagaaagatgacgtctagtgggcatgaaaattttgttttgcggatatctcagtatcctgaccacttagaaagatgacgtctttggcaatgttgttcagtagctcaaaggctatcattgttcgagctattcaattcaaaatgttgccaccaagtgacgccagcgagcatgaaagatttgttttacgaaagcttcatgctcactagcgcagcctggtgtcgaaatctcgattttcatggtttaaaatgatagcccttgaggtattgaacaactttgccgaagacaccaacattctcaataaacaagctcctgagatatctgcacaacagaagtaaaagtttcatgctaactagtgccacctagcggtcgaattccgaattaaattaggtaccatcagatagcgctctacctccagaacagctgaactgaagaccccaagtttcgaagttatctggattttgagatataccgttttcaaatggcggtctgcttgaaccgtatatagtgcgttcattattatgcgacttctatgtacattttttattttaccgcattataaagggtcatactgtaagcaaaaactgtcgagtattgtgtttgacgattcttgaggcatacatattggtttagtgtcaatagatatctttgttgcaaaattatagcatataaatcacaactgttgttcaaagtacaagagcgcgacagcctgaaggttaacagttcaataaagtatttttggcttcacctcgccactatttacattaaggaatacaattaaggacccccttcttctttttcttatgtctggcattacgtctcaattgataatttttgcatgtgtttatcgtatggggcaggtacaaagatactctatgccctgggaagtcgagaaaatttcctttattaataggtcctcgatcggtgagatacgaacccacgaccctcagcttagtcttgctgaatagctgcgcgtttaccgttatggcccagagttctcccgcttatcttcaatagcactatctcttcatacatacctcttgaaattcttccaccaattttcccggggatatgtccagaaaattatcaagtgtattctcaagagatgcttgaaggaatccctcttcaatttcctccaggaaaccctttagaagtccaacgctgacagctttagtgatttcacagcgattattccgaaagtccccaggatttcctaaataatggggactatgcacctgaaaagaaaagtaaccgcctacctagatgcgcgggaacttcttgcaagaaatgttcaagaatagtagtttacgcaacaggttgcagaatgatgatttttacagcacgtgtcgtacatttctccaacgaggcttgtcgagttggttaattacgacgagttctgtaaaaatcaaattctgcaacaagttgcttacaaaatttccttgcaatttcgtagaagggtattagaaatcatatcaggatattttaagaggcgaatgaacccttctggtttaaaacctctctaataaacgcaaaaaaaaaaatatcaggatacaatcaccattattatgccattatttctggaaattggcggttgcttattaaacaataggtggttgcgtaatgaaaaaaaacgttgcgtaatgattattacgacatagcatacttcagtgcaggaaagtacgccgtttcatgacgtattagtatgatgaaaaaacagcctattacgatgagaaattacagacattttgagcaaatgtctgaactaatttcagattcaatttctggagaaagtcatgaaaaacacatagagtaatgtctggcgtaatgataaaagaaattccttaagaaattcttagaaaatatggattaactctatgagaaatccttatagaaaatcttacagtagttcttgactcctgtttggtatcctttttcaggcatgtgatctttaaaatttcatatttttgaacgtttcagttgctactagtcatgaattgtttttttttattaagtttaagtacggtctccggtctcatttgatgagtaaaacaaaaaagcgtatatactttcatcaaccttagctgatggagttgaatttacactttttttttgttttttttacatcgaaagtaaaattggtataacatcttattattctaggaatgagttaaaaataataaagatgaacctactcgaactaaaacaaaaaccaaaatacatgcaatcaatggtgaacagttgttcaaaacgtgcttttcggttatagattacgaaaaaagatgttttgataaaaaagcatattgcgaaattacgtcagggctactgtgactgtatcatcagcttggacagtacttcaacaattcgataacttatcgaacacattcttatcagctttctatctacttattcttccggtaatttggtactatgtgataattgccaagacatatgtctctcgttatctttagcacttcaaacactgcaaatcccaggtaggaaacgcgaacgaatccaataatcccataggagagttacccttctgtatgtgcaaaaaaaaaatggtactttgtttggtcttattaatcattggtgcaagggtttttttacagagattttttttatatatttgaatgacacaatatggtgtcccataaaaagcattgtccgaaaagtcatggtactaaaccctagggcgaaagttatgcttatttatgtcagttttatagaaccattcaactctgttaataaacgtctagagcaggcctgcccaacctttttggctctttttcgacataaatggttggtgctttcgcaagaatagactgatatgaacaaaattagtctcaaatgcaagcttgacagtatatctgtctaatccatgctgaaaattttaagtttatatgaaactcttcgctagcgatgtaagcaaaggtaaaaatcaatccattttttgaacttaattacatcggtagcaaagaggttgatataaattaaaaatttgcagcatggattagacaaatatactaccaagcattcatttgagactaattttgttcaaatcggtctattcttgcgaacgcactaaccatttatgtcgaaaaagagccaaaaaggttgggcaggcctggtctagaggttcttctgccagatagatttatgaaaaatggtatttttttatgaaaatcagcataatttgatatattgtgcagatgtttccaaggcctaccagttttctaactttttattagcagggttgctgtacaaagccgcacagcgatgaacaaatattcgcataaaatcgaaaaaaaagccagtagcactatttttacgtcatctgaaagcttctatcttggttttgtgaaataaatatggagactatgaaaactaatatttttgtattgaatatcgcttgtgccactataggatcatatgtgcctatagtagcattattacttttcttcttctgtagctagtgctacagcttcacggcgttggcaaaaccccaattaaaatcgtatttttacaaaacttttatatttttcgttgaaagaaggggtcaaaagctttcgaccggtgtaaaaaaggtctccattcatctttttttttgtttaacacttcagtcgtcgcgctgttgtattttgtacaacactggtggaaaaacctcgcttgtcgtacacagcattagcgtggtggatttgacggtgacaaaccgcgcgacgactgaaagggtaataaaaaaaatagtttctctcagtagtgctactataggaacaataggtctactgtaggtgcaagggagcttaaattttaatcaaaactatttatttcaatcattttttgagctacatcgagctgtgaatcaatggttcttagataaatagctcctgaccttcatgtcaaaaatattttgcgatgattctcagcaaaacgccctgtacgctagtacgactataggggactgtatactaaaggtacatcggactatcaaatttgaagcaacattttctctagtcaataactggttttaaatgattatcgttttaccaaaagatatcgaatacgttgcatgaaattattaatttcaatttgttcatgaacgtaacggacttatagtcttttaaacatatttttgcaattccgtactatatgagcctacttttcatctgagaaatgaacaatataatggcctacttttcctaccagatgaaacagtgctgaaaagttctacttttcagtaccgttaatggtgctgaaaagtagcacttttcagcactgttttggtgtcgtcaactattgaataaatcttatcacacgtctcttctctaattgctctgaattattaaaaactcattcagctagtttcttattccacatctattgggcgaaccaaatcagactcaggagagctattctaaataagattcggatcgtctagcggacgtagaagatgtagtaaagttggcaagtcaagctcacaaaaaatccatatctccctacggcggctcgtgcgggcctcatctgccaactgtgggttaaatatggctgaaaattgcatgtgaattcggcgtcttacctgttccgagtgtagctcaaatgtgatatcgatgggagagtgaaaatttgtgacactcctgtgcgaacagtatcatagcttacgtgattgaaaactatgagtcgatactacacgtggatgtttgtccatgagggttgccttctatttctagaaataatccaactagaacggcatttttcgtaattgcaaaaaatgttgtatgcaacgcgttgcaaaactcgattttttcagcactcgtcgtatttatccaactcggcaagcctcgttggataaatgtacaactcgtgctgaaaaaatcatcattttgcaacttgttacataaataactattaagcaacgcttctgtttcataaaagcttccagattgttgtattttggttagaccatttgatctatgtcatattcgacggaaataattgacgctaggtatgcaagacaagtaaaaaatttctgcggaagatatggtcaagatattttctacggtgagttccatttggattgacatttcttttcaattgcgtactgcgaccaaaaaaaaaatgctttgctaagttttcgacaaaacttattacctacttatagcacaaactatttgaaaaagtgcagaaaagtttgtaagcaaaaatcaggtatcaacgttgaaactaatatttaccgaagatgattaacgaatcatgcaactttaaaataaatttgaagagttttcggatcaaaacctccaggatttaagaaaacacttgtttacattgcagttaacaaggccgtggacattttttttatttacctgtgctttcttagttttagcgttctaaaatttgttttcacattttcataaataacatcatttaaaaaaattaatattttaatacaatatgattaatttaagtgcataatatgcttcaaaaccacatatgtttaaggctaagtaccccgtcattcgttttagcagccatgttgactttgcagctcaatatttcaaagtaataaaagtaagtttgtaatcgtgaggtgaattagcaacaatcattaacgacgtgtacaaattttgattacgaactacttcgccttaacatttttacatcagtaaacttgataacttaaccaatcttcgattacttatggtaatatattgaactgaattttcaaaaacatatcaggggggcgattccaaaaatatattggcctcaagggggcgaaagtcaaaaaagtttgggaaacagtgccttaaaggttccgccatatcgatttatgaaaaataccgtattttgaccttttgtgccgaattttccaaatcctagtagatatttttacaatattgtttttttattatttttctataagctatttgtcattcgtgtggtattattgtctaaatctaataaactgacattggttttacctacgaaacttttttaaaagatttttagaaagttcatatgctctaaagaatgctataaattagcacatcttccattctaggaacacagattttttttctgggacaccttaatgacgcaaggattacactccaaaaatttgtcatgttcgaatcattacaataaacatatagattttttccataatgattttcatataactcttatttggaattcatacagatagagtttattacgaaaatcatataacattcaaacaaaaagactatggatataaaaatccaatgtaggttggtgtcatatacaaaatcatataactttcgtgtgaaactaaattgtaattgtttctttaataacaattaatgggttttcaatttgcattttctatatttgattatccaaaataaaatttcaaaaataataaaattgttcaaataaatttaaaattgtttatttaacatttcttcaatacaaagtgagcgaaattcataaaatagatttccttgatttgggagagacctaatacttcgccgtttatcaaacattacattattcgggtgttcgcacatattgaagattatcatctcatagttctacgtctgtttcaacaattcagagggaattttgttgcagcatgtttggtgaacaatttctgaaatgatggaatatctccctccctgaattttatgcccaaaactaattaacaaataaaataacttacttcgataacgtcaagcagaacatcgaaggttcatagttgcatggaatttgaagcagaacacttcaacgaccaagacaaaggctcacgaagagaggtaccatattctgaaatatattaaaaaaatagcagtataatcaaaaagagctgatttctacagcttacctttgataagatctttgaaaattttccaactaatcgtctagaaacagaaaaaaaaacagcaaattgtgcagttgccgtgccatcgtgtagctaaatgagaaccgatgtttttcacattacacaatcagataccatgtatatgattttgtaatgactgaatggataatggcgtccaatgagttttatgtagaatttaaattgcttccatattgttattatttaaactcaattggatcttcatataaccgtcattggacattaataaaacctatcaaatctgaattccgaagcaagtatatgatttttcagacaaggataatcagattaattggctcagtgtagatatttatcgactgatacgttaaagtcacaaccagggcagaattttccgtttgatgaaaagcttccttcgtcaagcgcaggaatcgaacccgaagtgtggggcactcgctaaacgtttaaacgcctagtcgccatttatgaaaagcttttcctagtaaatcattactcaacttatttgaattgcgctaacgctaacattacgtaatgagtcaatactgcccataaaagtataactgtcccacacggattttcgaaccaacacctattttcgtcgcaacactcatgtttcaatatatactttactatgcatatacaaatttacatactttgtttgaagatgttgtggaaaatatgaagttggtaaagtctcatatttaaaaataaagtcataacagtctcaatatgaacttgcaatgcccacagtaactgcaaaacgtgagttatggtcaagtttatgtattttactgatcaatagaaacaaaatgattgcggtggtgctaaatgtttatggcctgcggaaaggtactagaaaattgtgtacatttggatgagaagacaaagttaaaactttgagtgctatttccacaatgcctacgttatgggacagttatgcttttatgtgcagaatacgcaacacaaaaatgttgcgtaaggaactcataggacattacatgacgcagtgtgagaaagtaggccatttcataacccatctccgtgatggaagcctactgtgatgataaattgtaaaaaaaaacctactgattaatattttgaatcttctgtagattcgttaaggatccgtcaatcttcaaatttttcatcaaataaaatatgatactccaatatgtacaacaaactggtgtaaaaagccaattcgtctcgtgcttttgcaacttgaaataaaatgttcaatgaaaaatccccacgacgtacagcctgccgaccgaagataatcttcagggtgagtcgcaattccccatttggtaaccgttgcccacagtaatgccgctgtttaaacataaattggctgtggcgtaatcgcataccaaacaactatcaacgtgtatgatagtaaaagtgttcgggttgacaaatcgcattgccaagtttatgctttgctcctactgcaagaccaaccaaccggactgagtgtctgactgtcgcaaaatctaaattatggtaattaacagcttcctgtcaatgttgcacggcgtacattcttagtttggcctgtcagctcaagcaacgcatggccaattcaagtgcggctaatatttcagtccatacgcagacgaaactagttcgactagtgtgatactttagtcgtgacatagacatacaaatgcacaggttgcgaatcagagatggacttttaaatcacactttagcgttagtgctttttagaacttgtatgcatacggttgaaaaaaacagaatcttgaagcaaaactcaaaaatatagtaccatgctagaggcgggtcataaattgttatttttttgcattactataatagtttcccgccaaattatctgaaagagttagttgttcctgttctgtcggcgctcaatttattcccaagagtgaatgaaaaagtgatacgcgtgaaaggatcttcaattctcttcaagataagtgttttcatattgctaactaaaccagctttgtgctctggtgttggtacggttttgttttaaattgttatagttttttaattgttcggtaatattttttggcatttatccgtgggcatgtatgtattaacattagggtgatatctaagatagttatttcacataacaactttttttgttttacatgtggtctcgaacgttttctaaaaatgttagaaatgtggctttcacgagataatttcagaattgttacatcacgaattctgtacgttatatcctagtttacaaatcgtacgaagtactttgatctggtggaggaaattataacatgattaaacaaaaatcagttttaaatttgtttcaattaaaacaatttgttataaagaatttgagaacaattgcttatacatgaccagttttatttcatgcgcagaaagtgacaaatgttattataattccggaacaacatctgttcccattctgttgtaatattatacttcgcaaaaaaagttgaaaaagttttcgttggacatatttttttatatttaaattgcaaataaagattaaaatagtatgtttatcagtccgcagtccgggaagtctcccttctgttcttacggcatccagtatttttaatacagatatcctgtaagtatgaacaaataaaaggtaccataatcataaggtagaatacttgttcattatgccccactgcgacattatctttgccccgcctacaatctttgtttagggataagacatgtttcgacaaatgtgagatttcacaatgtcaacctttttttaccatttcattcgtagtactcaacagttgattatcattttcatacaggaagcgtaggatgaaaactacattaatactacttacttaattacaaatcatacatgctcactatgccccgcctacccctaattatattaataagccgaaatgtgctacatttgattgatattatggcatacgtataaaaaaacttttttgtccttagaatatggaataaaagtgtttaagacgggattggtggtcttatgaggcttaaggacaaaaggtcgaaagacaaaatgtcgaaatgataaaaggttgaaagacgaaaggtcgaaataaaaaaagcaccacaaaaatgttttgctcggtgggttttttttcttatttgaaatgaggttttcgaccattctagagtgtccctcccaggacaaaaaatcccgggatttgataaatttcgggatttcccgttacccgggatatatgttctgccttccagggaattccgagattcccgaaatgaatgcaaaattcgttgaacacccctagttttttttatattataacttagatattcacgatactttatataaacaatagagaatttgaaaaaaaaaacagcaaacccataattagtcaaagtaagcctttgtttttttttattacctgatgaagttatatatgaactacaacttactatttatctttaacttactttttatctttttatctacaacttactttttatctttaaaaattactttatcatcctattttattgtagaaatattgtactgtttatattatacttcgataaaaacaaaaaatactggttttattgaaaatctgaggatttcccgggccaagcaacattttttatctcgaatcccgggacaagcaaaacggccggaaaatggacactctagtcccttcttgcttgcttatcgacattttatctttcgaccttctgtcctgtcgatcttactcgtttaatggctacaacttttgcttcataaacagaaagtcaagtgttatatcccagctccgttcctttcctcgtactgtgtagttgtatccaccacttagctcccacacttaaggtgaaacagtttggaatcaacttctaagattgcactgaaacttcaaaggcactaatctcgcaaaggaagcatccaacaagagtgaactttttattttggctttgtgcacaagcagaaaccttaaaataagaaaatcaggaacgattgccttctatttctccagttttgtgtctttgaaaacgcgagtagggtcacaagtcggccattgtgacggccatctttagattccgagatgtttcaccttaaagtgttcaagtgatgcaaaaatatcaaaaaacaaaaaaagttgttgcgattaaaatattttttgtagtgagaaaatgatgctgctactagaggggttaaccatgtcattcaattgacgacgaaaaaaagtttttataaaaagtgctttaagacgtagtaggccgtcattgaaatttgttagcattgttgatgattgttgctaatttatcccatgcttgcgaaataataaaaataagttggtttcacacagaaataactgaaaaagtatcagcataatttatgcatgcaagcgcatacattgatactttatcgaagcaatatcaactatgagaactgagttttattactttgaaattgcgagctttaattccagaatggctgccaaaacaaatgatggactacttactacgtcacaaattatcttaatttttcgaaatcgatttttttagttattgttcaatagtaagctgttgtttgtcaatagttttactattgaaacagttagttcactttaaattaatcttatgagtatggcatcatattctattaacaattgattagcttagttaatattcatctgattcggcttgtctcaagttcatcgaaatcaatggagacaatggagatcaggaactaccaaacagaggaggaaaacagaggaatagattttcgaaactcttgctctgcttattggaagtatcaggtttttattgcagtttttttatgtgtttgatatctcaaaattaaaggaagtgtctttgtttggtagggaaattttgatacctcagacatttctcgaaggttctgcttttgaacatttcacttcgtttacaacattttgaaattttctccatgttgtagtaacatctaaaattgctctcggttcttctttatgcgggggatacatactgcgtaaattcaagaatctgttcaatcgcgtaaaaaaatggtgtggttctcaacaaatcatgaactaagacttttagatttctttaagctggaccgcgtaaaaacgcataaaaagacctgactgttgtgtaaattcagacgtttgatatttttcatgatttctgcagtatttaaacataaattctacttgtgaaattattcccaatttatttatttattgcaattatatttctctacaattaattataactttatgtaacatttatgaacctgtaatgaaatgcagtgcatgagtgatacaattttgtagaaaaaagttgtcaactaatgatttgttttaaaaccactttaaaagctctaaatgcaactttcctcgtaaatctgatagaaagtggacaaatatgacaacgttcattttttggacattatgacgaattgtaaaacgtgagaacagttgtccagtttcgagtgtctgaattattattattatcatattattgtctttattatagtgactttcgcccatggcgccacaattaacataaattgcaacatgaatgtgcataatataacaatgtgaagatgaatcgaagccatacctgaaatattggccttatctgattacgcatgtaaatttgttctgttggatactaactgatggtaactaatcggtcaagttttcaacgttatcgattgttcacccttattatgataatgaaagaactatcgtaacgcatgataatgaaaacacaagaatgtgactttcaccgctaagtgaatttacatattattagaaattttaatcggtcacaaattgacaaagaaatacggccagcagaaagttatctatgtctctggtgaattaaagaaatagcaaaccaacaaatctgatgttcttattattaactttctggtagtgacccatttaattactaggcgggtatttcaccttttcgagcttataggactattatacggctaatataggcattaggcattaggtttgttcaaaaaaccgtttttgctccacaccgcttattcgattatagatcaaattctgagtgttctcccaaaatttgagcctattaggataaaacttcaaagtttatatgggaaaagcaagcaattcattcaatcggtcatagtgtggatactgcaacacctagtaaccatgatttgtatgtgctgtttttcgcgccaaatgcagcaatgttgtaaattcagaaagttaatgagcattgttgaagaattttccgattggatataagtcaaaccaacaattattgagacgcctaatttgaacacggtcttcggcaaagttgtagctgacaaatgtatctaacagttcaaacttaatgctaactcccaagggctcatatgcaaacattatgaccgattgaatgaatttcttgggtttcgcatagtaattctcttataaactttgaacggcttgtgctgtctcagttttcattcaaatgtgctcaaatgttcggaggacactaagaatttgaatcgaacgagcagtgttgaacaaaaccgatttttcgaaccaccctgatagggacatagggcattcgtgccattgaagatttggtacaatatcaaatttagattacaaattgtttcaccttaaacagtttggtgaattgaaacttacaaatgaaagtctcttactagatgcacaaatatgttttagcatcgtctgcaacgttgaactaaaacgaaattcttatggtgctcatgtggcgtttgaaacacaaatcaaaaaagatttaattaatttctgtatatttagaattggttgaagtctattacttagtttattatcatttattttatttgcgacactttaccattattgtggcttttgatctattacttagtgaattggcacaatagtatactgcccatactcgcataacagtcccattttctataggattccctatataaatgggactgttatgcgagtatgggcagtataaccatttgttaatatttgaattgaatattaattactattgattttctaccaaaaacttttctgatatttaaaaaaatagactgtttttaacaactttagttcgaacgcatctagcttgtaacatgttttcctttcagaaactacaattttgttgctaacaatagaaaccaaggggcccagatagccgtagcggtaaacgcgccgctattcagcatgaccatgctgagggtcgtgggttcgaatcccgctgatcgaggaccttttcgtaaaggaaattttctcgattcccagggcatagagtatcttcgtacctgccacacgatatacgcatgcaaaaaatggtcaatcggcaaagaaagctctcagttaataactgtggaagtgcttataagaacactaagctgagaagcaggctttgtcccagttgggacgtaatgccagaaagaagaagaagaatagaaaccaagggtgccaaagtcaattgagactgatatgcgaatatcgacagtatgtgattcttattggatttttgtatcttcatcgttcagatgaacttccaggtaaaacttacgtgtcatgcgaattgccaaccatatgatgggaagctcaaaacttcgctcatttaacgtataaactacctcagctacccaataacattattatatccagacacatttggagcaattatccctattcagaggtttctaccttgtcgctcttttcattcatcaggagttggttagtttcaattcgcatttggtcgcctgcgttatattaactttgcaaacccgtggagtaagaagtgctgctaacctagcaaattattttgtttttcgttttctccagacaggaagcaattcctcgtaactcagtcatcaaatatccaatctgcatttgatgaaattggcgaaaatagtgtaataaatcatggcttccaaaatgagcgcggaaggcagagccaacgaaaattcagcgaaggacaaaaaatatatatccgttgccgagttttaccatggtaggagcatcttcataaccggaggcactggtttcatgggcaaggtaagtttctttttttttttgcgaaatatgaaccgttcaaaatactaattccattttcatattcaggttctcattgaaaagctgctacgttcttgtccaggaataaagaatatttttattctgattcgtccgaaacgaggacaagacatatccgccagattgacggaaattttgaacagtccggtaagttttactagatctctttttaatacacttagtttttttcgtatcataatactcaagactgatgcaaattttgaagtttagcttccctatgcttaaacgatttcaattatatgccacgcatttcgaagtttgtatggaaaaagtctacctttctattcggccatcatgccaatttgctgacgatcaaattttgactggatcaaatcaaatcaaaatgttgctttgagagatattgaaaaatcatatcaaactgctatagacgttgacctcaacaataaattattatccagacgtccaatcacgatgtgttcttcaacaaagtggtaactgctaacttcgtggaatattataataataagctaaagggctgaacacataaggttgaactttaaacctaaataatgtccatgcaaactttaaatggtgtaggcttagccaaatttgtattcacataattcaaaaatcaacaaccaaaaaaaatcaaaatttgtaccagtctaatggtacgtatagcactcgcagggagagcgggacaggtctcagatgtatcgaacatgggctctactggtgtgtgtgtgtgtgtgtgaaatagcagattataatgttagcatttactggactccgggtctactttgatcttatatttttctaaacaaatgttacaaatactggcatcaaaaactcatgactatatattatattttgttttctggtagttggaagcatgtttcaaaaaatatgattgatttcaaattttgctgattttgggtaacactgattacccacataaagtatggttggaattattcaaaagactattatcaacagaattcatagcctctggatataaaacccagggtgtccatccatccgggaaatccgggaaaagcgggaaaacccgggaattccaaatgaccgggaaaatacgggaaaaccccgggaaattgtagaacacaccgggaaaatactttcaattttaattactatggacgaaacacaaaacgtttgtgtggatgcctgccttataattcgaacaacgcattctaactgttggtaagatgttaaagggatagttaatattttctagttttttttatttctttagtccttcaaaatcattggtttcatgcaaagatcttcagtatttttttcttacaactgatttcttataagatgctgtgtatagtttttgggaacttgaaatcagaagacacagtgtgtttgtttgacaaattgagacatgaatttgcgaaaaaatacgcgttctagtgggcaaacattcattaatgtatcccgagttgcgtcctggcgcagttggtcgtagagcgtgcgaccgcactgagagctcaacgcatactgaatttcgtgctggcaagtgttcggcttataggtatgcggctgtagagcgtaagaactcagcatccataaacaattcgctctcacttgcgatcgggagatacaaacgtgagcgtggtgggggtttggcatctaagcccgaaagagacatggatttgcgaaaagagatgtgttcatagttagtactcggattcagtttggctttctattccgcagaatcataaggtgttctgtagcttagttggttaaagcgccggtctagcgtacacggagtcgtgagttcgagtcccactagaacgcgtattttttcgcaaattcatgtctcaatttgtcaaacaaggtggggattgcttatcaaaccttccggtccgcctcatagttacgtactatttggtgctgggtgtagttcttgtttttccagctgtattgaaaagcatgagccatagtctttggcatacaatcgggtctttctttagcagaaaagaaccgaaatgtctatcgacgaccggtgattgctagcagatatagtggagagcttgtcttgatacgttcatcgcttcaagctagttgaaaaactgaatacactgattgcctgtcgatcagagccgaactaggcatagatcgtctacatacatctgaatctacatgtctccgatgtattacatcgttccaggtgggagttatctgatatgtgaatatggtaccataacagaattttccatctgaacgaagtgataaatcataatattccgcaaactgtatcacacatctacagaatgtattgcgtgaagttaagacacagcagagtattgggtacataggaccaagtccctgccgggtggcgcgaaactgatgagcgatagacaatagaatcaacaacactgccataagggatagtaagcatgtgactattgtcgaaactatgattaggaggcaaatcaacatcccaagatcaaatttttgttacaacccaatgtaggtattattaaattaggctgtagaaaatgataaatatctgatcacttaggaaccttgcaacaggtaataaatgcccgtagtctgttttattcgaatacacatgtataaattgttaaaattgccgaatcatacgcggaatttattaaacggatcatgaaattaggactgaaatcataatgatgatagattatcaactttcctttcgtcttgctatttgttaccgttagaatcaccaaactgattggtttcccactacttacaccaatacaacagcacgaaaactgaagtattataatcgcgcgttggaactttcaatatccatatattacatcaatagtgaattcttgtatgtagccagtataaataacagaatcatcaacttcttgaacattcttcaactgaaaacaggatgcttgttttatcaaacatgctcaacctgcacctaaaatctcggatccaaatagttttctaaataaaaattgtatctaaataaaacgtgtaggccaacaaaacataattgagtaggagtttacaagttacttagcacatgaaaagcagtttaaattaatctattactagatcaacactaatgctcacatttttatattctcatttcatcatggtcctcattgctcgagcggagacgaacaccctggagatggaaaaatcgacagcgctacgataaggaaacgtaacagatgagaaactatcgatacatttatcaattataaaaccccgttttaatgttaacactttgtttctgttttttctgttttttttttttcgtttcagcaatcaaataaccgaaccaactctactatcttttcgtttcttcttcgttatacttatagtccttctggcactgaaccgagtggtgcgccttccgctttcttactggtgctgtttttcctgtacatttggcatagtgtcggaggtggtgtactgtatttgctatacaacgcactactttcgatattgtgcttggcgtgtggggaagcagtactagtggtgaagcggagggcgccattcggtttagtgccagagggactaaatctatttaatgtatctgaagcttgtgggaccgctttaattccggcgcctgcttgtggaagatcccggtgtgctaaacggtataggacatgttaacgggggaggctaggtaggtcctcacccagcccgtgtctagatgggcggataattgtctgccagggtgtggattgagcaattacaattacaaattcatgtctcaatttgtcaaacaaacacactgtgtcttctgatttcaagttcccaaaaactatgtttcggacatactagcaaatctggtatatgccagtaaagggcaaacattcattaatgtatgctgtgtatatttctggaaagatatgcagcaaattcgaaaaaaatcttatgaaacatgattgaaatgcttgaagcatttctgaaagagtacttagggactcccaaccaaatttttggcgatgcttgatagctttctttcaagatgcatagaatttttttttttcgcagaaatcctaacggaaatctaggcaataattgacgagttactttaaatatgtttgaaaaaatctctaaaaaacttattattagaggatttctaataaagaattcagttaattgtatgaaagacccttggtcgggttttcttgacattctaagtatatttctagtggttggtggaaagaatcctaggcagatttatcaagtgttcctgttcggaggattcattgtgatatttggtgaagatttgttaggaatactagcttgattagtcctcttaatctatgaaaatccttgaaaagattttgtacagatttgtgcacatttcttccagaaataattccttagccgattttttcatttatttcaggcattttcataaggattttttcaaatattcatccactattactctcaggaattgctccaaaagtccatcaggcattattagatgatatctattattaacttctcaaagaattcctcgataaatttgacataagattcctcattaagttgctccagaaacttatcttggaagatctccagcatatcatcaaaatattgttgctgtagtccaaacacttctctaatgagttttcaaataaaatatccatggattattcaaaactctagtcaaaattcagggattcaatccaaattgatccaagtaatttcttcaaatcgtcttgtaggacattatttgaagattctaatttatgttttaaatattttaggaagaattttatcaaaaatttaggagctctttcagagatctccgtagggattcttcaaggagtacttagaactcacataagcttcatctgaagttactctaggaatttctttcgaaattcaccgcattttttttctccaaaacatctaaaaccattttctagatgtttcgctggatgaaaaaatatttgaagacttcttaaagaaatgttacagataaaaaaatattttgagacctcttttagaaatgattcaaaaaaaaaataaaatcatggaagaattacttagaaagttcatgacaaatctaaaaacaaactcctcaagagatctgcggagtaatatgtgaaagaaatctatagtaaatcgagctattatacttgtcgtaatgtcataagaaattccaaaaagggcctcaggtctataaagcttttatttctaatacggtcgtactaccaaccccgatttccccaaagaaaaaaattccgaaacgctcttcagaaatcctgaatcccattttgagggaaaggatatttctccttaagatcgaatagtctattttttcaaatctgactttgatgatttaaggcacttccagatcattcgataaacattcttaattttcgcagcagttaaaaaaaaaatcatcttttttttgctatgtttactttatatacagataatagtttttcttcttctttctggcgttacgtcccaactgggacaaagcctgcttctcagattagtgttctaatgagcacttccacagttattaactaagagctttctttgccgattgaccattgttgcatgtgtatatcgtgtggcaggtacgaagatactcttatgccattattgcccttattgcctactctaatgcccgagaaaagatcgtcgaccagcgggattcgaacccacgaccctcagaatggttctgctgaatagctgcgcgtttaccgctacggctatctgggcccctattgttttttaatgaagcgaaaatactttaaagtttatctatatcttctatctatataaataaaaatggaatggtgtttgtatgtcacgaaatggcttcagaacgggctatcggattttggaaattctttcataggtatgttcctgaagtgttccgacgtgtttctatgtatgaaaagtcaaggatttttatcaggaaattcggaaaaacgagattggacgggactttaattttgtatgtatttgtacttttcaatgcgtttttcaacggcctacttgatggcaaaacgaagtttgccgggaccactagttattaaataaatttattttcaaggatacctttcatttaaaaaaagtttttagccatctaaaattgactatttctcgcgttcagtgtcataagggcgtaactgcagtgatcgatttctcttcgtcgattttctctttgaataattacttggccgggcgactgttttcgactgctatttttgactctgtagaaactattcatcgtccttcttcgtactgaaccgaaaaatgtttgcaaaatcgatttaatttcgtgtaataatgcaaagagaaaatcgatgaagagaaatcgatcgctgtagatacgcctgtatgatactcaacgcgagatttgtacattttgagagatttgctcatcttggaattatttttaaaacctggaaatctcagggaatttcatttctgtaaatgagtagacaccctgaccaagcactaagcggctgctgaataaacccctttagtgattggattcaaacacctgtcgaatcctttactctatttgctaacaacttccaaaatttgacaatctatcatgtaataaatcaacattaaaattttcgatggttaaaaagttaaacatctggaaaatttcaagtcaaagaatcatagtatcattatcattgaagttttatgcatccgggaaaaatccgggaataggaaagctgattttgaatggacaccctaaccgatttacaatttccttgaaatttctgcattctttacagcgattcgtttattttgcttaacattcctaatgcttaagaaaaatatcgcctatactaggcaatgtgaaattgcccaaacatgatcataatgcattaggtaagattattaaacaaacttatgaaaatttcgacgctcgtgtcggccgagagtttctgcttcttattcttcttggcattacgtcctcactgggacagagcctgcttctcagcttagtgttcttatgagcacttccacagttattaaccgagagctttttttggcaaagttgccattttcgcattcgtatatcatatgacaggtacgatgatactttatgcccagggaagtcaaggtaatttccattacgaaaagatcctggaccgatcgggatcttcagcatggctttgcttagtagcagcggactctaaccactcggctaaggaaggccgagagttactttgctattatttagcttcttatgagattatagtcctgcaaacatcttcaaaaatcccaaacaaaattagctcaaagtccttcattaaggtttgaagaatgagttttcgctatgagatgataagtttgtacttacattacagttctaacgtatttgggacatttttcaaaatttctccataataatttccatataaacctatatcgtctttgggccacctttgaatcactacctagaaagctgaaaaattcacagaacactatttttacggtaaggatagtaaggaagacatgggagattggaattccaaactttttttaaattttgaactgccctactctgcaccctatagccatagagtatatagtgttaatgttctactcatgtttttttttctttttaactatagctattcgacagaatacggaacgaaaatccgggcaatctgaaaaaggtcattccaataaatggcgatattacgttaaacgagcttggaatatcggaaattgatcaggtaatcaaccatccatgcccgcaaaaagaatattttaactaatctcatacatttttgcccagatcacgatatgccaagaggtgtccatagtgttccattctgcagctaccgtgaaatttgatgaaaaaatcaagcaatccgtcacgatcaatatgctaggcacaaaacagttggttgaactgtgtcacagaatgctctgtttggacgtgagtacaaggcttttcatttagtgattatcatcgactactaattactgcatttcaggctctagtgcatgtttctacagcgtactgtaattgcgataaaaaagaggtaaccgaaattatttacccgccaccgtacaacccagacgatattatccaattggtgcgatggttccccgaggatattttggaaaaggtatgtgtaaagtgtaattcattaaaataacctcgacattattttttaacggaattgtttcatactttccagttaactccatcactgattggtaacagaccaaacagctatacatttacgaaggccatggcggaacatatgctcctgaaagaagcaaagggcttacctgtgtcgattgttaggccttctattggtaagtgttatacattcaaccacttttcagatagcatacactgcccatactcgcataacagtcccattttctataggattccctatataaatgggactgttatgcgagtatgggcagtacatatcatcaacaaaaataatgcagctcattgcatctcaagcaagattgcttaaccctctaatacccaattttttattttcgatctaaatatcatttttagttatctaaaatcgttctaaacacgttttgggcaatgatttatttttattcgcaaatctatgaattttggtttttgatttttataatttttattttcgaacatccattttttcttgaagcctcttctagttactgatttttagaaataaggtaccgtggggtaagtggatacagaaaaatcaatagccaacttcattgttatgtacagctaacgtgaataatgtaattcaaacttttttatatggataacaaatgagggactaatatacttcaaatcgtcacatatttcgatttttcggattcttatgtattgagtataagaaacttgaaaatttgcgccaaatgatccacttgccccaccatggtggggtaagtggatcaccaataaaaaaatctattctgataacaaatgtggtgtaattatgtatagtaagaattatattactctcgttcatatttttagtgctagttttgttgcattttgatactataaaaattaaaaaataactttattttatcaaaattttatgaaatatgtttatacatgcgttcacactaattcgaacagaaaagagcattataactagaataatttggagaaaattcatccatttatacataaaagttttatagaagtattgtaggattattcctaacgatgttttccattaaatattcgttgtttgaaaatatttgttacatttacattttatacaaaccgaaattattttattctatttctgattatatttgtatcatctgtctagaacaatttttatggtcacataaggtacgataatatgctttgaattggaaaatttgtatattttgctcttttgcaactcagcttagataaaccacgaaaagtttcgtttgaattttacaatattcattcttttatatatttttataccagaaagataaaaaaaaaactttaaggtggattcattcaaactttctatggttaatttgacaaatttaagctagaaatgaaaaaagtggaaggaaaacaacatatgcggatattaaaactaattcaaattctcgtaagcagtctgccaataaatgataataataattgatccacttaccccatcccattaaaaagtaggggtaagtgtaccatgtccattatatctgtatttatttataaaaatcacatattttttattgtgattcattcaattagaactgaaatgctcaccacgtgttgaaaaaactactatattcgattgtagacagagatgcaatgatttttactgatgaaaaacaattttcaaattaatttatttttgcagctgaaaagttttattgtgtacgtgttatacgcgtagtaccagttttgcaatagtatcagtgtggacctaagaatataacctaaaacgaagcaatggtgcaaaaacattcaacatattcaagtaattatgattaatatagacaaatgatccacttaccccactgatacacttcccccactgtaccttaataaaaattcaagttttaacggaacttttaaaaatataaaatttttattttttttcaggaattatttttattttccgtgtaattaacggaaaaactggtttgaaattattttaataccaccaaacttttcttctgcgataggttgatcgtagaaaaatataaaagtaacgattttttatattacacgttaacttaaacccaggcatttgtagattatataagaatacaatttttcaaacaattttcaaaaatacaaaaaagtttcaaaagtaataaaaaacttttcttatatgcgtgttatgagtcaaggtttaagctaaaaatagaatcattttgatttcagagctacgaaaaaatacacaaaattctaaagtgtaccccgtctaaaggcggggttgggtattagagggttaagagcgaacgcttccttgataccgtatagggtagaagcaccggttttggccatatggcagttgtagccacaggggaatatacaccattttacatagccaatcagcatgaaaccttttgtgttcagtagatcacattcacatgatagtgctacattcatttactcgtccaaattgactcaaaacttaagaaaaacaattcatttttcttataatttaaactcccatacaccttatttggccagggcactcctcatttggccactctcatgagaaatcaatgcgattggccaatttaggaaccgaagttaaatctctggccgaaactggttccgttggcctatattgaccaacgggattttcaaagcgaaaaaatggttttagctcagttttgatattttacacacataatatggattgaaagcttgcatttgacatatttgttgtacatacataaatttgttgcttcgatttttggatttttgcgtcggtatattctgtaactcgataattctataagtcgatggtcccttgactatcgagttatggagagtcgactgtaatgactaatactaataataaaagtactctcagggtaactcatcatttgaagcattttgcaataaatactgaagacattcgggaaataattttaaaaaattctaccagccattttttaagttttctagagaaattcctgaaaaaatagcgtaataaatctcaaagtacttcaagaagaaactctaaacaaatcctaatagtaattcttggaaaattcttatcaaaagaaacatttgaaggtatcctaggtgaaactgtgtaaagaatttctcttgataagaatttcccaagaattaccatcaggattttttccctctctcgatttctccctatctcgatggttccttcgatttcgagatgtggagactcgactgtatcgagtaagggagagttgactgtatgttcaaacactcctaaaaaccctattggcatgactttcaaactttagcagattcctggcattctttataaaatctttcaaaatttcagtggaatcctgaggttccctaatgatcacccatgaaaacaactttcagaaaatattgaaaatatcatagcttactaaaatcatgatttctgaggctgaatatgaaggccaaactcttacaagtcatttatttgttaagttataagcaatttcccaaggaaattctgcctagtgattcttgacgtgatccagaggattatttgaggaatattgaaagtttcttgcaatatccttggaattccaaaatggataaatcaaccatgggtatgacgatttccaatggaattttgtcgactttaagaatcatttcaatagatttttttaaattctgaacagagattatatgagaattcatattaagatacattaggagccttgatgattttgagcagaatctgcaaattgttagctttattctgagaatgccctgcgagaactccaatgttcttagaaggggcatattgattcctagcgaaactgatgaatcctagacttcgagagttcttgaagtttcgttacgtgatcctgcaagatgcggggtcccaacagaatttaaggtggttctgacgttggccaactgcgcgacgactggaaggttaacattaaaatacttaaggttagattataacatttatcgaggtagtcaactgcttctacataattgaatcttcaatcaaatacatatgatgagcagcttacctatgtgtgtaatttctaaaatactccacgagccgcatttatgggtcgcgagggctacattcagcatccgtatttccataaaccatcccattgtattgtcatccttcgcttctctgtagtttttttgctagcaactaaacctataattatctcccaattgcccattctagtcttgtccagcttcaaggaacctgtcagcggttgggtagataatttcaacggtccaaccggaattgtgtctgcagtcagtaaaggactgttcagaaccatcttgtgtgaggaatcctgcgtggcggatcttataccggttgatttggttataaatctcatgattgttacggcttggtatacagcgtctcgtaaaggtgcaaacaatatcacagtctataactgcacaagtggcattgataatcctataacatggggatcttttgttcgaatgtgcatagataatatgagaaaacaccctgtcggtgagtattattcttcaagtgcacttttgcacgttatactttaaacttattaatccctgtatttctcttttagagggtgttttgtggtttccaacggggaacctgcgaaccaacaaggctttgaatcttatccatggatttctagtacacttcattcctgcaattttcctagatttagtttccatcgcaactggacgaaaaccaatgtaagagttgaaagctttttctgccacggtaacctaatccattaatgccttttcctaattctagaatgaagatcgttcaaatgaagttgggcaaagccgcgacatgtctgcaatattttaccaatgctcagtggcgcttccgcaatgataacgttaaacatttgctgactcatctcagctccgatgatagaaatacattccaatttgatgtcggtactattgattggcacgagtacatcgaaagatacgtactaggctttcgcgaattcttgttcaaacaaaatcctcagtctctagaaaaatgtagaaataatatgtacaagtaagtatactgtgttctcataatcaataatccgataataaaacatttctcatactttttgtagattgtatattctacatcagtttttcaaactgatattggtcgggtgcatgtggcgatttcttctgaaaaaatcggatcggttacgtactatttggtcgaagcttctaaatgcttttgcgcgagttattaacgtattagctcttttctaatatttcgttcatctagaaaatgagagggggttgcaacatctatttaatttattagtccatatgtatatttattccaaccataaaaatttacccgggcaaaagataacatgcataataaaacaataccaagtgatgtatacgccttttatttctgtattgatgacattctttatgttatattccaacatacaacacaggaagacatatttcatgtttttgattttcttattactattttatttttatgacttttaatctatgaatttcaatctttagaaaatgtacagatcatttaaccgacattgttaacagatgcaaaaatgcagcagagaacacaaaaatacatttgtccagcaatcatagtactggtggtcacgtcaaccttgcaaacatgggcagtggaataccttcaggaattattccagggattcttcaagtgatttctcctcttctaaagcaatatagagattcctacagaaattcttccagagtcttcttcaatgattccaccagataaatctctacagggattcttgcagagctgtctccaaggcttttttcaggcattacgaagttattgtatattgaaataacatttgactgaaaacatttatacgtgcatatgcatattcagcaatcatgttaagaaaagaaagcattacgcgcaacactgccagctacttgctagctgttctgatgtcaataaagagatcgaaagatcagttctgatcgtgaagttaatctgaacacaagttgttctttttcaagtcaccctccggaagaatacccccgtaatcagtcacccttcttgaacagtagtgagcggacattttagtggcgacgagagaatttggaagcggcggaatctggcacgaccatttcgaagaacggattttccctttccgtagaacgagctggagtaggcagcgaaaattagctggtgacaatccggtttaaggtagaaggtaatagtggaaaaagtggtgaaaccgcagctattgtttgaaggtgaacagctggcgtggtttttcggtggtaacaaaaggaaataaagcgcctttgttaattggaacgccatttgcgttcgttggtggcgtggcgtcgtttcattgtgaacaaaagaatagtttattagaactgagattttggagtaggactacgtttctgcttactatgaattcttttaaacatattgaaga

SEQ ID NO: 69 - DNA, 4345 bp, Aedes aegypti
tattgatcgcttttttcaagtcagtagaaagtactcatcgcccttcgtcatgttacatcgaaaaatgttaacaaaatcgattgaatttcctgtactagtccaaagagaaaatcgacgaagagaaatcgatcaatgcagatacgcctgtatcatactgaacgcaagaattctgtttgaaatgttcgtacactgagaacagcgttgcggttgaaaatactatatcaggttaaattaaatacacaacgccacttgatttgtgcagactaaattcgcatttatttagaatattttgtgcattcaattttaccatggcaccatttgtatagttaaaattactatatcatggttaaaaacttgcagcagactagaatcgaaccgaggatctggcgattgtcaagcgcgaacgctagccgctcggctatcgacgcggttggattgagagggaacaaaacgcaaataaaaagcgttcatgatagctcaatcgtggttggaatagtaaatttaaaaacacgttcatggttctcattactgcaacgcttgtttcagtgtagcgttccaagattaacgaaacttgttttttggcgatctatattcttcaaacgcctttttggtttggcgcgcgcgatgttatgcgaaacttgtttttttaacacacgcacacacacacgcatttgtaagccttgcatttgtttacattcttgccgacacggccgatagaagcacgaaaatcggcgacatcgtggtttatttgtcgtaaaaatcaaactttttacgtgtttgcagttattatccgacgtgagcctgcttaatttatacagttactagtgaccatttatcttacccaacgccatggattatcacaagcgactcgacatggtggagatgttcaaagaacccccggaatacaaacctccgggcacggcggaagaactggcctgcagcgttgactatccgaatatgaactccctgcagtatcgcatgacgcgcaaggccactcaaaacgtactgcacccatgtctggagcacgttgcacgtaacggaaacgggcagattatcgttgccggaaatgacctgatgggtcgtcgatggggctccagtttctacggctgggagagcgccgaagaggtgctggatgattccaaagtcagcttcaagcgacagtgtcgatactgcattacggcgctgcagttcaccaaggatccaaatctggtgagtaggtattgtgtttgttttttttttgtgaatatatgtccagatataggcgaatcaaactacttcaaggctacgcactgccctgccgcgattgagccttctaaaactattttgtatctttcagtttataattggaaccgataaaggctccgtggaattatggtccacaaggaacgaagctcgcggcgaagggtattccctgtacctagtcgatggtcaatcagagcacatcgaaggagtgtcggcaatggatcttatcgaaggcgaggaaaataaactgatcacaggctcgcatgatgggtgtctcaaagtgtggaactacgcggccgatctccattccaccacgacgatggcgatggctcatactgatgccataacaggtctttcaaccaatcgagaggataacatgatgtttgcctcgtcgtcgttggatcactctgctttgctgtgggatctacgcaagccacggccagcatcggccctattcgatggtcataacttcggtttcacaacggtgtactggactacacggaaggaagccaactgtatagttgctctcggagatgaagccggcaacgttcacttcatcgacatccgacaaccggatgttccgacacattccgtgaaagtgttcaacaaaaagatccacaagatctcattcaatgggtaagcacttaggggaaagtggggcagtttggccaccttaaggaaaagtcgataaaagtgctgaaaatattatgaatttttcgaatgtttgcatgatttccaacaatttttagatgaacacactagatccgcatgatttcctttgtcttataaagttcacggatgaatgtaaaatggttcttaaggagacagcactgatgaatattatcacacattgaattgggcttaatatgcgaattatgtttattgcgtgataatattcatcagtgctgtctccttaagaaccatttttactgacttctatctagatgtaatattctaaaacaattatcattatagatagatatgtatacttcaccacaatgagcaccccatttttgattgcaaaataatctcatataatctaaaaattcaattattttgttactacccctgaaaattattagtatctatacgcttccaatcgcgaaacgcaacatactgttagccatctacactttgatagcgcaactagtcagaggatgagagatttgatttttcacgcattcatcacatgcctctgtgggggaaaatgttttattttcttgataaaaggcagtcaacagtgaaacggttaagtgaaaaaggtagaaatatccatgctcgatgttcaacattcctttgttttttttatattattccactactttcataaagatccggctggtaggagcactagtttgaggttggaaaaccagaatatgtgaggttagtttcattggaactttcgcctgagcgatttttgcacttgaataaaacacgtttcgaaacattctccgctgcctcttaaaataccattgggtagagaaatgaattctttaccactgaatttcattcaatttcatttattatttcacttaagctgtaaaaataaatattttgttctgaatgttttgaaagtttgacatagctctcgtcaaccatcatcatgacgacagcagcacactccaccggacgaattgtcgtcttgggagcgaataaacacttcgtgcaaaaatatataatttttaaggaacattctaacaatcaaacattattattctgaaatgatgaaattcaaaagagccattcggggcaatatgggcagttttttcaaacattatttatttatttttatttaagtttcgaacactgacttagggcttattcacaaatttcataacgctgaagggggtgggtgggtgtccctcggatgttacagctcatacaaaatttgtggaatattcatacaaaaagcgttacaagggggtgggtgggtgtcaaaaatgaccatttttggcgttatgaaatttgtgaatgaacccttataacatgcctattgctttatttcctaatcagcttttgggttgcatgttatttcagatgaaatttatagaatttatgcagttttcaaggggtgctcattccaccccattggccaaaccgccccgaatacccctacatatgaactactaaacgtccttcctttacaataatcttgattattccttccaacagcactcaatttgttgttctggggaacaccaatcaggcacgattttacgacgagaatcttgccttactacacgagtgtacaccggcgccgaactatcttcgggatgtggtttgggagaacagcgacagcaaggagaaatccagctgctggttggttggatgggatacgtttttccagaaagtggaatactgaatgttcgacagacatcatcactaagatcgatttccctaccctggatgtttggaagaaactctgcaattttttttatatacctacaccctcatacctcaaaaatacgacaaatagagaaaaataatgtatactaaactgaaagatttttctttaatggtttcatatatggtcggtgttcagacagactggaccaagtgctttttaatggttttagggaaacataccccaggcattcgtaatatcaaattacttgcattatttgctgtaatcaaggaacttatctatttgttgatacgtctgtatcaaaatagcatcgtaaatatcaaaattgatggagtcctcatcatatcttcaagataccaaaatatcgtttaatccggtctgtctgaacaccgaccatatctgagacatgtgacacatagtccctcttgatttaactttttttttgtgaattgagtaactcaaacttagtttttgctcgggttatcgttgctaatcgtagcaaccgcgttcgtgctcgagatatcggcattttttgagtggtttttgcgatcgctttccccggaacagcggtttgatttcagtgactaagggtgtactagtgtatccactaaaagttggattaaattcagtgaaaaacaggagaaaaaacagtatccaaaaaaaaaatttctcgcgtggctctggtgatacatgtcaacctgagagagactcgcgaagaggaaaaatatcaacgtcata

SEQ ID NO: 70 - DNA, 12210 bp, Aedes aegypti
gaccaggacgataaccgactgatgaactacccacctcactgcccacagagatgtgatgagaataagaccaaaacgagttgcctcaacaagcaatttttggttcgtctgcttcacctgcttattataattatttttttaatcataccgcatattgaggctgtcgtaatatgtctattaatctatacaataaacctttcttctttatttttgatcatgattgaatataacaaggaaaaccaaaaacgttcattaatatgatttgtccaatcaatatactccattgaagccgcccatgtaaagtatgtgtctgggttatggattggatatgaaataatcgtactttcaataagaataaagattgacgacaatccattgatttcgcacatacccttcatatgcaaacccccattgcaaataataataataattaaaaataatattttattcatcgtgttttccgtgtgttcgaaaaaacacgcagcgccgctgcctttcgaacattggttttgacattccccgtgaatgacagacggaaaacggaagttgactggcggccgcttaagctagtactaccatcggcgcagcgcccgaatttgacagcctttttactctcggcgagtgtatggaaatagacgtgtaaaatgaaggtacgggccgatttttgtgaaattttgtggttttgcggacgaatttggctgaccggtggttcataaatggcgtaatcgtgtgctgtgcgatttgttggttgtgcagggttggctggatgcggagaaattcggaacgaaaaatcggattttgtgattgtgtcaacgcgtgtttccttcgagggctagctgccaaagttgtcatgggaaggatggtgaagaaatgccatgaaaagttggaagatggaaaaattcaatcgaataaaatggactgtttcaagtgatggtatgaaagtggacagctaaagggaaaatggagcatttcggaaggatattttgaaccaccggaggccacagaagccgggagctgaatgttttgattaacctctactgattgttttgtatccggtgtcttgagctaatgcaagttccaattccttccgcagttgaacgtatcgtttcccgctaccggggcccagaagaccttcgaggtcatggacgaccacaagctgcgtcacttctacgacaagcgtatgggcgccgaaatcaccgctgaccatctcggagacgagtggaagggatacgtcttcaagattgccggaggaaacgacaagcagggtttccccatgaagcagggcgtcctgaccaacagtgagtatccttactttattgtccagggcttgtagcggctcattgtttttaaaatgttttggagatctcttaactggggaaaagagattaaacaagaatcaagagaacaaaaagaaacctgacctgaggaacccagagatgaatgattcctaatataatgtgaccagcaatttcttaggaattctttgtgacattgcgattactgctcatagtattgtatgcatttgtccagaaattgtattagaaaacctatttgcaggtacatctatgagaaagtttcttctaaatactaatctaaagatatctctaggaattcaattagtgattgtttctacggaattcctaagaaataccttcaagaatttcgattaggaatttaagaatttacttttaagaattaacctgttttttttttcttaaaacgtaatcacagaatcattagaaattccgtcaatattcgcgtttagaataatcaaaaatacaactccagatatgcctccaaggatttcttaggatatccaaaagaattgttgttcaggggtcaaccaggattgtctctaagaataccttcaggagctattcgaataattctaagtttctttcaggaattctttgatttgtttttccaaaaaaaaaacttatcaaaatgttggaggaagattgcgatgaacattttttgctacaactaacaactcaatttgttaaacattatataattatagtccaatcaaaggcttaagcctataggctgtattgtatttccaatgtattgaatagtactgttgcaatacgttatattgtttttgtattgtattttttatccgggtacgctttcaaatgcaatttattgagcttaaattagttttgatttcgttgagatacagctgtttgaagtttggtaggtaaaccatagttgaagaaatttcagcagtccaataatgctgacttccccgcacttacgatgctgccaaaaatcgaaaacaaaacagatcactgtcaaattttgagagaccatcactgaatgatatagaagtctataaaaaaattaacaagtgattttgagaacatgattttttgaggttttgtccggccatgcgccactgtgcggccccctaaaagtccgcggatcaccggttgttaaattctgctgtcttcttcttctttctggcgttacgtcccaactgggacaaagcctgcttctcagattagtgttcttattagcacttccacagttattaactgagagctttcttttgccgattgaccacttttgcatgtgtatatcgtgtggcaggtacgaagatactctatgccctgggaatcgagaaaatttcctttacgaaaagatcctcgaccagcgggattcgaacccacgaccctcagcatggtcatgctgaatagctgcgcgtttaccgctacggctatctgggccccccgaaattctgctgtggggggttcaaatattatgtagggagatagtactgtaggaagattcaaatatgatcatcgttttacgagatttctggacttccacttctgtcccgcttataattgttgaatgttggattaatctgatgaatgtggaacctactaactatcgcatagtattcaagtttgtcgaaaatcaagctctggagctaccatgggaaaaagagaatgaacataaagattttacaaattactagagaaatgtttgaaggaatcattgggtaaaatgtagacgaaagtcccaggaaaaattatgatggaaattcaattaaaattataagtagcgattacgagtagctacacttaaaataaaaacatggaagggatttttagagtattttaaagaaaaaaaactacttctcgatttttaacacttcactttacttttgcaaaagaaaaaaataataatcactagtaaggcgaacaaatacctttaaactctaataagcaatacatttgaatttaaatgtgtttgctcgccttactagtgatttttagtattttaatttttcttttgcaaaagttaagtgatgtgttgaagtttaagtaggtagtaagttttttcttaagacgatagattttcttgaagagtttctggagcaatttatgagagtaaccttggatgatttttcgacggaaatcatatgaaaatgtcaggagattaactggacaaatcggtgtaggaattattgtaggtttctcggaagaatcccttaaaatttctttcaaaattctggaaccaacctttgtggatttctttggaagagcttctatacacgcagcgaactggactatcgaatttcatacattttgccttatgaaaggtggaacaattattgcagtacgaacggtttatgtatcgttttagcatcacttcacttcaaggcgtcgataggcgcgtggtgtacgctcggtcctgtcgatcgcaaggttcttggttcgatttcaggttgccgcgaaaacgttttttgttttgaaattctggtttcataaggcaaatttatgaatttcaatccgatttcttgtggcgaatattcataaggggttcctatgtttatcgatagtccatttgcctgagtgtaggaaaggtatctagttatacactcctagtgtataactaactagagaaattaaaaataggactagtgggaacatatctggaggaaatattgacatacccaagtaaccactagcccgttaattcgccgttttgggcttatagggctgtcatacggcttatatagggtatgtcatttgccggctattcggcctcaatggaagttgatcctcaatatcagcttctatattcgaatagcctagatagccgtgtagtgtcggtagccgattgcaacaaggctagaaataacactacggattgcctgttccggtggtataagtccatcatacaggtggcctctaattcatggtgtcatgcggctaaaagcataccgtgcctaggaatgaatggttaggggggtcaaaagaaacctaaccgtgaacggtgcctgtggagtaccagggcacccttcacagtattatgcccttactgtgctacccggagcaatggcgcagttgaccttgtacttctccgaaataatcggctactcatatttagcctcaaatcagaggcttgatacgagtgggagcatgttaatgtaatatgaatcgaatcaaaattatcaaggtgaaccttcatcatgcaaagggcgcatcagcagtgctcagcagaaggttcaccaaggaaaatatcaatgtgggactaattcaagagccctgggtaaataatggaagggtacttggttgcccttcgagcagttgtagagttttgtacgacgaaactcagtccaaaccacggacggctattcttgtaaatagggacacaaaatttgtcccaattacagaatttatccgtagagacattgttgcgatcaaagtagaggtgccaactatccgtgggaaaacggaggtatgtattgcttctgcttactttcctggagatgttgaagatgtgcctccatgctctgtcgttcattttgtcaactactgtaagaaaattaatgcccaatttataatagggtgcgatgcaaatgcccatcatacaatttggagcagcaccgatattaataaaagaggagaagatcttttaaactacatgtcgtctaacaacatagacatatgtaatagaggtgattctcctacttttgtaaactctatccgacaagaggttcttgatctcacgatctgtagcgacttgttatcggagaagattgtgaactggcatgtttctgatgaagaatcattgtcagatcataaacaaatccggttcgattttgaagctggatcagaaataacagaaagctatagaaacccgaagaaaaccaattgggatctctatcgttttcatttaacgaataagaattcgtataacggtgaacagttcacgactttttcacaactggaaaatgcctctgatgggatcattgaccaaatggtctcatcttatcatgctagctgtcctattcaacaaaggtcatctaacagggatgtgccttggtggaatgacaagctggcaggattgaggaagaaatccaggcggttgttcaatagagcaaagatcactttagattgggttgaatacaaaaaagccctaacagaatacaacagagaactaaggcacgccaaacgtaaggactggagacgggtatgtgaaaccatcaacaacgctcctgcagctgcaaggctgcacaaagtcctttcaaaagaccattcaaatggtctaggttgccttaaaaaagaagacggcagttatactgttgactcttctgaaacactggaagtaatgatgagaactcatttccctgaatcgatcccatattcggatgaagaacaggtctcagatgaggcaagacatgtatggtcgataaatgcctatcagaaagctcgtgaaatcttcacgccttcgagggtcgaatgggcattgagttcttttcagcctttcaaatctgccgggaaagatgatattttcccagccttactgcaacaaggaaaagagacgctttgtccgctcttaaccgaaatattcaaagcaagtgttgcgctttcatatattccaaaagcgtggcaaaaggtccgagttgtcttcattccaaaagctggaagaaaggataaaacaactcccaaagcctttagacctataagcctttcctctgttcttttaaagacaatggaaaaaataattgatgacttcatcaagtcaacaagtttaatagaaatgcctctttgtaaataccaatttgcgtatcaatcaggtaaatttaccattacggcgctgcagtcgctggtaaataaaatcgagaaatctcttgaagccaaagaaatagccgtggctgcttttctcgatattgaaggagcattcgataatgcatcctatagctctatgagttcagccatggaagcaaggggcttggataaaagtgttatcgaatgggttatgaccatgctcaagggtcgcacaatttctgctgatctaggaggtgcgcaaatatctataagatctacgaagggatgtcctcaaggaggagtgttatcgcccttactgtggtctcttgtagtagacgaactccttagaaatttaatagatcaaggttttgaggtaattggatatgccgacgatgtggccatcttggttcgtggaaagtttgataacacgatttccgatcggttgcaaactgcgttaaacattactctcaaatggtgtaggaaagaggggttaaacgtaaacccttcaaaaactactatcgtgccttttaccagaaggaaaaaggtaaagcttatacagccttctttgaatggagttcaaattcaattttcggaagaagttaaacaccttggtgttactttggataagaaattgaactggaactctcatctgagcaaggtcataagtaagggtactaatgccctatgggtctgcaataaagccctaggaaaaacttggggactgcgacctaatatggtaaactggatttattcagcaatagtccgaccctgggagggaggcaccgatactacacacgaaatatagaacaacatttgtttgaactgcaagataactccagcttgccaacaacaatcaaggcaggcttggagaaaactgctagttttcttttgttgtgtactttcgatctttcctgacaaacatggaaaaagggccacagttttctatgcactaaatattaattttcattggaaaaagtaaaacgatgcgtttttcaatgcttcatatttaatcagttgaaaggtgctcacgtgacagtgcatgaattgactttcattcaatttttgtcacttttgatgaaatgcgaaattgtgtttcaatcagttacgcgctttttccatgttagtccaatgtttgagatctgggctcacagtgacagttcgtgacagcggaatcccggctcactatgacgtacagaaattttgtattggtttctccctcccaggtccgaccaaaaattagttatgcttcactggtatggtggcccaagacaaatgaggtaaccgctcagaagaagctggctaagttgcagagacttgcttgtatatcaatgacaggggcaatgaaaagtacaccatcggttgccttggatgcccttcttaatatactgcctttgcatcaattcactaaactgcaagctgcaaaaaatgccttgcagtttattcgttataataaaatactagatggtgatttgattggtcacatgaaaatcatcaaggaattcaatttgaattcagataacaaaacaatagaagattggatgacaacgaagaccaactatgattttccctttaaagtggttaaaccaagccgctatacttggcattctggtgggccaagtttacgtgcaggttctattgtgttatataccgacgggtcaaagatgggcgacaataccggagctggagttttcggccctggtatcagcaaggtaatcgctatggggcgcagtcccactgtgttccaagctgaaatacaagccatcattgactgtacaaatgtttgtctcaaaagaaactataggtttgcaaagatctgtattttctcagacagtcaagcagctttgaatgctctaaaggcattcacatgtagatcaaagttagtgtgggaatgcattctttctttgaagcaattggccagtaggaacgaagttacattgtactgggtgcccggccattgtggaattgaggggaatgaaatcgccgacaatctagcaagacagggtgcagcttcgagctttgtcggccctgaaccgttctgtggtattgctgagtgcactctcaggatgaaactgaaaaattgggaaatgtccatggtagaatccaattggaacgccacggatacatccaagcaagtgaaaagattcataaaacccagtctagctaaagcccgggctatactgaatcttaataaaggaaatcttagggtaataactggcctgatgaccggtcactgcccaagtaggtatcatcttaaaaatataggaaaaatacaatcctctgagtgtcgtttttgtcaagctgaagacgaaactgctgagcatttactctgcaactgcggagcattgcttaatcaaagaacgttaacatttggaaaagggttattaaagcccttggaaatttggcaaggtagtcctaataggataatagactttataaaacgagttgtgcccagttgggacagtgtgacacatcaaccaatgtctatcacatctcaattgtgaaaggatatttgatgagcaccaaataaaatatgggtcataccacaatattcctaaataatggaagcagtggttaaaaggctctacagatgagggaaaaaaaatagggtatgtcagctctataaaagcccttcattagcacggagggcgaattaaagtgctatttggttactttggtagtctcttggaaattctttaggacaagtgaaattactggagatagtaacgttaaagcaaattctgaagaaattccacgaaacatcaattggaaaatcaatgcaagaatttctgggagaaattttggaggaatcccagaaggtattccagaagaaatctggagaaatcactagaaaagttcctggatgtttacttcttcttctttctggcgttacgtcccaactgggacaaagcctgcttctcagattagtgttcttatgagcacttccacagttattaactgagagctttctttgccgattgaccatttttgcatgtgtatatcgtgtggcaggtacgaagatactctgggaatcgagaaaattgcctttacgaaaagatcctcgaccagcgggattcgaacccacgaccctcagcatgatcatgctgaatagctgcgcgtttaccgctatggctatctgggcccctaggatgtttactactgggatcagaaaaaaaaaatatttggaataatcgcgtaatggtctctgaaggtttctcagtagcctcttaaattttgctccaagaaagaattaactttagagatcatttacttaaaaagagactatggtaggtgtaccagttatggacataatggtctatttcgccatagacgataattcaattgttttcaaatttttaaaaacttcgtgtgtcttagtagtttgaaatcaattatatcttgctgttaaaacatttaaaaatgtgaaagtgtggccaaatagggaaccactatagccataactggtacactttccctagagagcttccatcaaaaatgaactttttagagacttgcattaaaatagtgaccaagtctcttaaattgatttccgctagcacagccctatttttccaatcagactaattcttaacatttaattcctttttacagcccgtgtccgtctgctgctgaagaagggccactcttgctatcgcccacgtcgtaccggagagcgcaagcgtaagtcggttcgcggttgcatcgttgaccagaacctgtctgccctggccctgatcgtcgtcaagaagggcgagaaggacattcccggactgaccgacaccactgttccccgtcgcctgggacctaagcgcgccagcaacatccgcaagttgtacaacttgaccaaggaggatgatgtccgccagttcgtcgtgaagcgcccactcccggagaaggatggcaagaaggcccgcaccaaggcacccaagatccagcgtctgatcactccggttgtgctgcagcgcaagaggcatcgtctggcaatcaagaagcgccgtgtcgagtcccgcaaggaagccgaagccgaatacatgaagatcctgcacctgcgtcgtcgtcaggaacgtatccgtcgtcggtcccgtctgtcctcgatgcgtgactcgcgcagctccgtcggtgaggaacgcgacaaggagaaggagaaggccgctgctaaggctgccaagaaggtcgccaagaaggaggccaagaaggaagtaaagaaggtcactgaggccgccaagaaggctgacgccaaggccaagaccaaggctgaaccgaagaaggcagaaaagaaggccgaaaccggtaagaagaccgccggagacaagaaggagaagaaggtcgagaagaaggctgcgccagccgtcgccaagaaggaagcgcccaagaggaaaccggaagccgccaagggtgatgccagtgcggccaagaaggagaagaaacaaaagaagaagtaaataacattctacttcgctagcggggcgctttcctttgtaatttaatcttaatgataaccacaaaaatacagagttaagaaactaatgatggctgcattgagcggattatcttattcctgtgtttttttttagggattctcgttgtcggatcgaagctgtattgaatagtaactagaaagctgaaaatgcactgaatcgcttcaagtgggacctgttgtgactcatgcggaggaattcatgtaagttttcagcttatagggattccctccgtatgattctacagcgagttaaattcagttttccgaacatggtccttttcactcgagtcggggttgtacacttctaagttttattcttgacattgatttttcattatgacttacttgcaatgattgacttctcttcatcgttcattcattcaattattttgttaacatcaaaaaactgaatcaacaatttcacgccacaatactcggttcgtggccgcatatcgccatcctcggttctgcaccacagtcgccaaatcgctgtgcacttaatcctcccactagctcgctgcgctccacgcgagtccggcattcttgcaacatgccctgcccatcgtatccttccagctttggtctcttcatcatcgctctcttcgtattattacagcaaactgattcatttatcgtagcacttttagggagttgcccgataaaggatggtcaaatcttgtatctttagctagaaaggttgcgaaagtaataattttagcaaagttatttgcgaaagagaggttcgattaagtcagaaaagctttttatgaaggaacaatgtcgatctgtcttatggtctgctgaatattgttttatgaagtttgcatcataattattttcatggatatcgaaatcttcatccaagtggaagttaatttttggtaaattttgcgttaacaaagaaccttatacagttttactcagtaactacaccgtttgctagtttaggaagttaatacattgaccaatgcgttagaattattcaatttcaatcatttgattatacatgtcaggcttacgtttctattgaaaccataactcatcacgtgtttcagctattcgaaattaaggtaagaaaatatttttaaacaacttgtataacagtgtgtctggaaagttaattataagagaagctgtcatcagctttaaaattctgccaaggtttcaccttaatctgctgttgccccttccttttagagccgttcatgcaatccagtttctcacctcaatcgtactgtcaaaaagtgcatgcaactctcggtggtgaatttccaggtaaatggaaaaaaactaggggtgtctgattattttaataattcgactgaactggtttttgatggagaatatattgcttcgcgttgaaaaatgggttaaccaacgtgcgaagtttgatttttgaccaactttgccgcgtcgcatctagattttcaatagtgcgcataatgcacacggtggagggcatagatgcgcactatagcgaagtgactcgcgacatggcgaagttggtcccatctttagttgcgaagcagtatattgtttcactgaagcgatttttcccttttcagtattgtgcaccccccgctaatatgaacgatattgcaaggaaaatcgaggttcattttttatttaaacttcaagttactctataaccgtgtttctggttatcccttt

SEQ ID NO: 71 - DNA, 9346 bp, Aedes aegypti
cgccagtcgtaggctcgccttgcatacatgctcgtgtatggtgtatgatggtatgcttctagcagcagaaaaaaggtaccatcaggcaggaaagaaacggacgagtgagagaggtcaagggaaaacaaaattgccctcttcttccgtacggggcttcatgtgccgtataatacacctttgagtccgatccccattgatgggtgtttcgtcgctgtgaacggtaccgtcaccctattaacacactgaaaaggtgctccgcggaggttgtaggaagcgtgtgtgttggtgcaaaaacagtgaaagcatcagctttaagcgaaggaattattttgaagatttcagcggctgacgtgaagtcgataccagattatgagaatattcgaaattttacgatgaggctctgagtgattcacgagtttgaatcagcccccggtagatagtgagccctgctatctgctgttgcagttgaaggcctttgtgatagtccgatttatcagtattctgaaagaacaacaaaagacatcattagcgagaagaagcaaacagagagaggctatattagtatcgattttcataggaaacaacaccgcaatcgcaatcatgtccaatcacatccacacacagtccaccgatgcagcgttgatcgccagaatgcatcagatgaggctggatggggacggctcgggtgcaggacaacccagaatggcccatccccagcagtcgatgatgtcggatgggatgtccaggggtagccaacatcttgcacagatgcagatggaaagccactacgtcccagtttcgacggccatcgggtccgggaatgttgtgctaatgaacgatccccgtatgtatcaaggtcagatgctggcttcaacagctggtcgaaaaccaggagacattgcgcatgttggctactacagagttagcaacagccccacccattcgcttggaggctcatctcatcactcgggcggtggcagtccacgcgctagcggacagctacaacatcctcagcaatactacgacccgcggtatcaagccgtttacgagaacatagactactatcctcctgctcaacctcaacagatagacgcgctcatgtacgaaagaaaatttgaatccaacaacgtcaaagctcagcctcaagttcctgttggatcaggaatgtcccatctaccacctaacggtaatgccggtcgctacgctcacactcctcagccaccagaacttcatgaacagcctcccatctacgagaacctccaaacagcatccggacagcaggctcaacctcaagctaccaaggcttccgcgcaaatctactaccaccgaaatgacaccagtagtcctcaggtccctcacaatccacattatcaactccccgaacttcccatatacgaaacaaccgttgtcaaccccagtgcaaactccaggtacgtcaccgcaagtcaaggaccaccgccaggaccataccatcattcgccgagcaacagcaacgtctccctcaaaatcgcccagcaaccacagcccgtgcacttgcccaacgtcaaataccaagccaccggagtcccactctccgcagctatccccaatgactaccaaaagtctcccaagcacacgtcagccccatcactggtaagttccacacgtacaatctctcacaagcaaactccatcaatcgtccttctcgtacccagccaccaaaatcagccgacgccatcaagtaccaacagcaaggtgcgaaaactaattccccatcgcgcagcagctccatatccggttccagctcgttgaacaagtccttcatcgaggacatcaacgggtcggactacgtgtgcatgaccggcggaaacaagtaccaacaccagcagcagtactccacatccagccaatcgtcacaccaccaatacaccgcaaaacctccgacaacgatcgcatcctcatccgccggaagtgccacgacgccgtcaggtggccccgtcaccagcagaccttccccaaatcctcccccgacatcgcagccttccgccggaccaccacccggcagcaaaccgaacagcgcgcagagctccttctccggcggcccggcgccacagagccgtgcgccttccgcagtttcgccaacgccatcgcaacttagcaccggaagcggttccggcaaacgtgagtagaacagttcgttggagataacaacttatgacggagcctgaatgtcattgtagggttaacgaagaacctcctgccgtacaacgtgacaccgccgcgccctaccggaccgaccgaggcggagcggaagatcgaggagctcacccggcagctggaggaggagatggagaagaacgaagagcagggagagtacttcggtgagtgttgagcggacgttagagataagcaagaaattttgtccagcttctggaagacaagtgttccagtttctgcgagacaagcctaccagcttccagaagagaagttttccagcgtctggaacagaagctttacagctttcgaaaaagaagcttttggaagagaagctttccagcttctggaagagaagctttccagcttctgaaagttaacatttccagcttctggaaggaaaaatttccagcttctggatgagaagttttctagcttctggaacagaagctttccagcttctggtagagcagctttccagaagagaagtttccagcttctgtaaaagttttttagcttaggaaaaagaagcttaccagcttctggaaaagaagctttccattttcttgaagagaagctttccagtttctggaagaaaagctttccagcttctggaagagaagctttccagctgctggaagagaatctttctagttttagagagagaagctttctaacttctggaaaagaagctttctagcttctggaagagaagctttccagcttctggaagagaagctttccagcttctggaagaaaacctttctagcttctgaaagagaagctttccagattctagaagagaagctttccagcttctggaaaaggaactttttagcttctggaagagaaatttttcagcttctagagtaagaccttctcagcttctggataagaagctttgcagcttcaggaagaggagcttgcagctgctggaagagaagttttacagcttctgtaagagaaacttttcagcttctggagaaggacctttccagcttctaaaaaagaagctttgcagctacaggaagagaagcttccagcatctggaagagaagcttttcagcttctgtaagagaaacttttcagcttcaggagaaggagatttccagcttctggaagagaatctttgcagcttcaggaagagaagcatccagctgctggaagagaagctttccattttctggaagagaaactttccagcttctggaagagaagctttccagcttctggaaaagaagttttctatcttctggaagagaagttttccagcttctggaagagaaactttccattttcttgaagagaagctttccagcttctggaagggaagcttccagcttctgggagagaagctttccaagttctggaagagaagctttccagcttctggaagaaaactttgtagcttctggaagagaagctctccaagttctagaagagaagctttccagcttctagaaaagcaacagcttctggagtaagaccttcccggcttctggaagagaagcttaccagcttctggaagagaagctttccagtttctggaagagaagctttccagcttctggaagacaagcttcccagcgtctggaaaagaagctttccagcgtctggaagagaagctttccaacttctggaagagaagctttccagcgtctggaagagaagccttccagcttctggaagagaagctttccagcttctggaagagaagctttccagcttctggaagagaagctttccagcttctggaagaaaagatttccatcttctgaaagagaagctttccagcttctggaagagaagctttccagcttctggaaaagaagctttccagcttctggaaaagaaactttccagcttctggaaaagaagttttctatcttctggaagagaagctttccatcttctggaagagaagctttccatcttctggaagagaagctttacagcttctggaaaagaagttttctatcttctggaagagaagttttccagcttctggaagagaagctttccattttcttgaagagaagctttccattttcttgaagagaagctttcccgcttctggatgggaagcttccagcttctgaaagagaggctctccaggatctagaagagaagctttccagcttctagaaaagcaacagcttctggagtaagaccttcccagcttctggaagagaagctttccagcttctggaagaaaagatttccatcttctgaaagagaagctttccagtttctggaagagaagctttccagcttctggaagtcaagcttcccagcgtctggaaaagaagctttccagcgtctggaagagaagctttccagcttctggaagagaagatttccatcttctgaaagagaagctttccagcttctggaagagaagctttccagtttctggaagagaagcttttcagcttctggaagagaagctttccagcttctggaagagaagctttccatattttggaagagaagctttccagcttgcaggagaaaaactttccaacttctgtaagagaagctttccaaattctggaagagaagctttccagcttctaaaagagatgctttccagcttttaatagcttaggttactggaaaagaagctttccagcttctgggaaaggagctttcctgctttcgaaagagaagctttccagcttccggaagagaagctttccagcttccgggagagaagcttttcggcttccgggagagaagttttccagcttccgggggagaagctttcccgctttggaagagaagctctccagcttctggaagagaagctttccagcttctgcaagacaagcttccaagctttcggaaaagaagccatcagcttctggaaatgaagctttccagattctgaaaaagaagcttcccagcttctggaagagaagcttcccatcttctggaagagaaactttccagctactagaagagaaactttccagcatctggaagagaagctgttttagaagcttttcatttttacaatagaagtttttcagcttctagtgaggtgttttctagctcctgcttagaccgcaaccaaccgatttagcagcctttgcatgaaacttgtgcaaaacactgtttccagcttctgtctaagaagctatccaacttttgactgagaagctttccagcttctagatgacaaacttacttgtttgatgcagaatagctttccagattatgtgtgagtagccgtccagcatcagtttgagacgctttcaagcttcagtgtaactagatttccagcttatatgctagaaactttctagcttctgtgtaagagttttcttgctagtgctgagaaactttctagtttcttccgagaagctttcaagattctacttgtttttaattatgaatcgtggtttactgctaaccaaccgagtggaagtttaacaactacctaaaagctaaacattacatatattttgcaattggattaaatggacaaatttatgtgaagttttgcgaaaaagttacacgtcttctcagtgagaatcgaactcacgactccctgatctctagttagggcgcgttacccctacgccatgagaggactcatggacgcagaagttaacctgaattcgatttcagctcacgtggtcctttttcgcaaagtgcacctcttggatcctacacaatagaaatctcagccaccacgtcgctggagagtgatgtgtggcatttcactacctaaaaaatattgcgctctcgggctaggcattggatatatatagaaagcgttgtgtttggatgggcatctaattcttccgaaagaggtgcactttgccaaaaaggaccacgtgattattgagctggaatcgaattcaggttaacttctgcgtccatgagtcctctcatggcgtaggggtaacgtgccctaactagatatcagggagtcgtgagttcgattctcactgagaagacgtataactttttcgcaaaacttcacatcaatttgtccatttaatccaattgcaaaatatatgtaatgtttagcttttcggtagttgttttcaagattctgttgataaactatccagtctttgctactgctgagaaactttcctgtttcagctaggatacgacttctgggagaatccatgcgaaaaaaatacaaggaatatttgtagacatggcttaaattattattggaaaaatgggcttattaactcgtgcaggaattgtagtaggataacatggaacatccagtattatgttcttcttcaataagtcttcatatgtctttctggaagaatacattcctgtaggatttttggacatcggtgctacaggatttctttcggaaatcttgggagcagcctgtttttgttcctggaggaattccttcaagtaacttctgagaaatcgctggtgtatgcttttaaaattattcctccaacgatgttagcaaattttcttcatttattttcaaaaaaaaatattaaaaaattatataatttaaatcttgcgaaatccgctaacagtttgaaagaaatcttatacaacctctcaaaacttgctccaaaaatcccagctaagtgtttactaagaatatcacaagaaatttgttaagggtgtagggaaagacgtattgaaaatattttttgcaatccacataaaatttcatcagagatctcgcaaggaatttgtcatagatcaagggcaagtcaaataagacctcatcagaaatccgcttatattaaattcgtacaaagcactcgatatattggagttttctaagaatctgggttggggcccagatagccgtagcggtaaacgcgcagctattcagcaagaccaagctgagggtcgtgggttcgaatcccaccggtcgaggatcttttcgggttggaaattttctcgacttcccagggcatagagtatcttcgtacctgccacacgatatacacatgcaaaaatggtcattggcatagtaagctctcagtgaataactgtggaagtgctcataagaacactaagctgagaagcaggctctgtcccagtggggacgtaacgccagaaagaagaagaagaatctgggtttaaaatccttcaagaagatctgcttaagaagaaaatcttagatttttatataaatgtatccatagatctcgtcagccactacaacaaatatatgtgccaaagatctccctacaaatcagctaaaaacaccaataagatttggccaaggaagctatcaaaaatcttatttgaagtccacaactaactttctaaccaatttgtcaaaaatctttcaaggaattcactaagtatctctctagaaatctgtcttaaatcccaatgaaattcagttctcgtaagaatcagctagatcttccaaagaactccgtaaaaagttttcaagaacataaaaacaagaaagctgccaaatatctttccgagagagtcgactaaatgttctacaggattaggacaagcatttcatcagaatctttcgagctatacatctctgcaaagtttagttacgatacggagtttgagatgtaaggcggccggtataattaatggttagaactttaaaagaaccctaggaaacacgttcaaaacaatttgttccaataattccagaaaattccactcaagaactccaatcccttatttgaaaatcacagaatccattccagaatttatttctggaaattccggagaacttctcatctgggaacattccgctttgcctagccgagaactttctaaccacctcgctttccgttccaggcatctgccacacctgcaaggagaaggtaaccggtgccggagcggcctgccaagccatgggcaacctctaccacaccaactgcttcatctgctgctcctgtgggcgtgccctccggggaaaggccttctacaacgtgcacggccgggtctactgcgaggaagactacatggtaaatgtaccgagcgccgtctagaaccgcttgccgcccttcgctcctaatgcgtgtttgtttcgtttgcagtactccggcttccagcagacggcggaaaagtgtgcaatctgcggacacctcatcatggaaatgatcctgcaggcgatgggaaaatcataccatccgggttgcttccggtgctgcgtatgcaacgagtgcctggacggtgttccgttcacggtggatgtggataacaagatctattgcgtcaacgattaccacagcatgttcgcaccgaagtgtgccagctgtggcaaaggtaagggatcgtcacgaataagacgtttgaactctaacggttgttcttcacaggaatcactccggtcgagggaacggaagaaacggttcgggtggtcgccatggacaaggacttccacgtggattgctacatctgcgaagagtgcggcatgcagctaacggacgaaccggacaaacggtgctacccatacgaaggcagactcatgtgccgatcgtgtcacatacagaaaatttccatacaggacatgcagcacggtcggattgtggaaccggtctgcgccacgtaccagtacatggcataaatagctattttgaatttatacgtaacgcgtacactcctcaaaatcaattatacattttacccggctggctggaaacttatcaagaattatgtacgttgaaaagcggcaatcgcatttacaaatcgtagaatgaagtaagtgtgcggaacactgccaaaaaccgctggataatacctagaagatcgatcaaacgattatacatttccaaatggcagatgtcaatcttatggcagctgtcgaaagtcaatattattgtgcaaatttccttcccattatttaatcatcgtcgttatcatccaacttacagtctattatgctatatattgacctagccgtatgtttcatcacttaacgtattggaaaccgcgagaattgtgcttaaaaatacttgatactcacgagaacttcaaaaaagatacattccatcaaaccgccacggtgtctgctctatagtatattacaggtaagtagtggtggcaaaactccatattcgcgatagaatgccattttatcggcagcttaatccatttgttgcagaacgtgcgaacaaaacacgaattgatatgatacatgactattataatattatcgaatacgatt

SEQ ID NO: 72 - DNA, 5580 bp, Anopheles gambiae
acagatgtcccccacaatgtcgcccagcaaaaccgataaaaatcaaccttctaaatacattatccttggtccgacgttatctgtcaaatcccatataaaaatttgacagaccgtccgataaaatcgcatgcgaaaaaacgttgccaccgcccttaatcacccacaaagtttgacatcggaaagatttttcgttaaacagccccaaatcagctatggaattcgagctggctatttgggtagtagatcagtttagttctacattttcgcgtgaacaattcaaagtgcacttgaaaaataatgttcgattgtttactttgaatagattaacatcttaacacatttaatggcgtactcacaaaggaaatttatgcaataatatacacgttggcagaaccaaatctctcatttcattccttctgcagaactgggctacttttagctaatcggacgcgactttcccccgtacgtgttgtatcaactgtcagattgctgcttgccggacagccgcatgcaggaccattgcctaagcgtacgcggtcccatatttatgtcgtgtcttgttttctcgacagacgtcatctattttcctcgcccagtagtcgtacgataatggtaaagatggatgcacgaatcttcgatgatatgaatttgtaagtaaaatgcacttttattcggtacaatttgtcatccagtgtccacccaacgcttgccatcgcaccaacccgtcgcaagagtgtaaaatgtttacccttttttcgcccatccggcgttgtgttggatatggatgttgtgggggaatgcgaaaaaaaacatctgatccgtaaacgatgttgagctgtttgtttatctcgttcattccgttgtaaccgtgccttaccgtttcagctacatcacgccggaccggctctacatcgagccctccgagtcggaacagttcgtcatcatcgaacggccagatggagcagtttcgctgcacagtgcgtatagtagtcccttttccagccggtgcagatttgttttgtaaccttatcctctcttcctaccacctctctgcagccgtggacagcaaggagcggttaccgatccatggttacgagctgcggaaaatctgcggagtgctcggcatggtgcggctaatcagcgggctgcatctggtcgtggtaacgcatcgcattttcgtcggccttatcaacaacgagccggtgtggcagatggctggttccgatctgataccgctcacgccgacgctgacgcacctgagcgagagccagaaggaacagaacgagacctatctggccatgatgcggcaggtgctggacacacccttcttctacttttcgtacggctacgaccttaccaacacgatgcagcgcatcggcagcaatccgaaggtcggggacaatgttggcctttacgggcagagcgacaagcgcttcgtgtggaacgttgggctgctggagaactttccactgctggtgcgctacgttctacccatcatacatggctgtgagtacacccggtggcatcatgccttttcccgtacattgtaaactagtagtggtcggacctacctgattccgattccgtgttcggaatcaattccagagtctatttagatgctggaattccaattttggagtcgatttcggagtcgagttcaatcgattacggcgtcgattccggaatcgattccggaattagtatcggtttcggaatcggaatcgaactgggaatcacaatttactccggtaacggtatcagaattgactcctgaataggctccggtatgagaatcagtgcttgttcttgagaataagagaaacaagaagtttcagaagtaaaattagtccgggaatctccatgagaatggatcgtttaccagtagattaggattctttgcggctatcaatacgtagcatcataggacccacacgtctattcttatgaagatgtcaaaaccgactccgatttcgaagccgattctgatttaagagctaattccgattctgaagccgatttcaatttcagagcccataccggagccgattccaatttcagagccgattccggagccgattccggagtcgattctggtgtcgattgtggagtcgatagcggtgtcgttcccggaatcagaattggccccggaatcgaaatcggctacggaatcggaatccaactgggaatcgcaatttgctagggtaacggaataaaaaatgtccctataattggaattagctccggaatgagaaacagttcttgttcttgagagtcagagaaacaagaagtttcagaagcaaacagaagcattctttgcggctatctatacgtagcatcattggacctattcttggaaatgcctattcttaaggagatgccaaaaccgacttcgatttcgaagccggttccgatttccgagccaattccgattctggagccgatttggattcctaaatcgatttcaatttcagaaccgattttgattccggaaccgattatgattgcggagccaattccggaatcgattccagcaaaacttcggagctagccccaatcgattccgacgaaaacttcatttttcccatcactactgtaaacattaagttttctctctcattctctctcactctctttctctctctctctctccctcccttccctccctcccctgctatcggtgcagttgtttccatcaacgatgtaacggtgaacgggcatgctctcagctggatactgatctcacgccgctcggtacagcacgccggcacccggctgttctgccgcggcattaaccagaatggcgaggtggccaactacgtcgagacggagcagatcctcgtcaccggacaggatcgggtgtcgttcgtgcagacgcgcggcagcattcccctgttttggcaccagacgccgaacttgcagtacaaaccgcggccacagttgctgatcgggcgggaccatctggtcgcctgctcgcgccacttcgacgaccagtgcaagctgtacggtgcgcagtgcctaatcaacctgatcgaccacaagggcgcggaagaggtgctggagaaagcgtacgatgcgaccgtgtccggggtcggcaacacgcagctgcactacgtctcgttcgacttccacaaggagtgcaaaaagatgcggtacgaccggctgagcctgctgatgaaccgcatcacccacgagcaggacaagttcggcttttatcacaccaaccacgtcggccaggtgtactccgtccagaagggtgtgttccgcaccaactgcatcgactgtctggaccggacgaacgttgtgcagagcctgattgcgaagcgcagcctcgagcaggcgctggaacggctcggcattttcaagttcggcgagaagcacatcgatcccaactcccagttcgaggcggtcttcaaagcggtaggttgatggtgctagtggctagtgtttcatataaaattggaatgcaatttgctctgtttttattacaggtgtgggcagataacgcagacctcatctcactgcagtactctggcaccggtgcgctgaagacggacttcacgcgcaccggcaagcgcacgttcaaagggctgctgcgcgacgggcttaactcgcttacgcgctacgttaagaacaactttagcgacggcttccggcaggacagcatcgagctgttcctgggcatgtaccgcgtacggaacggggaaggtttggagtttccctcgccgctcagtgtctccgatcccacggtcgactggcgcaagcgaatggtaatgtactaggccgatacatcttcccatgccacgcactaacctagccacttccatccttcgctcctgttctgcagattatggccacggtgctgtttgaaatagcgatgttctttgtcatcatgctatacccgaccgagtttagctttaaaacgggtgtcctgctgctcggctggggcgtgatggtactgtttacccatcggttcttcgtcaagcatcgcagcgatttcgtcgaccggccgaagctgctgtcaaaaaagtagcttgccggcaggggcctctaaccgctggcgaagaactggccatgcgcgacgtgagcatgtactacaccatcgtgtgagcacggcacggcggcagcgtgcggatcaacagaggggcaacggatgaccggcttttacatttatacatttgcatgttacgggtgcgtaggaacggtaggtttatattcatttgcgcgtgtgctttgatttatttattaatttattatattcgttgatttttgttcttttttttaatttgttttgcagtaccttacgcgggaaagatgcacagaaatcacaggcacgtaaaattgattgtagtcctgcgtagttaaaacaaaatgggttcatctagaagaatgatcatgcctgctgccagtaggaaaattcaaatttagacgaatggggcttcagatgatgcaaatgaatcaataatcaactcctaacctttccttacgatttgtatcgaatgcatggtctacgggtgcagcaatgcagctattttgcttcctatacggttatttcagggtaggagaatgttattctagcgtaaaccaataaatcaaggtgtagtggatcattgcaattagtttctttcccagccgtagcaaatcattcacgaccgacagatagtgatacagagagagagagagagagagagagagagggacagagagggacagagagagggaaagatgcagattgtgcgtgaaatgggaaatggttaatgggaataaacattcatcaaggtgtagcaggtgttaggaactgttggttgtaattgaccgttacagataagcaggttgagctaaattccatgccaattccagtttgattgtttgtgactaacaaactataaatatttatatattttcggcgcggtcttgtcggcacgtaaaacgtaacgtatatgaacaatagatatctacaataaaatcactccgtcattcaagaaaacagcaaatgtacatggtagtttcctctatttttgtttcctctactaagcctttatcggcattaatagggttttgtttgcctttgtctcgagaatgcgtaattacatttatcatgctcatttcattctattacgattgcctattcctgtaataattttgtaattatgcgtgtcatactatctactagtatcatttttactaacattactcacagtatgaaacaatcaggcttattctattattgcaatcagctatactgctaaggaaaaacgatttactttgaaacgaaactataatgggtttgaggtttctatagaaatatgtacagtagtccagtccagtggtctcaattggttttccctaagagccttctaaaacaacttcttctaagagccttctaaacagagcatgattaaaagatcaatcgagtcaaatttgtcgtctcgattataatcgggtaaaagactggaatattacacgtaatatggttgtttttattatcctaaaaaacctaagacaagacaaggaaattaaattttggtcttgtaaatacagtggccggcaaaataaagtgcccactacttacaattttacatt

SEQ ID NO: 73 - DNA, 5053 bp, Anopheles gambiae
tcttcttcttcttcttcttcttcttcttcttcttctcactcttcttcttcttcttcttcttcttcttcttcttcttctccttcttcttcttattcttcttcttcttatttttttgttgcatcatacattatcggtcaacgtctgtctaagccacaaatatttaaatgtcgtggaattgttgttttgatccattatattcgtttccatatcctttatatcctccatcactccaattcatcgaaaaactcactgggcaaacagatcatcataatccgtaatgagagtaatattagttcaacagatgaaggtgatatgccatatattttgaaccaatcatttcatcagctctgtcataaatttacagcataagagttttcataaaaaaaatattaaaacaatattgtatatgaaccactttatatttaacatttttttactgatagagtaatttcatatccaataaaacaaaattctttcaaaccagcaacggtcatctgtttacaatccgacatgaatttgaattgaaccggtttcgctccgtgaaccggttcgttctcggaatgattgttcctctcgctgttaagccatcactacagacttattttcgcagagtgtagatgcgtgtgtgaaacgagcttagattaattattctatttcagtgataaaaacgtgcaaaaccctttgaaaaaccagcaccagccaacgaggaacacttttctgctacactagcaccatttccttttcggtaagtgttaactggcagccgtaaatcggcggtgcaaagttgcgccccgctcgctcaggtaaaaataagacgagccctacactgacgccatcttggattttcacttttcgctttcgtccgctgttgctgctttgtgctgcaggcacgggtggtgtgttttttcgggacgctgcgggaagcaaacgacgtggacatcgatccctggcgtcaacgtgtccatcgcatcgtgtagacgtgtgcgatgaatgtaggtgaaacagccgtaagtaggattatgaactcgcaagatcaaacattgagccagcagcaggctgcctggatggcagccgcccaggcagtccagcagcagaccgcagctggtgggggctatggcggagcgtacggaatgaaccagcagcagcagcagcaacagcaacagcaacagcaatatgctcagttttacgcgctgtaccagcagctgcagtacagcaactctggcggtggcctgcagggcaacatgggacaggctggcttcgggacggccaacagcaacaagggcgttagcggcgtgggcggcacgatgaacaactcaccagccggattttcggctggcccaatgtccgataacggtgtcgccggtggtatgggttcgcctggcattggaattgcgggtggcaagtttttcagctctcctcagcagaaccagcagcagcagcaacagcagtccggtaatgacggaatgggcttcaagcaggcgcccagtcagttcgggccgattcgcttcaacatcaacaagcatccgcagcgggtgagcccgatcgtggccagcaatccgctggcacaggcaagccaaatacacgcccagcaacagcagcagcatatgcagcaacagcaacaccagcagatgatggccgcgttccaaaaccaaaatggtacgggtggtggcaagaagaagcgcaaaaagaacaaaaacaacaacatgaacaaccagcatggcaatgggaatggtggcgctggtggtggtggtggtggtggcggcggtggtacaattttcatgaacggtatgctcaacccgaccgccaacattccgccactgatgccggcgggctcgctgccggtgtcacctgctggcggcagtgccggtgccagctttgtaacgtctccccccgatctgagcaagccaccgcctccgctgccggcagtgccgggtggagccattcccggtggtgtcggtcccggcgccggcattgggctcgcgccgcaaccgcaggcccagacgccgccgaacgttgggccgccgaagaagcccgatccgttccacaatccaaccgacgattggccgcaaagcttgaacaacttcgtggcccgatgctacgccaagtgcaagaccgatttcgacaaagatcagatcgacatctgtctgaaggggcgcattacggccgcggccaacaagggtgaattgtggacgaaagactgggacaacgaaccggtgccgagcgtgcacagcgagcgcaaccagcagccgctgctgctgccaaaccttggcagcggcgtgctgggcatgggatcgcccaacaacaagggcggcaagcttggcgggctggcccagtaccagagcccgctcggaaacgtcaagggaggcggccagcacccggcgccgtacggggctaagaagccggcacccaaccaggcgggtctttcgcaaccgttcggcacgaggctgggcgtcaagtcgggcggtggttcgaccgcgggcagcaggaagtcttcccgcccgtcgcggtcgcgttcgcgctcacccagtcggtacagcagtagcggcagccgcaatcggcgcagccgttcgtccagcgatgattcacggtcgccacgccgcaagggacggcgatcgtcgagcagcagcgacaacgatagtcgtgccgggggttacgcgagcaaatcgttcggcaagggcagcagcaacagcaagcagcagcagcagcagcaccagcagcagcaacagaagcacaagaatcagaaaaatcagatgaataacagcaaaaatcaacagcagcagcgcaaatcgcacggcggattttattccgagcatggccagattggcggcgcggtcgagggtgacctcgagcagctgaggaagcgtgccgcgcgctttaacggccagggcggcaagaaggtgccgccggtcgttgcctccaacatcgtgtcgccgttcggtagcaggaaggaccgccggcagaccatgccgacggtggcgtcccgcatcttcgtcgacgaggcgggcgatcgcgaccacgaggacgatgaggtggatctgttcgatctgcacatcgtcggcacgtgtcgcgatctggaaaagagcttcctccgtctgacgaaggcaccggccgcgtccgaggtgcgcccggtcgaggtgttgcgccactcgttgcagaacgtcaagaagagatgggtcgaaaagcaggactacttctacgcctgcgatcagctgaaatcgattaggcaggatttaacggtaaggggcggggaaggtgtgcgatcaggcaaaaaatgttatttttgttgaccaacttcctcttattctacaggtacaaggtattcgagacgcgttcaccgtacaggtttacgaaacacacgcccgcattgcgatggaaaagggcgaccatgaggagtttaaccagtgccagacgcagctcaaaatgctctataccgatgtggggggcgagaaccatctagagtttaccgcgtaccgaatcctgtactacatcttcaccaaaaacaccttaggtaagcatcagccgggtccttactgttgctcgcagtatgcaataatatctttctttttctgtgtttcctccctcgggcagatctgaccaccattctcaagtccttgacggcggcggataaagagagtgacattgtagggttcgcgctccggctgcggtcggcctgggcgctgagcaattatagcactttcttcaagctctatcgcgatgcgccattgatggccgggtatttgatcgattggttcatcgagcgtgaacgcaaacttgcactcaaatccattattaaagcgtacgtatgcatccggggcaatcggttgggcgtgggttgaaccattttgcggtgtgtgggggaatggtttgtgggcacaacaggtttctaggtgagcggtgggcccccccttcctgccggaaccggcggttgtgatgttcgtgcttttgctatgtgttagctgtgttgtcagaatggccgggacctgggagagtgggtgtcctttccccttttgctgctgcgtgtgacgtgctgtcggcagaaacaattcctcaacgcgctcatcgatgcatcaccataacacacattcccttgttttttagcattcccctatttctctctctttctctttatgtaaatgtttagcaaaataatccatttaacgatttcacttatgtgtttagttatcgtcccaatgtgccggtggaaatggtcagccaaacgctggcattcgacagcgagcagaaatgttgcgagtggttagagtcgttagaaatgatcatggccagcgtaccggtgccagcggctaaaccagcgccggcggagggatcgtcggaagcggtgatgggtggtgtggctgctgctgctgtcgctgctgtggatagtaaaagtgtaccaagtgctacgagaaaagtgatcgactgcaagctatgcatgaacctgttggccaatttctagttcggctgcgctcaaaacgcaaacgcgccacgcacgacggcgtatcgtagggggaagcggagtcaagtcagccatggagttgtcttcgtttcgatgatgccatgccccgttgggagttcgtttacgtccaaggcagaaagaagagctgatgtggcgatggcggcaaattcggccaacagattgcgcattctcttccgatgttcgactgtgtacaagcatggcggtcatggcctgttccgtttgccggacgcatatatctagcatgtagcgtaaccgccgtcttccctcaagtcgtacgtaccaatggccaatgctggatggctctcctcctgctttcttggcaaatcgtgcttttcttcgagccgttacgcaccgcagaaaagtgagtgacgcgcaacgttcaacgtggggaaggagaaaaatttgttttagaatttttctcctttcggcaataatccttcaaatgctgttcgtgtttgtgtgtggttacggaaaggaacaatcaatatggcccacacacacacactgggcgagatacgtagagcgaaattggacttgcgtgtgattttgtgtgtatgtgaagtgcgatttgtgtgagta

SEQ ID NO: 74 - DNA, 5588 bp, Anopheles gambiae
ggggattgaaatttagtttcgattttatgtatcgttagatgcacttcatctttcggtgtatctttttccccctaggaacagaatatataaaaatgttattcgggtttgtcgatcgctcgtttctgagggttaatcattctcaaataaggtgtccttttcattcttgattcatgatatatatctctctcaaaactgctaatattgcagcttaagtgatagtttaaggaaaatatcgccaaattgtaaggacaatgcgcgatgctgttttgttgtgttttcttccaaacgaacgaagtgttttttactaagaaaagttaaatgtgcctcgtttctatgaacttttcaatacgaccagtatatacacgtgcagcgtagcacagtgggtgaaaatattaaacattattttcattctatattttcctcaaacatggcacacaatttttatttactgtaaaaaaaaaatgttttcatgtaacaaataaattttttttaacaatttttatgcatccaatttattgtatgttcaatatgtcatgtgacccgagtgacagctgcgtgtccgacggttcgcccaccgtgccctttagcagtggtttgctccgtcccgctcgcgctgccgggcgctggagaagtgaaaactctcgccggactgctctgtgcaaaacattggagcagtcgaagaagggtggtttggtgcagaattttcaacacgcaggaaaaacgaacaacattacccgtggtactgcgatatcgaccgaccgacatagtgcttttcgtcgcggcgtaatcgctctcactactgcgctgggtttggtgctttgttctgttggggacttgctggtgctgtggtgtcgcgggctaggttgagaggtgtaaaaagctagtgccacttggattgttttcgtgtcgtatgcggatgataaagaagcgtagccctcccgctggttcggtttcgattcgtccaaaagggcccatttgtggcagtgcgtgagtgttggttgtgcagggcgtgcgagcgggccgaagagagaaagtttggggttgcggtgtgtgtccccttgcggaaggcaaaacgtgtgtgcgtgtgtgtgtgttttgtgatattcttctaccttttagtgaatgattccaaccccctttcctccaacattccaagttacggaaaagaaataattgctgtctattgaacagtactacccgtgccaccacctcccccgttcggcccttccgcccgtgttagtgtgccattctctttgcaacctccccacccccccccccaccctcccctctcgacgcgagtgtgtagttttgcgcaataaaaaaagtgatgcgggacctggctaataagatggccgaactcaaattcgaggcaccattggcacagttcgaggagagcgacgagtggggcccggtcgagtaccagtcctcgaatgtggccaacggcaaaacggcggccgtaaccatcagcgacacgctgaatctgaacaatctgaaagaatcgctccgttcgctcgacggcaaccagcagcagcagcagcagaaccagaaggatgacgacttgaacgagctgaacgacaacctgctgctcggggacgacacggtgcggggtgggggcgactcgaacaccaccaccaccaccaccactgccaacaacaacaacaacattaaggtgggaccgatcaaagacaacgtcgactttgcggaagcgttcaccggcagtctggaggatttggtcaacacgttcgacgagaagatcacgaaatgcttcggcaactacgagcagtcggtggaggagctggccccggtgcaggtccgctcgcaggaggaaatcatgaacgagtgccagtaagtgtgaccgttgtgggtggcaaatccggggacggctcgggttgtgggcaggccgcagtaggaccacacactcttgcgtacatagcaccgccaccacgtagcagcatttttacgcagacgagccgtgccggttgcggtggtcgagcgggagtgattgaagcaaattagtcatcagtttaattttatttcccgacggagcgtcatccaatcggtccccgccccacccaagactcccgcttcccccaaatgcattggtcttggatccccagccagagcgaaaggaagcgctgcgtacggcagcgactcgtggcggctggaccattttctcccaactaccgtctgaatgaacttttcacgtgaaaattatagccctaaaagaagaaagtatgcgagccggggaggagttttggcaccccgctggcataaaattgccccaatcggcaagcgattgccgcgttgctgctcatcatcgcgagagagtaaaggcggagaaacaacccgccccccagcggacagtttgcgcaagcatataataacaccataataaaaaaaaaaagaaaaacctttcgcaaacaaactttgcgtagcaagggaaacgcactgcgcgttttgggcctactatggtgagatttacggtgtgttcaatgtttggtggcttttcgctgtcatatgtttataacaaacatccaccaccaccaccgccgtgtagtccggagaagcatttgcaaaaaaaatcaataatcttcacactgtattttatgtttttttttcgtctaaccgctacaacacgttgattacattgataggcaaactggtgctatttttgtgcattattggggctcatgcaccaacgctgtatggttgattattgatggcgcattcgaatgggcttcataacgataggcctcgtgcagttctgtttttttcgatttggctcaactcttttcgttttgaatttttatttatgtaatacgccacaagcaagagctggaaacagttcatcatttgcacatttgcaattgatgatgaaacatgcatcgaaggctttcggtttgcaccgattggtttacctctttcttaccccttcatgcacacaaatacccagtgcatgaagtcttcagaattattcttaaaaaaaacatcatgctatttgcttcctttccatagctcgttcgcattgtaaaaagaaagcaatgtcgtaacgcggaaagcgttaaagtgtaattaacgttgaataaattaatagtaggaccgctctattactactatacacataccgtccagaaacgaatcgatacacatgctcaacacgtgcatacggtgctcgtatggtgcatgggtccatgagtcatgttaagaaaaacagaaacacacacactcccccccaagctggcacttttcaaatgccaaaaggcattccttagtggacagaatcgttagcagaacgtccgcgacattggggaaaaaacacataccgaacgcgaacgcatatagaaaggattagtgacaaaactgcaagacccagttacggagaaggaagtgtaacacgaagcttccgtagcgacgctcatgtgtcagtgcgccacgcgaccttgaaccagtggcagcaattattgggcattggggcgatgcagtattcggataatggatgtccaatacgccagtagcattgagggagaagccccagtgtttgagccttaaaaaagctcctcgtcataatgggtcactactgcctggtgtggcacgcagatttattatgcccagcccatgttacacacgcaggaggattgtaacaagaaatggatttaatcttatgatttattatctttcaaccaacatcattactgcaattgcgctgtgcattcacaagcaaaatacgttttaattcctccctcgcatatacgttttttcttacccatggttaccgctcttctcaacctccgacaggatgtggtggactattacgggcaactttggcaacattctaccgatcgattggtcgaaaacgtacgcgcgccagatgcacgtcccggcgctgaaccttggcatgcgcaagcccggcacaccggacgatgagctgctgcaggatctcagctcggaggacgaagcggtcgccagcgatctcgacatgcatgcgctcatactcggcggcctgcacgcggacaacgaaccgatcaagacggcggacgaggtgatcaaggagatcgatgacatcatggacgagaccggctcggaggacgggcagctcgagaatgaagtaattgagaaggccaaggaagtgctcggctcaccgctgtacgaagaaagtgaggaacagggcaaagaagcaacatttggagcagcatattctaacgtaccttttgtttcgctctagaattgcgctccctgtcgatcacgcagctaaatgagctgtacatggagatggaggtgctgattcgcgagttctccgagacgctcatctcggagctggcactgcgcgacgagctggagtacgagaaggagctcaagaacacgttcatctcgctgctgctggccgtccagaatcgtcgccgccagtaccacgtggaaaagaagaagggaaaggcagggggcaaaggatcggccggtgccacaaacagttcgggtaagtagtgcgttgcaaagcaagctggaagatgaccttttttttgttacaatcaccacataatctttgaatgtctctctctctttctctctcgacttttggatgcattccctcaggcatggatccaaagtatctgaccactgtcatcccttaccagctgaacagtacacccgataatcaaacgctccaagtgctgattaagagtaagcatccctttcgaatcccttaataatacactaatcgcttatgctcacactatccccggttttgtggttcccgttgcagtactgaaagcgatcaacgaggacagtccaaccgttcctacactgctgacggactacattctcaaggtgctgtgtccgacgtaagcgcatcgcatagaaagttgacgcttcccacaccgactgcggtgccgcggtggaacgtctctgcactccgcgcacgacgcccgtgtgctctcttctcatgtgtgccggtcgtcgtcgttacggggtcgatgatgtgtaggtaatttgtacacgatttcaaagctcttatattgctagcagaatagtaaacaaaactaagagaatacacacatacaggaagtattctctcttacttcggggaattttgcgcaaagaattaggacagagaatagtccagcgcggatagcagcagatacctactattcgattaacacaaactggattgtggagctaacattcgctgcagccaaaccgcgggacagcacagacacaggtggcggagttccgccacgatgctatttattagtgtgtagaagttaagggcttccggtgcgcgttagctcgctccgggttaaaaactatgtgttcttcgttatcgtacgctacgttttgatgctgattatgtgattttgttgcttgcgtatctggtttcctttttgccgcatctgccccgcgcaagcattggcgggcagtgctattttttcgggaaatgcaatactgtaatcaactttactattttattcacctcgtcgtaagacacacacacacacacaccgtaatgatgtcgtaacaattttctaacgctctttctatatgagatacgaagaaaacacgacgggattccggaggaagtcagtcgacgtttcggt

SEQ ID NO: 75 - DNA, 5651 bp, Anopheles gambiae
gtgttccggggagggaccgccgggcacacatcacggtacgtcgtttcgcggcaaaataaaactatccacgcagacagaatttcaaattccgtgcaaggagtggccgcgggtagttgcaggcgagtccgtatgagcgggtggcatgcaagagaaaaacatgaaaactgcatcgcttcacacagcgtttcgggaacggacccggaggttttcccgacgtgtacacctttttcttccccattttcttatcctccccatcggggcttgtttccatccctttcttttcctcttccacaggaacgaggtgaagcttacgaaatcaccgcacatcgatctgcaacgccggaagctgcacataaaaaatgcctcggcgaaggataatggcgtctacagctgcctgctggtggtcgtatcccgcacggacggtagccgccggatcgcgctacgtagttcgaaaaactatcggctcaagctaaaaccgggaaccaattacggtacgctggtcaagcgagcgagcgagcccgttcagggttagataaagcagtgtgtggtaacccttcgttttttttttttttgctcgttctctctgcaacaggccaaagcaaaatcgattgcaccaaaaaccacaatttgctgctgtgccggggcaagcgaggcgaccggcagctgggtgtggcgggcgaccggctaaccaccgaccgtccaccgatgagcgatgaggcaccggcccagctgcagctcgccggcgaaggacagtcgtcgttcagcgggccggccccggtccgtatcgtggtgcatccggtgacgacggtggttaatgagagccagccggtcgttttcaactgcggcttccgggtgacggcggccaacgagagcggcgggtttgtgctgcgctggcgcaaggacggcaaggtgatacgccggtgggacaatctggcggaagcgaccacggtgccgacggacgatgcgatggtcggtgcgacggagagcagctcgatgttccgggacgatggtaagcatggggcataatgactccttccactcagtacatgcaaagttttcgattaggcatagattgtaaaacattgggaaaacccgttgaatttaaacaaagaaacttaattaatgccataaacttttcaatgatgaatttaataatcattcagatattataaaaaaatatcccttttttgtctcatcgaccatgacagacaccaatctttgagtaaacttcaaagaaatgctcgcgaaaacaaaaacaaaaaaggccacccttaacctcttgcactttgagaaatcgtttttgcttactaatttcctcggattttattttccactccactccaaaaacagctcgcattcacgtggaccgcacgaacggatcgcttgtgttcggttcggtggtggccagcgacgaaggaacgtacgactgtcagataacgaacaatgccagcgactttctggtcagctcgacggcggcggaattgcaaatcatttgtaagtatctttttggggttgacagaacccactgggagggatgggagaggccatgcgataagcccgctttccaggccacatcaaagcactacgaccgtcccagactctgacggtcgtagactgtgacgatggttctgcttctggagaaagggggcccaccagatgggcaacaagataaaagcattattccattaaagggggcgcactggtttatcacccgaaaccctctcatttccctgcgggagtaactcttcgcagtcggtcttcttagcaaaacacaaaccgtactttaactgacccgtgtggtaccacactcgcgcccttttcagccaaccttcgcttcacaccgaaaccaccgacgagcaaaaacctggagctgggatcaatcgccaaaatacactgcaaagcgcagggtacaccggcaccgaccgtccactggacgacggtggttagcgatggtgggccagcgccggccctgcccgactcgatcgaggacgtcaacggtacgctggtgttccgcaacgtgtcggccgaacatcggggccagtacgcgtgtgtcgccgcgaacagtcagggcgaaattcgggcaagcgtttcggtgaacgtggtcattgcgccgaagtttgagatcgcaccggagggtgcggtacaggtggcggagctcggtacggtacagtttcactgcgtggcgaccggcgacccgaagccgaccatccagtgggacaaagatctgcagtatctgcatgcaaaggccggtggcgctaatggcagcgaggaggagcgctatcgaattctggagaatgggacactggtccttaccgaggtccatctggaggacgatggacggtacgggtgcacgattggcaacagtgccggactgaagcgggaggaggtgcatctaatcgtcaaacgtaagtaactgccactgcattagtgaagaagtttggagcagtgctgcaaaatgtcatgagcatcatgagatattcaccaacgaaaacaatgaacatatccgtcgtgaaagtgcgtcatgacatgctgaacatgcaaggatcaaagtgcttgaggcaaccgcgatactctgactcacaagctaagcataattccgtaacaagcataatcatgactttttctgtcatgactcatgattgaaactaagctcaaatcagttctcgtacacaactgagatgatcagaggtaagactcaaacagttggtagaccaatcacatgctagatgacattttgtatagctcccaactcttgattgattattggtcacgaaattttctatcggtgataatcacgacattcttggaatatatgtggagtgtggtctcatgcaacaaaatgagcattctttctcgctctgtctgctttgattgtccgcatatctcccatgactatagggatgatcaccgagtgaatatgtcgcgaccaagtgaatgaccatgagttagttgcacactatgtcatcaagcatgtgatgatcgcaccaactgattgagtctcacctctgatcatcacagtacaggagcttgggacgctgacatgattttgttttagccagaatttgccatgactatgtcagtgacattttgcagtactgatcacagtaaaaaaaaagtcatgacatagtgactgacgaagcgttggtcgcaaaaatgtcacgaaccatgtattggtcacaccaatcgttatgagtatcacctctgataatcacaactgggtacgggacgctgacaggaactttgtttcagtcagttttttttgtatgacattgacagtgacattttgcagcactggtttcgagcattttttaactccatttcactctattccatctgtgtgcacagcgtccgacggtatggtgatgccggaagagtcggcagaggatggcttcctgataacgcgtgccgtgctcatcaccatgtcggtcgcctttgcgtacatcatactggtcgtcgggctgatgatatggtgccggcatcggcgggcagcacgcaaagcccggctcaatctgggctcctccaaggaaaatggtggcgatgtcgatctgaagaactgcgaaattgaaccctgtctgccggacaaaacgtccgccgcggagaatggtggcgtaggggtaagttccggccgttccaaaagcaagcagaagaatggatcggcaggaggcaaagacacggtagcaaatggtgtcgacaatgggcaggacaagagcgatgacacggtgaactcgagcaaatcgaagaagtcgtccggttcgggatcgctgctcgagcagctcaccgtgccacggtcggccgtcgtcgagatgctgcagattggcaagtgtgactttggcgatgtgtacatcgggaagatacgggagaatgactgccgattgccaccgccgaaggaaagtgtgacgcaggaaccgatcgccggtgatgaggtaggtcccagcaccgaactgacgacggagaacgaacgcaagagtcccgtcaagaagggcccttccaatgaggagctgaatgcgatccgacccgagaacgactacaagccggtgatggtaaaggcactgacgaaggtaaaggacgaacactgctgtggcgagttccggcgtcagctggagctgttccgcaccgtttcccatcgcaacgtggtacagctgttcgggttatgccgtgataaggatccacactatctgctgctggagtacaccgattgggtgagttgtataaaatggtatgtaagatcgttcaaacttacttattctatgactatggactattacagggagatctgaagcaattcctgctagctacatctccgatcacaccgcccaatggaacggtcgacagcaagaaggatgccaccacgaaaccaccgccactcaacgtgccacaaattcttgccctagcgcaccagatcggacgcggcatggacgctatctataaggctcgcattattcacaagtaagtctgccttacgcctagaagacattgatgtccctcttggaactcacacaatcctcacatattatctgcacccagggacctggcaaccagaaactgtatcatcagcagcgatttttcggccaaaatctccatgccagcactggggcgcgacaagtacagcaaggagtactgcaagcaccgcaaccagctgatgccgatccgctggatggcaccggaatgcttccaggaggacgattactccatcaagagcgacatctactcgtttgccgtgctcgtgtgggagctgttcacgaacgcgaccgagctaccgttcaaggagcagacggacgaggagatcattaccgctgcccaggcgggcaagctcgagtggaaggttgcagaaaagacgcccgaagcattgcacaagatactggtaagtgtttggagggagcgtgtaatatctttcggcgtgtgaagacatcgcatagagctgatcttggtgaatcgttttgcagacttcttgctggtcaaccagcccgaaagaacggccatcgttcagccagctcgtcgtggccatcggtaactgtctgcagagtgaatatcccaaggaaccatcggaataagcagactggaggtaacagacgaaccagcgactgctctctgtctatctatcgaatcatcatccatatacaacgaggtattattcaaatgcatctcttttttgtattatattacacatacatgaataccgtacacatacatacacacatattaataaaatcattaagaattgtgtaatgcaaacagatgcaaatgataatgaagtctaccagtgtggttaggcgtttgaaggagcgtttttggtgattttacacctagcgcacgcaatgttgaaggcagtttcattaggaaaggataaaaagaaacatgactacatccccatgagtagtgaaagccaagattaaaagaaaaaagatattcgtccgaggaattcttccaatgaattttgatacaaaaaatacacacacacacacacacgtgcgtgtttcaatgtaaccacccgggataggtgtggacaaatgtgtacggaagagtaggtagacgttagggtagtatttagtcgaaatatttatacacatacagtttttgctccctcaacagtagtagtctgaaggatacgtgaccactttgcggaacagtttcaaaaagaacgcatggattct

SEQ ID NO: 76 - DNA, 4784 bp, Anopheles gambiae
aacgtacgaatagctgtgctactcgaatgcttctgcgtacctcgaacgacctcgcccgctcgaacggccggctccgtaaagccaacgaaagaaaacaggcgttggaactgacaccggggagtttgcttttcgcaaaggaggagaaacaaaagtccaacgcctcgtgtgtgccgtttgctccgcgtgctgatccaagctagtagccgaccagtgtcgccacccggtctgggcccaatctgtgaccgcgaatctaaactctcatctcttccgatgccccgcacactcacccgggcagttccaagacacggcgttgttttttgaaaacatttactttaattatcagcttcctcttgtgtggcgggcctggaagcgcaacaaacaaacgtaccacaccacgacacggtgtctagtggtgaccgttgactaatcgcaatagttgcaatgtggcgttgtccgggcggttggtagatttattagcgagcagtacggcaagcgattgttccattccgccaccgaccagcggggccagcgaacgtgttgactgcaaaacattcctctaatacggttccgttttccaattgcagactactaccagcgaccatgcacgtatggttctacgtgctcgctgtgctggcgatatcacacggtgcaacgcgagtcgctagcacagacagcagcagtccagcccgaacgaaagccgccagcctgctccatacggatcaatcacacatcagccatcccttcaatcagcctgcgttacggcagggctcggccgactcgacaacgcccgtcacgaccgtctcgccggaaccacggataggtgggaccggtgcgccggaagcggccagcattaagagcagcgagacgatcgagtacgaagagtatgtggccgctaaggatgcggcggtagaggtagacaccgaaggtccagccgaggagccggagctggagaacgaaatcggtgacagtgagccggacacggtggacacggtggtggtggagagcaggcccgatcctaaaacgctagtcgagatagagaagaaccttctgagcctgttcgggttccccaatcggccaaagatcgaccggtccaaggtggtgataccggaggcgatgaagcagctgtacgcccagatcatgggccacgatctggtcgactccgtcagcgtaccaaaggaaggactgaacacgcgcaacgccaacaccgtgcgaagttttacacacgaaggtacgtacgacggggacgtgggaaagggaatagtagtacaagtagtgcaatatctaggaagccattccgaaggctccacgacagcaacgacgacgtcaaaaaccggtacacggttgcgcacgacattaaagagtgtttagcgcattgccacacacacgcacacacacacagaccgatcggtaacgatcgctcggttaggaggccaagggacctgctcttcaaggaggtgtcgcagtgcgaccggcgcaaactggtggaatcaagttgtttttattttcaattaattccacgtcctaacacttgcggcaaatgcagcagttaatgttgagctataacgctgtgcttacggacgatttgaaagtggttccattgcaatgttcagacaccttgcccagatgacattaaggtttgggttatgcagttttagacattagaaatggtaaaaaaggtcaaatattggagaagcttttgactaaagatcacacaacgtgtactgaaatacaagaagcaacccagcaagtacacagttcaaatctatcccaagttcttgaattcaaaccaggatgttgaatcggccgtactcgaaaactaaagacggctggtgcactttgattgcacactacctggaaatgcgattgcaataaagaagcgatcgcgcgatcgattgtttgtgtaatacggcgggggcacaactttgtttacataatctccccccgaaaaaaccgattaccgagcgcgcgcgcgccctcgtagtatggcgatcgttttgctacgcatctccccgtgccaaagagccgtggaagatgctgcatccgcgtgtccgggtgtggcgtatcgtgcgtaaaattatcgataaattttgcacacgagtaaagcgaacgtaaacgttcggttcgttttgcgcccagctgtacggttcaaggagagaagcgtctatcaacaccccattgcggcaaagcgaggttccgaggagtccgatatactaggtccggttgaccttttcaccaacccgcactgcttccaactacttgcgagatgctacggagtacggatccagtgtttatggtaaaatcggacgagcgctggagagagggagtgctgggagtgcgttacgcaaagtcgaaattctccgccaggcagcagcacgcagcctttgctagtagtatcacgccgcttgtaaacaaacaccggactagaaatattagttcgcgcaggggcgcagcagcacaaagagccgtgttgcgccgaacgcaattaaagtgagtaccgccgggcgggcgcaattttcggcaaaccgcaaacaaactcacccaacacttacggagacgatcgtctgggccttggtctggatgatgcgtagtttgttgcttagaaaaattttgacgcagactccagggggatggtgctgaagagggccgagtgttgctgattgtccaaattcgctaatgggtttgccaaatcgattaaaacacacgctggccgcgcacatcccgccagtttcggagaagtgttattgtttgccgcgtgttgccgggccgacttcaggattctggttttcgtctggcagaaattaagcagtgggggatgttgttggacgcgttttcgcttttaggggttggggggggggggggggtgttatttcatggtgtgagctcgtccaggtggttcatgacaggtacggcggaattgtttatttatccatgcaaagggttgaagaaattatgagtctctgtggcaaacctgaagatgtcggttttggtcgaattgtatttaccgtgaaacaaagtatggaaatattggcccaggtcttgtacttaccgggaaagaaaaatattggaggacaattccattaagttgatttagtttgttgttctactcttctacactacacacttgccacgacacaacaactcaattttgataactgacgtttccttaatatggctactttgatgcatcttcatcctgatcggtctcatccttgcaatgattaacgttctctctctctctcttcaactctttcccttgcttccttacagaaagtcacatagaccagcgattccagcatcatcatcgcttccggttactgttcaacgtaacaagcatcccgcgaggcgagaagttgcgtgcagcggaactcaccttaacccgcgagggcatcgcccatcgaagcagccgggcgcaggcaaggacaccggtcctgtatcaggtgatggtgtacgacatcgtgcggcccggcgtcaaaggcaagcgtgccccgaccttcctgctggtcgacacgaaaacgctcgccatcaacgagtccggcacggccagcttcgatgtgatgccggccgtcgagcggtggctaaggcagccgcgcaaaaaccacggcctgttcgtgcaggtgacgggccggggccgtggaccaccaggccatagccgccagaggcgcagcatagtgccggccgtccccgtccacgagcacgtccggttgcgacggaatgcggccgagcggcacgacagctgggtgcagaagcagccgctcctgttcacctacaccgacgacgggcggcacaagcaacggccgatccgggacgcgatcagcagcgcgaaccgggcccggcgcgcctcggccaagcgcagcagccggcggaaaaacgaactctgccagcggaagccgctgtacgtcgacttcagcgatgtcgggtggaacgattggattgtggcgccgcccgggtacgaggcgtactactgccagggcgactgccggttcccgatagcggaccatctgaacacgacgaatcacgcgatcgtgcagacgctggtcaactcctacaacccgacgctcgcaccgaaggcgtgctgcgtgccgacccagctgtcctccatctcgatgctgtatctgaacgagcagaacaaggtggtgctgaagaactaccaggacatgacggtcgttggctgcggctgccggtgaagtgttgaacgggaagagggggggggggggggaataattgaggggaaggatacgttttctgtgagaaaacaagggggaagggtaggggattgaaacaaaacacgaaattggatgaccataggaatcggcagggccgcaactgttttgtttaattattactttaaatctttgttttgtgtataacgatcgaacgtactaagagcgaagtgtgtagagagtgtgagtgagtttgttttgagagaaaaagggatcagataggaatagtagcaatagtagcaacgatcaaacttgtgtaccatagtgaaaaaaagtcatgtagatcaagccataatcaacgtatgcatgcaaaaaatggggaaaaagcaaacaaaataaaactaatacaaacaagaaagctcaactgttgggtgaaaagcgtgtgaggtgtgtgcgtgtcaagtggcacactattgtccgtccagatgcggtacaggtcttgtaaggtggcttagcgagttggtagggctgggaaactagtgctgtggcataggtgttagtgacggagacttcagctgaaaaaatgagagaaaaatgaaggacacaacgcggggggggggctca

SEQ ID NO: 77 - DNA, 16833 bp, Anopheles gambiae
tatggaactgttgaatactactgcaatgatgtacggcgagccggaatggcatcattaatgtgagatgtgaaacgataccgtggcaagacagtatctggtcaaatgtcatggtttttaaagagttaattcgaatttgaaatacgattgccaatgatttgctgataacaaaacaatgaaatgcaactttcagtttccaaatctgtaatcaaccgtcactttcaaaatgcacttgagcgcgtaggacagctcgaatctgttatacgcacggtcgaaacgcttcgtgatgcgctgcaagcaaatccacgatgtgtggcgttttcaagcaaatcgctgtagcggtgtttgtgtgtgtgaatgcatgatttatggatttacgctttttaaacatgtttttgtggttatttaacgtctttatttgtttaaaaatcatattctgttttcaaaatggtaaaaacacaaggcaaatctttgcgaaatagcttcaattgccatacaaatcgcctatgttcaagcatatcgtattgacgtctccagtagcaaaccttcccgccggtccgcgaagggttaatccagcaagcgtcacaagtcgtttgtgatatcgcggcaattcaacagcatatttacagtggcgctgcgtttcggtccggcaggaagagaaaacgactcccttcagtaggtaggcgtgtgaactttcggtgtgcgggttttttcgtcgtgcataaagcccaagtgcaatctcgcgtgcagtgtgtgtgataatttccactggcagcagtcacttccagctcgtgctgtgcgttccggtggacgggaaaggttagcgggacgtggttgttgcaacagaagggagagttgtcgtcgtcgtcgtcgtttcggtgtggaagaagaaacggcacaccacacacagagcgccttgcaaacacacacactctcgagagccccgaaaacttgtccaggcaagatttatcgtccacccgttgttgggtctggcggagaacagagagaaggaagcaggagagcgggtgttaggtgtatgccaaaataggatttacccttctgctgtgtgcagtgtggagaagtgaagaagagcagtaaaagggaacaacaaaaagaagccgagcaactcggtgtgtgagtgtgtgtgtgtggatgtgtgcgtgcgtatccttttccagcccttggctatggtgcgtttccgtgtgcgcttgtgtcagtgacatcgaaaagcagcagcagcagcagcctgtcaaaagcaacgcctgctggagagctaccaggacactttggagtgaagaacagtgaagtaacagtgcagtttttttgtatctttcggcgacgacattttgcgtgattacggattaagcatagccctaaagctaaagtatgcaaaagtagtgcaaatccttgtgcaaaaccggtactgcgaatgagggtgtaggtgtgtgtgtgtgtgtgtgtgtgtgtggagaaggaaacaaggaagcaaggaaacagggcgctctggcgtgcgaagttttggaagtaattcttcttccccaaagccaacaccctttctgggggttggttacagattggataaaaaaacggaaagaatagtgaagcgaaaagaaaagcaagacacacaactgcacctcgacacgattgcacagttttcagagcaggacgaagtgtgtgtgtgtgtgtttgtgtctgtgcgtgtgtgtttgtgggtgaagaaacaggacaggaaagaagtgtgaaaaagaagcgagcacaggagcgtgcggaggtggtgtgtgactgtgtatgaccagatatcgtcttgtgtggttgtgtgtgtgttgttggaagcataaagaataactgcaacagaagaataactgtgtgtctggcctggggggggggggggggggggagtcgcagcatttaacgcagcattaacaacaacagcaacactagcaacagcggcactagaataactttcaaacatccaaaacatgactcataagccgcaaactggacagcaaaactgtttccagctatcttctctctccctctgtttcgctgtttctctccttcgcgcttacccgtgtggcttgctttgatttgtagctgtggaccaaaagctcttgctgctgtggatgcagttttccattttttgcaacaaaacgaaaaaggagagaaaaagcctcgcttcaattgtgaaagtgattatttaatccgtccaactccaccggacccaccagaaagagagatatgtcaggctgtgggggctggaggaaaacgtcccgagcattgtccctagttggtgtggggtgtcttaatgtttccccggggaagaagccggtgcctctgaccaccaaacccccccacacacacacacatacacatgattgatgggaggaaatttggcgaaagttatactccgcggtgaagtcttttcctgttcaaaattggagaccgcaagaaggaggaggaagaagaaaaaagcagcaatcggccatggcaaggggctgtcgaagtgcgtttgcgcttatcaaaaattaaacattacccacatatactcctccgtatctcggacgtttctgctgtcgctcgggttaaaatggcaatataaaacacacacaccttacgagccacttaccaccagctcacggcaaaaccactctaaaaaagcgtccaattaaatgttttattaaaaaagatatcaattaaggcggttgtcgtcgctctctaagcctaccgctcttctcctacgtgcggctttttagcccgttagttgcgggttcaccacaccgccgtagagcaatgccgaaaagttgcgtattgattacacaataataaaagcgaaaggaagcagcacagcaccgccgaaaccactccacgtacgacgacgcggccagccaatgatgatggaggaggaaaccgcaaaaaaggaaacgtctttttgatcgattgttcgggtcgcggttcccccctaggtggtggtggtggtggttgtgctggaggtcattttcattcggcatgttccgactaattttagccgttctagcattgattcattggcggcattaaaagtcgtgagtaatgaagtacaaacatcgtgcgtggcctgcaggggtcgagctcttctaatcgcgaggttacagcagggaattagtcattggccatgattgccctggactgtggaacacttccgtaacggattcttactaattgaagagaaaaatggacaagaggtacataggcaaaggctttgaaatattctggagagatgtacaacacagagcagagcaggcagagctaatgttatggcctactatgacgaatgtcgtcgtggcgtgaagcacaaccatgtgcaataaaacaaacgctatcgtgcgttctgtcttggcttgaccgtggcccatcccctttgctgtgcgctgatagacgcctgaagcaactgcccagcgggatcgggctcttatcgggcccaaacaaaaagtacagacagaaagcaacacaaaagacctctccacgggagatagagaggggcccgtgcccgacgaggaggggggcaatgtgctactattgcttctatggccgcacgacactgattcgcacttgaagaaggaatgtccgttggtttggttgttgcggccacgtccgtgttttgacgtgcccagtacacaccaccgagccgcgaagtgatgagcgcacgtacttctccgcaccccactatattgcaccggaggtctctatccccccccccccccccctacctccagttctccaaacaagtcaacacaaaagaggtaaaatggggccgcacgcggggccagatttttttggacacagcgcagaacagagatatacgcatttttagagctcttacttacttgggtgtgttgttactttgcccatccgtgtctccagtatttggaaggtctggtgaagtggaagcagaatgtttaaacatacacacttgaaacgggtaatgctcagcatatttcttcttctggagggatacgcaagagaggcaccgggatgagggagagggcggagaggaagttgcttatgcggcaacttattccacacacatgtgttgttgttgttgggccatcgctaagggcaggctgaagcggttgagtcagtaccattcggcggttggacaaaacgtggtagaaaaaatcacgatcatacttattccgggaagccgggaatgtacgacgagtgcagtgtgaacgaacgcgcgttttaggtcatatgcggcatggtcccgcgatgtgcatcaaccgcgtcttggtcctgttgctgttgctgctgctgctggtgtagttgttgggcgacagcgtgtttatttgtccgcgccccatcccataagcccttaagacatattggagttgccccgtgagagaatggacagagattcatcttttttttgttcgtcttctctcgctctgttctgtttataattgatcccgttgagtgccctgctgctgttgctgtctaaccgtttccgcttggattcatcagctagggtcatacgtacgcactcacactggccttgtcgcaccatcggaatcggatgcaatcggagcaatggacggcgacgggactatcggaatgttacatctccattttgctacggcgcgtaggcaacattaatgcctcacatacacgttcttgccacagcacaaacggatacattgtgtcacataacgcgcacatcttaagatcgacacagttccgtgcccagatgctttttttctcgttccattagcacaaccaaccgggagcaccatatgggtcgtggggagaaaaggcaactgtagacgcagcatgaagggcatgaaatgcatgcggtgaactacgctgtgcgaaacaaacggtgcgaaataaatgcagtaatgcatcttgcattcattatcattcacttgctgcaaaacgcatgcgcgtgacgtaaagtcaaggcaaaaaaccaccccgtgcgtggaggagagggaaaggagaagcatacgagagataagaaagatagagcgcgcgttgttgctggtgttagagactattaacagtaatgctaccattgctactactactacttccacggtcagaacgtggcggcggcatcggcttgggggaacgtaaattgtttcatttggaatgaattaaaaccactctcggtcaccgacaatcatacactgagccattgcgaacattgcgtctttccgcttccagtgcgttacggggctttgcccatagagagagggttgatttatttacattgaatcattgccaatcattgtgtgtacttttattggctttccattgccgccatagcgttaatctttcgcttaccgatcggttcattgcttagaatggcacggaacgatgagtcttaaggcgacaaacaaacggtactatctctctctctccctacaccgccatccgtttatgtttaaggtctgcggccccgttagacacacattcacacacacacgccgtacataggcgatgggcaactgagacatcaccaaagggacgctgggtggtggtggggtgtgtcatgcaaaaaaggagatcttttcataaatattaataatgcatataaaccgcccgtgtgtcccttcaccgcgcgtgtgtttcccgcgcaaactgcaactgcgcccgtgtgcatggtcccgcgccactcccctgcgatacatcgtgcgaatatgtgtgcgatttctaaacgattaccagacctctataacctcagcaagggagagagacgatcgtttgtttcaattagatattacgaccacctaccctaaacaacggcttcggcacacagtgtggggacaacgcaaaccaacccccacggcggggacagcacagttcttcccgtttggcttaatttatagctcgttgtaagtgatcgctttcgattcgcggcagcacacaatcacacacacaaaaatcgcgccagccagtgcgttatcggaaaggtcgcgtgacgtgagtgggtcaagatgcgtcgtgtgtttggcattccttctggtaaacgcttacggctgcagcagtcggccggaccagacggacactctttcctctgactctgaaagcgatcgatcttcatcgatcgtgctccttcaagactgcatttttctacacggtttgcgcaagcaggagttctaaccttacgtacattttttaagaatgtttccagcctagtttgtgtagtgtcgcgaagaaataaaacgataagaacactgaacgaacgaacgcaagtgtgacaggtgtgtccccgtgtcccatcactcttcctgttttctctctgtgtctagtgtgcatgtacgcgtgagtgtgtgataagcggtgatacaagcagagtatgaaaatatgagtacatcaacgcccacagcacagcagacggccggacccggtgccggtggaccaccagtaccgccggtgaagcccgtcctttcgtcgcccggcgcctacatggccaacttccaggggtcgggtggtggcggtggtatgccagtggcggcaccccccattacggccggcatccacgggacgaacaagacgcacgagaagccgacgatcgccgcccggcccattccacctccgaagctgccaaactactcgtcatccttcaacaagatcgatcgcgatcgaaacgagttcaccaagatcgacaaagcggaacgggaaaaggttagcctggtgaggaaccgcgacaacttgcgtagtattgtggggggagggggtgggttgaaagagaggatcatcatcgatcgatcgctccagttgccggaagatgatccttctttaccggattgcgtgtttgtgctttcttttccaaaaagggagaggaaaacggttaaattttattgattatttcattaaatcggctctttggctctttgaaatgtgcctaccatccgatcatgggtggagatcgagctctgcatacagacacaaactaaaacaaacagttgcgtatgttgaggggggtttgtttacctctcaattgcgggggagaggggggggggggaataatgtaatcatcattggatgggtggtaataacaatccttcgggattggtgcgggtgttacgatgctcactgtaccccgaagtgtgtgccgtttcttaatgcctgtcggcgagacgttgcgcctggttgggttttaccttcacgtcccgctgctgcagcagaacgacggcatcttcggtgtttagaaagagggtggaaaaggaacagacaagcccgaccagtcagtcagccgtcaggcaaggagctactgatgactaatttcacgctccatttccgcggtttccctttttcctaaagctgtctgttttacattaatgttaagtttgatttagtttgctgtttcgtttgttattaaattattaaaattaatgtatttttgttttacaatcaatcagtgtttgtgcaaacgataaggatcggtgtggttagaatagtcgtgcccgtcgcgttgcctaaatttttcaattcttctttcgttttccccggtgtgtcgttgttcttcgttgcgtgtgtgtgtatgtcaccctgtgtttggttcggttttattaattgattcgtttatttttgtttggtatgtgtgcttttcagttggcaacgaagcgcgaaatgttcttcaagtcggagagcaacagtccgtccggaccgccaccaaatccaccggtagggctgaacagtctcaacctggctaacaacaacgtgatcgtgagttgagctttgcgttgtgtggttggcttcctactttgctcccgcttcctcccctcctccttgctcgctcgctcgcttgctccttgtgctcctgctctcttcacatcgttgtgcattattccgctttcaacaagctctagcctcctatttgcctactaacattgcctttagtcccccccaccccacatcccctcattcagctttattaatgtggcaaactaacagctaatccaacacttccgtctcgcttctctcattctatctctctccgcagcataataacagcgcaaacgcggccaacgataaacacagcacggcagggctcactaactcggttggcggcggcggcggcggtggcgtcactaacaacagctcaccggccgcggtctcgattggcgcaatggtcaccaataacaatcacaacggtctgaacggtgcaccggccacgaatggcagcgctgtgcacgcggcagcagcagcggcggcggcagcaaccgggaacaacaatctcggcggaggaggtggcggtggcgtgaacgggctggcgaccagcatgaacagtatttcgctgaaggagaagcgggacgccctgctgaaccatcacgatagcggtgcgaacggtcaccacggtcatcatcaccatgcggatgcggcgaacgccaagctagcaaatgaacggcacgagaaggagaagccggtgatgaaaacgaagccgaaggagctggacgggtacgttgggttcgcgaacctgccgaaccaggtgtaccggaaggcggtgaagaagggcttcgagctgacgctgatggtggtgggcgagtcggggctgggcaaatcgaccctgatcaactcgatgttcctgtcggacatttaccacgccgagcagcatccgggaccgtcgaagcgcatcaagaagacggtggccgtcgagagcaccaaggtgctgctgaaggagaacggcgtcaacctaacgctgacggttgtcgatacgcccggtttcggtgatgccgttgacaacagcaactggtaggtcgcagacagagagatagagagaagcttctttgtgccataatcgttgctcggttaatgcaatgtgtgttctatacttttttctacagctggctaccgatagtggactttgtagagtcgaagtacgaggagtatttgacggccgagtcacgcgtccaccgaacggcgctgcccgattcgcgcgtgcacgtttgtctgtactttattgccccgtccgggcatgggctgaagccgctggatatcgagttcatgcagcgactgtgcgataaggtgaacatcataccggtcattgccaaagcggacacgctgactccggaggaaatcactctcttcaagaaacaggtaatgttgtttgtggcgaagaggcaactgacgtgtgtgactgaccggacgacttatacaatggggtgttctgttcgattgcagattctaaacgaaatcgctcaaaataagattaaaatctacgatttcccggacccgatggacgaggaggaggacgcaaaagtacttcgccagctgcgcagtcgcgtgccgttcgctgtggtcggtgcgaatgcaattatcgagatcgatggtcgcaaagtccgtggacgacgctacccgtggggagttgctgaaggtacgcgagaacgaagggagggtgttcgtgggtagaaaactatatcacacatttcttgcccttttgcattttagttgaaaatttggaccattgtgatttcatcgctctgcgcaacatggtcatccggacgaatctgcaggacctgaaggatgtgacaaacaacgtgcactatgaaaactatcgctgtcgaaagctggccggtttgggtaccgatggcaaggccaaactaagcaataagtaagcactcggggcacgcaaaaccaaatctcgaacctctcgtccttgtcggtttggcctgtgctgttttctaacttaattctcatttctaatttgttggctttcttggttgtgtgtgcattttttttttcattttgcattttgcaatagctgctctaacgttacatcaaattcacggtccagctacgaatggttcgacgagagtgaacgtagggcgggtgctttgccctcttccgttctcttgcaaccattcggagctgatccgggagtgtgtatgatgatggtttattattatttattattataacacacgcgtgtgcatatttaaaacactgctgctactgctcggtttaacactaaattcattttcatttctcacccttttaaaaccaaaaaaaaaaaaacaaaaacacaaaacaaacgaccccatattcatcactcatccagcttatgcaatattggaactgttaacacaaacggtactggatggtaagtcagtctacatggtaaatgggaaaactaattggtattagcgttatcatagcatctttccttcgcccccttcctcgtttagtggctgggtggtctctatgaaagtgaaatcccgccaaacccctcggctggttatggtttaaacccaaaactccggaacacttccggtgggatttcattttgatagagtcttcaccgtctaaacgcgatgtgtgtgtgcgtgtgtatcacagcataaatgaaactcttcaacagctcatcagcataatctgtgcttgcatgcatggcttctttattcatccgttcgtttatcgcattcatttagttgctaatgaaaaaagaaaacatgaatagctttctgtaccaccgtgcatgtagaagaagcagagagaaaagcgcgttttgaaatgaaagaatagtgcgaaatggatgatactcacgaaaacgttgaaacttgtcccacaggaatccactggctcagatggaggaggaaaagcgggaacatgaatcgaagatgaagaaaatggaagccgaaatggagcaagtgtttgagatgaaggtgaaggagaagaaacaaaagctcaaggactcggaggccgaactaactagacgtcacgaggaacgaaagaaggtgatgaatcaagccgggaggaaattcagcatcatttgatgttggcgttgattgacacaaacggtgtacatgaaatctaatgaaccaattcccatttttaggcactcgagcttcaaattcgtgagctggaagatcgcagaaaggctttcgagcaggagaaagccgaatgggaacagcaaaacggtgtcacgcttgacgagctgcgccgcaagagcctcgaagccaacagtaaagagtaagtattagtagctttcggatgtgtaccttcttcttgctcactttgttacttgttacggttttcttcgataccttttttgaacattttttctgtgtaatatgtttggtttttagttttcaaaatcccccttttccctgtctcgccaacgatctccaccatttttaaatcagcaaaacactcgaggccattcggggctcgaggctaaagcaggccaaaggaaggctaatagtatacagtagattggattgtattaaatgtaaaccgaatagcttgccaacaacaagtaggagaccttcgtgtaggcttctgggggtgtgcttttggattttgacccatcaacgatcgagtcgtcgttagttacttgtttacccatgatcaccatgctctaatgggcctgcgcatattaattaaagaaacttttttgaacgacaaaagcaattcttattcaacaacccgtctgggtatcgttttgtacagcatcgttgcgattttgttatcttattgtatgtttttgttcattttgattgttttcttcaaatcacatgaatgatgctcttattactacaaaatgttgccgtgtgttcttgtataccttttgattcattttgatcaacgctctgttcagttgttttgtgccttacctgctgtgccttacttgtgtcaatactctcgtgctgctctatttcgcttgcctatcttctgtttctcgcaaccttggcgggactttcgtctgttttcgatggatagcattttatgtggtgtaactggaatgatcttttttggttgttaaattatccagaatgcagaactactgctgttgcctaatttcagactctttcattcccactctcctatgtgtcatgtctagagaaaatcccagctactgtcctaatgcttatttgtggtactatttgatttgcgtttgttttatacttttagtgagtttgttatgtttgtttttacttattcattttgcttccgctttctacatgttagtttgcttcattgagcttattgttgttttgtgttggaccttatcgtcgatcggtcggttacgtttgtatactttatgtgtttgtataacagccaaaatacgatacagacttatgaacagaaatttatttggttgttttcttcttcttcttttcccctcttgtttacccttgccatcatacgaaacaacaaaaacaaacacacaaacaaaacattgaatccaaacttcttttccaaacccttaaaccaaaatttatgctattgatgatgataaaataacatggcataacacaaaactgcgctctaaattctatcctatcctaatctcaatacaaacggcacacggatactctggaaaacacacacgcgcaatattttcataattcgtatgaaaacaacaaataacactttgtcaaacaaacaaacaggaagagaaatttttgtgtgagtaaacatgacgaaccgttttgccttttccatactcttcaatctacactttgtttttgtatatactgaatatacaaacatcaaaattgtgcattttttcgtattaaaacagcatttgtcactcatttttttccttacacatggcgcgatcttcttactgctggagcatactgctatcactttacaaacaaaatgtatctttatcgacacatattccacgtgttatgttaaggcaaattcttttcaaccgtttaagaacatgaatgacactcctccagcaccaccacactcacttcattctgcatctgcatacatagcgccgtacgcgttgggtcggatatgtgctgtggtaatatttaatgttgattatgaacagtgcattaacggtgtaaataatttgagatttcgttttgaagcgttttgtatgtctcttgtggtattaaatataaactcacaacaattcgcggaacatttggtggtatttggacatttctgtctggatagcaaagcgaagcttacgaataaaactccaacacactacttccaaaaacacttcagggttacacatttacctcaaagttgtaattttcaacacagcgtgaaagagattctgtgttgtgtgtgtgtgcatgtagtacctgctaacaatggtaaagtgttataatatgaccgacactttgtaaaatagatgataatacatgtaaaattagatgatacacacaagcaattagcgagccaaccgatcatcgtctgcttagatggtgaaatatagtgcaaagcgcaaacacaattggtacattatttgtataaaacacacacactctagttgaactctatatcccgtgtatgtttgtatgaagtagtaacacctctccaatcccttgatgtacaactgatgtaaaaacaaatgccccccaaatgctttccaggaccgcgtctcttgcatcaagaagttccgatgagtcgaagggcaggcgcgtgtttggatcgttgctgcgtcgacacactagcttcggggcgccggacgccgtccgtggcgttaccggggcagccggttcgacttccactctcactactagcgctaacaataacggcagcacggtgccacccagcccgcaagatcataacgattcgtaaatgtgtgtgtgtgcgtgttgttttgagcggttggtttcgtttatttcgttgattccgggactttcatcatcacgaaaaatgcataacacagtaaaacagtctccacggaacgagatcgcttctcgcggcaaggtgtagctgcatctatatttcatgtgaatgtgtatgaccaagcgcggaacaaccatccataaatatcaaaatctcaccatgcaaaccaaccgcagtcgccacaccaccattcgccactagaattactagcgtactactaaagctcgcctcactgtttactcttctgcacccaaccactcttacttgtgtgtaactttcatctcatttatgcgatcaattgtagactaaatgaagagggtgaagaaacagtaaggtaaacgcgcattacttaccataaaccgcactctaaccaatccctatcacacaccactcgttcgtcgaagctaatatctatcagcactgtggagcggatgctgagtggcaaacatagtgggacacatagtcaaaggtagacggaacgttggtatatatatattagaagggtaaaaaaggagaatgcaaaagcatttatcaaagcaagcagcattactcggatagtgtaaatgtaaagtttccttctggtagtctggctggacacacacactattgagatatatttcccgcagggaggcacacaccgtgtgtcgcttgctatcttcaactatcttttactccgtaataagtacatcagtcaaaggaatagggaaatcgatcgcaacacaaacctaactaatcaagtggatcatccaaccacatatgcaatagaatgtagcgtacgtgaatacaaatattctagtgagaagggctttccttacatatactacagtgcagtgacgacgcgcgaagcagtagtagtattatacagagaagatagattgcggagcatatttggtatagatttatgagctttttcgaaaatatcccacaagtcacgacggttataggaggggaaattagagtggagaaggttgcagtagatttaagatttaaatgttttcattaccacgactctacaaagaaagtgtaatactcacccgtttttggttataactgtatctcggagaaggcattgttgggatggttaattttatgtgtcaatttttatgtgtgctttcatcaattcagggtttgcccctcgtgtatttgtcctatgtgtatgttttgtaatctcgttactattactactaatttacatccaaaagcaaacaaaaccgtatcattataacgctccttttgtagtgggaaattaatacaaaaccatataaacaaaaacatcaccgttttaggagggcacatttagggcagatggttctgatatataataaaatggaagaggaaataattacatgtacgaaagggaataggaaacaaaattgctgtttttgaaattcttaacccaaaaactgtggagaaagatgaaaatgcttaaacaaacaaacaaacggcacaaaataaatgatacagcagaggcaatgaacgtaaagtttccacattaaaaccatttggctcatgcgaacaaactgacatctcttggctggcatttttctttcacactttcccccctttctctattcatacttaatactcgtcctgcattcttcctgctctctccttgttgtaaccacaaccatcttcttcatctgtttctgttactggacatctgggggatttgtgacacactctgtctgaggtattgatcaattaacttacatcctgtaaactcccttgctagtaccagaatcacattgacaccgttatacattaacacattatactaccctctcctctctgggccttagattgtatcctatgttatgataacgtgcacacctccatttcattccatgtatgcgtgtgtgtgtatttgtgtgcgagttgtccttcttttcttatacatttgtttatctctctataactcttttctattctccctctttcgctgcatgttgttttgaaaagatcaagttcgtttcgaaatgatttgttttatctttgcatgtacccttttccgcacagtttatacacctttcactagtaacagttggcttttgctatcactttggggatgttatcattgtttcgtaaaactcttgcttaattttacgtttactacctacatgcttgttgttgtgttgtgcaacattatctattgtgatatgcttttataagtctctagaacacgatcaacaatgtggatattcgtatcttggcctgggttttgtgtagataaactaagacacccaacaaacctcccctcatggcaggtaacacctcggtagttagagttttagtcaagatcatcacacctctacatgaaatcttcgcagaaccaaaactactcctccagacatagctttatctatctttggcgctatgcagtagttgttagctactcgccccggtctccgtttgccgtatccttaccttcgtttgattaaatcgttttcgtatcctgcaagattttacttccttcctttatatacccactttgctctataccttgattattcttctagagatactcttttagattatatgctatgaaattcgttttgtttttcttccctcatttctcaacattacctccctgctcaccgactccttttcagaactgtggacggcaaaggtaagaaaaagaagggccttttctagagtttcgctcaccgttagagtgtggtgtaaaggacggtgggaagaaagtgtgcgcacactgctattactactactactactaccacccggagattggccagcgatgattgatgacgaggacgatgaagatgatgataaggataatacggacgagatgaatgtgtggtggctgggatgtcaggaaatgcagagagcgaacgggagtggatccaccctaaatatatgccccgctcggatagaaatggcacaggcgcacacttccgccactaccgccattacggtctgctactacagctcaaacggcgtccactaaaaacagaattccccctacaaaaaactccccccaactgtgctggagacgcgactgccacagtcgagtatagtttaggtaaggtttaaaaagacagttaaacaaaaccgatcatagcatcaccgctagccacccgccacttcacgatcatctatcctctgtcgcatcctagcaaaacaaaccacagcctctctttctccctcgttccgcgcacccgctcatcatgcttcccgatcatcatacagtatatttcataagagattagtaacaccatcggtcacaagaaaagg

SEQ ID NO: 78 - DNA, 2846 bp, Anopheles gambiae
acgcactagtacgacgacggagatgagattgacacacaaccgcgcgcgtcgagtgttagtttccgtttgacgttgcttttttccttgttttcgattcatcccctcgcccattcttttggcccttgtaagcttgaaagccattgtacgcttgagaaagagagagagagagaggctgtttgggagatgtggtcgttcgtttcgcacgatctgatgctgcacactgggacactgctggttaatatttgaaaattgctatcaattttatcttgcttttatatattaattttcaccaaaagatatgaattgtggggtcataaaactattttgaaaattaatactggtacaacttcatgtttattcctgaaattgaacgctttttgtcaactttaatcgcttttaatcgcttttattcaatgcaaccctagccaacgaaccattttgctctttgggtgcgaacgggcaaacgtcacacaccccgtcctgtcacctgagctgtcaaagcgacgtgatcacaaaacaacacgcgctccgcattgtgtacgtgcgaaacacgtgcgttttggatttttaccctaaaaaagtgtacattttactttcaaaatgaaagtaaaacccgcgaaaaaagagaaaccagccgccaaggggtcgggtgtgctaaaaaaatccaaaaccgacatccagaaggcgaagaaagtcaagtccgccggaccggtgaaggaatccgccgccaaggtagccgctgcggcaaagctactggagaagaagaaggaagtgaagctggtaaaagcaagcaaaacgaaagcggacaaggaggatgcggagcaggaaaatgaacccccacagaagctggtacaagcgaatggtaaagcgcccgcaaagcaggagaaaggatcgaaatcgatgaaggaaactgcgaacgaggaaaaaatgcctccactgaatggtaaaggaccgagacccgcgaagcaggtaacggacgaggaagattcacccaagcccgaaaatgaatccaaggcggctcgaagggaaagagaactcaagctgaaagcgttgaaaaagaagcaaaagaagttgggcggcaaagtggtgtccaaggtgtccgaggagacgctggccctcgtgccggaacagttagtgacgaaggcgagcttccggaagctgtacgaggtggtgcacaacaagttcaacgagaagggcaacaagctgttcggggatgatctaaagtacgcgttgcaagtcgtggctgtgaaggtgccaaggtgcccgctacggatctgtcgcgtgtaagtaggaggaagccatcggtggtgctgcaccggtgaaatgaagctaattcccttttttttgccttttccagcgctcttccccacacgctgatgcgcaaggaggatgaaatgtgtctcatcgtgaaggataacgctcgtggccgggatgtcgactatctgcccacgctgcaccactgggaggacaagctgaaggagctgtcggtcgggtacaacgtgcaggtcataccgtttcagcagctgaagcgcgactacagttcgttcgagatgaagcgcaagctggtgcaccgtttcgagcggttcgtggtcgacgcacgcatcagtgggcacgtgttttcgtttctcggcacacagtttgcccggcgcggtaaaaacccaatcgcggtgaagctggacagcgacgcaaagattaaggaatcgattgagcaggcggcaatggtgcaaaccttccggcagacctacagcggtccggtgacggaaatcaagttcgccgtacactggatgccggtggagcaggcggtcgcgaacgggatggcactgctggaggagctgaagaccgtctatccgggcggctggttgaatgtgcaggcgatcaacctgaagacggtgtgcgaaaagtcgtactcgctgccgatctacgtcagcacgatcgatcccaatctggtgccggtaccgatcattaccggaccgcggcaggtgtttgtgcagaagcagcagaagctgttcagcaagcagacaggcggcaagtacgaggtgaccaaggacggtgttgtccggcgggtgaagaaaccgagcgcggatggtgaggagaacaacgagccggattccgatgtggagatgacgctggaagacttccaaccggacgacgacgataactgggtgccgtacgatgatgagccaccggcgagaccgcgtacgggtggtcggccgcgtcagcgcggtccgaagatgcgcatcaagtaggatgctattttttttagatttaataaagataatactaatatctggcatcccctgtacatcttgcgggatggaatatatataaatggaatcgtaacttaccggtgtgtttaaacgatgacgagaggcgagcagaaagcgaacacgagaaaacaatctgttcttgttctggatttgtcacggcaatcgatgttcttaatccgcttagaatggaagcaactgcccttcttattgtgtgctttatgcggtgtaaagggtcgagaaattataaaagcaccatcaaaccttttcgtcagcttcattcttgattgagatcttgtttcgatcggtacgcagttgaaggttctagccatgacgcaccttcttttgcgatcggttttagcgattctgtgtttccgatgcattttagcgcactcttcttcagtggcgattgataagcgtttagtgttgtcttccgtgtatgatgccattcgtggaaacagtatcatcgatcctgccaacagcctcgactccgttggggaggattcacgcaacaaacgaaacgtgcgatactacacgtacgacgatccgacaaacgatgagtaagtacgaggtgtgtgatgc

SEQ ID NO: 79 - DNA, 23771 bp, Anopheles gambiae
  misc_feature (9028)..(9415): n is a, c, g, or t
gcacacatcccgcgaaatttgtggaccacaaccggtggaacggaggttgcggaggaagaaaacacccagactgggtggtggtatgaatgcttcacccttcccgaaaatgctaactgtcaaattcggctgaaggcaagcgagctgtagcacagcacggaatggtctactgcgttcgaggtgctcttgccattgcacatcgtcagcaaatagtgtgtattcgtgcgtgtgtacgtgtgtgcgttgagaaggatcaaattctcaaagaaaacggcaatagccacagctacaagtgtcgaagtgtagcaaaagtgtaaaaaaatcaaccataaatcgatctaattcgatacagagcgtgttagtgtaacgcagtggtgtaattattcgttgtttgtgtaattgggcggtcaaacccctcctccaatccgtgtgtgtgtcatcaagcaaaacggttcaagaaatccgatccgaaaccatacgatccgcgggcaagcgtcgaagctgcggctactttgatctcgtattagttggtagcaatacagtggtttaaaagaaacaaagcataatccgtgccctagtcgtccacgccatcgggggaaaaccatgttgcccttcacaccgccgattgtgaagcggttgctcggctggcggaaggtttcgccggatgattccgccgaaggaaaatggggcgaaaaggtgatcaaaagtttggccaaaaagatgaaaaagtccagcgccctggaagagctagagcgggcccttacagcacagagcagccacacgaaatgcataccgatatcaaggtaagagagaagaggttgttttttcttcttcgtcactttctccttccagcaaaaggtcgttttattgtggtgaagcaaagaagcatgttacgtctggtgaatgaaattaatcaagttctacttgttttaggttgaagtggtttgagtttcgttgcttgtagcgtacagagttgattagaaatgcgcgagcggcctgcacgatttgttggttgcgggtatgtggttctgtgaaggggccatcaaactctcacacacacagacacacccgaaacacacgaacggtacccatatctaaagatcaaggacaagttatcggttcactactgagtcttgtttttgggtgccgaaagcaaggcgcacaatgaatggcatgcacgtgtaggcaacggggagcaggggccacgtttttctatcaacgtaagaccccgagctgttggggccagttttttggaatgtttgatggcgctgattatgatgatgatgttgatattggagcgattcaagctaaagcaagtatgaaagaataacgaggaatctggtaccactatcgtatgcccggagtgggttatatggtaagaaagctggtgagagaaagcacattaaaactatacctatgctgcagtgagtgccactatgtgattaagcgcacgagacaattctgaaatttatgtagccattcagtttgttttcttataaatgcttccttttatagaaagatttaacattatttgattattgaaatatttactgttggcctgctcacaaatgtttctactgttcgtttaactatagttaacatagcttgaggtgttaacaaatgacgtcactgaagcattctgaagtgaccaaattgaagtgtagaagaagacaatcaactaatgtccgcgcgccactctttatcatttgatttaccccttcagctcacaacaccatgataagaggttatttttccctttatttgttgtgtgactacggagtttatgtttggttcagccaaacagaacgtgatagatttgttttaagaagtatccaaaactatcgctgacgatgttgctgatgatgatgatgatgttaggcaaactcatttgctgtgtcatttcatcattccaaactccagtatagcgctgtgttctctcctggtgaatgttgcctccgttgcatgttgatattcaaagccggttgcattgcgtcaccgtcttgctagatttgattcgaaacgctgcactctctctctctccttgtctccctctctcttatgctctttttgttgtgatagtgtgtaaacagctgtttctggaaacggattttcaaaacgctttagctatgtggttttaagctgataaagggctccctggttaatgttgggaaatagtttgggtgcatgtgtgtgttttttttcatcttttgaattgggaacatctgtgtcgaatagttaaaatgtaagggattaacatgaccaatgaccaagttgcactatcgcaacagttaatgatttacaatcgcaccatcaaaaagggggaatatctggttgtctcttcgtgacaatctttggaacattcatattgctagagagcatttaaagggtattaaaacaaacatttcttcaattgatattttttcttggcaataatttctaaaacctctaaaccaataaggccgggccgtccctactgaacagtaatttgtaaaacttatataatcatgaacttatgctcattaaatagtagcagttcttagaaacatttgaatgttttttaaatggtaaaaaatatgataataaaaatagtaataatatttcaaatgtatgaaataacataatattcaaaatttattttatttcctttgctgaattcaacattcctagctctattcggatgtattttaaattttgactggcgatgttaactatgtttctatggcacaattaaattgttaattatgtttaacatcattgtacccaatgtatgattgttgtttcgttttgctacaattataaatgaatgaattagtgtttttctgaaactgtcccgtagatttcctatcaatgcgaactttcgcgtaactggtattacgtagttttaagttaaaattactcaagttaatatggttgaagttggtagctaaagtcaatagtttaattttttatgttatctttactgaaaattcgcttttttctcattttgattgattttcaaactcctgtaaaaagtaatcttccttgataataatcaattgatgtttcaaatcgataaataaataacaaaaataatttagaaacccgcgtttctcttcatccgcgtatatatcgggccctacctggtttatagaataaacttgacgtaaaaaatgcagacgcataaagtattactataacgttcgcataaaaaaatgataaaacagtcgactaacgaaaagttaagtgcactttcccataaaagtatcccatgagtcagcagacagaatttgacatctctaccaatcgaactcttactgcgatggccaaaaaactgcagcaactgaatttagaagcgtacgcgatcaaagaacggcacctcgccacgacaagaacggaaaacgtgtggcaatttgtgggtgccggataggttcgattcggcatcttcaaaatcttggcactatattagacaacaattagggcattgcgagaaagcaagggtccaaaatagtacctaggaaacatgaacaaacatatcaggaagcaaaatcgcgtccactggctttgcagcggctcgtaatggcgccaaaactcaataagataattttagacgattttcggcggaatttcgatgtgacacccttgtacgcaaactggtccaacatccctcagctgctccccatccaaagtttttagaccaacatgatgcaaaagctctactccaacaattttgtcgagaaaacttaggaattgataatagctaaagatcgatctaatagtcaaagaagcccttatgcgtctcacgtatgtcttcatctgacatggcgaaaatcccgggtaaataacgacaggtagctcgcaaggtcgtaaatatatttttgtaagtaatcctaactaattaccctttaaagtacgatcatggaaataccttatctcgattagtttttcctacagcaagagagtattatcacgactgggtcatatcatcagtgtccatatttttttttatatacacaggtcgttgtccccaagatacactgttaatgggggccaaaaatggccccaaaataccgcatatagtgaatttccgcgcaagtcgaatctcgttatttccaaccaaaatatcactaatgttcgtataattttgcaagtgagaggtgatttatgtcactttattaattatttgatatgattctgactaaatataatatttttaaaccttttgaaatgagttttaacatacgatcaaaagagaaattatttcgcatgtgaaaattgatgtgtcaaatcagtacaatttgctgaaagaactgtcaaatttagaaaaccgcttatcttcgaatgtgcgtataagaggtaccatgtatctcgaggactacctgtacgggaattcctcaatacatctgctgcttagcgggcagacgttaaacacactatttaggatataattttaacttactccatagacccccttctttcagacaacgatgtgttgatttgattttttaatgctggaaactctatgactcaagttttttgttgttttaaaatgtgtatagtttactaaaaaaaaatcaattcagtcatgtgtccctgagaggtgctaatgtgcccgaataggtgtgctgcagtcttgcgataaaaattccgcagatcccggtatcgtcaacgttttcgcgtaacgttccgcagtcttgcgattgactcccaccgattcatcaaagtgtcccgtggccttgagttctatcgaaaaaccctgtgaggttcgataataataacgctttgaaaacaataactacaaacaataacaattatatttacatattaaaaccaggagatggattgattctgagtatatttacaacgactaggcgtctccattgaaaacggacatattaaagtgaaagtttcatccgtatgttcttgccttaattttacattacagatgtttcttagttacatggacatgtattgttttggtacccttttctcttaattatggcaccgacaaataaataagatcattatggtaactcctaatggttcaagaatacatttattaattggctttatataccgattttacgcattgtgtagcatatagcttttcttgaaatatcaatacacttaatttttggtatgattggtgttttccggacgcctttaactgtgacgtcggctttggtaccaaatcgtaccaaaatcgattaactacgtcatccgccgtgtgttgtcagatatggcaattaattttacgttagaaatcatttgcaatacatgtatttgcagtatacaatttcaacaacattctcatttttccatattcccgtactgtttgtatccttttcatttcatacaattcacaaatttcactctattgagacgatcgtttgcacacaacagggtctagggacaaggtcaacaacactgccaccgcgtttgtatgggtaaatgaacagcagtttgtgtggtcgtgtgtgtgtgtggctcgtgtttagtgtttgtctgtctctgtgcgtccgtccgccaggctgtcgcaggtctgtctgtccgtctggttgccagtctttgtgcgaatgaatgtttttggagttgcaggaggaagtagcatcagagcacagcagagactcatccagaaccagccgcgtctggaaagcgagtgtgcataaaggcagccggggcggaccggtacaaacggcgacgccaaataatggcatgcgcgcgcatcgtcacttctaattccccttccgggggtaatggcaagatgaacccacacacacacacacatacacgccggtgaaatgaatccgccgcggtaatatgccgctgggtgtgtagtaaaactgtagtctaccagagcgtcatgatacggttgcttttaagaggctcaagaccagcacgttttaaggtgaaaggatagtacagcaaaacggaagagtgcaaaatgaaacctcgtcgtttttgttttaggaacctttagtaaaggggtagcatggggaaaaacggagaaatccatgtatgactgtgtgtgtgtgttgttttttgttcgtttcttacgactgggaaactatttagtttctttagcaagtcactgtgccataccgttgctacacaccgtaccagacagtgaaagtgtcacgtacgtacaactcctaccagaagagcggtcgtcttagcgtttggcggtgatttccactttctatatcctgctggcttttgtggtgtttgtgtttgaaagcaaaagtacacacgatcacactgtgtagagctatcgtggcgagtaataaaaattaacaaatcaaatactaaattatttatagtaagtacatcggtgtgctatagtgactattgcagcttaaaagttacgtttataaatatttaaatatgtactagtaacacgatccaaacgagttgaaagcatgcagctcgactgtctgaggcttttttgatatgcctactaatggtgtacaaagttcaactaccccgcctgttactcgacgccatggtatcgacccaatgtttatgtgtgtgtgtttgagtacgtttgtatacactttgtattactatactcggttggccaacgccgtaaagcactaaacctttacgcttgtgtgccaagagtgtccaccgtacaagaagaacggtcccccggaagcgtcatgtacatgtacattcagtcatcgtgtctcgtcaggtgcaccctatacgccgcaacacagtgtgtgtgtgtatgcatctttccgtaggctgcgaccaagtgtatgtgtgtgtgtgcgtacgcgtgcccagacgaagcagacgatgacgatggcgtgctgatgatgacgacgtcgtcgtcgtctcaaaattaacatagaaatcggttttcggttctggctggctgcttgcatttctgtcgttctcctgcaattcttcaacctcgcaacctttcataaccgtgtcatattatgtgtgcgtgtatgtgtgtgtgggcatcatcgttattcatccactcttccttttgtgtctatcgctgtttgctatatattatttatgttcctgctttatgtcgcccgttcggctgttgttgggggccactttctctgtctatcgtgcaagcgaaggatgcattttaaaatgctgtttttgctgtacgacatgttgtgtttaagcacgcggaaagatttcctattgcgctaagcacgcgaaggatgcaaaatcgagaagcatcgtaatgcacctccaccatcattacggtaatcgttactacaagtgtgtatgtgtgctagagaaagagatgatgcacacttgatgatgatgatgtgcaacaacatgccgatgttttgttttgttttcaatcaattttacgctttttattaaacagtatcaagtcgactcgagcattgaaatttgatcttactgggttatttaaccacaaaactcacgttgcgttaagatctgtatctgtaaaacattttaattatttaaaaaaataaactgtctaaactaatgcttcaaatcaatgaccatcacgaccggaacgctaaccacgaagctgctgcgctcgtgtacagcaaacgtatgataattattggtttcgctttgtgctaatctcgctaacgacactgtacagcacagcgcatcgagaagcgatgtccgcgtgtgtgcgtgtgttgtgtgatgcattgtagacttagcgcaaaaattttggcaaacgtgtgtgtttttgccgttttcaaggtttcatcaaactcacccggcacggggaccgtgcgtcgcggtcgcgttccatctctcccctccccaaacacgttgttgattatgctttattccactcacacacatatacacatggaggcccccaccgtcgccctacggcggtatgcttgctcattgaatgcttttgttttcgtcttcggttctaatggttggtgttggtttgatctacccgttgaccaaaaaagtacgccactgtgtgaagctcatttccagtgccccggtttacacgttggtatcgttttccgtattttctgtggatgggtttatggtaaaattatttatacactttcttgaggggcacagtttgtagttcttgagtgcaggtgcactggaaagatgcatgttttcctatttcttgactcgttgctacacggttcatggtctctggtttatgttatgttttaaaatatgcatgtaatgttgatactgttccctttttcaacctgttaattgatgccagttcatgcaattaactcgacaatgtaataaaaataaatacatctttcatcatgataaattcattcccgtaccctaactcaatattgttttatatttatttatgcgtgttagtaagatgtaaaactaaggcttgtaataggttttaaattttatacatccatcttgcctgttcactcgttttcatcgctaaataaatgaatatcaattttaccaacggtacgaatgcacctttttaataccattacagggtttacctagccaatccggcattgtcaaagcgttatctgtcgccgtaaatactttttcgggcgacgtaaaccctcaattgagcactgtcatttctattcgggccttgtgaagtatgaatcgggcaaagtacagaatgaattgggcctactttatattttgttgctttctagctgtaaaacaatacttttttgctagtagttgaactgatatgtaagaaaaatcactatttttaagtttaatcacataaaaaaaatattcaaattccttttttaaaatttttaattcaaacccgtgcaatgcaatttagttttatatttttttaataatataataagtttgatgatttaattaggtaaacattttaaaataatacataatacagggtttacctagccaatccggcatcgtcaaagcgttatcggtcgtcgttaatactttttcgggcgacgtaaaccctcaattgggcactgtcatttctattcgggccttgtgaagtatgaatcgggcatagtacagaatgaaagcgtcctactcttgaaggtgtcaaatcggtcgctccggtgtgtttgatccatgaagcagtttaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtaagttaaacaacatgcaaaatacgtatttttaaacaacttgatggatcaatgcggacaccggagcgaccgatttgacaccttcaagagtaggacgctttcattctgtactatgcccgattcatacttcacaaggctcgaatagagatgacagtgcccaattgagggtttacgtcgcccgaaaaagtatttacggcgaccgataacactttgacgatgccggattggctaggtaaaccctgtatagaataaatgaagtattaagtaggtgctacagatttggaggaatgtataaaatgctctcttattttaaaacatttttgttaaatgggttcacgattaataaactatgtttatccataatacctacgtacataatacttatatattacaaaaataaaaacacttaataatcatatgaagcttttctaagaagttcgtttctcctaaatgtattctaggtttcgtggtatcatttggtgatttattcgtgctctgaaacgtgtgacgcaattaatgtcacatttgtgccgtttgctacatgtgttgatttaaacagttatcacacacggtcaaaaactgtcaccttcgtcgtaaatgtatcgttcaaataacttttggcagatagacttgggtaatgaaattgaattgaattgtgttcttaattatttaatggctgatttcttatcaaaagaagttggtttttaagattattgaatatttttatttttgatatattatttggcttattagaacaaatacgccatgtaacagtaaaagaaacaaatagttaaggtcacctctatcattacccgcttggcaaataacacccaaaaaagctttctaaaaaagcttccatgtgggctttgtggttgcatatcaatatttgtaatagttgtggttccacgttaaacgtaatttttctgatgccatttcagcttcctggattaacggaatcagtagaattgcaaaatattacttctgataggtcatcttatacctcttcgtcacactatccatcttccattacctgtacttcctcttggttccgcgtgtaccaagttttacaaattgcgttttttttttcatttcggccgcggttgaattgaaccgaggcccacaaggaaaagcagcaaaagcaagacagtaggccggtaaaagcgagacagaaggaggaaagcaatgaaacctacgtcttcacgtgtgtttcactacaccagaacgaacgcgtgaaggaagaactaagaaaggcaatcgaagaatgtaaaaaaatgggagcatcactttaaagtgcaaaattgaagggttattggagggttgggcgagggcgaggcggtagtgtgcatatggtggcgtggatgtatttatacatccacataaatattttaggggatgaaatgcagatgatgatgatgggttggaagcagttggaagtgtgtaacatgtatgtgtgctccatttatttgagctttgtctactttcgcttcgttcgtttatcggtgtgcgtcttctggttaaactctctctctctctctctctctctctctctctttctgcctgttcgttccatcaagaaaatacttttttttgcagaacaagcgttacctccactccgtttgctccggtgggtactgtcggctttcaaaaagtgtgtttaacatagcgcatgcattaaaaatgagaagcgccagtgctgcttccttctggggcagtggtcggcaaaccttgtgtcgtaaagtgccaaagtctagaaaaatacaagtagaatccgtcgttaagagtaacatttataaactgtgattaaacatactttatggttttatgaaacagggattagaggggaataaagccttcatctgtgcagcaaagagccgcatgcaaatcgcgaaccgtactttgccgatcattgtgcggggtgtggaaggatatacaacatatattggagtgtgaaaaaatgcaataactattaatttattttcattagcaatacggcaaagccgtccctactgaataaaaaaaattattttctttaaaaaaggacccttttcatgggttacagaaggcagtataagtaaacagaactgttcttcttaatttctttttaaatagacgttgaatctaatgcttttagcattctaaaagcgaatgcataccatttttgcatttccatgattctgccgctggctctgctgtctgtctcgttttattagcgccgatgcttgtctacccactcacgcaatttttgacgccggtatatcgctctcctcccctccattcaccccatcgcccaaagtcattatccgctgcacgtctagacaccccatccacccctcgctgccggcatagcatgctgctgctgtgtctgtgctaccaaatatatgtttgcttaaccaaactcactctccttccctgtctctctcacacacacactcgtctggagtattctcgcatggtatctctctttttctatcgggagtttttggagtttgctttctcgttctctctctctctctctctctctccctctattctatcattctctcgtttttcctccgttttctggatgtagctgttctctctctatatgtatcccagacagggtgtgcgcacgtttgtatatttgctctctcgagaaccatcccccttttccatcatcgccatcatcatggtcatcatcatcccccgtgtttgcattggcaacgggagcaaactttagcgatgatgatgatgtgagatgcgcgcccacaggcctacacggctgtgactgtctttgtgtgcatgtttaggcgaagaatgatgggcaaataatgatgatgatgatgatgatgatggggttcgtcctctctctgttgctggtggccagcagcagtaactcaaaaacccggcgcaccatcgggcggcagttttgcattggatgtgtaaacgtgtagagcgaatcaactgccgtgtagagcgtgctgccaatcaacccttttatcctgtgtatgtgtggttcttgcgtgcattatttcacagtgcgcgtctgttccagaggaccgcttacccaacactgtagtgttgtggaaactgtgaaaaatttaatggtatgaaacaggcgaggcgctgtcaatttatttatttggcagaaatttagctgtttgcgggttctcgggctggttgtcgtctatcccacactgaaaaaggggttgctatgctatcgttgtttttcttctgttttgtgcaaattctactcgcccgttgtcgtagcgatgaagcgatgggaccgtcctgcttaccccttcagccagacatagagcgtcccggtgtgtgagtgagacagcaagtttgcgattgtatgtgtgtatgcgtgtttatgtttaggatgacggaacacgtgtgtgtgtgaatgattgtttcgtgtctgtgtgagggagctgtttgatggtggtggaaattgtgtaacagttatcgttgtgtgtgttgggatgactacacacactgacaagagatcagacagaaagtgaaaaacaagcataaagagcaacatagaaagcatcgttggagcaaaacctaaaaggagagtctggaaatggcaacttagggagagaagtcgcggtatgaaaaaagcgaaaaccatcctttaaggtcatccaatgaaagttttcgagaagaagccgctgagagtatttgttatgtttcatgtgggtgtgtgcgtttttttttgcattttgttttcaagcgtggaaacgattttgatatctcgttgcacgagcgtcagcacaaatcaatgtgataagatatcattggagtgataaaaaaacaaaccatgtcgataaattgattccaagtgcaggagagaaacgcaacgcaatcgtgtagcgccgttaatgcgtgcagcttttttatgttattttaaagtgttcacctcctgtgtgtgtgtatttatttcgctaattggctacagttgttgcgtgcttagcctcctgcccgtgtcactgtaaaccatacacgtttacttaccccatgtcggctgtgtgtacattaataggggaaagcggggcaaaatgggcatgttaagcagtttactgaatattcctttgaatatgccataaaacacaatttttctttcattattgcatgcttccaccatttatctatggatttaaattgccacatagaatgaaaacaacttaaaaacatgtaaataatgtaaaataaaagttgatgttttacgagaagcatttttgacacgcggggtaaaatgggcatatccctggggcaaaatgggcatatgtaaacaaactgtgaaacgtcaaaacactggggcaaaatgggccacaacaactgcgcttaggtaatggtctatgcttttgcgcacgtgtcgtgaaatgtattttcgttctatcttttgttttgctggtcagaaaagcccttaaaattcttccaaaaatatgttatcaaaattaaaacagtttttacacgtttaaatctacaaaatcgattcttttgaagctgtgtctgttatcattattgaggcgacaaatacaacaccatagcctcaccaaacgccatttgtcaaaagtatctgcccattttgccccaagcgtaactgcccattttgccccacgtgaagcatttttgtattttatgttatattagtaaaaatacgcattcgatcgccttgctttcttcagacaaattgtatagaaatatcatatctttaataatatataatgtaaaacttcaacgcatccctgtgacactgggttaagcttattttcgaagtgacaaaaattacatcaatatgctactaaaccttattttgcacttttcttggttatttgttgtgttagggttatgaaacttacatggtgttcatagaacactctaatgaatacattttgagcattggaaagtatttttgtagtcaaataatgcttaaatagagggtgcccattttgccccacatgcccattttgccccgctttcccctatagtgaacacaaacacacatggcattatggcacttgttcgtctttcgattgcagtaaccataggaattcacccttgcgggagaaaagcggttaaactagtattacagaacgaacaaggggagaaggatgcggttgcgttgttgtgttttcgatttcattgcctgcgccagtgtgttggtgtgtattggaatgcgtctgtaagtcttaatcgggggcgtcaaacgtgggagcagtgcattcgtcatcctcctgttcatcgacgcaggaagagcgtctgatttataccggaaacacaaacgtgtgtcgtgcgagacgtgtgtgtggaagttggtgtgaagacaggaaacgtcaaattgtgccgccgggttccgatccccatcctctcactcgctttcgctatttgtcgtggacgtgcaaaacccgaaccaccgtattgtactgtatttaccaacaactgtcgttgttgtgttgatggtgttaagaggctggtactgtgatgatgcgatcttgcatgatcttaccagtggctcaagtgtaggcaggaaagtaaatacacgttgccgatcgcatgaaatggcattatggtaatgaaggtgtttcaagaaggtggaagtttttgtttttaagcttaacgagaagaacgagtgtgtgggtgtgtatcggtgtggtggcgcttcgagtcgttacgggtggagcgtgcaaggaatgtattgcatgataatgaagatgaaattgtcgcttgtgacgaagagttggatcaaaaatgtgacttgaaattgatttgcaatgtatgttaaatcgattctgttcttgtgatcaaccatcttttagaaatgtgaaacgaaatcgaattctgtgatagaaatttaatagattaaaataaaatatatctataataataacttatatttttactattgtaattcaaacatttataaaaataataagtactttttttgtgcgtagacttgtaacattaaaactgcatgttgtttaaacttttttttacatcatattgaagattttaaatggcttagtaaaatacagaatgagtaattattaaaatccattctagcttcacggtttttctgaaatattacactaacaattttaaaaaataatccaattaaatatctaccttattgtcattgtaaaacattttcttacttggagttggttcagtacagcccaagccaccaatgcctaagccatgggcattctcgaaaaaggtgtgttattccgcttgccgtcgtgagaacccattgaaatttcctgacttttatttattttaatcgatctttcgagtgccctcatgaaaaaaatgtatatggtttcatatggttctttaaaaaaatcatttcccacctagaacctggatatgcctcattttttgtgttccataggcaaaatacgtagtgatgcgcacagtttgctcgaaattgttttcccatatctgctcgattagtactcgatacgcttgaaattgtggatttgtgtgtgatcaagagttttgaaatcgtcaagatttggtgtgtttattagacttagactttcttctgtcgatggacgatgccgacgagctcatttttcattcatagccatggtgttttatgaaaaacaaaacctaattttgtaaaacgttattatataaaaaatgggtattatttaagtataaaacgggtacagtacctactataacgataggaaacatcatttccgagcgaatctagaagaaagtaacgaaaaagcagcatcacagttgattttaaaagactttttaaattccgtttaactggtgcagtttaagggaagttcaggctccagtttaagggaatttgctcgaattctccattattcgtgctcgaaaatgtcgattcggtagtatccctgctgtcaacgagcaacggatatgcttctgcaagtctggcagcactaggtagaaattctgcttagaaagtactccgtgaaaagtcctagtagaagatggcctgtttattcattttttaatgttttagacatgttttgggcgggaaacaaagcatgactcttgtacaaataatttacaaaaaaatatatatatctagacgcaattttcttttcaagctaggcgaagaacatgccaaacaatttgttgaaaataaaagcgccaaccctaacttgcctatgtcaggtgctggaggttctcgtcagcgctgccaggttcaaatgtcttattacgagggcaaaagcgctaacgaatgcatcacatgcaatatattagtatttaaaaaaattactaaaagagtttcgcacgtatgcgtttcatgtgagccaggttctgatgaagcaatgtaatattttgtcctgatgccaagaaacctaaagatgtttcatagatctacatttttataaacatttctaaatatgtatacataacgaatgggacaaaattgtcgtcccatatggcggttctagtaaggttgaaaagtctggcggttctagtgttaagttaatcgtctcttatcgcgctttagcggtttttttctcctttttatttgtttttttttcagaaatagtttagtttagatcatgagctatattttcttcaattataagatttagatatttgttatttagacttgatggcatgtatggaattgaataaatattaaataaacattaaataaacaataaacattcaacattagcaaactcggacaatttcactgactttatcataactggtaaaatatttttttctttttatttttatttggcaacacaaatacaatatttttcctgaaatttgaatgacttgggtggagggggggatatcgaagaaatcttttatctgaatataaacttaacaaacggccgcatggctccgcctgaaatagtatttatctggcgaaatgcgttgtttttttacttattttcaaatagttctgtgatttattaatgcgttgacctgactgctaaatatttgcaatcattttaaggctttctatttttattatggaacgggcttgctacaacgccgctaacacacattacgagcggaccgtgattatcgataaatatgcaaacaataataaaaacacacattgtcaaattccacagctacaatcgataattgtttgcagcaacgatcagtttgaatcgaaagagtttcatggctcatatcaattgcccggcggtggtgcaatacaaagaagaaaaaaacatttctcggttttgtcccgcacctccttaccggttagccatagagttagcaattccataaatcgatgaagcgcgacaccttcgtcaatacacccttgggtgctcttacttggaggagggtgcgtaggtttcttctccttccgtgtgccgttgtttcgtgtgaacgagaaacgggacggctctatcgggcgcgtctactacggtgcaaggtgctgtagagcgagatcactacccccgtatgtctggcgggtaaaggcaggtttttaacgtacacacggagcaccagattggtacaattcattaacgaaccggtggcccccaatgcgcttgaatggtgtgggtttctttaccgtcgtggtagagaatcaagagaaagataaatggaacccgtttgtgtcgcgtgtgtgcgttgtgcgccttgtccagccacagcttccattgctggcaggcaattacatcagcgaaggcttccttttctcttgtttcgttttttcgcagcccaagatgcactaagtctggcaaaatgcattggccgtgcagtagtaaatgagtcattatagcgatcggtgcgcccacatctaaggaaagtggattttttaggccagagagattgaacgtgtttcgaaatgatgacgggtggtgtgtgggatacaagctttcttttgaaaattaatttactactactacaaacttatactgatatacgatgaaaatttgtagctaaatccacgttggttcacttgggagagtaaatttggccaagtcaccccgggtctttttaataaacagcttagaccattggaagcttttgcgtaatatttaattatgtgatattttttattaaaaatgtctcatatgccatacggccgtacccttctgaataacaaataaactgtctagtttctgatattcttatttaaaatggggtctcaaagggactcaaacaacggttgaacagtattgtttgtgttataagatcataagcagtgcttgttaatggatctgatttcctcatgacatatatcaaccttttctttctttcctgtaatcatcgggtaggggcattacatgtacagtgttttgcgtgttttaactcttcgttgtcgcggaatttgcggaaatgaaaaatgcgaatgagcggatttggaaagctggttttgtctgaatgcaatccgatgattaaatataattttaaagtaaatcaatacagaacattcaaaatctgatgaagctcatgttcttccatatagattccgctttccttggctcggtaacagctgattttcctctggggaaaatatttgaatggccagaagctactattccgtaagaccaccaaggataagcaaggattgcccaaaagccaatcaaaaccttgagcgcaaaaaaacagcacgctgattcgtaaaagaggtttcaggctcgtcgatacatatctacaagtgggttgtcgatttgatggcattgaattaatcgacatcttcaaaaccttattcgggctgaagaatattacccactgaaaaattacaactatgatgaaatttgttttatttttggaaaaaaaaatccattaacggaacaacggaccactaaaccaatcgataacttgttcaataacgacaacgatagtgaactaaaaatatattcttgatactaataatgacaaaattgttcgtatgtagccctttttatcaacacatttgcgacctggaatcagttatttaaattttcaaacgtttttgaaagagcctcccgaataacatattacaagtgagtttatggaacggaataaactcgcattgaggagttccacaatattttgatgtgattggaacaggttaaaagaatttcaaaacagttgtgaggaaaaatttgcggattcgaaaaattagcaggatagatctctttagcaattccaaattaaaacataacaatattttgcactaaagacaaagcagttattcaaatatcaaatatcatatagtgttttttctcctatttttagttggtttcgagttttctagccgttcataccatagtttaaaaccatagtttttgttctatatctataagaattgggacagaatattattgccccaagaagaagtgaacgaatgtaaagggggtaactcggagtgcggaagacagtcgttgatcagatcgcgataaagaaacaccgcatcgaactctctctctctctctctctctctctctctctctctctctcttgaggtggatgtcatatgtccttctgtcgtttttcggtcgtattggcgaacatataccattacatgtgccgtcgcatgtactattagtctacttaccctccctaaaacatgctgaagtgtttgttctgttacattgttaaactcactgaaaagagtttcaaaatacatgatcaattctaatagttatttcgttcacaccttcatggaattggttgactttgacttacacaacatttgaatgaaatataaaattagcaaaaattaacgctttgatacaaacaccttatgtacatgcctctttaatttatcgtgagcagttcccttaatacatttggttttatcattctattgcggtcagttaccctctccggcgatgcacacgaccaacatcatcgttttttttgcgttggattgtgtattgcactgtgattgatgacttaatcgtaccgtttacgaccgttttgtggccttcaattggcttatctgctgttcacctgtaattccggcagtgtttttttgcctatgagtgagatggaataaaaaaatccccaggcttgttaaatagtttagtgttttgattgcattaaactgaattaaattagaaagaataatgtgctgaatagggttaaggcgtagttatttgtaatatatttgtgaattaaaaattgttagatatttaaattattcaaaattttgggctaggacataatgctaaacctttaactaaatgagtcgtgatattttaaattctttaatcgcttggagtcagtagtattgcatcgacaataattctaacgttgtgtttccttatatatttttacagaaatgcttcggcgatcggagaaaatggagttgcgctaaagaaaggtcttccacacgtcatatgctgtcgattgtggcgctggcctgatttgaatgtaagacaaactcgaaagcctggtcaactgttttcttactggtttgtttcaactgtttcttcccatagagccataccgaattgaaaccgctcgacgtatgcgaatacgcatatcatcttaaaaaggacgaggtgtgcattaatccatatcactacgcacgcaacgaaagccattcacagcactcgcagcaacaacagtcaccgcagcagcaacagtcatcacagcagctgcagcaaccgctgaccatcttggttccgaagaacctatcaaactctcagggagaaaactccgttacctacaccttggacgatcttagtaataccgtaccagtcaacacacagtacaatgcattaaagtatgtatgagcagggcgtgtagcacagtgtagcaatatgtggttacatttttctctacaatctttttctctgttacccttccagtgataactatgtaaccagccctcaaccatcgcaagtaacgtcacgccagctacaacagcagcaactacagcccaatcaattgcatcagcaacttcaacagcagcagcagcagcagcaactttcttccccgtgctacatggaggcaacactgggccaacagataccgaccaacacgacgattatggactcggtcagcgtcggtgtgccgaacataccgaataccgagacgccaccacccggctacatgtcagaggatggtgatccactcgaccagaatgacaatatgagtgagtcattgttggtatccgcgttctttattgaatctctttttccaatgcagtgcgggataaacataatcttgaaagatcgtttacgcttgatagaaagtttcaatgttccactataaggtgaccctgctaagaggagaagtggaagcgtagccgaacatagaacataaagtggcataagatggcaagcaaattttgttgtcactttttttactatttacgcgttgttttattttatgtttcgaattcaattttgtaatttaaggttttattttttgtctctcactatcatcatgattgcttcacgcatctagccgatttgtcgcgcatgtcgccatcggagatggatacacagccggtgatgtaccatgagccgacattctggtgctcgatcagctattacgaactgaacctgcgcgtcggtgaaacgtttcatgcctcccaaccttcgatcacagtcgacggctttacggatccttccaattcggaaaggtaagcatttcatagtgtcaaatatgattgaatgtctatttattgtatcccttattttctttgctattttgtttaaagattctgtcttggcctgctgtcgaatgtgaaccggaatgaggtggtggaacagactcgacgtcacatcggcaagggtgtccggctgtactacattggcggtgaggtatttgccgaatgtttgagcgactcgagcatcttcgtgcagagcccgaactgtaatcagcggtacgggtggcatcctgcaacggtgtgtaaaataccaccgggtatgtgtcgatgaaagaggggaaaatatgatttcgttgttaattttgttaacattttcttgttcatgcttcatccgcaggatgcaatttaaaaatctttaacaatcaggaatttgctaccctactgtcccagtccgtatcgatgggctttgaagccgtttatcagctgacccggatgtgcacaatccggatgtccttcgtgaagggttggggagcagaatatcggtaaacttaaatgaaatgtctagattggaaattgacaaaacattttaactaatgtactaacacttatgtacgcatttcttgcagccgacaaaccgttacctctacgccctgctggatagagctgcatttaaacggtcccctgcagtggctggaccgagtactcacccagatgggctcaccacgtttgccatgtagttctatgtcctaaacactgctaccttgtgtcctataactaaagctccgtggatctcgctccagagcactcgaacgcagtgtgcgcggagtgtaaggactactaccccgtttgtctacctccgccggataatgtttttcgctcctggtcctaatgttctctgtcagaagcaggatgttatagattaagttttcctaacggaaatttcattcaaccctctaccattgcaaccagtacccgcctatagacattgtgtacatattgcttttgattacgttcaggttcagtgctgtatttttgtggagggaggatattcttggaagccttttcttttattttaaaaatcgacaagtgcttttcgtatggtgcattggccattcaaaacggtttaactcagttgatgaagtttatctttttgttttttattgttctatgttcataaagagtgtttgcttaagtttcatgatactaatgatcaaagcgcgtatgcgaatgctccaaccgaaagtaaaatgaagcggagtaagcgatataaaaccatcttattgttttaagtcaacaatttgttccttatcgtgtgaaaaagattgtgtagcgtaatgttttggctggtacactatcgtagtttgccagtgatgggaaggtgtattgcattaaccaacatattacgctatgctagggatgttctagattgtttagttaagtttttgcttagtttggtttgtttaattacccgtattcttttagctctgcatactaatactgcgtgtgacagtgtggtttgatattgagtggcagtgatttttaggaacgtttggattaagagaatgtaccaagtatgtggtagtgtcagagtgaggcgaaacgatgaggaaaaatcaatcaatcatcagctggaatggtacggacgcaacattacgaactgaacgaacgatgtaaaaaagggatggaaaggatactattcgatgtgtgctcgagagagcttgcgtcatagacgaagggtgtcttgaagcggattgcaagatcatagacactttgtatacgtgtgttagtttgtatgtatcgttgaaagggaaccggcaatgggatctgtttttggagcagcaatggtggat

SEQ ID NO: 80 - DNA, 4921 bp, Anopheles gambiae
atcgctaaaatgaagtcaaaaaagtttcttttacttttgaataatatatctacgattattagacagcaaaaatgcgaactataatttatcgatcgctataaactgccaattcaattttttctcagctccatcgttctttgcatgccgaggagaattctctcaccgaaaatgctgtcagccgctgtcaaagcatgctgtcagttattttctcagctgcattctcggtgtatgtagaaacgctcccatacaaaaatttgacaggcttcatgataaaatcgcatgcaaaatagcaatgacatgggccttagttgacattttagagcttcttgttctattcgctactaatttcaatggaatttaatgcacaaaatgatgtgacataaatttataacttaactcgttagttttagggtaggcatttcaaaaatcagtacgaaaacagataaatcagtatttctggccactctgatcttgggttcacttctcagtgcggtgtgtctgcgcggagttgtaaagtgaggccaccttgactgtcaaacagtgcgacatggtccgacaccctccgaccgggcacgaaatgttcaatttcttgtggcaaatgtggtggagtggaagttgctctcgcggtgccaataatctgttgcctgtattgtaacgaggaaaaactaccattttttttgcaccgcaaaacacacgacaaccccattgcaaccgttagcgttatcattccagctgagctcaaaacaaacagctgtcgcctttttgctcctcacgaaccacgagatttgcgtggtaacaccactcggccacacggtgtatcgagtttccccatcaccacgtgtttttgcgcaatcctaaagaggcgtgcgtgcgtgcgtgtgtgtttggtgtgtggccaacaggcaacgcgtggttaattccggccggactaaggacgatggagaacggcacgtccaacaatctgcaggatgggctttcctgcgaggagctgttccggaaaagtgacggcctgacgtacaagtaagtaggcggtgcggtccagcaactggccgaaacatatgttttggtactccgtcgcttccctgctatattgttataccctttcagtgactttattatcctgcccggttacatcgatttcacggcggaagaggtggacctgtcctcgccgctgacgaagaaaatcatgctgaaggcaccgctcgtctcctcgcccatggatacggtgaccgaagccgaaatggctatctcgatggcggtgagtagagcgctcctctctttcacattctcgctcgctctttccctctctcgcggtatgtgtgtgtgttttgcagctcgcggcatgtgtgttttgaaaaacaaaccttttctgcggatggactgccgaaagggggttgaggaggatgtgacgcaagagaaataataattccaccccgtctcaacccctttacttgttgcgttcgacagcaacgtttaaaaggtttcctggcgatgtctttagagagaaagagagagagtgagagaaagaaaccccacaaaaagtgccccagacaagacattagtttacttatcgtttttttacgttttctgttctatttcttggctattccatccccattccacacaatagctgtgcggtggcatcggcattatccatcacaactgcacccccgagtaccaggcgaacgaggtgcacaaggtgaagaagtacaagcatggctttatccgcgacccgctggtgatggggccggaaaacacggtcgcggacgtgctggaggcgaagcgcaagaacggcttcaccggctacccgatcacggagaatggcaaaatcggcacccggctggtcggcatcgtgacgtcgcgcgacatcgacttccgcgagcacgacgtggacatcaagctgaaggacatcatgacgaagctggaggatctcattaccgccccgaacggggtgacgctgcaggaagcgaacaacattatggagaagagcaaaaagggcaagctgccgatcgtgaacaagacgggcgagctggtcgcactgattgcgcgcaccgatctgaagaagggccgcacctacccgaacgcactgaaggacagcaacaagcagctgctggtcggcgctgcgatcggtacgcgcgacgaggacaaggagcggctggagctgctgtaccagaacggggtggacgtgatcgtgctcgattcgtcccagggcaactcgctctaccagatcaacatgatcaagtacatcaaggagaagtacccgtcgctgcaggtgattgcgggcaacgtggtgacgcgccagcaggcgtacaatctcatcacggccgggtgcgatgcgctgcgcgtcggcatgggctcgggctcgatctgcatcacgcaggaggtgatggcgtgcgggtgcccgcaggccacggccgtgtatcaggtgtgcaatctggcccgccagtacggcgtgccggtcattgcggacggtggcatacagtcgatcgggcacatcgtgaaggcgctgtcactgggcgcgtccgcggtgatgatgggatcgctgctggccggcacttcggaggcgcccggggagtactacttcagcgatggcgtgcggctgaagaagtaccgtggcatgggcagcttggaggcgatggagcgcaaggacggcaaggggtcggccagctcgcgctactaccacacggagattgagaagatgcgggtggcgcagggcgtgagcggttcgattgtggacaagggctcgatcctgcgcttcgtgccgtacctgctgtgcgggctgcagcacagctgccaggacattggcgcacgttccatcgctaacttaaggtgggttctgatagttttaatccattttttgtaaaataatcgaattcatcgtttgttttcccgcagaaaaatgatctacaacggtgagctgcgcttcatgaagcgcacccactcggcccagctcgagggtaacgtgcacggtctgttctcgtacgagaagcgcctgttctgagatcaacccaacgcccaggagcaccttccgtgaggggtctccggtacggttcgatggaaggcgcagcgcagagcggcattttgtggtggcacaggcacttaaaaaaagaaaaagaaacgccctgcaacagcgagacactgaaaatttggggctaaaagtgatcacatttgtctaacatctaccgctgtaagcatactgtgtagagttcgtgacagttactaagtaaggcatgtttctagcaaacatacaaacatgggagttatggaacatttggacatacgcgacacagcttacaggtagttgcaggcgtacaacgcgagcgacgtttttctttgttagcaacggtaaaaagcaaaaatcacactcccaaaacacatttatttaagcttaagtttgcgtgaaacaaaaatatggcaacaaaatttaacaatcaatcacacagtctgccaccttaatttaagatttaaacaaccatttcaatctctttcttctctttggtcgctgtttttaacggtgacagagagagagaagtagatttcgcgtaccgtgcccgtcgccgcaaccgttttccactgcaaagcaaagcatgttctcttttctccacgttggagaaaccaaattagcatggcaaagagcaattttcggggtggtagtattacatgagatatgttactaattgcaacaaccacaacgttggcctaggtgtgagaaaattcaaaatgtgcattaatactacaaacacagccaaccattcgagtggggaatggcttcagttgtgtagcaaattgacttccttttgcctttcaattgtgaaagagacgtgaatagtccgcttcaattattggaggaaaacaattactgacagtgaaatatgttaaatttaaggtgtaccaattgcattcgatagaagaagagcaaaacaggtccaattggatgggcgagtcccggcgtcaagcctcatccaaatccccaagtccttcgcaaaggactcttgggttactccacacatgaccacgttgctcataccgccagcaagagcaagatggtgaagaagaaaagtttgtccatactggaacaattcctctaggcagggaagattgttaaacaaacctccgaacggtactattgtagaaagttattaaaaaacaacaacaaccaacaataacaaactccatgtagggggagctaccttattgagctttttatggcaattatgtgtctaatagtgttagttgtgggtacgatcgacactgatataatgaaaagtgaataaatgtatggaccgatgaaacatatggtccgatataaagtaaagcttccaatactgctgatggctactagtaatccgaagatgatacgaatgaaatatcgggccaggtatggacaaatcaactccataaacgaggatctaattcaaaactaatgattgtatttatttttatttcattttagagcacttctaccatatggtacatcagtgatttgttgaacttcagcgtttgtaataaatagagctacttttttaaacgaaaattgtaagtatcaagtttaatcttaaacatgaaaaatgtagaatcattctatgagtgtgaactaacattagtgtgtaagcgttagataatgttgaacgtgtctctcctcacaattcaagcacagctccaatacgttctaatcatgcgacgcagacgagcttaacaccgaagcaaaccgaaccacacaaaacccaatctcatttattttctgtctgtgcagcaaatactccaaatctccagtccatttgctcgttattacactcctctctgggacgttttctgtacgatggtggagagccaagccccgtgtacaaggatttattttttcgaagctttagtttacgctccgctcgttaacacacacacacacacaatagagatgtcgggc

SEQ ID NO: 81 - DNA, 24467 bp, Anopheles gambiae
ttgtttaaaaatgatatttttccataaaattaaacttgaccaaatccctacaatcatagtataatgatataaatctacccgattgcgttgtaaagccctgcaccggcattcaacacacacgcacctcagtccactgggatttgcttcttagcagttctgcacccttaaccgtgctgcttacaattttccccacagataacacgcacactgccacgccggcgttcgcgtgtcgctcgatctttaccgtcagctagcggcccctcggacgatgataaaatttcccttcaagccccacattccggccagttgtggtgtgcacgttgcaacgaacgggctgtcaggtttgccggtgaaaagcgtacactgtttctctccagacgtgtgaaacgaagcgaccagcatcgctcgcgcaacgcaccacttccggtaagcgcatctcagccgagctccgtcgtcgcatacgatcgtttttgcgtgctctaacgctcggtaaaaaccatcgtgcactgttcggtctagcgcttatctgacgcttagtcattcgtgcccccggttcgaggttcgatcgtcggtcgctgtggaacggttggttcagtttgcgtcgaacctggctcgtggtcggatcgtgcaagcagcgcaacaagctttgccgtctttctacactgcagtctttctgagtcttgtgaacatttccgtgcacgtgtgtgctaaccttcattcaagaggatcatacatctcagtgttttaccgtgcgttcgatttcgagtggaaagtgatcgtgccagttcttgaaaagtgcatttgcgctaccaattttaagaccgtttatcgcaaaaaaaacactccgtcaacatgagagaaatcgtgcacctgcaggccggtcagtgcggtaaccaaattggagccaaggtaagcaatccggaaagacaaatctaataaagcatttgtaaatgttttattaatattataccatcctctgacataaagagggtttcaagagtgataatatttgatccaccatgcttaagaagtgttacaagcatactatcatcaatagaagttgcttgcctatggaagattccaatcagttccgtggaacgtaccattctcctgtgtgcaccacttgcatcgaagtaaatgcttctggaacatggcgttctttttgtttctcttcatgtttcagagataagaccaaaaacttgagttttgcattggactattaaattccaattgcgctatctcgggcaatggtgatggtgttcggaaacagttgcctgtaagtgcctgccctgaagtaaccggaaaatttatttttttcatgctgcctacgaaacgctcccggcatatggctgatgtgattgcgggtgaacaagatcgtacgatctgcggattctctttgtttccaacgtccagactgcgaccacatccggcgccgacgtcggggctggacggagtaatcagcgtgtctgagtgtttcgcgatttttttcccggtgctttgcagcgggagcatcaacacactcactcataagccctcctgctactgctggttgggatggtctagttctttcacctaggcgcaacgcccgattggcgtacccattctaattaacggcatttgttcagcatgactgactggccgttgggctaggccgcaacgttcttcagtttcttttttggacgttcgaatgaaatggcatggaagccgttccgcgtgcagagatttgcgaatcagcgagccgagaatgatggtaaagccacaacgaacgagctctgcagtgtaacgaactcttgcattggggtcttccagctgatatcttgtggaggttggtgtttggcttacagttcgcattagtacgctacccgttctacgagcagaagatagctttatctgccgtcgtcgcgttggtcccctttgtttctttgccgttttctcaatggttcagcagtgtagcatatttatcttaagattatgcgagaactcgacaacaacctctcccaggaaatgctggaacaaagcatatgtccatatcgttacattccgcgacagagccagtatgcccgccagatgttgggactgtgtgagacttttgtctggtgtccgattacacggtttaaacacattttaagatacacaaacacaccgccgacacagcatctcctttgaacgtcagaacgtccgaagtgactcatctgcaattggaaaataatctggagcgttttattgtgcccttcttgacaattataattactgctctcctgagtaatacactcttgaacaataatcaacgatgagttgtcggggaattcgtttaaatcatacatgtactgcaacgtaacactttcgacaaacgaacttatcagctgcgatgcagaaatcacggaatgacgttaaacgcacatgagtaatgctttcggctaatcagaagcttaaattgttctttcacacgaacattgacgagtctcaatgtgcgctgataaactagacgaatatcagcaactgaaggtattaaaacaatgacaagcagtggacgtgcttggtgaacgaaaaaagttactagttatatctgagcagggcaccacctcacgcaagcgaaaatactcaccttaacaaatgagagagcattagtgcaaaaaaacccaaaagccaaatcaaatgataatatgacctcgtatgcgtacatacgtgccgagacaaacaaaatgacagaaatgcttgggaagggtttccaccaaatctcattcagcaagcttagctgttgccctttttttgtctgaggtttggaatttctagaaaatgtacaaaaaaaaacctcgaccctttccagccttgacccttccactgtttagagtgtcatttttgttgatgtctctatagtttttcatacccttattgcgtgttgattcaattttttttaaaccagccttgtgtgatgacacgtttttggtcgagtttttgttcgagtttcagaaagtaaaaacaaaaaaagggggacgaaattccctttcaccaaaactctagcagacctagcgtgatcgtgatctgattgtaactgagcagcagttgtgcatatggatcacctccgaacgtaaaggtaataaatttcgggaagctgtaaggtgactttgcttttccacgtgaaagtttttacgataatgaaacccttcacgggtgcccttgcataccattcgggaggggttatgctttcctttgatcaaccttcaccgctgacccgggtcacgaccccgaagtggagtggctttcactcgaacacggcaccaataataaaaccttcacggtaaaagttagatagaccaaagattatctatgaacgattccatttcagcaaccagcttgatcaagttacttgtgagtaaggtgagtcttttggactttaatgcacctccgcgttcgatttcggtggagacaaattgaaatggaattttaatgtaccttcgtaatgaaggtgccagagtcatacactgttaggatcccaatcattctctgtaaaaggaagctggggtgcctgcgagcgatggtaacgtttgttctgattacataaatactgagaccactgcgacgagtgtggctaaccgtttcataatgtacacctgctggtaacttatccataaacgtgtttgcgagttgcgaattgttggggtgcaaaaacaccttctctcagtatggtatctaatgcttacggagctgtggtcaaggttaggtaccagtttaaatcgttttctatcccaaggatgataaaataaggcttggaatacttcgttgaaatgtaaatacataccttcatagagagcaatgcaagacgaacgaagatcgtatgcctcagtgcttgcttgaatatagttttgtttcgacaaaaccgcacacaaaccaacaaagcgtttaacattatttatttgcagcctactctagcaaaggtaaggtggccttgtcactagaaaaggtgaggcttatcaaaaaagttgtcaagctgctatttccgtatatgagcataggaatgactccaacctgcgcatgatttatgtggagttttaatcagtgccccaatgataacaccatcacgagtgatcaattaatgatcgtttaaaatgagttagtgaatgtgtgcgtctaatcgattcataatcactgatcaatcttttgtcgattaattaaaagatatctctcacgaacccttcaacggtactacgaattcaatcgctgtcagaacctagagctagagacacaatgagagaggcagagcaaactccttcattccggttctatacacataaaatggtcaggttttttggaagggagagatttatggtaacacaaaagagcggcaacgttaagttttgccaagtgaatcgttttatggcgccttccatgccatacacggtccagtcggtttcattcgtcagcggttcatcgttgttttcacattttcttctactcttggcaccataaatgaaccttacaccggtaaatgaggaggcaagggggaggccggcaaagcgtctggcaagcatctggagaatcattaaaccatggcaccaggcttaccgcgatttgcaatgttgagcttccacggaagcttgaattattctcccttcctttcgttcgtttcgggaaaattaaatcaaactcatccgcacagccggttcagcgcacgatgattctcggttcttggccgtggcgaattgcagttatgagttattggcggtgtggctgaagttggatgcggtcggtgtatttcaccatggtccactgcatcgcagcaccgatcgcaaagatccattagtctattagaacaagctgattagctaagaatcggccctttgatcggggaagcattggccggtgaataagattttgcaatttatcgtccatacaagacaaacgaccaccgctagggtatgatactccttaacccaagaaccaatggacttggttcttaatcttatgcgatagaatcattggaaaaggcggaattatatggcaggctgcgaagctctgccagcttctttacgattttcttgatcgcactgatgcatagcgcacagttcgttgtactccagtaaggtgtccatattgatgggttagtgaaatggcaatcagatagtgtaatagaagtcttatcgctttcaaacatgaacatgaacaaccgtctacttgttgacggacattgaacgatgagtttaatgttaacgttgcttctttcaactggcgttgataaacatgaaggcagctgatcttgtacaatgtgtccaatgtatgataaactaccccgtgagctgtttcttatcggtctgagcggcaccaaacgagataggtgtagttatatggaacgtagaaagctattttatccgaaatcctacccttatctggaaacgaaacattatccgtttttgaaagtgtttctttgatcgacacttatttttgtagttttgtatgacattactactgcagtttcaaaatcaatgttgaatgttgtaatgttgaaatgtaatgttgaaattatatgctgaacactttataggtgatatccattttagttggatgttggatagttgacggacagttaataaaacatggattttgatgataaagctggttaaaaaaaaaacatgctcaataattagtaaacaatcgaataagtgagtttggtctattttattacttattttctattaaagctgctctattaatgctggttaaaaaacatgctcaataattagtagacaatcgaataagtgagtttggtctattttattacttattttcattttatttttaattgatttataaaaaaggattacgtatcgtggaacaagagaggtcagtttttttacagatgatattaaatattccgtttgtataagaaagatccgttcttttaaagcaacagcattacgtgcattctaacacctcttcaccaaaccacctataatgaacaaaactgaagaattggaagtagttcgcaccactatagaataattatcatgttcatcgcaaaagccaccgaaatgcgcacgatctagaatctagattcgtgctagtgctgcttctagaaccgaactcctggtggtcgcctgacttgcgtgacttgcttgtgtatttggtccaccgtaccggtttaggtttgttttcgccaagatcgcttgtccctttctagcagacaaaacgatcatccacgctctaaacaagtaattaacatcaataattaactctactctggcgcaactgccggcaagtgcgccttcgtaccagtgtggtccagctagctacaaataccgagatttgatttaatttttgttggtacaacgaactcagctgcactctgctgtccatggcggtatttttggaaagaacgcaccaacccggaaaacttaacgcaacgtgtgatgatgggtagcgatacctttctgctgagatgtggctcaacgttggcgtctgtcgtcctcgctgcgtgtggcgtctgtccgaggtaattagtgcaaccggtatggttctggtccgatgcattcactttctctcccacggaagcaagtcaatcaatcggttgtgacaacttctgcattcaaatgatgatgcaaacgaaacgaagctgtttaagtccctgcgcaaggtgacagaatattcaaacagaggtcgttgactggtaggttttctttgcacattgaaagcctcttttggcgtgtttctatgcaggtgatttgtcgagaatcgagctagctgaaagcaccgaaaaccaaacatgacacgcacagaacgaaacgtgatacgctggataacccgaagacgagcgaaaagcgttagatcctaattatacacaggaaaggttcagcctaatgtcacgaacgaactctttcggggcttctgagacgaaagtttgatgaccggttgtcagtttgcaatgttgtttctcgctactttttattttaaacacgcagatggtaagaatggattaacgccacgtaacataagaagatgaagctaaaacacgatcacgatggcaagcttatttagtacaaagaaaccaagacaccagattatcgtgaaggcgctttaagattcgatgctctttgtaatgcttgtcattgattatgcgtgatatgaatgaagaatcggtagacatgcaaacgagtaaaagtgttcattcgactgttgctggacgatacacggtgtgatgtgtggttacattgaatcaatcgaaaacagcttttcgtgtcaatgtcatggtacgaataccacgaatatcgaacaatacgaataacttttattgtgtattaaccaaccacaagtttagaacatcagtaacgccaaacaatagagttacgcattattatccccatacagcaattggatgtagtgcggctatacagacaattagttatgcagttgtcgtacaagagaagcattggttgtttgaataccatgacaaatggagtgactttcacgctaaacaatagtcttacttttggtggttagtaacggtcaatgctggatggagtgtattgaaaaaaaatctgtattttgtgggttttatggtaaaaccaaaaaaagcaagttcaaacccatgaatctgttctatgagtgtcaactgtaacacagttagtgcattattacgttcctggacgaacagtactcgttttgattgtgttagatagagtgactaaggcccaacgaaggatctcggaatgtgtgtggttttataaataaatcaagtaactacgaatgtggttcaaatgtggatcatgttagcatctacttgttcgttcccgagttctgtctaaaccaaactaaagaagtatttaaagtagccgttttgtgcactgtgcatttggctgttgggaacgtttaatagtgtgccaaaaacgggttcttcctgccaacatgcagtgtggtcctcatacttcgagtgtgaaacgagtctgttcgcattaaaggcttctaaatttgcacgaaacagtcccccattctcgttttaggccctaaatatagccaccagaggtggtggattcggcggtacagtactctactcgtatcttcaaaaatgccgtctattcctccaagaaattctcgttagcatgtgtttggcatagggctgctggcaaatgctcgaaatggcatttatgtgacattacttgagaagaacgtatgtcagcttttagatactttgaagactaaaaatatctccaccgctaccccggcacacgctggacaaagcggtatgcgtgtgagtgctgtcacgcgacgataaagttgccgcaatgattaaaatggagctaattgctcgaaagggaagtgccagccagccagccgtctcctcgaactgaactgactcaccacgcgcaataggaccgcaaggaagcgctctgttcttgaagagtctggtcggcggcatttcagacccacgttagacgaggttaattgaatttgatacaattaattaaactttcccctcgatggagcgcctttaaatttgctaggtagtcacgatgagacgggcaaggtacttttgttactctagcaactggacccttcgagatggctcttatcagtgtggtttgtttggctcgcgaaagcgctacatccaattggagtcaatgattatcgaggtcaaacacaaggttgatgtgagcgcgtcgaggctgatcgactcaaattcaggatcgtgcccaaatgttgcggtacagcgctagatgagattgtgctacgattcaatgaaaaagcgaaacattttcttacttgaaggtcgtcgtactcttgcacgtcttttgattgctttgggtagcaaaatttaaaaccagcttaaacaacttaaatcaaaatgcttaattctcgggcttatcaatgttggagtgaaaaactcagcacgattgtgattggttatgtgtcgtataacaaaaaaacacatatgacccaggacgtgtttaaatgccgtacgtgcttttgatttgtggaatcgattttttcataaattctggttgttctcataaagtgttgttttgtgacaagtctaaagacgggcgtttaaataattattgccatcatttgtacaattatgtaaaagttttattgattttttttcttttgtttttttaattacaggtaagctgaataatcctacagaatggaaaaaaggatggaaggaattagaaatgtgaaatgcacctgttatcagacaatgaaatttagacattaaaatagcatcattaggtgtaatgagtatatctatagtagcaggaaaaagttttacaaagttcagcataaatgtgagcgtaaaatatagtgctgtacattgtaactacgttaaatctgcaacgtactttgtcgttcctaataacgattcattgctttggcgcccaccctctaatttgttgctgtttttttattaacaatgccataaaataagagtgtcggtaattttctttacaattatttcctatctctatttcttcactgcactctactgcgtgaagatcgcgctaactaaccgagctgattacgactgccaaagagacggcaacataatccacttggcgttgcattaatcccgcttaacgcatactaatgccaacaattctcgccgtgcttgacgagattatatcgtactcgttactttccgagggacacttttccttaccaatgcctagaacaaactggtaacaagcaaaagtgtgcagcaaaatgtgactcttcaaatgaatcatcctacgtgagccaccatcagccgtcgaccgtgacaaacgagtccacgtagtctttttgcaatccccttccttttttctccctcagttagcaaacgctacggaaatctttgaagacccttgccggctgagcatgctgatgaaaatgcgaaaaatttatctaccagcattaatcagcacactggtagtggtagtggtggtggtggtggaagcaaccacgaagaactataacagtcggcatttccttttcaaatcaaaacgactctgtttgctgaagcatttaggaagcaaggggggcttgggcctgagttggtttaagcgctagctgctagatggttaagcatgactgattaagatttctgcaacaccgaaaccacaaccgatccatctggcgtctgaagcggatgagcggagctgagacaaatttttctttcatctttgcctttcatgggattctcgatcgtttgtacctgatccaggtaagctgcacctgtcataacgactcaacacaaacgtcactgacgattgatctttctcgtcggtggattgtttcgcggacagctcactttccacgttgttttttttcgaaggtttgtagtgccaatgcaaatttttatctaacggctcaatttttgaggtcactggacaactgacattagatggcggggtgaaggatgctgttgggtgtagaaaccctgccgttcgtgaaagcgaatcgctaatagccaatgatcaacgccggatgtgttgcacgtgtaaagaagaaaggttgcttccggaggccaggtttctcacgatttgtacaactttcaacgtagcgtacgttgagtaattactggttacagttttatattctcttataggagacaaagtagaagtgatattagtttgtgatatggttttataagaaaactatccaaatgttaagatcaaaaatacattgtttaatccatttttaaccatgtacaaataaactggcttgggttcgttttgaaactggcaaacgcaacatcgaaaaccaatcaatcggtattgcaatcgaaattgaagactcacgctatttgaaatagaaataaaaacaatacaatacaaaccaatccaccaaagagaaatcactacgaattgagctttcccgctgtgcaaaaagaagaaacaaaaaaatagaaattgattccgtctgccagaagcgagcagattgtcttctggccaaccattttcgcacaccggtaggctaagcggatctgcgaaacttcattttgcgatcatctccatcacggttttgggaccgaaatggaagtagtagttaattgtcgtttcgtgatttcgaggctcggtaccgcaccggacagtcggattgcttgcattcgttcgtagaggtaacgtacggtaaccacaggggaaattggaaaagcaggaaaaacggggccacttgttgtgacagatggaagctattcgaatgggggttgcaaattggaaagttagtttatggcatcgctgtgcttgttcctagtgattgatagatcgagtaatgaatcaactgtttctactctgcacgatcaaatggaagttggaagatggttggcgtgttgataattttagttttttcgttattcagactaatataaaaagtgtttcatgactattatattttaataaaatacgatctggaaactatagcttcaccgcaaacatagctgttcaagaccacaagataatgcgggagaatctttaggtcggggacagcttatagataagaacagaaaaacctcaatcaaagcattgcaaacatgcaacggaaccatactgcgatcatttttgtagtgactgttgcatgttgtttggaaatgcttagcataattgattgattcccatctcttaacaagaggtaccgttgtcctggggcactggctggtcattgttccattcaggttaacttagttgtcggtaatgttaccactgtgtgctggaaaacgcctcccagagaaagtctatactctggtaaaccacacagagtgggaaattaatgattgagttgcttttttcagagtcggaatcaaaaacaaagttaattcttacgttcccatttacacatctgatgaaactaacaattttgtgtgacttatgtaaacatgatatttatatcacagactaaacgtaactttctctctaaatcgtacatcgtctcacggattaacagaatacagttttattgaaaaatagctcacagcattcacagccattacgttaccagtttgcttctttcttctcaaaactcaggtctacgtgttcagaaaagctaaaagcaggtcagttagcggcaaaccaaattttgcacgattttgctgtcgtcaatctttcgcagtacgaccgagatttggagctcaacacgacctgcgaacagaacggaaaacaaatgccaaatagaaacgagctgctggcggaaaagtcgttgtccgtaaagctgccaaacgtttgttccttccgttcaatgattatttgccaaagaaaaagcctttgggtcgggctaaccgcataccgacattgccaattccaaatcctcgatttcggacaagctttcattcgcgacgcaagaaagcttcaaataaattatacccaacaaataaaaatggcgaactggctggaactgggatggattgttaccttttttttataccataataataacacagttggtgttacaaacaagcgttgaagatgtctcgttgctcgtgggagatttgattggggatgggatttttcgtcgccgcttccgattgccggcttacatccgcgatctcagccgatcgtcaccgctacggtagctaagcatctagtaagcttttccatcgagcgtatcaaacgtgtggaaataaaaccaacatgattaacgcaaacatgcgaacgtggaaccgattttcaccaccaccctcatcttcactcggacgatccggctcatgtgccggcgctgtgcgggctgcaggtgctggaaaatccattaattactgaactaattgcccgggcgggtgtggttgcggtgtaatcaccgcggcgaatttgggttacaccattactccgtgcagccataattacaacgaaagggtcccggggtcttcgtgggccaccggcacaatctaacggaagaaaatacagggtgcgattggaagatggccacagccgtcgtataccattcgttcgttcgacggtaatggaatgttgatcgattcaatcgattcggtggtagaactgaaatgggcaaaagtgtggaaagagtcgaaaattgacgaatacctgtgaaactgtacggggtttgtggtacgtctgtgcgacacatgcagtgtagcatgattgaggttaatctacaagtgagcaatatgatgccacagcgaaaacgatgatctccgataagatccgttatgtgatctttttacactgactctttttctggcgatgaaatgtaccccctttttgttgcattattattttaacgcataactgacagtgacacagcacctcgcaacgatccattcgaaaagatagcaaagcaaaatatagtccaataaagagaagagaaatgatataaaatgaccatatgaatgaaccgaaatcacattgtcgttgtgttgggttgcccaaaattgtatattaattaagtgaatggcacctttaacgattcacttttcttctgcaaagtttctaccggtatcaaatatccacactccggtcgatgaaaagctccgattacggtgctaattatgatattgcctctaaaaatgctacaacgatttgcattctcattccaatacggtttaaacccattgactgggcaatatttatgaggtgtaaaacgtacgcataaaatcatcattttaacgtcgttacgtgtcagcaattcagaatctgagttggggcgaattttaaaatgtttaattgaataaaagtcattatactttcattgtgattagtatggcgctattaaatcgtacaaccgttatacttgattgattgtggaaattactcagtcgaaaacaaaaagagtgtaattttttacatattattgtttttctgttgacttcagtggaaagtttgataatgactggaaagttaaatcaaatgttgctccaagcatttgcagtaaataagacaactggagatgtcacgaacaactagatgagaaaacagactactctaacgagacgaccatttgacaatcaattccaccacttgagccaactcgccggaaatagagaaaagaaatgaaagtcgaatgtaagacgaagcttatttcgctgcattaaaaatcgcttgagttttttgggaaaactgctccaatttagtttcaacgatttattccctttcctatgttaggtacgagctctcttgtcgtgtaagcgtccggttgtttcaggaatggaaaaataaatttatgagtgacaaataatgctgcgcgcttgaaactgtaacgatgtcaatagagcctacagtaaaagaatgatatgatctttattttcgaggaaatttatacagaatttgtgactcaaagtcctattctagattcatttacattttaaaaaatagacaaatacccagctgatgcttgagcggaccgcttcttctttagacgttaaactgatttaaatgacactcattacgctaattgcaaccgttgtcgtgttgttgctgagagagaaagagagcaatcatacgacacgtcccaagggttgaattacgagccaaaaaacatgatcgttttagtccatgcacagtcaaactaaagcggttttttgctgacatggtgttagcttcctgctggcttccttcacggcgggatccgtattggtatgtagtaaagaaagggggttattaaggcacctgcttttttttgtttcacttatgcttcctcgtctgcagacttacgagagcagaaaagaagcacaaatacacaagcttcgcaaagtatcgtactgcgttcgtttgttcggagaggtgagtgctgaacatcgtttatgtaggtttatgaaaatgttctgttgtcatcttttggaacacggccaacggttcatcatctaagttgtattgccactatttgtgattagccatttttggtgcaatttggtcgattgccggctccactttttgcaacgctgtgtgtttttttattcgtgtgtaaatcgtttttgggccaccgtgttatggccggatgatggtaattgtggtttaacgatgtccattttgccgaccagctgtgtttttcttcgacgtgtgtgcttttatttagagctgttttacgatatttaatggacgatcatttggaacgcacgttgtgatggcttcatcaaaggaagatgggctaatgtgggtggtgataagagtgttaattcactcactagtaatgcgaagaagaaaaacatagatgcgatgttaatgtgatcgttacctttgacagatcgagatgattgttcagtttgtgtaagatgcattgcaacttatttgatctttcatatttttcaactgacgcaaataaagcttaacacttcatgcaattgtttctacaatttgatgactaatctcatcccatagaataaagcagctgtagcgggaacatttgtattaatcataccgacacgacacatattaacgatcgtgctttgactaattgtgtgcgtctgcgcacgttgaccgcaaaaagagctgtatcgaccaagccggggagggggtagtagctaccactcataacaataataattgtttgcaagcgattcctctcgcaactgttgctttcgtcaatcgagctcgtttagctcggctgcctggcgacggcattaaattcttgcgcgaaatcggaattcaagcgattgccagtttcactccattcatgatgtctttatgatggcctggatgtggaacgggcgagaaggaaatgtgtgagaacgacgccagacaataatagacgacaacggagacctccaccgaatccagacgtatcatatatccggcacatagagagcagcgccacagcttcatggtttcgatgaaagaattcgttcgagaacagaacacgaactgaagcaccgtccgaccgtgacatggtaccagcgaaagtgccaatgttcctgaaaatgctcgaaagaatgacggcgcaagggaagcgagaaccttcattaccattatgtctgagaacgcttttgctgtcataaatacgtatacaaatttgacgtctcgtattcctccgtgttccgtgttatttgtactgaaagatataagaacagaccgttttcgaacgatatggcactgatgctggattgaagtatatgtgtatagaaggacaaaaaactatacaaacatgattgtaacatactgtcagcgcaacattgttgcagttatatggattcagcccgatgtagtgtgaacatgaccaatgcacgttgaacccggcagagagtttacatacatttgatcggttacgatcgtagctcctgtttaggtcgtttgcatgttccgaacatgtggcttccgtttcatttggttgagaatagcagattgcttttgcatgtttaatgtctgtttctgtaacgtaaagagagctgttgcggaaaggatggtgtaagattgagtaaatttactcttttggaaaaatttacacttcatgcgacgaacgaggaaattttgtacgtttgaagaaatattcttgatgtgatgtaaactgctgtttatgatatccgtcatgataaatttccattactgcgataggtgagattcttgctagaaacatatcgaatagggcgttattttacaaagtagatcgctcatttacatggcataaatcatatttggcgaaccggtaaattttacctacatagtcataaacgcgtctcataattcaattcacagaattttcgcccattacgatcggccagaagagaatagtccgagccataaatgcgctgactaaacatcgttagtcttgcaccggcatttaacgagccagcgagctcgctttgatatttccgcgttgcggtgcgtctgcatcggtaataactttctcgcttatcgcatcgatcatttggggaagggacggagggcatcacttgcctggcgacgtttggatcttcgcgttggtttcgaaaaaccgcatccgagcgcacgcccgtagtcacaggtcataaattatgctgtggtctaaaaatactaataagcagcagctacgtcgactgcatacaagatgcagtgaatggcgttcttcatcatgttcggtaaggcaaacatagaaccgtcaccagaacaccaccgtccgtacaggcttggtatgcaatttgggcaaagcattttcggtgcgggagaactttttggagctgaagaattacgcactcaactttcggaagggtacaggcatggcgcgtgtgactttgagttgacagccacgaacgcagacgatgtgctgaaaataggagtaaccaaacctgaacgccctgtcatgggcgatgctgtgaagatgtgtgaaagataaatcggtgctgctcccagcagcatcccgttcggcggtcaaaccgtgggcgatgacccgtactgtggtgccaccgatacgatgctgaacgtatccgctgtgcaggaggaggagaaagagacatcgaaatgctcgttctacatggtgtgctagcgtatcaaacaagccaacagcaatcttattgcgggaatagttatctacacacagacatacacacacacgctcacaaaagcaacacaaaattgcacgaaagtctatcgtgagacatgccgtggatctttgattagaatctcatgacaatcccgaaagcttcccatgctcatggtgggctgaacgccaacccaaacaacaacgacaatgacgaaaagcaaacgaccctgaaattgggctaccaaatctcactgacaactcagcggaacgcgtgagttttctgtgccggaagtatctgaatggttgttgccctatgctgacaccgggcgttgggggatcgttttgagaacgaacgagccttaattgctaggtacaataaacacatataattcgctaccatcatgacatcacgactgcgtagtagaaatcgctaaaactagaaaaggggatctgagagagagaaaaaattgcctcatttttaccatgcaacttgtaaggtatagtgaacatattatcaactagcgtttcaacttgtcgatgaaactttgaatgcatcaaataatagggacactaaattgagaacgtttcgctattggaaagaatgtgaccgtgcgtcatgtaaaacaaatctaacgaaggaattctaattacccacggggaacgaaacgtgtatcactgattgtttgtaaatgtgtacgcaaccattcactccccatgaatgatcgaggaacatgtctttcccccattgttcctatgtaaatcgatgagttgacatagttacgaacacgcttaaacagggaatggcacaacagctcaatgaaagctgctgcatgaccttcttcgtcatcggaagtgacagttatgtagcgattgaatgaatgagtaacagtctggaagtacttctagtggccaatttgtgcggcagtaagtagtgcaccaatccattcaatagaaaatagtgacgcaaaatattgtctacctttgcgcggtacaaaacaattcccgggatagagtgacacacaacacaggcgaacttcattctgactgactgggctctttctccgccgaaacgggtggaacgtttttgtggcggttggggctaagcgttttcggcaagcggaacggtattttggggattctgttaagttgggctgcgtgaaacaatcatacatggaacagtaaattattttgtcacgctttgttaggctgcaggtttgatgattcgtacatctttggtctgctgggcgggtaagaaagagacgagaagtggatgagtttttgaagtaaattttctaccacatttcgtttctcgtggaataatacagggttggatgattgttttatgactaaaaagttccataagcttcagtgttgattgttggtgatatggatcagtgatttgaacgctgtcattacggagcaatgtctccgatgtgctttcggtaattctagttttattgcatggcattttgtctaggccacaagttcttgaacagttcatcatatttaggagagcataatatcgtaaaaattttagtaccctttggtaccaaaaagctatgtaaccaatattccttcaattgataataacaaaagaaaaatatcatcataactggagctcactgatttatgtttaaaaaatacataattttgggcactgtatctaagaaaaattgtgatcagggtctgatcaagcacaaacttttgacaggaagcgtctaatgaatgtagcgtgagaatgtagcattcgtatttaattagatcctcccgtatttgaaagcgtcggcgcagagcctgcacaaacccattcttcgttcattcgtataaccataacaaccaaccacaggagaagtaatcttctgacacctaagaagtgtctcgagtgtcccatgttcccatgttagtagcggaagggttgaactcgtttatattgttgtttctgtgtgtggatttcaagctaaaaagtaaccatctttggaaaatttattttgggatgttgtcttccaaatccattttagagtacgtgctcgtttccgggaaagcctagtttaagaccggatttcggtagcagagcgttagatttatggtgcgctttcgcgagcaatatgctgttgctgctgctgtaacgtttccgtattcaccgtcagtttcaacctgaattgaaatgggattttcggcgcatctttcacatctcacacctcaagggacagtgcaatcgtccctgggactgtgacttaatcgcaatcagactgtgaacagcgaaattgagcgctgggacgacctatgccatgggccggtgatcggtgagagtaaactgtcaaactgtacgccagtctttcgacttacattgatgtctcccagtaagccaggaaaagcttcaccacgtgaaggtggtagaataggatttcctttcgcgttgttgtgtctcccgccacgctaactaattgacgatcgctgtcaacgttgggcgatgacaaagagcatgctgcagtcactcggtgcagtctctccctagccctgatttatttataactttcaaaacggtagacccaagtgcgagatcccgcacacagtccatcgggatccattttatttttaaagccctccccacttaatggttttctagtggggcattgcgtgcgctgtatacctaccagcgcgcgccaacggaagccacaaatgagccacagaagtaccgaaagcaatcgttaaatctaatttttatttttatgaaaatgttaacaagcgccctggagtcgtcgggtggtacgtacaccgcgtcccatccccggggtgtgagatggaacaccgattatggcttacgcggattagatggattgctaccgcgtccaacacgatggcctcaagtgtttgtttgaatgggttggtgatcgtaaatatttcccatatgggaaattgcatccgcgacctacagatttccattttggatggagatgggaaagagaccaaaactgtgaattgtggttcccctttttccagcacgatgaatgatggtcaatatttcttccctgtcaccgcggttcgattgaaatgaattcgagcatagcaagagggttggagtgtggagagtgcatgagaaattaaaaccatcaccctattcatttggatccagtttggctaatgcagtaggtttacgctttaacgattgacgagcacagtgttccttaaaatccaatatccgatgggaaggacggcagaaatgacataattctgacgtaattttctcagaaagtaactcccatatgccggctggtactcgttgcagcacatttggtttgatttgatacgctttaatgagttaaactagagtcaattttagtattcataaatgttgagctataattaagaagttgtgttactgatgaagtctttcaagcatatgcttgtagttaaaatcatgatcgtaaaagaaatataattatttttaatgtgccttaacttcttcgatctgtaatggtgctgtgacctaaaatttcttatgtaaatatggttcgttgcagaataataacaaaaacaaattcattttttcatttccagttttgggaaatcatctccgaggagcatggcattgatgcctccggtgtctacaatggcgaatccgatcttcagctcgagcgtgttagcgtgtactacaacgaagcatcgggtaagttaaacgggttcacagtaacacaggcagttttcaacaatcagccagcagcctcctcaggtgctcaacacttatttctatctgatacacggtaccatgaaaattacctgttgatgtgcagaattctcgtgttgattatttcccctcgttcagtatgattttattctccgttattcttgatattgatctactcagacgccgctagtggacgccgctaccaccatttggttctgtctagtgcagaatatgtctgttgaaatggatgtaaagcaaaattcttgcaaccatgaaccgtaaaccgttcaacagctagcgaacgtgaactatcagcgcttcactagtattaatcgtttccggtccagtccggattgcagttcgaaacaataatactaattagaatgtcggcagcaaggactcaacagaatggcaatcaaaacgtgcccggaattgcatcggttagcggttccgttttgtgcatcggaagtggtgttgggtgtgagtcacctgtttgtcgatggctgttatgcgttcattcaatgatggcataccttcgctactcatagtcagcatatcttataattcgtcacgtacttttcgtttgcattggctttttacagcagtgtcgcgggcatccggtggcaagtatgtgccgcgtgccattctgcttgatctggagccgggtaccatggaggcagtccgttccggatcgtacggtaagctgttccgtccggataacttcgtcttcgggcaatctggtgccggcaacaactgggccaaaggacactacaccgagggtgctgagctggtcgatgccgtgttggatgtggtgcgcaaggagtgcgagaactgcgactgtctgcaggtgagtagtacataatagactagcacaaacattgttttactgatccgcatgccctttcttgtagggattccaactgacgcactcactgggaggtggtaccggttcgggtatgggcacgctgctgatctcgaaaatccgcgaagagtatccggatcgtatcatgaacacctactcggttgtaccgtcgccgaaagtgtcggacacggtggttgagccgtacaatgctaccctctcgatccatcagctggtggagaacacggacgagacgtactgtatcgataacgaggccctgtacgatatctgtttccgcacgctgaaggtgcccaatccgagctacggcgatttgaaccatctcgtttcgctgacgatgtccggtgtgaccacctgtctgcgattcccgggacagctgaatgccgatctgcgcaagctggccgtcaacatggtgccgttcccgcgtcttcatttcttcatgcccggtttcgctccactgacgtcccgtggctcccagcagtaccgtgcgctcaccgtgccggagctgacccaacagatgttcgatgccaagaacatgatggcggcttgcgatccacgccatggccgctacctaacagtcgctgccgtgttccgtggacgtatgtccatgaaggaggtcgacgagcagatgctggcggttcagaacaagaacagcagctacttcgtcgagtggatcccgaacaacgtcaagactgccgtctgtgatattccgccgaagggccttaaaatgtcgtccacgttcattggtaacaccactgccatccaggagctgttcaagcgcatctcggagcagttctccgctatgttccgtcgcaaggcgttcttgcactggtacacgggcgagggtatggacgagatggagttcaccgaggcggagagcaacatgaacgatctggtgtcggagtaccagcagtaccaggaggcgaccgctgacgacgagttcgaacaggaagactgccaggatgagatggagggcgagtgcgtttgaggcggacgggcgggccgttcgaagagagcagtccgtggccagcactaacttcctggctttggcatttttattatttattaaaatttctcgtagctaggcaaacgattttatattccgaataccggagactgcgtgtgtgtaaagaaacgttaaagtaacatttactaaacaaaaacaaagaagaaaagaaaaacataagaaaaaaagtatcgtaataatatactcgattcaccgtttgatcatttctacaggatacttgaattgatacgacttctaaacgatcgcaaatgctactcaatatcatcttcgatctcaagacagaagcttgtttctgtattgagatattttgtaacttctagcgcaaacagtaaagactccctggttttttctaagggtggaaagttcgtctcccgttatgtaggtactcaagcgaagtttcttgaaagcggagaaactgctagcggagagtccccaacgactagaagcaaaggattgcagacgaagataatggtgagggcgagccctttccaaccaactatgagaataccatgtgtgttattttactcttaacagaatagtttttgatcagatgacggtgttttgtttttggtaacagatgaactgagtgacacggggtgttgttttgaagaacctacaaatacctatggataggaattagtagtcttgtcagcttacaatcggatggtagcatctagaacaatagagaacatctactcaaagcccatttcgtgcagatacgtgtgctgattgtctgtttgtgttgaaattcttgaccggccggtaacggcatcgaacgtgaaggtggatgccaaagacgcgaagagttgtgtgtaatgagcagcagcaattgtaaccatactggcaaatcattgagtgatgacagtcaagcgaaatatatcctcattatttataccatgtacgtgtatgccgaattatcgtgtgtttttgtcaaaaatagtaaataaaaacaactttttgtgggaagttacaaatcgtactggaatatcacagatattaacaaataaataaaacataaatttaataagattgtacagaaaagtgaaatgaagattgcacgcaaacaaatgaagcgattatactgaactttacaggctctcgagtttaagatgcaatattttattttttaatatatatgaaaaaaataaaacgcattgtgtaaagggtgctgagatgtttcgcagttttttccaaggatttcggattcgtttcggtatatcattgtgtattgtttaagattttataatgtattacgagtgttccatgtcttaaaaatgaagcagctatggggcatgtaatgactgttagaaattgggcaagatgctgttgttgctagtttcataaggaatattgaaacatcctttaatcatgagcgttctactattctttagtttattgaacaatagtgctccttactggaaaaccgctaacttgagctcaatgttgctcaattttgctcatcaagtgggctccagtatagcgacacctagtggccaaaaagtcgtatttccagc

SEQ ID NO: 82 - DNA, 4418 bp, Anopheles gambiae
tcaatgcaactataaaccgtgaaaaaactattcgatgtaccttttatccttttatgtgcgtgtttttttatattgtattaaaatatttaaaggcgcgcattattacatctatttaaagcaaacatgtttggagcttttagttcgtgagaagctcaagctcttccgctcactatagtgagcttcgttcaagcgtttgggcctcaaacgtcttattcaccgtgaggtttatgtggcggctatttgggttctgtcaatttactgcttggatgtgacagcgtcaagcagatcgggagtgtgtgtgaaattcttgagacagaagaaaaaacagtgcaaaactcacaagcaacatttgctggtaatggatgttagaatgcaggtagaatgtttgccagaaaaagaataagcaataatgtacggtgatcttgtaaaataaatatcaatgctacaaaaaaagtgatcagtattattgataagtgattcataacgcacacttttctaagctcgtgagttcgaaatagcaacaacaaagcagtacgaaaaaagttctttaccttatagttttggtaaacaataaaaggccaatcggggctgcgtttcacaatgtcgaatcagatgcattcccaaaatccggacgcagcgctgattgctcgtatgcaccaaatgcgtttggaagctgacggaagtggcagtggtggtgctggtgctggtgctggtggtggaaaaatgatcggttccctatcacgagccaaccttcctggtagtggcggtgggcaggattctaattccgacagcagtgtctacggtatggtgacttcgactgcatcggctatgggagctgcgccgggtagtaatggtgcgactgtggccgtatcgatggccacaatggtgaacatgaatgactaccgtatgtacgatcggtatcagaatcagatgcttgctgcggccgctggtgggagcaagcttcccgtgcagcagaacaacagtgcgcatgctacggtctcgagcacatctgcgatggcaggtggcggagccaacagtgtcagtaccagtggtggcagttatcagtacagggtcaataacagccccacccattcgatgagcaactcatcccatcactctggcagcggaggtggtggcggtggaaccattcctaggacaagcagctcctcagtaggatcgatgcaaccgcaacattattacgattcgcgttatcaaacggtatacgagaacatagactgctatccaacagctacgcagcagcagcaacagttacaacaacagtcatttgatgcacacttgtacgaacatcgaaagttcgaatcgcacaacacaaaggctcaaccacaggttccggtgggtacggcaggccaatcgtatatattgtcgaacggcgttgtgatggccggacgtgaacatcccggaatgatgaatatggctggccgatatgcacacactccgcagcccccggaagtagcgagtgccgaacagccgccaatctatgagaacttgcagtctccaccttcagcgggacagcaggcacagccgcaggcaaccaaaggatccatgcaggtatattatcaccagcgtcccgatggcaccactccaagccctaatgcaatatcacaccagcagcagcagcagcagcagcaaataccgcatcaacagtatcagcattcctcagaccagctgtcccagcccatctatgaaacgacaaatgtgaattcgaatagctacagaacaagtgctaatgctgctgcaactgccggacctatgcataatgcagcagccgctatgtatcatcatcatccacagcaacagcaataccagcactcgccgacgaacagtagcatatctgttaaaattgctcaacaaccgcaaccggtccaattgccgaacgtaaaatatcacgcaactggagttccggcatctgcagcactgccctacgactatcagaaatcacccaaacttggtgcaccgtcattggtatgtagcatgaaattgcccaacgacgccggactggcagtgataattgtgaatatgttttttttttttttctacagcccccgaagtctacggaagccctcaagacacaacagaaaaacaacaagtcgccgtcgcgcagcagctccatctctggttcaagctcgctcaacaaaagttttgtcgaggatatcaacggatcggattacgtctgcatgactagcggctccaaatacaacaactctgggaacagcactttacagtcgatcaaaacaagccccctaacatcaccgccaggtacaacaactccagctggcgttgtcgcaggttccaccactgctgctatgccggtgcaggtgggccaagagcggcagtatgcaacgcttcaagaaatggaaatagcaaagaatcaattatcgaataaccaagggaaagggaccgtgtcagccccttcgaacaatgctcttggaagtaaattgacggcaaatggaagttcatcgatggccgggggaatgggcatgggattaagaggtgccgtttctccgacaccttcgcaattgagtacaggatcgggctcaggaaagcgtaagatgtctttttttactttccttcagcatcagtgttcgtacatcactgttcttaatattgcgttgtataattattctttccgcagcaaaaggattgacaaaaaatctactcccatacaacgtcacaccaccaaggcccacaggaccgacggaggctgagcgaaagattgaggagttgactcgtcagctagaagaagagatggaaaagaatgaggagcagggtgaatatttcggcatttgtcatacatgcaaagagaaagtaaccggtgccggggcagcttgccaagcaatgggaaacctctaccacaccaactgctttatctgttgctcctgcggacgcgccctgcgtggtaaagcgttctacaacgtgcatgggcgtgtttactgtgaggaagactacatggtaagcattcattcagaacgtatggaagtttctgtttacaattacaattcttacacgcattaattctcatttgcagtactctggattccagcaaacggctgagaaatgtgcaatatgtggacatttgatcatggagatggtaagtaatgaaagcacgatgcccattcattgtgatgtagcttgagcgatatgagtgcatcattgatcgtgttatgtatgattgcagatacttcaagcgatgggaaaatcctatcacccaggatgcttccggtgttgcgtgtgtaatgaatgtctggatggcgtacccttcacggtagacgtcgacaataagatttattgtgtcaatgattatcatagcatgtttgcgccaaaatgtgcgagttgcggtaaaggtgagtgataaaaaataatctccatccatgtattatttggtggcaggatccttcgagtcgattcttcacatcaacatttgttttaatgtttatcactttaggtatcaccccgatggagggtacggaggacaccgtacgcgtcgtggcgatggataaagattttcatgtcgattgttacatctgtgaagagtgcggtatgcagttgacggatgagtcggataaacggtgctacccctacgaaggtagacttatgtgtcgttcttgccatatacagaagatatccattcaagacagacgcgggcgtattcttgagcccgtttctgcgacttatcaatatatgggttagtgaggaaaagatgcatagtatatcttcttcgcgtatatggatttatatcaatcatagattcagttggttctgctggttcaggaaattgtaatttatattcctgttagtgtctcatctatacattctcatccggtcacctcattggcgctttgaacgttataaaaaatgtgctttaaaggcgcacattaaaacattaaacgtaactcatcgcttttagtgtttaacaggtattttactgttcgtgttcaatagtacgacatttcacataaaagcttcaccctatctatattacgaggatattatgagataaatgtggagacgacggtgttgcatcaagcgtgtttcggaggtagataattaccgtaacattccgtttaaatgtgtatgggcttatttaaaaaaagaaaaaaaacagaaaaaaatttaacagtgatcacaactacggtgtaaagccatggaatgactagaatgggaattactgcaatagctgcatgtattgcatttaccttggcctcaactatgccaatgcgcaagatttagattaataaaggcgaagcatatttgcttatttcgtaaactaccagtaattatgtttgtgtacaactagcaatcttattcgatcccatcctcgtcgtcaaaatgataagggaaggtatgtaaaaaacggatttcttatatggcacaacaaccgtggccggttaaggctttgc

SEQ ID NO: 83 - DNA, 24849 bp, Anopheles gambiae
aaatccaagtgccaccagaaagcggccatgtggtgctaaagcaaaaaaaaaagagagaaaaagtgctatagctaaaacgtgttcatctttttttcctacttggcttgcctgttaatgtgtgcagtatggagaagcaccagcaacagcagcaacagcagcagtagagagctgcaaagtgagtgtgcgtaagcgagtgaagtgagcgttgtttaagtggaagggagaagggagagtatcgagggtgacccacagtgtgcaatcgtgcacgcagggcaacggcaatcgatcctccagtccctggcaacggtagatcagagctcgtgcgaaggaggcaagaagggctggcaaacgggtacaagtgaggcggaaaacggaaaggcgaaccatagctcgcatttttctgcatttgcttgtattttcatttttactttccgtcgcctctctctctctctctccttctgtccatttgtatcttgctgccgtgggcccggtgttctgtgtttgtgaagttttgaccgcgtattggaatttaattccctttccccacatttccgtcaaagcgcgcgctcacgccgtggcttaacgttaaagacacatacaatgaattggatttacatcttagcctgcatttatgtatcatcacaatttctgctgctcaaggtaagttgtgaggtgttagttaataaacatttggcccataacctccaatatactatcacgactgtctatagcgtttacattgcttttcgccttctatgattctgcctgggttcgttgatcgaagcggaactattggagagtgaagtaaagtaaaaatcaaatttaaataacaaggattgaatgattggctgattgcatttcaggaaaggtaaagaaaataatggcaaaataaaggaaaagggcaaaaaagcttcatttttttcttcctctcatttggaaaacatattccagagctaaaaaaaagctctatcccatcgctgcgaaggaaatgcacgattcaattcacgctatgtgcatccatcaacagcgttggatgaacggcgcactctaaaattcgcccaaaacgatctacctttaattttcacatagtgaggaaagcgtctttgccatttctcttttgatatgtctcttcttttttgcgtttggttgtattattcgccttctcgaatgcttccatccaatgcgaatggtgcaatttttttcgtcttatttcgttagtcctccaactccaaccctttgcatcatcattcacaaatgtatttatacgggttttttatgtttccttttctttgcgtttttttcctttcccccggtttctttctacccattgctcgcacgaaaggtgtactttagtatgtcagcattcacctcgcgagagagttaaaacgatgccacctggctatgggtcggatggtataagtaacaaatgctgtctacccgccaatgtgtgcgtgtcatggcgaagcaagcgagccggcttacagctgtgtgggtacggcgacggataccgtatatgcattaacacacatacactaacagacacgccgcttgccagcaggatttctgcgttaaatatctggcatggtggatggtaaacgtctctgctggcgttgtttccaccagttaggagaaacgcgattttcttaaaataggaaaaatcatacaatgcacacaatattaaacgttttatataagcttaattttaccaaacgacctagtggcaagaatgtggtggttaaaatgttatttttttgtggaatgaattttaacattttccaaaaaggatagtttaatgatgaatttaaaaaaaaaggggaaatagattattagttatctttcgtcctcacccacggagtttgattgagctaataactttttatcaaatagacaaaggtatttgaaacggggtttagaaaaaataaccaaaagaaactatttctgcactgttttgcccatggcttttatgtttacatgggcgaaaacatatgcttagttttaattaacatgctgcatatgggcagcaaagcaagatgttctcggataggggggaatgtttgcaacaatggttgtatatgttcaacgttaatgttgttaggttgatcatgtataattcttaaagttctccgggaacaaccatttttggcaaacttagtagaaattcaattttcttctttcaacaattaaaaaaaatagttgcggttgttaaataatgtattgaccggaacattaattttaaattggttttattggttacaaagcatataacaacttttttgctgttgtataatttatttgtattgtaaaatattgtataaactatttaacagactttttttaaaaactcaagcaagagtacattatcggaaaggcacattttaaaattatttgtaaggatgaaggcttgtaaaccttcttttgcaaataattctcttcaaaaaatctatcgagcttcattctgtctacctgctcaaagaaaggttcgtccttatccggatttttggatagagcagggtaagattatttaattttttgtttctgctctgttcgttcgcacactgttcatggtgagcaaaaggtttttttttattctaaattttcagaaaactgaaaaaaaacgtgatcgaagtagtagttcttaaacatacggttagaagaagaattatatgataatgaatattttttgcagatgttaatatgcacagatgctgaattccttcacatgacatgcaacatttgtttatggttatataatattatgtatattgtatcaatttgtaatattgataattttattattatgttcgggtttaaggcatttggaaacgcagctctacaaaacaatttcaacaagaaagaagataattgtcaacgattgtgtcactaatggaaagcaattttggactacagaagacgtgatttacctgagtggatccactttaaacaacgattgttaatattgttggttgatgggaggttaatgtcactagaaacggtcatgtacaactttgggacataaatactttagaacgaaatgttccgaaaatttcttactaatttcgttgtattttcctgcctgtgatggaagactgcgctgggaatgtgatacatggagcatggtagaaagaattcagaaaagctgtcgagatgttctcgatcttgcaatcacagagaaggggctattacttagaaaattcgtttggttatagtgtcaaatcatcgaacgcttcggccgcgtaatcgtgaattgtttgcttggaaacttctttttattgttgctgctcaacagcagcttctttacaagctttaaaaaaaatctctcttgcttcctttttttgcattgagcacaactcggtgatctttcaatggatgggaaaatgttgagtagcaaaagcggcaaaagaattgggtattttattttttcttgattctgttttcgtttctttctcatagtaagatcttttggaaggttctctttcttgttattgttgtttggcgcgtcagtttttcgtcgctgttactgatgttactgcagcagtgcaatgcacctggagtgtatcatcgtaccgattctgcatgcatctacgtgtaaaagtgtgggtcattaggcatatatcatgcacaataatgaaaatagggactatcgtaaatatgcatgtgaaccgtaattaaagcatatgcatagtcaaatatatggtgtaaaacaaacattgagttgacgatggtaggtatcactatactttctggttttttttttcgaacggcatgacggtgcactcattggaagatggcaatgatgtatttgacagtcaaaagaaagatttacgttttgtaacattcgctcctacctcgatacaacctatgtgtgtgtgtgttagtttgcatggattgaggtgacttgagaggagaagtaatctgtcgctgatcagaatcgttggaactcgcgagcaaaaaaaaatatgtgaaccaaggaattgatgctaaacggtgaaaagaattggaagcaaaagaaaaacaaaagcaaacgaaaattaaaagagaatcataaggaccgatctttagcgaccgcgtggtgcacaaatacaggtttggatgaacggacggaagaacaaatgcttcttctcgcaggagaaggcaaaagaccaagactacagcagtgtgatgcacacgtgatcgcacgcgatcttgcccagagaaagaagcacaggctgtgcggggcgggcggccaggcaggctggcgattgggtcgtggtgcggctggcaaaaatcggtagaatgagtgcgcgaagtggaatggagagggccggataacgcgcaagacgctagaagttcctgcgtggtggtgggtaaagcagcagcgcgcgtgttttcgtccgcacaggtagaggcaacagacgaaacagcagcagcagcagcagcatgcgccaggtgaaggagagccagcgagatcgagttgctttgtgtgttggtgtgagcggtacgcgtgagtgaaggaagtgtagctataaggaccgatgtatgtggaagggcaacagaactagcagcagcggcggcagcgcgcggtggtcagatcgtgtagctgtagctgtgtgcacaggagagaggtggcggaggagagaggcgcatgaaatggatgaattgtttcccacggtttgaacgaacggatgagcgagcgaatgaacgaataaaccggcaaaagctgtcgagaatagcaataacagcagcagcagcagcagcagcaccaagcgagggcaataataaaaatagcatcagctctccaggtcgcctgcaacgaaggagcggataaaacgcaacaaggcaaaagaagacgaacgaatgagcgatcgggtaaaacgcaaacgaatgttgaatttttgttggacccagatgaatggaacgaagtaggaggaggaggaggaggagggtaggaggacgaggaggacgaggaggagatggggcatcggtgggggaggaagcctggttgctggcgatgggtggcaggtggcgtgcgaatgagcgaaacaagaagcttatgacgacattaaaacaaatgctatgtaatatcaaagctataaatgcttttatatacacccatatacgcgcacgctcgatgtgccccaagtaatgagagaaagagagagcgttgctagtgttggtgcctaaggaatttctaatatctattgccatctactcatttggttgggcgtattacccttctttttgctgcaattttcctaacagaacaaaaatacattgttgcatgtggaagaagcaatacagagactcgctagacaaaacgatggtgaaagattggacaaaaaagccagtaaaatcggtcggtagagagttgcatgtgtgaggtaaaaaggaagaagatagtatgcgccgggtgtgtgtgttgctgcaatgcactaccaagctggcaaaataggtttgcagtttcttcgggctgttgcgaacgatgcaaaggattatgatgagcatgtaaattcaactcgagagctttcgtcgagttcgaacacaaacacacacaaacataaatattcgctagacgacccccaagtgggaccggttcttcccttcactggcggcaccagattgtgaattccatagcccctcgttcgcttaggaatgaatcatcatttcaaacgtatccgtttacgtactttatggctgcatcacgatgacgattcttattgaaacagtgctattaattgaatgctactacttattgtagttagttctaatctctgaggtcatataataaagcatcaagctagcaacttgatgatagtgtcaaagtgtcaaaaacgtgtattgtaagcagcctttgacagtttattttgcagggttccagtgtgaattttcctaaaagttagttttatttattgactgcttctcgaaattttggatttaaaacaacttaaccatcgttcaatacgcgtttttaatattcaatgttcgcagaaaaagaaaaacaactggtttgatatgttttccggtagcaaatacggaatgtggtaacaaaaaaaaactaaaaaaaacgttaaatttcaacaaaacaccttttgaaccctgaagaattaatagacagaggtaaacaagcaccgggtagcgtgtagaattcgcagagaataggtagttattcaagtacagattaatagaacgaaattgatcaagcattgatcgtcacatcaaaaggaagaaaaaaaaacgtataaccagcgcgcgtcctaagatctcaggctttccttcattgagtggttgttaatggtaggagccatgtacaacattttggttgattgtgttgctgcttcgggaggatgctctgaaaggcgagagaagaaggtgtgtcttgtgggtgactgtgcaagaactactgctcggggcgtccagtatgtattagtcggcagtgttttggtgttgagtctcgattatactcaagcgaagaggaaacaccagaagagaaaaggatggtgttaagtgtggtcaatccaaaagggaaggtgtaacagaaggtatgctccccaagagccgatggttgattgcgatcgacaaaattgattgtattaaagaagatggtatctatagtttctgtaggaaaagggtgagagagggggcgaagaatgtgtttgcgcacatgtgtatttgtgagagaaacagagaaatggcgaggaagtgattttgtgtacgttgcttgcatactgtttgtgatacaaataatttggctcttagcggcgtgcagttcgaatagcaaactaaacgtggggaaagttgggagcaagttgtgaaaattcgtctgttgcttctgccaaatccatccgacaaaatagcaagcggaaggggaaaaaaaaacaccgtgaaacaagcgtacagaatcgcatttaaaataaaatgaaaataccaatgaacggcggaaaacccccgctgctgcttcgcccttaagtagatgtaacaattcacgttgcttttagggccttgccatccagcggagccacagcctactatcgaataggagcggcaggcagggcatgcatgtgcgtgggaagatgtggggagtcgctcgctttttgtcgtctccctttttccagccctccctcgctagagtttcgtttacccagaggtggtggaagaatagaagtgagagaatgctggagtgatggttttggactattgatggaattgccattaatgcgcctattgaaatgaagaggtttgttaaccgacttgtgctgaaccggtaaatttgatcagtaaactcatcagacagcgatcgggcgaagagagatcgacggcagagtgaacaaataaatgaggagaagggcgcagaagagcatatgatcatttatgctgggtgggcgaacgatgtggatcaaggaaaatcaactgttagtgttaattttttatttttgtttctcattccccctggtctcgctattgatgtggttgatattattacttgctttgttttcttcctttgttgtgtgtttacacttgtagtgagaaaagattaaggcataaaaaaggtaaagaaataaccttcgttgctcgacccctttcaccactccagtttctggtgtgagaagcggagatgagcctttggctactgaagaagcaaacttttcttaccggttcgcgtaatcattcatttgccagatttcattccttattcatttggctgttcggacgtttgttttttaatgtgctactgaggattgctcctcgctcacgtcacccgccaggagaagctaaggtctaacctggaatcttaccttactaaaaccgtgcattcccaccttcggcacacagattttcctatattcttcccttgctccttcaccattctcttatggtgtcgtgtttatttatcgaaactatcttctttaccttctaacgtcgtcactgcgggagtgcgctcttggttgagtggaatattgtctctgtgtgtattcggaagattgaaaatcaggatcaccaagcgcttgatgatgaaacattattcattctttatcgtttgattgaaagatttctgtaattgtaagataatgcttacatccggagagcatttatacattcatagaatgaccatattagctattaagttagaatgtgtagttggagtggaacaatttatttgtgtaattgactgcgtataaagctacagcatcaattagacacggttattaccattgtcattgtcattgtttttattactttgggtttggctgaaatacctacttaattaaaattatcaaaataaatttgcaattacttacaagtttgaggatgcaaaaaaataagaaactattttatatatatataaacaagtatatacatatgtatatgtatatgtatatgtatatgtatatgtgttcccttatcctctttccgatcccgcattagaaccctccataatcccgtgctgccttaatttttaatttttaaattttaaattctaattttctaaaaaaaaattttctcaaattttagataatttgttgttcatttttgttaggttaggaaattaggtaataagtattatttaagtatttgtgtaaccaaaaggtagacaaataaatttgaatatgaatatgaatatgaatatatgtataattcaaccacttgaagcgcacatcagttcaaaccaacactagcgcacaccagctgttgtttgccgtttcgtagatagtttttttggttcagctccttttttgtgtacttccggttgcttgttttgcaccggatggtggtgaaaagctgttgctgtttctgctggtgatggtgatttagttttatgccagatgcatgcgtattttagggacagacacaaacacacacccagtgttctgcaggtagtctctgtgcttgccgggaaataagatacaggaacacacacactttcgaaacgatcgcacagaaaacaggaaatctgccacttccggtctaccctgttcgtgtcctttaagaacagaagaccatgagcacgcgaaaggaaggattcgggcttttttgtttgtacaggtagagaggtattaaaaaataatgttaagctggatttttttaatggaataatttctgaaacgatgtgattattaatcacactcaattgcgggataactttgtaaagaaattgatcggctatttttttataaacaaataaaaataaatcttatataatatatatagtttctttgtaatttacataccagacaaaaacaaatatgttcaattagtgcaaatattaattaagtcaagaaataattgagtgtttgattgttactatgcaaccctggaaatgcagattcctgtggaggatattacctgatttattgtgcaatggaaaaattgaaattctaaattacttttagttattatattacagcgtttacatcaaatagttactattttgtaatgaagatgcaatttgtgtgtaattaaatgatacaaaatccctttattattctattggtgcattcttattttcgtaattattcgattctattcttctacaataaaatgctcccaaacctcgaaggaaccctttcgtttgcttgtgcacataaacttgcaaatatcacaacataaaaaataaaccatgttctccgtttatcgttgtgctcactttgctttgctgtagctgtttgtagagcttatgcccgtaccttggaatttaccttttgtccggtttaatatggaacattctcattcgcggtcgttttggatttaatttggtagttttattatctgacagtaattgggatccacctaaaagcggacgacggtgaggtttagttcgatccttatcattaccagtgcagcttaaagtgtttatggttttctcatgacggtaatttgccgtggcatcttttgatttcttgttttgctggatagtttttgttttagctaggctatcaactcgaagctcttttttaaacttttccattcctgcttttctattttatataaaatatgaacatgtataaacgtatgttgtgaacatattctgtttaaatgctatttcctaatatcaggtggcttaaacaagattagaaacattgtttatatttcttttcactgagtaggtgtatgtgaaagtagtagttgtacgatgtacgatggtattgtccttttgatggtcgttatgtatcagcttgaatgattaaatcaagagaacttttttttcgcatgtctttgaagtgaaacgtgtgtgtatgtcattacaacgagttccaatgtgcaggagagaagtcaaatgtggcatttgcttgcctcttcatgtgatgacggtgcttgctgttgctgccgaggttcggattgcttcacaattactaacgagtattacgaccttttacacatatgctccttttattgtatgcttcaattttatgttcctatctgcatacatgattcactcgctgttcactttgtggtgatgcttttgcgtgaatatattgcatctgaaatttggtctttaattatatcctagccctttcctttgtttcccattttccattatttatctctctctctctctctctctctatgtttttccataggttgccggatcggggctgtttgagctggagctacgctactttcaaaacgaaaaaagcatcgaccacaatgaaaaatgctgctccgaaaaggcggatgcgcagggccgctgcatcggtacctgtaaaaccaggtttcgggcttgcttgaagcactaccaggccacgatcgatacaacctcgccctgcactttcggtgacgtcataacgcctgtactggaaggaacgacactgaactttacagcgatctcgggcgcaaaggaaggcttcacaaatccgatacgatttccgtttgagtttggttggccggtaagtggtttttgggcttatttacaagtgttgttatgttttatgatgttttttttgcatttagtgttgcagtgcaattatggggattagtttagtaacattatattaacaaatattattgaaattttttaccgaaccaatgcaatgcattaattgtaaacgtgagatgtgattgtggctttcactcttctcggacatctaattattcatatgcattacatcagatatataccaactttgaggctatgtggacagttatttaggtcgcgtatatgaacgtcttctcacatgagaatactatttcgctatgctgatgtaaaaaatcttgccgatatctaaaaaaaaacatggaacaaagacatttaataattgctgccactggaagtactaatatttataagtaataactatcattatttattttcagtaccatattagccaatattggcaagcaacctgtcaattttattacagaataaagactttcagtgctcctcatacaatttacgttgtttacttttatgcatgcttttaccataatttctaaggcaccgatctgattttttgcataagcataactaaagtgtattctcatctttgtgtgaagaaagtattctgatatgtggtttaaggaactgtccagaaagcttctaattcagaagatgagtgaaaatatgacgtgtcctactttgagatgccgccactgtatacccagaagaagggagaaagaagtggtgaatctgtcttttttgtcatttttcataaaaaagactcacaccagctgcttcctcccgaaaattgagatcgacacccggtaggatgtgtttcgactgtttcctagctgagtatattattttcgtatattttcgttatttgagtatattttcgtagcatgttcaatctgtttccatcaggcccatcaggacatgatgttattggtttcgttgttgtttttttcatatattgccggaattgaatagtggaacatgtgaaataaaaaaataattattttgtgttgtttgatacagtttttatactgtattttgccgccacaagtgtagatgcaatttcagcaagcacagtggattgtagttaacattttacacaccaacaacacggctgccaattgttaattgtacattaatcccgtaagccgaatctcaccagggtttctgtaagcgcctaccaaatcaacattttgcacatcacgagcaagtgagtaggtaccgcattgttttgttttgatattctgactgacagatcgatttgacagaatgaattgctgcattttcagtaatgtttactaatatccagtgttgttttactaatatccagtgaaacgattaatttgacacttattttattgatttgatatagtaaaatgtgtattactgaaatgcattcagtaaattattttgctgaaagtcagtaaaaacatggcattcatgctgaaaaccagtaaaatattctaatactgaacctttactgaagccgaatgagaaaatttgctgtgcaggctcaatacctgccggtagtttgatgcgtagccttgtatgaagtgattgtagggattgagttgctgaaaatatatcgaggatcacgacaatgatggtataatatcaggtggcaagtctcaaaatctcatgaaaactagatataatctaaatttccctcattggctgaaatatagctgaagaaatgacaattcatttgtttcatttgggtaacgctactcacgcatttgaagttctacgttgcataccttggaaatgctcgatgcaatgcaatgttttctttggctaagcgacttttgtcgttacacaattcaatacgcaccccaacttagtagtcaacctgcttcctctcaaaggtttgtgtgatggtgtacccgagtctgggaaattgtatttaaaggtaaatcaagtgcagtgttggttgctaagacagttgcgagactcatttgggacatgccggtgtgttgtgtagtgtatggaaatgcataaaacacccaacacaacgatgcgcagcagtcgttcgttctgcccaactgctgcacgagaagtgtaagcagcaaaatggtgtatcatgtctgcagaatgagagagtacacaatgcgcgaagcgggaaaggtcgatcttaaaatgcgccatgtggcaacacaaatacacaaaaaaactgctgggaataacaagcgacataaaaaaacaaaataaaaatgaaaaaatcccaaaaagcacaagccttgtaatagggagaaaatacacagcgagagacacgcataacgtagcggttggcggcggactagtcgtctggttcgtttgctcccaggcagtcgccaagcaggacgcaagggccagggtacgtcttgtgttcttcactttgttgggaacatctgctattcaggttttcgaagcgtcgttcgtggtatgttataccgtgtgcggtgtgcctacggctactgccaaatgttcgtcgacatttacgttggtttaaagcagaggtggcaaacttttttttcatatagataagcaccacactgacatgtgacatggaaaagcgtgcacagttcagatttcgaatctgtacttttttagaataggtttctatcacataccattacttactaccgtagtttgttgaaattatgtaaaataaaaaataataaacaggaaaacacacagcaatattaagcaatttgcataaattttgtaggaaaagagcgcaacacatggttatgcatctattcacactgctagaattttaatatgtccgtgcaaattgctctgaaactcccaagacccgagacaatctcgtatggtatggtggtggcgtgtcgtatggcaccttctggcgaacgatgccagattcataaaaaaatgcatactttgtacactagtgaacgtatgtgttggagtattggatatttattttaaacatcatcgactaatcatataaaagtgattttttactttgttcatggtttgaaaacattttgttatgcatataacacgaatatccataccatactggaaagaataaggactgccagaaaaataagctgacgccttttgatagacaaattacgagtgcgcttgaaaatgtcctgttgataataaaacacatagagtgtggaattttgtcacccaactatcgagagtttaattaaaaagcgttaaactattgaattctgactatttaaatattcgtactagtgcagtcctaggattgttatttcttcatcattataaacttgtttgatcttccaggtatgtgtgactatttgcaccaataccgatatatttgctgcctctatcaaaaagttggtttccttggcaacgttaatgtgatcgtgtgccctgagcacacgacatacgatgagttgatttcactcaagccggacgcacaatgttggtattgtagtctatactggtattgatagcatccaggttcttcattggcgcaccccataaaacgttcgtttgtaccttgggttgcaaggaagggaaagtagtgttgaaattacggtggcatcgcgcctgttgcagctgctcgtcgtacgatgtcctctgtggcgacgtatatatgtacccttctaggtattctttaaaatgaaaacaaaaatgcacttatttagaagattacaattcggtggtataattctagtacatattttaatgcaaacttattgcagcaaattcaattttgctgagtgtaacactacccgcgatttgccaaaagtttatttttatcactaatcacaataatttatttaaagtacagatttgaaatatttgagataaaattatcaatagttttatatgttttttcgtaagagaaaataatgtataatatgtgcatatttggctctttaaatatgtttgcacgaaaaagcgtgtgatcagatatgacaacgacggggtttctcgaaagtcacctccctgtgtgatgttcgggcacttatgcgacattctcctttaagacctagcatgccgtttgcggtacaaagaagaatgtgatcggaatgtttgtttccttgatttgctaaagtattaagtatttaagtattaaagtattaaagtattaagtatttaatgattagtatgcataatcttcgcattatttatattgtattatccttcgatgcttgcttgatgcggtgaaattcatcttttagccaagtaaaacaggcggtcccgtggtacattcgtcgattcgcacgatttaacaacatgcccgtcgtgggttcaaaattcatatgatccgtccccccatagcaaggaccagctgcgtggtactaaatactgggtttaccagtccaataaacaactgtctgctttgtcgtggttttcattattttttatatttctctattgatcgaaaagaagatgatttttctagattcaacataagcaacttttgtctcgtaaatccattactagactgatctaactttcatcgatatttttcctttgtacctttacctgtgtctactatattgttttcctcattcgtttcaaccatcttattatctatgcctactatttgttttgacctctttttttaaaccttatccaaattatattaaacaatttcaaacatatagttcaactcactctcattcccaacacgcttgttggatataccaaaacggatattttctaattagttagcaactatgtatgattttatgtggctcgccaaaacaattttgttaaaaatgttacccgcagatcgaaaaagtttgttctacttatgaaatagtgttgcaaaaggcatccttgttttacattagcaatacggcttggccgttgtgaaggaaaccagtataatcgtatctttagtatgtatttagtattcatctgcagaatatgtttattttattgattcataatctatacaaattctggtgatatgaaagggggaaaataaaggtgttgaacgatagtctatagtcgcagtatatatatatatttatttattaaatattctattatgtatttatcagtttcttatgtttgttgcagtattaacaatattaatattatgttctactggaatgtatggtttatactgcattttgcttgaataaaacgaatgtgtttcaatccgttttgtttttattttttcaaacaaaacaaagcgtgccgaatctgacagttgtgcaatcgaagatgacaattgtgttattattggaattggacagataagcttacaccatctgacgtgtgatcaagtggtggacagcgttgtctattcaaaaaagataattgttataaacaagtggaaagttgtttattggactagtaacccttgtaagtctcgatagtctgtataggcggcatgtctgcgtatgtcgttacgccaacaagaaatcagataaaacaggatttatttagtatatagtaaaggaatgcttcatgcactcggtgaaatgtttcaagtgcagaggacaatttttcagaacagcggtggattttgtgaaaaagaactccgtgatgttttattagtttggagcaataaaacacatgtttcgatagctcttatttcgatgaattctttattgctactaaaatttcataggttttaatatgtgatctttaatgtctctacactgccgaagttcttctctccacagccgaagctcacctctccacagttcattctctattctagaaactctccaaattccctttaaacattttcaacctgcttccccaagattatgcgtaacaacatgttttcagaaaatagtaattgtatatttgacgctgtgtgttttttgaacctttgttttacgttcccattttgaataaagaatgattgcattcaaatgcagaaggttaaaaacagaaaaaacaggtgatgattttgttgttcattgcaaaaataaatgaaatatggaccaggccattcttgtggaataaaaaaattaaaaaaaggcaaacactttaatttttgttaagttactaattgttgttactgtaagaagaacggaacattttgctttcgtatgtcggaagtgttatttgatgtagggaacggtccgtgtttagttactgaaatatagcgatgtactatggaaaatgaaatcagagagagacaagcacgagttctgaacataatgaattcttcgctgtgaaatgaaaagccaagaaatggatgtacgactgttacaatctcgtccggacttgcgtgctgccacagccaagtcgatcaggtgcaaggtgcaaacggcagcacacgaatgggctacaattacagcagcgtctgaaaagcgagcagtaccaagcgagcattgtaaaaaaggtagacaagactgaaaaaaaaaagccaaaacaaatcaccaacaacaagtagacaactgcaacgtcggcactgtgtggcgacatatattcgatggagtgacaacgatgacgacaggctgcttgcggtccatctgtcgccaccgtcggcattggattccagtccaaacggataaagggttgctggcagcacggaggaggaaagccgatggtctggttggagagggcgagtgggagaagatggaagatttccagtggaccagaatggtaattgaaaacagcaacagtaacaataaaaaatccaatctcttttcctgtctagcacaggtgagcagcagcgattttttgttattgttggagagaaacaaaagatgagatagaaccaacgaattgcaaaaatcagccacccatcaaagtaagccatccgagcaaaagaagaactaaaacagcgttgagtcgttcatcaaagtaaccatccatccaggcagaccggtgtgcgcggcacacgcaggaagacgcagccaaaggcagccaaccagcataatctaattgagctcgaaccaaccgctggcagccgtcggcgttccgtagtcggtcggggtcgtgttggatggagccagatggaaaagtttatttttacactcgtatatacatacacagttatgttgtatgtgtgcgacgtacaaaacatatacagaggacgcgagagagagagagagaggatcgaggttttgcgttgtttgatattatttttcgtccccatttttcggccaattccacactctgcacttctttgagcttcccatacacccaacatagtatcatcttccattctccgtcaccttggaaatgttaccgctccgcatgattccttcggcactatctttttcgtttcctctgttggcgctgctggctacagattgacagtgttagtgtatatttagttagggaacggaccttttttttgtatgtaatttacctacgctctttaactatccttaccagagccagatgtcacgcgccacatcaacgaacgcatccacccattttggatatacctatcgtgggcactggcatacattttgaatatgtgtacgggtcatgtttaaaggagcgaacatcatggggaagattgaacgcaatcaaaatgtaaaagaacacctgggatttataatgaacatgttattcataaacatgaagaaagaatcgatacatgattatcgtgcttacttcgtatcaatattttagtgaagcttatcactgcgacaagctttattgcatatcttaatttatagcttaatacataaaatgatttcattctatgctcttcgttggcaattatagttgtcatagatgcatttcacacctcattcgaattcaatgagttgtactgttgcaaaaattcacacaacaattttgattattaatattttaaaatgacgataatattttgatttaaaaagtgacgataatattttataaaatgtttgtaattgctttgagtttgttcaaacgaaaaacgttgcgtaatgtataatcacgttattcactcaaatacgtaaagtgtgcttatgagaatttaaaatactttactacatttttcatttcttatattaagatatgatatacctagcattgtatagtcgatgctctcatgagcaattttaatatatttgttgtattatttttgtataaaatgttgttggaacttcttagaatagtattgtatgattaaaaatacaatattgtatctattaggatcgttctaattagcgtgcgatccttaatcagtatgtatctgagtgtatctgattcagattcgtgaatctgaataaattatcgaaatgaaatgaatcggaatctcggatgaaaagatgtatacttctcagagattgatgaatctcgtaaggttcattaatctcaaagattcatataccttgaccctcttcttcttctttgtgtaacgacttatgcggccatataaggcattcgagacttatgataaagttctacgcaatcggatcacacatcagtcaatgaaagggggggttggggggggggggtgtccatgcaaatttagatcccacgacaggcatgttgttaagtcgtgccgaattgacgattgtaccacgggaccccgtcccgaaaattaatatcttaaaaatcattcatctcaaaaatatcataacgtttcattgatttatgaacgtttggagattcgattcgagaattgaatcactcatcgccgaagattcgttagaatgaatctctacaaatgattcatgaagcacaacactaatctcgatgcattcagttttcattttgtgtgttataaggaatgtgcaaaatcaaacaacaatgatgttcccgttaactgccattatatgccggtactgtcacaaagagcagggttttcactatatgtgttaaaattgatgtttgatttatataaacctcgatgaacgtagcgtttagtttttctgttcagcttgtatggaatacgcagaagttttcttgttcgtataaatattacgctactgagaaacattaactattttcgttgtatttggtttcacagttttgtgataatttcataggttgatgtagtttttttttccaataagcttgttgcaaatgcagtgtcaaaccattatttggggcgaaacatggcagctcctgtaaagctagtcttattctgcaaaacaggtctactatggaacataccaacgggttacggggttgcaagtgtaacccactatacgcataccataagtttgctgcttcctctcgcacgaaggtgcgacgcggagtatagtgcatttgcaaaatacggcacatggaatttgccaaacctccgtcattcgttagcatgtgccggctaccaaacattccatagaacgtgggagaagaagtacggccggttggtgtactagcaagtgtattgtgacttgttcgcaaaaagctacaacgaagcaagttccaaacgaccttcagtggaagtggccggctagtagggcgcgcggtatgtgacctggtggcggtggatttttaagccagtttgtcaaatgtttcgtaaggggttttgttaattgtgtagcatgtctcgtcgatacagaaacgggggaccgttttacagcgttcacggaggtacagcaaccacatggccaataagggggttaaacaagggaacgaatgttacttagtggtgttgttgtctctaaggtttctacaaaaatgtatcactgaacttaatccataatttttctttcttacttctttcagggatactttacacttatcatagaagcgtggcatgatacaaatgaaacaactactcgatctccaggtaaatacttacattagctttcgttagacttatttaatgtagcgtggaaccaatttttaattggttaatttccattcattcgaagcttcatttcgggagtattgatggtttcttccataacacacgcatgtatccgcttcaggttaaggttgatgtcgttatttgatgtaaaagttcacaacaacaacaacaaaaaataattgagagaaaaacaacttccacaaaaagcgggctgttttgatatgatgctactctttataaactaataattatgcatttcttttctctgcgtaacaggcaccctcatttcccgtctctcaattcaacgtatactggaagtttcggccgactggatggaagacagttacaactcatcgcacacgatgatacggtatgcgttccgggtgacgtgcgatccgaactactacggtgcaggctgtgccaatttgtgccgcaagcgggacgatcaatttggccattacacctgctcaccgatcggtgaacgtgtttgtctgtccggctggctgggagaatactgtaccgttggtaagtgctttagtgaaggggcacgcgcgtttaaagtataaaccaccggtttaagacatcgctgcgggtattgggctaagaaaatgggtttccctttctccttcttgcacgaggggtatcacataatattgcttagagagaatgtaatatactcgtacaatttcataaaatggcgattctataaatctgatctgatcgaagatttttggggggttaaacagaaagtcacaatttttagaaacagcaagatcaaatcaaaaggatgaagcatatgccatcgtttttaatgagacatgataaaacttttatgcacaaattgtattgaatagaatggcatggatgtattttaatcgtatgttgttgtgtttctcttaaagaagttcgcaaaaaatgatcgagaaatagaacaaaaagatttatcggttatttatttaatttttttatttcatccatacagcccaatgcactccgggatgccttcacggacactgcaacaagccgaacgaatgcatgtaagtattgcaacttgcaccatatcacgacacgctcacaaagcatatatttctttacctttgccttatgtcaccttcacctgcaaataccctcctcctcctcgtactctttgccattttccaccttctcctcttcccgatactcctcccatttctcagtcacggggcgtcgaatgcatgcaagctctgtgtgcaattaatgtacccttcatctgcgcactcccgtcctcctctttcgtttgttcgctactgctggcatttttaatgagcaatgagaagtttttttttttaatatttatcttgctttctctcttatatttcgtttgtttgctacgcttcttagttgccaatcgggatggaaaggtccgctgtgcgacgaatgtgaaccgtatcctggctgcctgcacggtacatgcaaaaaaccctgggagtgcatttgcaaagaaggctggggagggctgttttgcaatcaggatctaaactactgtaccaaccacaagccatgcctgaacgggggcacctgcttcaatacgggacaaggtttatacacgtgccagtgccgtccgggatataagggtaccgagtgtgaactgagcatcacgagctgctccgatcacccttgtttgcatggagccacctgcacctcaacagtggatggcgaaacatcgatggacgctgacggccgcaaatatcagtgccattgtgcgaagggctggatggggcggcactgcgaacgggaggctataacatgcgcggaaaaaccttgtcatcaaggaacgtgcgttgatgtgacgccttcctcatcttcatcgtcatcgacatcagctaacttccgctgtgactgcccacccggatatagcgggacagcgtgcgagatcaaatctggcgaatgctattccaactactgtgccaacggtggtacctgtcacgtggcaggatcatcttcatcatcctccgcatcatcatccatcatggcttcttcgcaatcatcgtcatcatcctcgttatcggcgcttttcggatcgggaaatagcaacaataataatgacggagggattggaatgctaatgtgcctctgtccggatggatttgttggtgatcgctgcgaggaaaatgtagacgattgcgtcggcaacctgtgcttgaatgggggcacgtgtgtcgatgcagacaatcactttaaatgccagtgtgtgcccggattcataggaacacactgcgaggaaaaggtggatctctgcctcacaaaaccctgcgcgaatggtggcatttgtacgaatcttgaaaacgattaccgctgccagtgccgcgcaggcttcaccggtaaggattgcagcgcggacgtggacgaatgccactctgcgccgtgtcggaacggtggcacgtgtatcaatagggtgaacagctaccaatgcgtttgtgctggtggctatcgtggacactcctgcgaggaagaatccgctaccgtcatccaacgtgatgcggacatagaagggagtgaatttcatcatcaccaccatcatccgcaacagcaacaacggcacagtggaggagaaggagttgactccagcagtcgcaccgcggatgggttgagcagtggtcaaatcgttttaatagcgatgttctccatttcaacaccactgttggcgttcattgcgactacgatcgttatctgtctcaagcgcaagcgccaacgggaacaagaaaaggatgatgcggaagcgagaaaacagaatgaacaaaatgcttcccacaatctttccgcatcctcacatcaccatcatcatcacctgcaacagcagcagcaacatcagcaacagcaacagcttcaccatcaacagtcgtcgtcgtcgtcgtccacgtcttccggtgctctgctccattcatcttcgcaacagcaacaacaacaacaataccataatggatttcacaaccatctccagtcctcaggccagaagcggaatagtagcaatacactttcaaactttgacagttcgcatcatatgattaaaaacacgtgggataagagcatcaacaacatgccgtcaccaccaacaactgcaagtggaagcggcgtcagtagcagtggaggtggcggaaccggtggttgcagtgctggtggagttggtggaagtgtcgggtccgcagcacttttgctcagtggagcaaatatggacgataatggctgcctcattgcttcggcggcagcggtaggtagcaatggcgctggaagtactggaatgggtggcgtcggtggtgcagctggtgcattattgtatttgagcacttccgatgatggaccgacgatggcgtcctgctcgacattacaacgtgccaaatcacagaagcagctcaatacagatccctcactgttgttacagcagcagcaacagcatcaaaatcatcatcatagtgtgatattatcacaaacgtcggcttcatctctacatccatcagcaagcgcggcatcggtaggagggggcactgtattatcgtcgccagtggtatcctctacgggtacaccctgttccaatggaagtgggaaggatatgtttgacaaacgcatatcggttctatccgaatcggggagattatgtcatcctcggtggaacggtgcaacttcagctggcgtagtgggaggcagtccttcggttgtaggaccttgtagtccaccacacatttaaccactatcgctttgttacactgtaggacgcagtcaacagccgttctatttaagttcatttcaaccaaaagagatctagaaaagatcaaaaacacatacatacacacacgcacatatatctttatgtatatatttacatatatatatctgtgtgtgtatttacacacttgagttactgaaaatatgggtgtccggatctcagataccaatcatgctttaaagacaaaggacaaagtgtatagtatgattgattttatgtcttttgcaatcgtagtatatgacaagatcagccttcgggtatgatcagacgtgacatatctgcacgaatattgtcctatggtttcctagttattgatcttaggatttttattacttttatttctttttgtcaaatgctatattgtgtgaggatttttttggtactttttaacagtcactaactttgaacaaatgatattctttcatgctttcatcgctcaacgcaaaatatttgtttgtttttccatcaccgaaatattcaatagaaccgttgcataattatgcaataccgtttttttcgcagcggtgattttaattacaataaagtgggaaataactatga

SEQ ID NO: 84 - DNA, 10921 bp, Anopheles gambiae
cgagctgtgaaaaccaaccatctatgcgagtggtcagctcgttcaacctttgcgggcgttgtacggttaaaagccgggattattcgcttactgttgcgaaaaatataaaaccgttagcatcgaagatttacgatccagcaagacgcaacattaatcaacgcggtatcagtgacatggaacagtaaattgttccttttgcgggactactaccaaaatattacatcccccgtttgcgtccgctggctcgcgatcgattggaatgtgtcaatttgttcacaattcgctgcatacgttttgagcgatcggcaacagcggctaaaaaatctgggcatctttcccatattgagtcatcgtgagtgttgtcccatgagctactccactcccaaatgtggataatctgttcctttcactcgccttggcccgttctcacgatcagatctctgggtgtctgggtaagggtaacctatcccttaaccagcagctattagccgagtcagtgccgcataatctttaccgaaagatctaaaaaaatcccggacccacactgcataaaaccatctcaatttcactttgtttcgtctcatttcagaatcgagcttgatgagccacgtcgaaaagcaacgctacgatggatggtacaacaacctggcccatccggactggggagctgtcggtaagttgtgcgcgcacaccacccttttggtcataattttttgatttatcacacacgatcaactgacaacccgcacgtagcgcaatctcagcagggagggtttttcacaaaactgtccaaaaggagcttaaaataaaaaaaaaacacacacaccgcccaaattcacccccacccattcgagtataaacgtctccgttgacagtctgttttgttcggtgctttaacgattccccgtttgcttaactggagggcttttatgtgcctattttaccgattttacctgtgagcagtaaatgcagaaatattgcgatgtgtcacagcgagttgtgccgatttcgctgcgatcgctcaattttcgaacaccccagcacagcggggtgcgtttgcattgagctgctgagaactcccgcgttgttgcgaaacggggcttggtccgcaaatccgagtagtatgtttactttattgcattttaagcctcacttactcgatccctgctactccacaagctctaccggcgtttcgtatcggtcgagtcgcaaatgtagatgtaaattttaattatttatgattatcggccatcaatgctgggcgagggaacactgattactacaattgattacattccgtccaggcgggaatatgcgggtacttaaattgttctcaattttcccatcgtatggctaattagcgaacgtgactgtgtagctctttcgcggcagagcaattcattaaatttggatgaatgtttttgtggcaagagataaacatggaatgtttaatctgcttagtagtagtgatattatttctcaaaattattttttttcgaatctcaaagagaagagtttattgttgctgctgcatacttttacatgattaatttttttactaatcttttaaaatttcgattcagtttgatataaatcatgctgttcatgaaatttaaacagtatttttgaacaattgtatcataatgtttaaacattaattcaagcttcttggcactagagagcacttgcgcctccatcatattcaagtaatcgattaacgcgttcgctccatggcacatacaatactcattcagcatctgtggcacgtgagcgacaacccaccagccaagtcacgcgaccgacctgcctggtgtgtgccagacgccccgctgtgtagtgcaaaatgtagcaaaatgtaccagtttgccgcatcatgcccaccagcatcacacgtcaagtccatttcagggagtgactccaaaccatacatcattcggtgcctcacaaccagtctctttgacgtgcagtgttcaaacagttcaaacgtctcttataccgggccgtatgtgcgtgtgtgtatcgaaatggttcaggcacacagcacgtgaagttaaaattcagagtgacttaattggattaagcataccttaagtgcagtgcctgttaactttgtagctgcctccaaaccttcccccctcagtgcatcacacccaaggtgcattcttgcatccaaccttacaagctgcagacccccggacagcttttaagctgagcattcgcactgcaggatcgatgaatgggtggttggatggatggatggattaccttgatatggtgcacccttccctaccgccgttagtagcaaaagggctggaccgtgcttctgtagcttcagacgctgcaggaggtacaccagtactaacaacgtcctacgaaactcgttttgttttgtgagcagcagcagccaccactaaacagctactaaattatatgaataatgcctcacacagcgcgtgcatgttgcaccatattggtgatatgcagttcaagcgggaatgaatgaatcatagtaatgtagatgcacctgttgtggcgataccttcaggcaaagtattcagaagttgaaaggattgggaagctttttatcatttttatgtttatgctcattttatattatttttctttaaagcaagagtctccaaactacggcctgcgggccgcatgccctcaagagtctttaatgcggcccgcgatgactgggttaaggttaaattctggcttctgactaattaatcaaaatttatttttttacttctgaaagacgaaaataaagattccgtaaaagaaagctgcagaaatttgatataatttgtcagtgttttcttattaaaacgagataggaacttccactcaatctaaaggaagcgtcaaaatggccctcaacaacgttgattgtgaaacaatgcggcccgcgaactaaaaagtttagagacccctgctttaaagcattgtttgaaatacaataatatcattaaaacatctggaaaaatacaaaaaaaaagtttttcaccgacataatttatgcctggcaatcagttttgttgaaccacctcaacagccttcatttgtacttacatttgcctttctgcagcatatgcaacaggattaaactcaaaaacaaaacaactccattgagatgtcggttggctgttgccactcatcaggatcggcgtacaaatccttccccgggcttattgcattatgaaacaatttgcccgctcgaagtcatttataaaagtctgaaagcaataattgatggtctgctcgcgtctgacctcgaaatcaaatttcgagctgatgctgaatgtgcaagggctatcgaacgatggtgtagatgctttattttcttggctgttgtcttgtgcaggcagtagttttctctgctccattcgaaaggagggtttgtgtggtatgataatgctcacttccattcatcgattaatttgccgtaatagtttggtggtatcgattccttctcactaacaagcatcaacattactgttgccttttacagaacataatactcccgaaaaggaagcaatgcattacgtgtaaaagaaaaataaatgacatttatatgtctattgttgttattcgtaccatattgggtggtgttaatgatttgtatcaaggctaatttctatgtttatagtaaatgatttaaattttttcttatcttccttttattaaagtaaaaaactttaatttaatacttaatctttgcatagacatgtttctgctcacatttcgctattttttactatgatgaatgtgcaaaattctagtcgcacagtgtttctggctcaagtgttgccttattgcatgtcgtacaatttcatcctgttgagctatggctggcaataaatatgcattatgtatgttcgctaacattttcgacccaacaggtgacaactcactcgctcaaactttaattacttttatcaccctggctggcacgtacggacggtaatctttggcattgatctagatacctgcatgcctgataaggccagcggtatttaatatgtaacagtaacaagagtgtagaaattaaatgacaatttatgtctcgtttcagaggcaaagtaaactagtaacgcgttgctttttcttggttgaatgatggatgaggtatcaattaaattaagttctatgaagtgttataatttattatcgagatcaattggaatgatcgataagttatcagatacacaagatgtatgcaataagaaacaaccagcataaaatatatgaacatagtgcagtttaggtttatccacaatgtgtgctcagatatactaaaccggtaaaacaaacccgtttgtatactgctacttcaaaatcaatggcacatttttacatcatactttgcatatgtttcaacacacttacacgtgtaattattggtgcataatttatctctagcaacgatgacgtagcctgtgcgcttttttgcaccacgtcggtggtccactctgttgcgctgttctatcgcagctccgacacgtaaaaaacagtttgtaggaaaaataaaaattatggtccaaacagacagaaacgcgtgtcataacagccataaagttagtgcgtcccagtcacccgacacccataggcgcgagtgcatttgcacccctacactaataggtcgcgccgcgtagcttaaccgaaccgggtaccgggtctccatcatcatgcgaaggaaccgttaatggacaatttaggaataattattatttatgagctcgccattgacattgaactgcttccgtttggtagctttttgctaccttttccttctgaggcttcacggctcgcttagcaaatgtcagcacacaaactcacttccaggtcgctccaataagcagggctgagggtagtaagaaaactgtgaagaaaatcatcatccattaagaaagacctatcccttaaaatatgcaaaaaagcgcaaggtagcagcaattaagctgcgcgttgcagggaaaggcagtctagcaaattggtctagcggcattgtgttttagcatgattttaaaagcacttgtaagtaggtgtttcgcttcagcttttcgaatgaccggaaaaggtgcctagcaaccaaaactgtcagttattctttttctcgaaaaccaacaatgtactcaaggtttttattcaataacaatacattaatatataactaatagatattgttgatggattctaaatactatttttcccttcttttaatacttccacagataatcacctcacgaggaaagctccatcggcatacagcgacggggtgtatgtgatggccggttctaatcgcccctcgccccgtaagctcagcagactgttcatgcgtggcaccgatggtttaccatcgatggaaaaccgtaccgccctgctagctttcttcggtcaggtggtgacgaacgagatcgtcatggcgtccgagtcgggctgtccgattgagatgcaccggatcgagatcgagaagtgtgacgaaatgtacgatcgagagtgtcgtggtgatcgctatattccgtttcaccgtgcggcttacgatcgcaacacgggccagagtccgaacgcgccccgcgaacagatcaatcagatgacggcctggattgatggcagcttcatctacagcacatcggaggcatggctgaatgcgatgcgttcgttccaggacggtgcgcttctgacggacaagcagggtacgatgccggtaaagaacacgatgcgtgtgccactgttcaacaatcctgtaccgcatgtgatgcgaatgctcagtccggaacgactatatcgtgagtaatccatgcttattgcgtttgttttgaatgtgcagtgaactgtaaccaacattttcaaacttttacagttctgggtgatcctagaaccaaccaaaatccagccctgctctcctttgccattctgttcctgcgttggcacaatgtggtagcgaagcgcgttcgtcgccagcatcgagattggagtgatgaagagattttccaacgagcacgacgtgtggtgatcgctagtttgcagaacatcgtcgcatacgagtatctgccagcgttcctggacaaggagataccaccgtacgatggctacaaagcggacactcatcccggagtgagccacatgttccaggcggccgccttccgatttggacactcgctaattccaccaggactgttccgacgcgacggtcaatgcaacttccgtcgcaccaacatggacttcccagctttgcggctttgctctacctggtggaattcgaatgtaggtttgctttgcgtgtgagaaacgttcggtgtgtgtgtgtgtgcaatatgactaaattgattcgttaaaatcactccacaggatgtactcgataacacgccggtggaagagttcattatgggcatggcgtcacagatagccgaaaaggaggatccactgctgtgttcggacgtgcgcgataagctgtttggaccgatggagttcaccaggcgggatctgggtgctttgaatattatgcgcggtcgtgacaacggacttcccgattacaacacggcacgtgcggcttaccgtttgcccaagaagaagagttggcgcgacatcaacccggcagtgttcgaacggcagcctgaacttttggagtaagtttgttggataaagtttgggtgggtaagatttcattttaatgcccctggtacgcttaatccgacagtctgctaattaaaacgtacgacaaccaactggacaacgtggacgtttacgttggcggaatgctggagtccgatggaaggccgggcgaactgttttcagctgtcattattgatcagtttaccagaattcgtgacgccgatcggttctggttcgaaaacgaggacaatgggtgagtgatttgtgattgtggattaacaaaatttcaaccagcaatctgacacctgtaccaaatcgtctttacagcatattcaccaaggaagaaatagccgaaatacgcaagtttacactgtgggacattatcgtgaacagtaccgacatcgaggcggatgagattcaacgagatgttttccactggaagcaaggtgatccctgcccgcagccggaacagctgaacgctacattgctcgaaccgtgcaattatctcgaggggtacgattacttctccggttccgagctggcctatatctattcgtgtgtgtttctcggttttgtgccaatcctttgcgccggagccggatactgcgtgatcaagctacagaacagccgacgtcgtaaattgaaaatcaaacaagaagccatgaaaaacactgccaacactaaagtgtcggtggagaaaatggttgcccgggagtggttgcatgcgaatcacaaacgattggtgacggtaaaattcggaccagaagcgtcgatctatacggtggatcgcaagggagagaagctgcggaccttcaacctgaaacacgtcgatgtggtgacggtggagcaatcgcaggagaactacacggccaagaagccatacattctgctgcgtgtgcccaacgatcacgatctagtgctggaattagagtccaactcggcccgcaggaagttcgtcaaaaagctggaagatttccttgtacttcacaaaaagacaatgacattcgtggaatcgaatcgtgatttgatgctagccaaggcagaaacacgcgagcgccgtcaaaagcggctggagcatttcttccgtgaagcttacgcgttgactttcggtttgcgtcctggtgaacgtcgccggcgctcagacgcatcgttggatggtgaggttatgacggtgatgcgaaccagtttgtcgaagtcagagtttgctgcagccctcggtatgaaacaggacgatatgttcgttcggaagatgtttaatatcgtcgacaaggacaaggacggaagaatatcattccaggtaagagatactcgaaaaactcctaccaaaaacagcgatgttttaaaatgtctttctcggatttgtcttttaggaattcttggaaacggtggtattgttttcacgtggcaaaaccgatgacaaactaaggatcattttcgacatgtgcgacaacgatcgaaatggagtgatcgataagggagaactgagcgagatgatgcgatcgttggtggaaatcgcccgcacaacgagcgttaccgatgagcaagtaaacgaactgatcgatggcatgttccaggtatgttattgtgagtgagctttagtagtccgcattactctaacatgttttcacttacaaccctacaggatgttggtctcgagcacaagaaccatctcacctacgaggacttcaagcttatgatgaaggagtacaagggcgactttgtagcgattgggttggattgcaaaggtgctaagcagaatttcctcgatacgtccaccaatgtggcacgcatgacgtctttccatattgaaccaatttcggactcgcgccgtcactggatgcaagaaaagtgggactgttacacgaccttcctggaggagaatcgtcagaacatcttctatctgttcctgttctacgttatcaccatcgtgctgtttgtggagcgctttattcgttagtattactttgtgtgtgagaattttcttttgtatgaactcatcataacccttttaaatgtttccagattactcgtttatggcggagcacaccgatctacgacacatcatgggagttggtattgctataactcgtggttcggccgcttcattgtcattctgttactctcttctgttgctcaccatgtccaggtatgagtgattttggaagtaagctcacaattccattgtttaaccatattccttcgccaacagaaatcttctcaccaagctgaaagagtttccaatccagcagtacatcccgcttgattcacacattcaattccacaagatcgctgcctgcactgcgttgttcttttcgctgctgcacactgtcggacatatcgtgaacttttatcacgtttctacccaatcgatcgaaaacctaaagtgtctcacgaaagaagttcacttcacgtccgactatcggcccgatataacgtactggctgtttcaaaccatcaccggcgtgaccggcgtaatgctgttcgtcacaatgtgcatcatttttgcattcgctcatccaactattcgcaagaaggcgtacaagttcttctggaacgcacattccctgtacgtggtgctgtacgcattatgtctcgtgcacgggcttgcacgtttgaccggtgccccccggttctggttgttctttattggacccggtatcgtgtacacactggataagatcgtctccctacgcaccaagtacatggcgttggatgtcattgaaacggatctattgccctcggacgtaatcaagatcaagttctaccgtccgccgaatctaaagtatctttccggtcagtgggtaagactgtcgtgcacggaaataaagcccgaagagatgcacagctttacactgacctcggcaccacacgagaatttcctgagctgtcacatcaaagcgcagggaccgtggacatggaagttgcgcaactacttcgacccatgcaattacaacccggacgatcagccgaagatacgcatcgagggaccgttcggtgggggcaatcaggattggtacaagtttgaggttgctgttatggtcggtggcggtatcggtgtgacaccgtacgcttccattctgaacgatctggtgtttggtacaagcaccaaccggtactctggagtggcgtgtaagaaggtatacttcctttggatctgcccgtcgcacaagcatttcgagtggtttatcgacgtactgcgggatgtggagaagaaggatgttacgaatgtgctagagattcatattttcatcacacaattcttccataaatttgatcttcgaacaaccatgctggtaagtcaccatttttttaagggttgctaatgaacgtgtttgcaaatacaatattttgtattcccttttgttacagtacatttgtgaaaatcacttccaacgactctctaaaacgtctatgtttaccgggctaaaagcagtgaatcattttggccgtcccgatatgtccagtttcctgaaattcgtccaaaagaagcattcttatgtgagttctgccagctaacgatatagctaacgatagcgtacgaagtgttaattaatctttttcgcactattaacaggtatccaaaattggagtcttctcttgtggaccacgaccgctcaccaagagtgtcatgtcggcatgtgatgaagtgaacaagagccgcaaatggccgtactttattcatcatttcgaaaactttggctaatcgaacaacaaacaagaaaaggctgttcacaccttcatcgtcctttctcattccatactaataagctatcgtttaatcgcaacgcaccagtctgggaggattggttgatttgttctaatttcgaaagcgaaagcgtgtctcgtcgattattttttataacctagttttcaatgtttgtatgcgtttctgattgtatgtgtagcttttcggtagggagcggcaacggcatcaaaccagcagtttcagtatttgcgttagtctcatttgatattccagcgtcattatcaaatgtgtccgtttcgttcgttttaacgttaggtatagaatatccagatcttcgtttgcgtaacgttgtatttcccctccaaacactgcctaaaaggcttatttattctcctttcagaaggaagaaatccttaaaaagcaaaactaaatcctattccaaccaagttcatgatagcagaaacgctacccagttcacgatagtaaacgtttatcgttttgctttgttcgctcgcagaacagttagttttaaagtctcttgcaagcatatatcgctaaaagatcaatagaagcaatattcacacggatgcctaccat

SEQ ID NO: 85 - DNA, 7270 bp, Aedes aegypti
ctgatgcattgaagtctccgaatgaactgaactgctgcataaaattcaacgccattgcggcgcattttccgcccagctgagtcgaatttatgagaagcccaccagtttcctgctctaaatacctgccaatttcataacatcgcaccgacactgcgctacagcttacaatgcatcgaccaatcagcccatggttgttggtaataaaacgttcaaatattaatgtgtttctttcagcgggaaaccaccgaccgccgcgtaatgtggcggctgtccaaaataatttagctaatactatttaactctacttttgccgtatgttttgcagttgtgcgcaggcaggaccaacaagctcaatttcccgatgcctttcagcatttgttgctgcccccatgtgtgtctcgtaaacttaaccaaagcacttgcggccctatatgcttacccccgttgacttctatttgcctgcagtaaatcgaaagtggaaatgtacgttaaacaaagcgaaaatgtggtaaccttaccggctgcagcaatggcagcgacaatgacggctataataagtaccacggatcaaatctaagtccctagccaacagccagcagtatgacgtgtacggaagactgcacctgcagtctctgtcgggagttacgcggctacaaattaaaagtaaaacctgccagcaagacggaccggtcttcagggtgtccggaaggcacttcagctggcggaaaaccgtctccgccagggtcaaaatattgtaaaaatagcaaactaaacagaaacgataacttcattctcaagcgtcgactgtcctcggattgcaacaaagatggccgccatggtgcttccgcgacaccattggcgggcgcatcgacgacggaaattaactacgaattcccggagcaagccgccatcacatcccgacagcttaaccggatgaagaaagcccaaagttataacgagatctcctgctttgcgaaaatcaacaaaaaccgctacagcggaggtgtgatcgagccaaagatgatcaaaagcaccaccaacctcacagaagaagatgactacttcagctatctgccaccttctccgcctccatccatctcagcgtccgcccaaaatatcaaaaacaagattgaaaaacagaaagaccacaaagtgatcatctatttcggtgatagcatagcccataagaaatccgaaaaacccaaacctcctcctacgacacctcccccaccaaaggtcaccgaactcaacgtcttccacgctcaacgtctttgcgaagaaaccgcagaaatgcacttcaagcgacaaaactcaatagtcatcaagccaaagcgtaaagatacctcagaacaaaccaaacccggtaaggaattcatgcaacaactcaaatctgtactagaagagaaaaataagacttcgggtcctccgggagcacccaccgcggaccccatgggaccaggctgctcggcaactgtggtgataacgcagaagaaagcctcccctgcacatccagaaccccacagacctcctaccatagttgccgaacagccacagcaaccgaagcacacccaagtggtagagatcggacgggtggacaggacggttgcaaccgaggacggcgaaaaatcgctgccgtcgttcgttgaaagtgtcgtcaatgggatcatcaacatcaagatcgaggaaagtttcaaggtcgctacggatatcgtccatgccgtgtttcagaacgatccaggtgaagaagggtatggctgcaacgatgacgaagtcggagatcccttcgattggagcttcgtgcagaactggcgggcacggtaatgtagaacaaattttattgtatgctagatattttacttccagggacttggtgagcacattgaaacatttctcgtatgtaaaccctttgagactatcatcaactaatcacgcttcatttctatcctaacaggccatccggaagcgttgccaacggacatgtcaacacgccatcaaacaacagcaactccacatcaggagtcaacagctccagcagtaacctacacaatggttccaatgggctgtcacctggcaatcactacatcgcctcttcaaaccccgttacatctggaccacggatccaaagccccgctgtggccactccagcgccacgagtctccaaggagattgccgtccgcccaccgaacggaaaccaggtggatcctcgaaactataacctctcacctgtgcacagtctacagcaaagtggggaaaccactggctcgagcgctgtcagccaaggtagcaatcacaatctcacctacaacgcttcggccatgatccccgaacgggacattggtcccactaagttcacaaacggaaacatcaaacaacagcaccatactcccccacatggccttcatcaacagctgaacggatcccatcatgccgcaaccccgcagcaacaaggtccccacagatctgtatcgggtccaactaaattgaccgtccaaagctctccggtcaaatcccaaccggccatgatcagctccggactagacaaatccaacctccagcacagtgccaatggctacaacgccaagcgactgaaccccagtggtcttagcagtagcaacgacaacctcatcaattctccgacttcctccacagaacccctaaacaccagcagcaacagctccagcaatgccagcagtgttagccatctcaagcaacacttcgcccagaaccatcacgccatgcccgcttaccatcatcaacaatcgcagcccaactcccttggtggtccacccccaaaatccctcggcataacacgaactcatcaccacacgggaacgcatgacttccgtggactgcagcgcgtcaacgaatgtcacagctcgtcagacgagaatcgatcgtcggggcacgcttccatgtctgacacgggtcacggcagcagctctcccggaggtaatcgagcgaatggacctcttggtccactaccggaagatcgtttggcggcaggtgtcacgaaccgaagcgctcgatccagagctagtaccaatcattcgcggtcccgacatagggccacacccgcaaagatcccatggggtggaggagggcttgaagatataaagttggccattcagcaactgactatgcgctcccatacgagtacatcaacttacagcagtttgagtgctggatcggagagttctgaacctgaaagaagacttgggagatatagctcgctggaaactgtgaataccaacgtaactagcgccgatgaatttgtctgggtagattcgcacaatcgtttggtggaacttcagcatcctccatggagtcagcactgtgttctacgggtcctgaggtctggtcgttgtagggagcattctgagagggtttctgttgaagcggtccccagattgggttatcttctacagcgagcgttagttagagtggcacgtgaagtacaacgtctgtcgggatgtttgggcctgtgttctaagcatgaagtctcaggtgcgttcaaaatagtcctgtcccctgcgctagctgattcgtgtatcaaagcttgtcttcgagcggcagctatgtttgctgtacccggagatagcgccctgaagcagagtaaatctgcccgggctggtcttcaacttccggttggtagattccatcgctggatggccgacgccagattgggaagattcgtccacgagtatgctgcagtctacctttgtgcaggcttggaaaacctacttgaagaaatattcctacagtgtctaccaacggatcccacagcaacgcttacagcaagcggcttagagcatgcaatcgccaactctggagacttgtggggtcttctccagccttatgctcatctaaacgctggccgagtcgcttcaggagctctaaccatgccacgctgggctagtcagtcatcgatcaactccaacaatcaaagccctgcgctagaaccatgtctgctaaccacttgcgttggaagcctaaatgagctcaaggacctggtgcaacgagcacagctgagaagtcaacatattacaatgtcactgtcggccttacgagtgctgttctattttatgcgatgctcacagctagaacataatgacatcggagtggccaccaatggcggtggaaccaacattcaggagctctgctacgagcgagcttatgttgttctacctccactcgttgaatggatccgtgtatcctccgctcatgctgagtaccgccatgctctgctcatcgataaagacgacataatgcaagccgctcgtctgctactacccggagtggattgtccgccaaggttaaccatttccgaagaagagttaccctcgaagagacttacactgtccagccaaagtatagcgtcgtcgaaccactccggtcaaacgcaacctcttcacggatcactatcatccaattcatctgcatcaacttctagcagtaatattgtaagtaattcgcaatgaaatcaaagagtttttgtttcacaaaatctactaaactcgatttttgtgagagatagtcgaatagattttgcagcttttcccatcgttttctcccttttttcaggaggattccagcgaatgtggacggcgagcgacgtacgcgctcgcattccgtttgatgcttactggtcgtgctgagcttcttatccaggctctttcactggtacccccgaccactcggtacgatactttgaaccatcaagggctgacagctctaatggttgccgcggttcgcaacgacgatggagccatccaaacgttgctggacgctggtgctgatccgaacattgaagtacctgcagtgggatatcctaattgtccggccatacatccggaaacccaacactggacagcgattacttttgctgcgtgtaaaggaaactaccaagctcttcgaacacttctggaacgtggagcgcacgtggaaggtggcgccaggctgagcgaggataaatgtactcttacgccgctgcaagttgcaagtggtggaggtgtcgtggaagtcgtgtctttgcttctggcccatggagcacatgctttcctctccacgcagctcaaggattcactgagtttctcgggaagtgctcagagaggttgctacaggtaaaattatcagcattacagttttgtaagatgaaccactaaataaatgattatattgtagtgctatctctgtcgctgctgcccacggtcaaagagtgtctttgcgcaagcttctatcgcatccgctggctccaggaagccgtgaggttctatcgctggaggaaatgctagccgaaggtgacagcacaagtcgtacgcagttggatcgacaagcggaagtccctccaacattgaacaaaacacaaatcaaaagtcttcaagaggccatgtatcatagtgcagagaacaaccatttaggtaagattcaaacaagtgactatcactttggtcatgatattaaccttgtacttttagatataacaattgaactgcgtgctcttggagttccctggacacttcactgttggatgcacgccttggcggctgcccatgagctaaggctcgacgctgtcatcgatcagttgttgcaggacttcttgcaagtttgtcccgacgactacagtcagcagtttgtgacggaatgtctgccgctgttgttcaacatattccgttatagtaaagtaagtgattccccaaatcttttctatgatgtactctttcatgatcgaatatttttttcacagaaggaaggaacaactttactgttggcagacatcttcagtacctgctttggctgggaaccgatcaaacctattaaagaacccatattgttaccatcaaatggatccagaattgatcccaaattcgtcaacaacccagaactcagcgatgtaaccttcaggtaacatagactacaaaagcaagtcttaagtgaaagttgctcacaaatttgtattgcagagtcgaaaatcgcatcttctatggacacaagatcgtactggtaactgcttcgccacgtctgcagagcatgctgagctccaagttgaacgaaggcactggtaccccaacagttcagatcaacgatatccgctaccatatattcgaggtgtgtacgaagtctgcgaatacgaagtacataatttcggcatatctaacattttacgctttttatttacagttggtgatgcaattcttgtatagtggaggatgtaacagcctggacgtagctacgggagatgttctggagctgatggcggcggccagtttcttccaactggaaggtcttcttcgatacactgaagctcgctgtgctgaaatgatcgatatcgataatgttgtggccatgtatatccatgcaaaggtagatttgccaaaccaatttgactttgagcaaaataatcattatctgttttgtacaataggtctacaatgcccagaagctgatggagtactgccagggcttcctgttgcagaacatggtcgctctgctgacttatgacgattccgtgaagcggcttttgttcgccaaaaagattcccaatcacgacgtgcttaatggactgcttaccacgctgcaggttcgaatcaaggcccgccgaagtggggccaatgccccacccccaatggcggtgaacgcaatgcgacctgcatcaaacaataaagctaaataagttgactatgttgaattttgtatctgtttataacttttgactaacattgtcaatatcgaaataattttactaatttgtatatgtacaactttttgtagttgattagccatttagcaatatgttgaacaatatttatatgaaaaaataataatacttgtacattttgttacacatgaacgacaataagttaaaaaactcagttacacaaagcaactgttgtattttaaaacaatatgttagaaacattttacaaaatatttaccgacagcctgaaacagttttatactttggaacctatcataacacaataaacaataactattaatcccgcacatgagattactttcttaaaatgcattgtgaaactctcctatttgtaggtcacgacttacttaccagtcaggctaaggcctgggtggcctttgctgtacgtaggagacgtctccattcgactcggtccatggctgcccgtcgccagccacgcattctgcgaagggtccacagatcgtcctcaacttgatcgacccatcttgctcgctgcgcaccacgtcgtcttgtgccggtcggattgttttcaagaacaattttcaccgggttgtt

SEQ ID NO: 86 - DNA, 250123 bp, Aedes aegypti
  misc_feature (156688)..(157441): n is a, c, g, or t
tttcatatttttagtttagttcaacatttcagtgttcatttttttatgtttatctcttgctccaattcatttattttatgcaatctattatcggatcttataaataccatgataattaggaatagaacatagttaaaccacatatttaagaggaggtttcttttataagggtcagttattttatcttttcaaataaatcaggttcaacaacaatattgattggatttttttaacgtaaaatgtgtgttcattgaataccaatatgtatttatttattcatttctgaattttcatagcattgtacacaattaagtaacaacatcgactaaatcaagttcaaattatgatttcaaaccaaaatattccgttgacatcttctactttaaaaaatacgacaaattaattataatatcaaacttatgatacgaatcatgcatctaaaattgtatagtgcctcacataaatttattgacttagaaatatcatgtttggcaaaactccaatcactaaatacacaaaagatacaaaacaaatggccctattcatattcaatcagccaaattcttattcttactcttatagtgcgtacataattattaaatgaaaagattgccaacacatgggttggtaaaattatgtggaatatattataattaggatttttcaagcacggtattaagccaatatgttaatcttaatttacctaatgcccaggaatcgtattcctaactattgatcaaactgatccagtacagttttccgatataacgaagaccacttttaatatcttatgttgggaacccttcataagtaaatggatattacacattatttcaagccttatttcttaaaattcgactttaatattttattttccgcatttcaacacctgaacaataacccatacgtttgtttttagtagacttgtacaattatgatttagtttttttttctacaattgtaaacaattcctcattttttttccagaaatagaaagcaatcaatgaggtaacctcatttcaatcttcttaaaaagaaattgtaattaattgcaaactaaacaatttttttaaaaattatggttttcttcctccttttttcaaaggtgaaaattacaattaggtacttgcgattgtaaatatatcaacatatatgagattacatcatgatagcgataaaatcgaaaattctcaccacattgaaactgatgtgtaatttgtaatccaacattgatttatgtttatgagaaacaaatatttctcaaaatagtttaatgattttttttaaagaattgatgcacttttgtgcgtggatcacccgcgatgcactctcgtaattagaacagcttgtctgtctctactcgacacaccgtcaactatcaaattcctcatatcgtcaaccaaaaccaatcatcgcggattaaataatatataggctacctacagtttcgaatacgctctggtcaccaaaagtataacaaacaggacctttgttgttcttcttgttcttcatatattccgacctgatccttggttttcttccggttcgttcccgttcgggggacagatgatcattttcaagacacttgcacacgaatcctccaaaccttgaactgaaggtataatgagatccgtaccaacactcgtcgccaatgtagcagagtgaaaatacagctttaggttttggaatatagaatcacaatgttttatttactcttcctcctgtcatcgctctccagcatggcctactcttaattcatacatcaacacaatactacacaagtgtcggcataattttcctctacatagaaattgttcatatcaaatgaaaatattatatttacatataagcatgtttatatctcacaaataattatttatcatggtctaatcgcttatcaaagtgaatcctgtgacccaacgatcctccccattaacaaacatccctcccagtaacttttgtggagatgcaatggcaaacacggtctccaaatagcaaaggttacacactaacattccttcccccaatcttacctgactgcaaggacgtggccggcgccgttattgaccatgtataaatagaggcactgaattatgcacactgaaaaagattaggcggcatccatttattacgtaacgctaaaattggaaattcttgaccccctcccccccctccgtaacgctttttgtatgaaaaatttcaaatttttgtatgagccgtaacgctgtagcctactccccccctccccctagagcgttacgtaatttgtggatgccgccttatggccaatcctagccgaacttctagttgattctttgtgcattttcactgacttcggctaatcacggaatagcaaccattgatatgtgtagtcagtctaagctaagctaatttgctcgcctcactagtgattttagtattttattgtttgcaaaaaagttagtgttaaagttcaattagcagttttttctcttaagaatttcatgaaaattattcgacgaaattgcaattagatctgacttttatccattcaattaactttcctacatctgactcatatttaacttcccatttcctctcttctttttccagtacgacaacgtcaattcctgtctcaccgttctgagacagcatcaggttggcggtctcgagtcggtcaccccaaacgacatctgcagcggccgactgaaagccgtactctccctgttcttcgctctgagtaagtttcccctagtttaccaccagatggattgcgtcgacattgactcgcgaattcaccactaacgtcgaattaccttttcccctcaacacaggtcgatataagcaggcgaccaagcagaaggcagcagctgccgcagcaaacgcagcagtgacatcaaccaccggtttcattgctcaccaccaacagcagcagcagcagcagcaacagttgcaactacagcagcaaaccaaagtcgaaatccatgcacctccggccgacatgacgaaccggtaagtggggtgaattttgaatctcaatatttcgaatggtgggtaaggaagtttggtcaattttactgtagctgctcgatggataactagatcgaaaactgggcatgttgaatgtcttgtgaggtgaatttgaattgtgtgcgatataacgtccagtaagagtcgagtagttgttgcaccacatataatctgataattgattgaagttatgtgttgattgcttgtcttcgccaatcaaagcaactcaataaaagcatgttatgaagtgttacttctgacaacaatgcattccaatttagtctaacaatggaccaataatgatcaaacttctcccccaaaagtcgcaaaccataaacgataatttgatccccagacgtataccggtttgtctcaaattccgaacagactcatattccgaacactaggtttttgtatcgcaatttggttgaaatgtttcgctgaaatatgtcaccaaataacaaggaaatggcagtcatttgcaattcaattttaacctttccattatattatttactgcgggagtagtgctgactctcgagtttgaaaccagtagaacaagctcagataagtttatttgcgaaattattcatttgaatacgatttattcgtgctgttcggaatttgaatcaaggtgttcgaaatatgagacagaataaacacagtgttcggcatttgaatcaaaatgttgttccatacttttacgtaaaaacaatactaaaactaattaaatcaacataattattggtacacccaacagctaacagttaggctttgcgaagaaatcaaaaggtacacaaatatcagccaatttatgccaatcagatgcatttcaagtcactgttagccttaagtgttcggaatatgagtcaaaacggtacatcgataaacgaattcaatgcctactgccttcatcgttgtcgtcttcgtcgtcaattcatggggagaacacatttagctccccctaacagtaggctttgagactttgagttctttacccaaacattctccccctcagttcatcgaaaaacgtcgtcattttcacaatagttgttagaaccagaaacaacaagaaagacacccgatcaaaatcagcgggaaacttgaatgcataagcaatcgagaagaacagacagaactgacatcggaagaatcgtttaccgacacggtggaaaccgaaagaaaaacacttgccccattccaccacccctgtacagtttttgggtggaaaaatcgttatccttcgtgtgtttactgagatgcattcgcagaacaaagaatcaaacagcgtgacatcctatgatgggtgggcatgggtgtagcgaaggggggcagccccttgatcgatgaaaaaatatcaaatcattcctaatgctaacaagactaatctcatgttaaaatgaaacattttattggatatatctcaattcaataaatgtagcatgggaagcttctttgataacagttggagttcaccaaaattcccaatagatcgtttggctttggtatctgtcaaaggatacaaactctagtggaattgaatggtataacaataaattcgggtttttcatctaattatcattactcagtagataaattaaacctggtctcatttttcaagaaagagaagcacttttcacacaaaaaattatatagttatacaaaaagtgtcaataatagtcgtttcattgcgtaaaaattgtaaaattatttttatggtcgttggaaaacctagctacacccatgacgggttaggaccaaattcggaaaagcagctgcttccatttggggacaaacggacaacagccacccctgacgatgaattgggataatcgagtttctgttcctccccagcgctggtttgttttcccccctgaggcactttccaaccttcggagggatggttgggggttaagctaatcagactacggacggagggatgaagaatcatcacatcagcagcgcatcaaagtaggcacacgcagagaagtttcgaatcgagtcgtggagggggtgttcttgtcggaatgaaattcgataaggcgatataatggtttgttttatctagtttgaaaaacgtttgggggtgacaaacaagcaattaggaaattcgatttatcggaaaaagttgtctgcatcagtgttttaatagacaaaattagctagcgtgaatatcggggtttgtttccgattaacatttgcaataattcacctacaaattgtttattttgatcccagctgacgccataataatccttgggctttccgaccagctatgcgaggattttaactatctccacaaccggaagcagcccataactcaccgcaagccatttaaatctcccgttgaggtcccctttcggacacgttttcgctctcactttccattcctcggaaaaaggacgcatttagaaacacattttccatcgttatttacacacctcggcttcgagtttaaaggaccagtcagtgagcggaacaacaccaacagacaaactaatagaaaacacccctcatttgtaataaactttgagaaccctctcccagtcaatgttgtcggtagtggcgtgctctttccatcgctacttcgctgccaactgtcagtgacagaacaagcaccgagcctagtgctgctagaattaggcaagaatttttagcaccctcttcgtttgggccggtgatttccctttcaacccgctatggtacggtatcacgcgttatcctttctctccagcaaaacaagaatagaacacaaagtgggcgcagtttcaaatacctgccacgagtttgtttatgaaactcacaccaaaacacggaaactcagcacgccggttgcaacacatgtgacacttgatttacgcacaacatacaaaataaggtttgtgaagatttttcaaaaaacaaataacaatttcacttcatttcacgacagttatgttatcattaggaacgaaatgttttgcagagtttctaagagaaagagagatcattacatgacatcacatttgaatgcacgatggtgattaacccctctaccggcagcttaattttttaccgcaataaaaatattcaaacctcgctaatttttttgtttctcgatatttttgcaccattttttcacaaattcccaataaaactctcatagtttaagactccatgtcgatatctatcattggtgatctggttttaaagatattccgatcttccttggggaccgacattctccatataaaatgtctttggcggccattttgttttacgtgaatttatcaaaaaataggatttgggctatacaaagctgagtagtatggagctactctgagaaaaaaaaacatgcacatcggataagtattttaggagatatgtgaaaattgggatatgatgttttttgaagtttttaagaccattatttggccagcgtggtatcagatacctgaatgctgaatactcaaagacggatgcaccaaattgctccattttttcaaaacatgctctcaatagggcgatattcaaaactcaaaaggcaatagatggctctttttcaatggtagtaaaaaccgaaatcctgaagcaaagaaagcaccacggaagatgaactaaacacaaaaaattatgtattcactttacacttgatttctaatcactacttttttgattcagtttcctaattgcaagcaatttacgattttgattattttccatacgttttgacagttctcctactaccattcttccatgcgcttgtgttgaaagtttgagaaatttgagaatccagcgtagcgcgatcagtgagcggaatacaaacatcagtgtcgccgctcggcggccggtaagagaagctgaatgttcgaaaggttgttgtctgtaatttttgtcgctggcgccaactgttagcgtttgagaacaaaataaacagtcgttaccctattatgtattgttccaaaaagtgaatatccgcatacgatgaaaactctgtagcttgagatattaacgttggttatagctacgcgtcggtcccccaagaaattttggaatatctcaagatccagttgaccaatgatcaatattgacacaaattctaaaactagaagagtttttgagaacttgtgaaataatggtgcaaaatattgagaaacaaaaaagatatccaggtttgaatgcttttattgcggtaaaaaattaagctgccggtagaggggttaaggtgaaacagtttggaatcaatttctaagattgcattaaaatttcaaaggcacaaatcttgcgaaggaagcatccaacaccaataaacttcttattttgactttgtgcactatcagaaagcttaaaataagaagatcagaaatgtttgacaactatttccccagcacaagtcagccattgtgacggccatctttgtattccaagatgtttcaccttgaattccagaagaaatttttctaaaatatctggaagaatcgcaggaggagtcctttggaaaaggattaagatttacttgataaaatataaatgaatcttttggaagtttgcctaataattatctttcaggtattcctagaaacttttgaaattctgtgatgtagttcttgatcagggtgtctactacctggaaaaacctggaaaacctggaattctcagggaattttattcaacctggaaaaaacctggaattctcagggaatttcggctataatcagggaaattattttggatctgtaaaacaaggtagaatatgtccttttcgtgacagaaaatcttctcaatcataaaaattttcggctgcgccgctatcaagacgctactaaaaatattaagtcctaactttttaataaagattttatttatcccacataaaacataaatttatgattgcaaagttggtaaaggcaagtacagttcccatttacagttgggtgtcgttcataagcatatgaaacttggtgggaaacattcgaaatttatttacaaaaatgtttttcgactattccacaagttctggaagaaatttcaaggaatgcttcagatagtgattctttctgaaataccattatgagcgtctccagggatgctgccagcaatttttcaagtgatgcttaaatgaatgaatgaaaatcgtagagaactgcaacattattacctcaagtaattttcacatagattactctgaaaaaaaaagacagcgattatcaatcctggatttcctccaaatctttttccactgattcattcaccgatttttccagttgttagttataggaggttcattcttttcacgaagattcattccatagtttcgatatttttgcaagaaatcctacaataattcttgcgtcgtttatttttcatttttcacatggattctataaaacaatcatccacggttactttcagaaattgctccgaaaatttcctaaggccttaatgtttcactctcggaatcgaaagatgaccggcagaatggccgacttctccccctactcacgttttcaaaggcacaaacctggagaaatagttggcagacgttcctgatcttcttattttaagctttctaccagtgcaccaagtcaaaataaaaagtgcgctgttgtgagatgctttcttcgcgagatttgtgcctttgaagtttaagtgcaatctgagaagttgattccaaattgtttcaccttaatccgatgaaatcttttatgaacttttccaagaattcctcaaagaattcgacctggaattcctcattaagtttagtctaataatttttcaaaaaatatttccaaactccgtgaattctccaaaacttcattgaaggttccacattagttagctattctaacttgtgtatttttctaattgttcatacttaaatttcttcagggagtctctttgaatttgtttaaaaaatcttgtagggcaatattcagtgattcagtgattgattatttttcggttatattagcattttgttaagaaaattttgagaataatttcatcaagaatgcaaaagtgcaaaaatgcatattaggactcacacagaaattttcttccacgcggatttttctcaacatatccttctaaatccttgacatttccatggagacagctatagaagaacgactagatttgtttgagatttctttggaaaattaaaataatacaggaatttctgaatgaattttgaattgcgaagatgctctaaacgggaatgtcggagaaaatcctagggaaatcaatggatatatttcttgagaacatgagacttcctttgaaaatgtctccaaaggtatgaagggattcctaatggagtcatcaaagtagtttctatggttatcctcataaaaacttccgattgagttcttgaaggtatcaaaaactaaatccttggtagaatttcttatgaagttcatgaaaaatcacaaaacaaactcctgaagagattgttgaagttatatgtgaaagaactccacggtaaaacgagcagtaatacttgtcctaatgtcaagggactccttagaattattcttagagaaatgtctgttcaaatgagaaaccaaaatttcatgacgtggttcatgtcgttttttattatatttttagtcgtctcgtccctttttgtttttttttttcagacgagaggtatcttaaattctctgaattcgaaatcaaacgctatcagacccaatttccccaagatatcaccttggaaaaaaatacaaaaggccctctaaagaaattaggtgtatcgctgatgtccatgattcagaattccattttaggggaaaggtttttcccttaggttcgaatagactattttctacatctgattttgatgattgaaggcactttcagatcattcgaaaagaataattattttttgtggaaatcacataaaaattcccaatttttttaattatttttttctaatgttgtttacacgtttaaaaaaactgaaaataatttttttgttttgaaaaatactgttatttgagtattttttgtttaagtgctttgaaacacctttttcaataagtttttagtcatgtgaaatgaactattcatcaatcatttatgtttcttggagaatttccagaatttggaatcgttttattaaacctggaaaacctggaaatctcagggaatttcgtttctgtaaatgagtagacaccctgttgatgaaatccttaattgcttggagtatgtaactattattcactttggattcttaactttggataataattaaaaccatagatgattctcctagagaaagttttgacgaattgttttcagaaatttcccagaaatgtttgtaaaatataactgctggaatctagagtgaagggatcgctgcacaatcagaaaaattatcacgatttttggattcttagtggaaacatttggtggatgaataccataaggtttccctagaagaattcctggaagaacctatggaggaatccctatagaatattcaaaaggaatctttggaacagccttcagatgaattcctgaaagagtccttgatgaaaatattaggatatatgggataattttataatttttttctcaggaaactgaattttattgcaattgtactgcccataatagcataacagtctctatacggactttcaacccgaatatcaacagcaaatcgcgaattcttatatatattttgctgatcaatagatgcaaaataagttatcggtggtacttaaggaatatggcatacaaaaaaggaccagaaaataatgaacatttgtatgagaagacaaacttcaaactttaaactcaattttctcaatgccatatgggacagtcatgcctttattgacagtatggtaataatgtactgaataatctactgaaaaggtcgttaacgaattttgtatgtatgatgatatttttttatatatggcatcgttgcagaaaaaacatcgaaggttccttagaggaatccgtatagaaatcaatggaaagttctgataaaaatttttgaagaaatcttttgaaatcctagtacatttttctgtagaattttttggaggattttgtttgaaaagaatatcaagaaacttctgagaagcgaatgttctcggttttgttgtatcctactatgaattctgctaaaatgtgaaaataccttccagcaatgtttgggaatcttcattttttccttgagaaacctgaccagaattccgttaaagttttggctaagattttttttgagaatcctgctatacattccttctgaaaattttgctgacagaaacatgttcttcaaatctgtgcgaattcttctcaggtctgtgtttaaatcacactcatgattctatggaaatccttatcaggattctttaagaattttgtccataattcattcctttttcgaaaaaaaaaacttgataaatttcactcatgtctgacaaaagttgtggaaaggaaaagccttcttatagatttgtaaagctataaaaataatgtaaagctatacaagcttgaatgatgtctatattttcaacctttaggaaagatattcaaacaccaatcaaaattaaaataaattatgtgacataataataaaattcaaaaaaatgtatacttatacataaaaaaaacagacaaaatcaattttaggattgccctgtttgatttcagtcagtctttcttatatatattttcaatatttttaagtgtttttttttaatattattataaatattttattttgccgtctttattgcagtaaacctaaaagaaaaaaaaaattccgtaaaaatctttagaggtatccttaaacactcggagaaacactagtccatgaagatttatagcaggcaattatggaacttcaagaatttagttatgagaaactcgtgagaaaaattcttaaaacaaatcatttggtaatttcttgacagaaaaattagaataaaacactacgctagaagcaagaagtatccttaagagattttccatggaaaagtttctgaacgaatacatagtgggtttatcggcagtactctaggagaattcgctgggggatctggggaacttgatctgtttttggacaaatccaaaatatattccgatatattttaaaaactgaaaaaaaaccgtagaaaaatctgtagacaattatttgggagaaccaactaaataaaattgctgagaactttgttaagaaattccttatggaattaatgaaggattatgtccacatagaatccttgaagaaattgctttataaatatttggagttagttctgtttttttcacgcgtttaaatggatacctgtgagatttttatagagcattccaagaaattaaggactgttcattttattaagtggacaccttgtgcatgctgtatctttataatttatcaatgaaatttaaatcgattttctgcacttcaactagtattgtataatgttgtgaaaataaaacttctcccaaaataatttaatttcacacgaatttggaacaacgattatattggtcgatttttggtggctatcaaaatcaatggctgaaaaattcgacaatttgaattttttattaaaaaaataaggctagttcttcgaaagtagcatcaatcagaagcctgatggaaaaaatcaagttatttttggagcaatcattttacagatataataaaataatttttcccctataatttttagaggaacatatttgaaattgaaagagaattgatataagtagaattttttggttaaaagtatatcctgacggaagtgctaatatagtattaatatgaaaaataacttaccgtttcatagaattacttatttagtccccacgtcacatatgaagcacattagaaacacaattgctctattcgcagaagacctttcaaagtacattgacaatcatcaaaattggcaacactgctgtaattaaatcgattttatttttctcatattattttcataatatgtcattctgagattaccaattaaaatattcggagaaaaccgtttacaatttgctgtagatcgataattatgcgtacatgattttaaaagtatgagactttttagtaaaactaccataaacagtaacatttatacttaagacagtggtttaaacttatgatttagctctcgtttatacgttttcaatttttaacgaagagaaatgtcaattgaaatcatcaaatcatgaagcatgtatgctggaaccatgaatgaaattcatggaaacataagcactaattcatggatttagtcatctgtcattattgattccaattttggtgctgaaaagtggcaagttgagtcatgaaatcatgaagcaggatccctgaatcaagaactcaattcatgaaaacgaaacattatacgtcaattaagatcccagtttatatgtaccattggtagacacttaatattaagaatgaaattgttactgtttctgggccggtagttttgtaataaaccgtgaaaacattccacaaatgtcaacctaacgagtgcaaaatctttagctggaacgcaaacattcggtggtaaggtttgtacgcaaaatgttgtttcgtgcatcaattgaattggcaaatggtccctgggctgttggattgcatgagtggaaagtggaacttgaacatccggctaccgaaggccttttgtgagctgctctgttataagacgtgaggaatgcatcacttcagttaacatcgccgacgagcttgtcaaaaaaaatcttcgctcgaacccaaacatttcccggttctgcatagtcaggatgaagtaaatagagtaaggtggggcaaaagttcgaccttagtggtataatcaaagtttccagaataacattagtagttgaaacaaaataaataccatacaatggaccttcatcctattggctataattttgcagaacaaacttgtgtcaaaatatttacccatttttagttataacagtttcaaaattgattgtcttaaacaaacttttgccccaccggtggggtaagagtttgaatctagtgtggggcaaaagttcgctggctaaaacacaaaatatcgatacttttatgacaggcatactttaaacaagccaaaaacttaagtttgccgaaaaatacacactaaatttttatcaaaaagctgcctaaaacatggtgaattgaaatatactcaaaaatagcagtttttcgcaagagaaagtgaaaatgaaaaattttggtgacatttttcgcacgatcaggcagattttgctaaaattgaagataatatgtggatttcaggcaattttcattttttatacatgggtcgaacttttgccctgcagattcgaacttttgccccactatgggccaaaaattgtttccaaacatttatgcaaaaactaatacagctcaaagcatccttatgataggcctagaaacgcccttacataaaatattgaaaaagattttatcttcatttggttcaatgcattgaaaatttgactaaaaattacaatattcacgtcgaaaaacaacaaatagccataacttttccaaatctcaattggtttttatgatatttggagtgaaagtctcttacttgaatagcattcgaaccaccaagggatttattagaattgttttgaattgagctagaaatcttaaaaagaaactcttccccactcgacagtagcgcaaccagaattttgttctagggggggttttgcaaattttaaaatacttctcgagaaatcaacaactacaaagaatttaatttgaagaatttagaaagattacataaataagtatgattctatttagaattgttccttaaatatattttcgaattttcaatgagaatgacttctagagtaatttttaagcgcagcaatttgcaatatgaatcttgacgcagtaggtcgaaagtagatcaacattgcaaaacccaactgccggtagaaaattatcacttcttagagaattggcaatcgaaaaaatcgtgtctaaaggtcaaaaatgagtgcttcttcattgtgaagaatttatgtccaaatatcttacaattttcaatacgaccaataaaatttgtttttggattactttgtaatccgatttactattgaagtgggacgttaatgcatccatatttctaatggaaaaatccgtgtcacattgtttcaaatttttttgaatttttttattttcatgattcacccaaaatataaaaaaaattcataatccacaccgccaaaatcatgaaattgctgaaatgcttctaccgaaaaccaaataaatcgatagcattcgtagatatttaatttccgtaatctttaaaaatcaaggaattctgaaggttgcaaaattttgcaaaatgttaactgtaagaattttgatattttagatgctagacaaatgaaaaagttccaatatatctgaaggtttgacaaactgttgacacaacgcctttaatttgtttgtttatttttaaaggctagaaaattttatgtttatcagcttgttgtagtaataattcgcaatttattttatttttatcgaacttcctgtagagcttaagaattaaaaaaaaaacacaacttaggagaatataaccatgaaaaccactgactttcccagttttaaaaagaaacaaactaagttactgttctgtagttataagatgtgtagtgttgaatttcaaaaatatattggtaagtcttaaaattttttgactctggggggggttttgacccccaaaacccccccttggttgcgccactgccactcgaactttcgctccactttactctacattatggaacacccaacagctccggcagattaattgtgtcgtgaagcaatgtaagaactcacgagaatttcgccaagaatgtcatcgatatgatgacaaagttccgaagaattcacactttttcaaaaacaaaattatttttataatttcactagaaaacatcaccgatcgccatgaggcacgttgacaaaggtgaagaaagtaacagttggattcgtgtaacgccctgagcataagaattgttgcataatagtcacgaaatcatgacttttagtaatgatatcatgaacaaacaattttatgaattcatgacgttttgttcatgaatccggcaacggatttttttccgtgtaggaacagaagttagcaaatgctaatataattcaaacatgttccaataatggaggaattgatttttggaaagaataaataattttatatgaaagagaagcataaaacgagctcaccaaatgataattcatcgtcgacagggtagctccaaatgactttcaatttcgtcactgacacgactaacgaatacagactcaataattcaaaagtctacattacaattgaaattcgctttgtgattttgaagttaacttcgaagaaacgatacttcttggctactgtcatgttctgaacagggaaaataaaattctttttttttttcaaattcagcgttagtgtgttagtgtgccgccgcggcactgccgcgtctttcccgaaaattggtaagggcaccacgatgttagaaagtttaaggaacctctggtatatgtaaatctctgtcacgacgatacgcagcaatgttcaactttttgtccactcaaaaagtaaagataatccaaattaaaagaacatttattgaaccaaagtgttgttgtcagctgtgatctgatttgacacattaaattcccatttgtaccaaagcctactgcactgaaatagtttgctgatttcgtgacaattgcacattcttcacagtcggaaatttccctttccctccacacagcatgccatttcaatgatcatcaaattctcccgtttgatactcagctcagatgctcggaatcagtgtttacattgaaacggcagccaaaacagagagggtccggcttccacagtaactaactcaagtgcgttccaccatgaattgaaatcgtctcttcgtgttacgtagcgataggacaaaaaatgacaatgcctgctacgatgagcagcaccctcgccttgcggagtgggaatcgcagcagtcggtgccactgttgatgatgatgatgcattgttagaggaaaattgaaatcttttctcacatttacgacgatggatgggaaatgggtggttgtaaatgaactgtggccaacgcgagttagctaaatgaatttttgacgacttgtttttttttctccgcagaaaaatatttccataaattgaaattcggtttcggtctcataagtcacttaaatcgttttccccccgggacggacctttcagtttggggaggaaaccctaaattgatttatttgtaaactacgaaccatcatcaatcttaatggaagaggcacatcttaaattattcattgcggccaccgcaaagaccacatacaacttgttttcggttagttgttttcgaaatcaagagattaaaagccttggtggagagcaaacaccccaacccaagtcaaacacttactacacggaaatagtagtttacggaacaagttgcagaatgatgatttttacagcacgagtcgtaaatttatcctacgaggcttgccgagtaggataattacgacgagtgctgtaaaaatcgagttctgcaacgagtttcgtacaacattttttgcaatttcgtagaagaccacttgagggtatcagaaataaaatcggaatgcattcaccatcatttaacaatttctgaaaaatggttttgtaatgattcattacgcaactcaaaacagttgcgtaatgagaaagcgttgcgtaatgaatcattacagcactggtttcagttgcgtaatgactattcccgcactgcatacttcagtgcaggaaagtaggccgtttcatgacagattggcgtgatgaaaaacagcctattacgatgagaaattgcaaaaagtaattttacaatctttgacaggcacgtgccctttcttaggcctgctcaaacggagacatctatcaatcttaagaatcctaagatgctgttgcagtaagggaacacccctttgcgtaggtaatttaatccactggagacatccgaaggcacggaacgattcctaagaaaagggggtgccctaaccggtcccagcctgcagtgttaatgatgacaaacaatccatcgctgaacgtactttaggtacacacccgaaagtgattttttatgaggtatcgtctgatatttattgcaacaatactcaaatttctccaccgaaagaaaatcgataactagcagaagcgaaaccgaacccctcgattatgaaaactcggtcataaatcctgatcgagacccattagagtacagtcggttacatctttcacccggccaacttgcaggagtcaaacaaaacatgaacgagcgcttttagggacatcattttcgcattttgcgagggagagaaaacaacggtcgccataatggtctgcaggagacgacgaagatttcaatggctggtgcgtgtgcatcgaattggtggcagactcaccgggaaactcggtgggaagctgccaagaggcgagtacgtgagcgaaatacttccggatttttcggtagtattagtagagtattggctatgaatttgaagggagattatggaatcagctttcaatttcaaagtacttacaatattcgtgtctgcttaaaagaaacacaaatgatttaaaaaaagaaagcttcaatgataaaatctcttctggtaataattttaataaggcaaataaaaatactttagatccctatggattgattgaagaatagctagaagtttacattcttcatccaaattcttaaaaatccattcaagagtagtgtgtggtccttggaatccgtgcaagttcctgtggggcgagcaacggaatcaagatcaatcgtgtccggatcgctttgttcgagtgcgaaaagattttcgtgttcagtagaggctggattgccgactggtgagctcgtttcatgcttataataaacatttttatcgtggcaacgttacgtttatgtcattttcaaacaaactatggatggttcgtcactataagacccttattcctgtttcaaatattttaaatatccacatacctttcttttatcgtcattactaactatatgctttgaatagtttgacattatgaatgacgacgacttttttttaaatattctattctatcttctatcttttcaccgcgacacaaaaatgcaaaactagttttaagtgacagtcgtatttttcctccttaaccatgaatcgtatcatccaaaggtaacttccagatctttctcctacctcattaataaacacccttcctatagtgaatgtgaatatgcagaggtattctcggtctctgtaatcaacaatcttcacacactaacattccttcctcattagagtgatgcaaattttgaagttttggctcccctttgcttaaatgatttttattatggtaaagcatcttcccaaagtttgaaatgattcggaagaaatttgactgggcacacgccatttgaagtttatatggaaatatctcttcgtcataatattttatgtcaaagacccttccgaaatgggatgcatgaatgttcagaatggccttcaggaatgatgcaagagtaatgtcagggaagtcctttggaaatttcgtcggaaaattaataacttcattgtttttcgaaattcttccagaacatccaggatttccaaaaaaaaattgctggggtttatatatgttttatatgaatcaatccaaaaaatccttcagaaattacctctgtcgtcaagatataattcaaatatatttttcggtgtttctacattttttttccagttacttctagaagttgcctcacggattttatgtactgaggaaacatcgcattccttcagaattatcttaagagatctacaatttgttcaaaagtttcctcctatgatctagcatttctcataattatcctggccgttgcaacagacttgactatttcagattatgtttaccattatttgaatacctttaccaagcttttaaccaaaaatatctacagggcatggggcccttccttagccgagaggttagagtccgtggctacaaagcaaagccattctgaaggtgtctgggttcaatgcatcgagtatcatcgtacctgccacacgatatacgaatgtgaaaaacggcatagaaagctctcagttaacaacagtggaagtgctcatcagaacactaagctgagaagcaggctctgtcccagtgaggacgttaatgcaaagaagaatatctacagggatttaacatatgtgacttttctaaggattcgttttggaatggactatttatgtccgaaaatccattaaaaatgtcttgagttattctttcaatgtacttatttgaaaaaataatcgagcattgcagataccgattatttgataaattcttaaaaaaaaattaattagctattagctattagttttagaatttaaaaaagcaaattttattctcatttgaaattaaagttcatgaacattttttattgtaaacgttaatgaaaaagtgttcactatattttattcttttcaatcgcaacgcagcaaacaaatgttcatcaaacaaatttcagttgtgagcagaaaaactgcttctgaacattctgaagtttcggcaattacgatgacgggttcttgaacgtaaaaatattaccaagttaattgagaaagcttcctcaaataaccttttcgcaaatcttcatgtttttctcaataaatatttccacagataaatatacgattgtttcctggaagcaaataggaattcttgatttcataaatacttccagcaattccttaaccaattttccctcacattttttaaagtttctcaatagtttctcgagattctaattatttgctttagtaaacttttactgtgttttttttaatgttgaaacacgtttttcagagaattttacaggtaaggtgctcttacacctggattagttctagaagaaaagcttgatcgaaaatttcacgaatttaaggatttaattgtctcagctacaacgtagttttcaaacgaaatagggggcggaagggacattccctagaagaattcttgaaaggactcataatgaatttctagagttattctagtaaccatttgttgaggaaatctgaggaaaaattctggtagaactcctgaaacgtttatttagctcgtatgtgttaggtgtgctgctgaccaaatcgaaagtttctgccctgtcgacgatggactatcaattgagaaattcaacttataattcatgcttctaagtgatattcaattattcatgttttttgtcggcacaacagtacgaatgttagcattcgcccatatcaaatgatagaatggattcataccgggagcattggagacttaaacataattaagagaatttggctcattctggagagccgtggttgaaccttggacttctactatatattcacagagatactttcaaaaacattcattgagaatttattaaaagaacgtctccatattttcatttatttcatgtttatgtttttttttctagagactgttctatggattctgttttatgttttatggatcctccagatgctcatccattttaacatcgttttgaaattcgtccaaattatcgcttaataattcctaccggatttttttcggaaactcttctagatcccttcaaatgtttttcctgaaatttattagggactttctccaaaaaaactcctttgatttcatttccgactagtttaccaggcactgaagcgaactgaaccgagtgaacggaaaaagatcagttcactccctgttgtgcgacaagcgtcgttcctttcgtatctttctctctcattcttcgtacattcttccccagaaactcacgatacactcggtcgatttctcctatcggaaccaaaaggaagaagcaaaatatgtgcttgccattccagtgggcactttttctctctatctgcaaatttgtctctctgtctgtggcgtggcgcgtaaagcaatgcacgtgccaagcgttataacgttatatataataaatccgagaaacgaacgaaggagaatagaaaagaaatcgattcgttctttttccagatcactttttatctgatccgtgctgatcaaataaaccgactctcgccaaaaaagagccacggatcacttgttcttttgagtgatccggatcttctgaacggctccgaatctctagcacacactgtaggcctcagcgcattagattttttttatttaaaaacaaatctttacttttgaacagctcaatcgatttctaatctttttttttatagaatgaaaaaatataagaccctgaaaatacttttattacatgaaaaaaaatataaaaatttctggtttttagcaaattttttaaatgttttcatgtaaaaaaatgtaagaaaaaatcagagtttcatatgcttttttctgaaaagttgcaatcttaagctttcattccataaaaaatattggaaatcggttgagttgttcaaaagatatgatttttttaaatcaaaaatcaaatgtgcgaagacctatagtgtgtgccgataaaattgacggattttttttaatattttttaatgtaaaaaaaaaattgtgaaattttatatttttttgaaaagtcaaaatctttagctttcatttggtacaagaaatttgaaaatcgttcaagttatgatttaaaaataaaaataaaaaatttgcaaagtcgcgtttttattggtcattttattttggaaatcaaaaaatcaaaaaaaaacacgtgtatccttatttcggataaggaacaaaattgcaaattttcatggacttcggtgacccactagatcggtttttcatggaatggctttataaataactcttttttttggagactcctccggtgattcctcctaaaatatttccagagatgtttctggtatttctccataaatttgacaaatcgtcgaaggactatcccatagattttttccagagaaatatttacagcgatttctccagcaaaagctctacactgattcttccataaatttgtctagggatactccagggattgctccaaaaatgactctagaaaaggctccaaagattccttcagcaatctacccgggaaatccttctgagattttatcagcaatttttttaggaatttccccagagattacttcagaaaactctttttacgatttctccaaaagttgtactaagaactttttaaggaatttcttcagagattttcctaggtattcgtccaaaaactctggcataaatttctccagagatttttccagagatttccccaaaatgttctccagggattcttctattaaattctgcagggatttcatttttttagaggttcctcaagggattgctcctggaatccctacaagtatttctccaggaatttatttacgaatttctccaaaacaaatcctattgggaaggagtttttggaaataatctcgagggaagaactcttggaattatttctgatgaagttctggaggaaatcctaatgaaacctctagagaaatttctagctgaattcttggaaagatccccggagataattttgaggctcagaacaattctctacataagcttctagggaacctgaaaaaatcttatatgtaatttctgtagtgatttcgctaaagctatctttaggagaatcactggagaaaactcttgaggaatccctataggagttcatgatgtaattacttgcagaatctcagaaaaaaatcctgggggtccctgcagtaattcctgatagaatctctgtagcaatggttgagaatccctgaagaaatctccagaataaatcctggaggaatttcgagaggtcttccagaggcataccctgaaagtatcctctaaggaatttctgatttaaaagcattaacgcgtcggtgtctttttttttttgaggaaatatctgtagtaatcttaaaagaagttgtcctagtgtaaaccttggagaaatctttggaggcatctgtgcaagaatccgtgaaggaatatcatgagacctcacttgaaacatgtctgaaagaatctctggaattatccctaaaaaagttcatggaggaattcttggaaaagtatcttaaagaatctcattaaggctaagtagcccgtcattcgttttggcaacaatgatgacttttcagcatgcatttcaaagtgataaaactcagtcttgatagtttatattgacttgaaaaagaatcactgtacgcgctaacatgcataaagtatgctgatactttttcagctatgtcagtgcaaaaccaactgattatctttgattcgaaatcgtgagatgaattagcaacaatcattaacgacgtgtacaaatttcaatgacggcctacttcgccttaaaaatcttaccgaagtgaaatatggaataattacttgagactttcccactggagctctttaagaaactcgtttcaaaatctctagagaaatccctatagaaattatactaatgtaattacacagttcgcgcaaacattaatgcaacttccacaaatattcgtgcattgcacgcgttgtgtaatcaatgcttaaggattatcgctgagagaaatcatctgactgagtatctggattttcttgaaaaaaatggagaagaagttagaaaagcattcacatctaaatcctgaaaatttcaacacaagatgaaatgccaggaggaagcttttcaaactttttaacataaaacccaaaaactttttcttcatttttccttagtagttcttctccctattattctgagcattttccgagaattatcttattaagcttgtccagagattgtaccgcaatcaactagttcttctttttcttccttagctgattagctgcaaaatcatgctgaaggcttatgattctttcataatggttatttataatactttactggacgatatacgaatgcaaaagtgacaaattcagcaaaaaagctctcagttatcaactgtaacagtgttcatataatatttagatgatacactagctgtgcttcagtccccaattcaaagaatataaactagaagaattttagttttccaaatcgttaacatggacatttctttagaaaataattcaaaaagctacaaacagatatgcttttggttgggtttttgagctcaatcacaaaataatcgtaatgaatttttgaatttcaaagcaagtaaagcaagtagcaaatcagcaaaatttttaactacgtttgaacaaaatcacttctaaaaccatcagaaactgctcatcgatgtagcatcatcttaaagaataaccgctcactcctgagttccttcacctcgcaacaagatcgaatttcccttttctgcgcactccaatcattgagtcgcgctcggctccgatgcaacatcccgtccgtcactcctcggcaaacacgagtgtcacccagaggagtgcccccttgttatgttgctacgcaacaccctccgctcgcgtttgagtacggtttgagttccattcgcgcgcgtgccatgaagaaaaacgtgtgcatccagagcaccaccgcttgctacgaaccgaggctcagcttgccggttagtttacttcggtacgtcatcgcgttcgcatgcaactcatttgtttgaacgaagttggtaatcatcgaagcaaccccggcactgtgcacaatgttcgcacttggcggaaagggtcgcgcgcgcgtgcggaacttcctcgctgttttaatcctgtgacgacgagtcgagtaggaaacggattgctctgttgaatagaagggggattcgagggaaagtgttcttggaggatcgcgagctgcgagcggctgaagccatatggtgctgttctgagtgattttttggcaatacaagcattcgttcggagggagtcaacgagaattacgcctcgagaagtgtgtaatgtgcagcgagtgcttcgcgaattctccgcagctgcgatagctgcggatcagtgaaattgattaaaagttcaaacaaggaagcgcgaaggaagaaccagagagtgagctcgcgagaagaaaccacagctgtaagtgcgcgcgggtcgaaggatgaaggaaattaacgcgaaccgctataaatcgccgcttttgtattgttgtatttaaatggatggctagctggctggacggttgtttggtggatggccggtggatgaaggcttaaatgctgcacgctctcgtcgtcctgcggtggtgatttatgcggcaaatacaccgccgccgcagccatataatgggccacggtcgcgtcgtcgtcggctttgagggtggcaagtgtgggatgtgactgtgactgtgtgtggcgggcgggcttcaggacgaccgacaaacgaggattagttgtcgtaaagctccgagagatgtgctgtgcaaattgttgctgggtgttcttagacgctaatcacaacacggtgggcaagctccgagttgtggagacggaaaagttggatgcaaatgtggcgtctccttcgccggtgacgaaagagtgggcggctccggtgtttacacacataggatcagtgcactgagaaggggaggggagaagcaggaatgtaaacatgttcctttgatctgtcaattgcttctgctgttgaccgggatgcgaagctcctccgaattagacctgtgtgccgaaacattttgatcagcggtggcgtcattgacatctcaatgttcacatgttttggcacaaagatgtcccatttttaaattgcttttaaaacccaattcccaggcctatttttaagctaaaatacagtttagttaatacattccacatttcattataagtcgcttgcgttgggcatatcttgctaaaaaaggatttcaagtcaaagaaataaatatgtagtgaagaatgccttccctaagtttggtaaaactacttttttttttttttgaaaaaaatgaaggcctcaaaatgtatgaaaacagcaattttgttctatgtagaacattagagtggtgactctgcctaaaatagtgtttgaaaccttgaaactattctttagtagtaaaatgtaaagattgtctctttatgtatttgaaccttcagaactgaatctcaatgaagtgaatttaagaagtagatttgagtggcgtacgaacgatcataaacatggacgaaactggaacaaccaagagcaagtgagaatttatacaaaacattctcttaggaatttctagaaaatctgtacatgaatttctggagcaaaccctgaaaaaatctttagaggaattagaagtacaaattagtaattgcatttatgagatttcagtacaattaatggattgtttcattgcttttcagaactgccaatttgatcagttagatctattgaacaaaaccgtagtgcagtgcatgtcgcacgttgtcaaaatttggttcattatcgaaattggatacacctctgatttttttcgacgaggatgaatatcccgacaatacatttacatcctaaaagtttgataacatacgataacgaaaaaattggatttcttcaacaataagaaccaagaatagccaattttgcagtgaaaacctgcaaaatgtgtggaaaaattttcgccgatagaatatgtttttaattttaaattataaaatcgtagcccaaatgctgaacgttttcatataaatatccgaggtacacgaaagttcgaaaattatagaaatcgtgacaccgtgtttcgttttactcaatcgtattggacaataggagaataaggacaatcgactgattcggatacagttttgctttctcaaaaatatctgtaggtggttacgaaggtttcgctatttagaatcttcacaagagaattaaggaggcaggatccgtcatcaatttcggaattttcaaaagcagttttttcgttcaaaatcaaccgcaacacagtgaacacatttttatcgaataattttcagttttgaacagaaaaactgcttttgaagtttcgatgatgacgatgattacgatgacggagcgttgatcgttaacgagagtgcgtttttcttgaaaatcaattattaattttctaaaatctaaactactgatatttggttatgcatcggtaaccaagcctcatcctcgcccttctgctcaactatccacagtagactccgaaaaatcttagccatattatgaaaaccagagcattttaaacaagacaatttttagcgctcagtaataacgcagacagacgtttaagcaggaacaaatttattcaaaattcctgtgtaaattctaccgtggtgtcacctagggagcaaataggccttttcatgtgacaggtccatctacacggagagaacgaagtactcaaatttgagttccttctacccaacttggcacctctgtgcgttaccccaaatttgagtaaatagccaagtactcaaatttgagttatcgcacaaaattatctcagtgggtgatttttacctaatgttacctcggatgcaagaactcaaaaataggtttttttaatcggatcaaaatgcagcctaaaatagtagtcaaaaaggcatatcgaataagctatgtttatgtgattaatcaaaataagctgaactcaacttgaatgatataatagtttattttgttttatttcaattaataattgctttgaaaaaccaatcgcgtgggtggcagggcaggaatgatgacatcagcacaggaaacaatttggatcggatgagtaaagttgcagcatcaaacttatcgggatcggcaaaatgtactggaaacgccaatggacagctcgacccctgacggcggaacatggaggctgggaatggcaggaacagcgagcaggcaacgaatgacatgcattttgtccaacaaccagcctctcatttttagcaatagttcgtcggtagaggacggtagccattgagaactaggcattatgtcagacacttctcgacatcggaaatcgtgcaccaaaaacagttaaacgataactgaattcctgaaacaagaaagagatgattttacattatactttccagcaaaccgaattcctcggtggggaataaatcaaggatatttacctctggtaaatcagcattccggaaaacagcttctaacactagtttattgattttttataattaaaaaaacaataacaaacatacaaacacgtcttacgccgatgactgctaatcaggaatgaacaatgtagacttttcaatatggctgtctcattttttcatccaaaactgagtttaaactactcaacgggtagttcgcagcttgaatgtctcacgttgagttgtttgtactcaactatttgttttctgagtgtttgtcaattcaacgatcgattaacttattttatgtgatgaaatggatatccagtctatatatactgcgtttttgtagcaattataaatacgttaagagacatttcaagtgattccatcaccagttttaccagaaagtacgcaagttcaaggattaaacttgtatgatataagcgcaataaattgaacaagtatttttttattcaaatttgagttttagtcgaactacgtacgactaaatgtacgtatttgacagaatggaaattacccatttcttgagttccactgcctttacttaattttgagtttaaaaaaacttatttttgagtacttcgttttctccgtgtatgcatttgtttacatcggtggaataccggtgcatacacgaggctgtcattttcatagaagaactgtcaaagagcttcccgatcagctgttttgaaacgtcatgtgaataggcctattgctgcagtacagtgacagtttgtaaaagcacgtggcttcatcttctcgcttaccacccagtccaccacccactgaacaaaactatcaaaacaatcacttcaaaaatgattcacacaattttgatattttcacgccaatttattttacatgagtaacgatcattcaagggtgttatactagcatgaatctgtgagtaaattgaatgccaacttgtggtaaaaattacaacggattttattgatttttacatgagaaattggatccaaaagggaacatcacccacccagcccaaaacaaaggtacatacttttaagcgttgagcacgccggctgtgggagcggttgtgtgtcgtgctgtcaacgaaatgtgatcggggtggtggcgggatgcatacgccactaacgccatctgttagctgattgccacttggcgatttgtggcggccatgtttttacacaagtggctgagtctaacttgaacgtctgtctgcggtaataatgtcgcatgtttcataaaatcaatccctaatccatatttatcgcatgtgtcaagtttagccttggttagccttggttagactccaacagtttcaactatggacaagatattgcttagtacctagttcatatcttttttccatagactgttaccggtataaatgactaaatactgaaaatccttaaactgtctgagcaataaaccctagaattaaaagaggcgctgcaaggatttagtttgatagatctttcctaattacttatgcagataatactaaaaactcagcaaaaactgggaaataatcctaggggaatgaatgaagtatcttcataattcatttgatgaatttcttcaggaatgcttgaagaaattcatatgttaaatcttggagaagttttgagtattttttttttttttttttaaataataattttccctagtatctgtggaagattctctacatattttatggaataaccggaggaatctttgaataatttattccaggacactttttagtaatttcttgtttagaaatatttgatgaaattcccgatgcaacggcaggtaaagtttgagaatgacctaacattatagtagaaatttacatgtttctcatttaggctttctgaaaaaaaaaacatatgtcagtattactaaaagtattactattttttttttttgcaatttcgttaagtgttctctagagaaaggtattgaaacagtcctggaaaaaatgcttgatggaaaaacgtaataaaaatacatggaatgtttaaagtgtagtctagtatgctaaaaacttttttttaatgctggaaaattaaagaaacaacaatctctataaattttcatgtcaacaataatatttgttgcacatcactaatataacacaaatattaaaacagctaggcctactctacagaattaggtttttagaataatctgaaaattaactttgatcaaatgatttattttgtgaacgatttattcgaataatatttttgtatcataaaaaacaaagacaatcgtactaaaccaactcaggagatatacttaaacgtttggaatgaagtagctaagaaaaatagtgtccctcctttggcttttctggaatattttacaaagtttcaaaggcattttcacccattgtacgggctggtaagcctaggcttaagcgccgttactcgcaatctgaaacaaaattaaataaagaaaggcaagataagaaaccgtttccatttaaataaatttgtacaagtctaacatctgcgattgtcttcatttccttttgtggcaaaaggagatcatttatccatgatactaagttcatgtcatttaagttgaaataactgatgataatgatagaatctaagttgaaaaaaattgatgataatgatgaaattatccagcatcaacgcatcggttaacattcgactacagcaatactacatatataatgcttcgctgcttatggcttgctatagcattactagtaaactttaatgtcgaccttcagaaaatcacactatgttttctaatgacaaattctggcaactccacgaacgttagtacagcccacaattatcttacctttttgggatacctctcccaataaatagttgctacaatattatctagcatgcttttaatattatcaatgattgaaaaatagttgaatgaacaggcgataaaaacacatggaatgcttcttgagcaaagctttggaaatcctcaagaaattttcattggtgagattccttaggaaatcgttttaataaatcgtttatggaacacttgaagcaactttgaaggaactactcggaggagtgaaagattaatcttcttttgctttgttatctttttgagaacatgttacgcctgtactacttattcttatggatttggaaggtggaaagatctctgcataaagtgttgttgagatctcaggaaaaacaaatcaaaaaccttaagaggaatccctacgccaattcattgtgaatttattaaaaaacaaaacgcctaacaacttccttgtatctgaagaacttccagataatttctcagaattacattggcgtaggaataggaggaggggacaggtaatttattatttctgtcaaatcttatacaggtcggactcggttatccgcagtatcgatttttttttcactccggataatcgaatcactaagagaaaaattaaaatctgcgataaaagatcttaaatattatcttttttcgtgacgcagtggcgtagccatgaattatttccaggtacacattttttgatcaacatacacaaacaaaattttttcaaaccccttttttcttacgcccaaaactgctataccattcatattgtacatcgcaatactaaattatctcaaatttatgcataaaatcagaaaacaagaacatcaaaaatcgaattctggataatcgagtcttaaattccggaaaatcgaatcctggataattgagtcaccggataatcgagtttccggttaatcgagtacaacctgtactgagaaattttgttgaaagttcaactagaaactcctcattgtatacaatcaaatagtttttcccaaaaatgttattataaattctttcgcaaagttcatctaaagtccttcagaaatattttaaaatacatcacaaatttcgtcaaaaattattttgttttttttttctgatttgctgcttcaaatcaccggattatgcaagatttatttacgaatagtgttttcaaaatatctatggccttcgaattatcagagcaattttgttgaaaacccccagtcatacttttgctgccaaattagcatagtgaaatttgtcgaaaaaacagtttgcaatataacctaaaagagcagcttccttaaaatatttttttaagaaatagttcaatcaattgtttgaaaaactcatagtgcgggatttaattcttgtgctattcccgggcggaacgccaagaggcttcctcgctgaattcttgggaatattgaggtcaaagaagtaattccgctagatttcaaggataatttctaaagaagattatgattgaacttctaggaatgttttttttttgtacaatcggttagtgagatttcattaatcctgttatcatttacttttagagaaaagattataaataatcacttttttttctttggtctgtttcttcctgttttaacatcttgttgtttctcctcccttcgcatgacgcttccttgaggaacttgtatcattgaacttcgggagctaggtttagcattttctaagatatccgatacagataccttcagtgaaaattgaagtaaaaatccgatgaaaaggaaacaagagtttttgtagaaaatcatagaaaaaaaaactgttacagtttttctgtgaggcatatcgtcaggaattgcgtaaaaaagtttcagatattctacgtttgtagaaaaatgcgaacatggcaactaaggctaagaaagctctcagtttataactgtggaagtgctcataagaacactaagctaattactttttctcaactgaatcctatttgaatgcttgtctgtgggagaaatccttagagtaacacctgaaagtattatttaatgttatttgttgcaggaagtcttggaaaatttttgcttcgaatttttcaagcaattgttctagaatttccgagtgattttctataataattgtttaaggaaactctaggaaaacttcaaaggtaaaataggtaaaattattgataatctttttttttatatttttggaaagggatcattaaaaaatgacggccatcgtttgcgggagggggggtggtttgttctacgaaagtttgacagtacgtgtataaggtattggaaaaagcgtgaccgagaggggaggaggagtctagaaatccagaaaaacgatggacgcaatatttgaatcgtcccaacgaacccttgtttgatgatcttgaagataattgtcgcgggactcttagaatttcttaaagaaatgctcagttattccagaaatcctaaacaaattattcatgaacaactggtgatattttcaactaacgtttgtaatttatgttataagcacgtagattcacttcctggagaaatgtttaacagaatttcattagcatactcggttgagattcttcgatcattttgggagagcttactaagacttaaggctaaagaaacttcaggaaaaatctactgaataataactactaatcccggaaattatttccgtgggaattctgggagatacttagtgaaaactgataatggaattcttcaagaaagcactgaaagagtacggaaataattcatgaagaattttccgcgggaattctcagaggaatctctttgaaacacgtggttgaatacctgggaagctcgtagaaaaatcactaagtatattcttcgttagttctttggaagaactcttgaaggatattttttttactggaatagataaagaaggaatattaaccgtagtaaaaatataaatttacaaataacactaatatcagacaaaataacaaacaaaatatatgcaaacgaaatgtgtgaaaatcgtgattattgcgaccgatattacttctgtaaaataagaatttgataggccctactccagaaggggcttattaaattaatatgttactatgatagtcctctcaaacatttcggttccatgagttgaagaaaaaaaatatctctgaaattttatttaaagaaaatttacagttttaaattattctaggaattcattctaagatttgtccataacaaaccagtaactactattcgattttttcagtcattgctattaaaaatctaactgcgattccaacaaatcttaaaaaaatcctcagtagatttgtacaaaaatttcttaaaaaaattttgcagaatttccccgagaattttttttatcaattacaccaagaattgttccagagtttacaattacgttctcctagggacttttccaaaaaaatttcaaggaatcctccaaatgttcattttgaggttttttcaggatgaaattttgtttttagtatggttccataagtcgatatcgagtcatggaagttttactgtatctatgaatcaaattatgaagagaaaacaaaaatactttaaacatatctaattttcgagagtaatttttgcaaaaagtacataggcagtgtggataaatatttgcgaaaaactcaccaagaaagttgaaaaaataggaacacaaatttgacattttgtgcagggatggtctaaatactggatagtacaaagtatgccggaaaaactagtatgaaataaatcggtgggcggcacgcaggtctacctaaagtccgagaaagtcacttcttctatgtgacgccgcaggttactttgattggacaacacgagagtaaagatcaacagacgagcccaagtttacggcattagcagtcataagagtatgcatgcatagtcagccgcaacttaccgtcgatggtggttcagttggaacaccggggtgggagagtgtgtgtatttaccgtctgtctgtacgagcccaggtgcattcgtccggggaggccgacaccggcaaagagcaatataatacctacaccttcgccgtctgaataacgatagtgggggagtcgaaaaaaaagtccataaattatcgaaaactgggagatgccatctcgtcctcgtcgtagccgttcgtttctgctgactaagtacctggctgcatacgagatcgacggagggggggaggggcagattttcttgcgaacagttcttgctcgtgtttcgcataaattataatgaacatgatgctttttagaaattgaaaattccggcgcgagtagagtgcacatgacggtattggtaacaacaatgggatcatttcgggaggagtcgaggtggatctcgaatgtttatggtccactgttggaaattgtgaataatgggttgttttctggcggaattttggatagtattagatggctatgaggaatatgacatgtctcatgtttggacaaaacttccatgatgtgccatatgagaatccaatcgaaaaatcaatttattgatcatgtttgcatgttttgcaaaagttacgaagtttttcaatgcatattgtggttagagtccgcggctacaaagctaagccatgctgaaggtgtctgggactcccgatcggtccagaatcttttcgtaatggaaatttccttgacttccctgggcatggaatatcattgtacttgccacacgatatacgaatgcgacaatggcaactttggcaaagaaagctctcagttaataactatggaagtgctcatatgaaaactaagctgagaagcatgttctgtcccagtgaggacgtaatgtcaagaagaagaagaagaaatttcagtgtttggagcaaatgcgcacgaacaagtagcattttcagattccgaagtctcctggattatgatttttgtactctgaaaaggcgaaatttggcgcttatctttatactctagtaattttctcgattgactctaactgccgtctaattcagcgaataaaatacttccaacctcaaagcagtctatcatctccgcgttcgataaaatatcagtacaggaaatgagcagaaaaacgctctcattttcaccgttcaacctccggaagtagatcctttatccataaagcaatctttcctatcaaatgtgccttcatcattcccttttcaaaagtgactacttacccgtatgaacaccacttccatttggtaaaacacaccaccgtactcgatggagaatagaaaagggggaaatcgagctcccgaaaatgcgtgtcaaatttatagccccggaaatatggctgtggttatcggataaccttttctagggagccatccaactcgtagatgtgcagcttagaacttgttctggatttgtttgtggagtggagtttcagcgataaaagggggaaaaaggccgtccatatcgccgatatcgatcccgaacaatcgcaaaaccacgtgacaacccagaagctcgagggtgtcacatacctctagcagcatcagagctggggatgtgaccaaaagctatggcgatatcctttcgatatggatgtttggggagatacgaagggtgcttagtttgacggacggtgatacggttgagtgcgtaattagatacgtctcattttgccgcagtaattagcgtcttgggatgcaatgaattctcgattttggagggggcaaaaggattgttccggtggcgaaatatctacaatcaaagtagccctccggaatgcaatgagctgtgggttctttgcacgataggagggcctatacggcgttgtatgatttcaaaaaggaattataatgcaactttcatgttccacaatttttttgcagaaagtttatattatcaacgattttagtctaaaattattaataattttattcgacatttgttccaatgtttcaacattgcatattctattgaacttattagtactattataccagggagggagcctcagaatcattttcaaaattttattttgaatcctctgcagagctttcttcctagtactacaacagttagtccgtattggtacagcatacaacatggctggcctaaaaaaatgtttgaagatcaaatgcttgttcttaagacatagttttgattttctgttactatagggatagagacattttacgtatttgttacatttggcttgaatgccctcaatgtgatttttgaaagttaaattcttatctagcatgagccctagatacttaacttcatctgaccaatttattggaacccctctcatcgtgacaacatgtctacttgaaggtttcaaataaagagcttttggtttatgtgggaatattattagttgagttttggaagcattaggagaaatctttcatttttgcaatatatgaagaaaaaatatccaaacttctttgcaatcgactacagatgacacgcaggcttcgtcatttggttgagaggcctgtgtcatccgaaacgtagatttttgacagccctgaggtaactcaggtgagtcagatgtgaaaatgttttataatattggtcacaaaatgctgccttgaggaaaaccagttcatacaggaagtcttttatacttgaagttctgataattaacctgaagtgtacgatttgacagataactttggatcattctaacaatgtatgttggaaaattaaagtgttttattttacaatcaaaccctcatgccaaacactgttgaatgctttttctatgtctagaagagcaagaccagtagaatagccttcagatttgttggaacgaatcaaatttgttacacgtaaaagttgatgagtggtcgaatgtccatggcggaatccaatctgttcattgaaaaaaaaaaaaggaattttcgttgatgtggaccatcattttcttcaaaataaccttttcaaaagtttactgatggagaaaaacaaacttattggacgatagctggaagcttctgcaggaattttgtctggttttgaaattgatacaaccttgacatttttccaattgtcaggaaaatatgtcaaatgaaaacatttgttaaatatatcaattaagaatgaaaagctactttctgcaaggatgatgaggatgtagaaaattccatcatcgccaggaactttcatatttttgattttttaataatagttctcacttcttccaaatcagtctcccaggaattttcgaaaacgttctcttgattaagaatattttcggattcccgagtaacttgattttcaattggactagtaagtcctaaattaaaattgtgcgcgctttcaaactgcaaagcaaagttttgagctttttcgcaatttattagtaataatttgttttcctgtttcaatgccgatattggcttccaaagtttttttttttcaaaattaatttccaaaagggcttagagccagggtccaattgagaaaacgaattttcaaaatctttgtttcttaattgtaaaaaacgttccttgatttctttctgcaaatcctgccatataattttcatagcaggatcgcgagtgcgttgaaattgccttttactcacgtttttaagacggatcaagagttcaaaatcatcgtctataatcacggattcaaatttaacttctcattttggaattgaaatgctcctggcttcaacattcaaatttgttgaagtttcaagagcattgtcaatatcaaattttgtttgtaaagaaatgttaacatcaagattagagtcaataaatgtttcataagtattcctcgaaaataattgaaagtggagctgataggattgagaatcgtttcatgggatatttaaaaaggaaacagggatatgatcagaatcaaaatcagcatgagcaaccaattggcaaaggtgactagagttgatcaagaccaaatcaatcgtagaagagtttctagaagaggaaaacatgtagggttatcagagtattgaattgagaaatatcctgaagagcactcatcaaataaaattctgccgttggaattactttgagaattattccatgaccgatgtttggcattaaatcaccaatgacaaacaattttgacttattgcgagttaattttcgcaagtcagtttggagctaattaacttgctgcccagagcattgaaaaggcaaatagatagctatgaaagtatttttaccaagctatgtttcaacagaaacacctaaagtttcaaaaactctagtttcaaataactaaaacagtacagtcgggtctcctattaaacgcattcctataacgtgcactcctattacgctcactcctataagacacacgttacacgttataggagacccagggcttatgggatttcatcactttgggggtgtcgttgaatatctcgtatgccaaaagagatagtacagtactgtcttcggcgaagtttcagtactaagtacgatctacctttaggagttgaggatcatccttttagttgagaacttggccggtaggggcgctttttctgatttcactatatgaaccatgagggataagaatgcaaaattttgtaacatatgatatctctgaatcctgatgttttggaaggttggtgtcttcggaagagatgttcagtagctcaagggctgacatgtggtggccattctaatacggaattacgccaccaggcggcgctagtgggcatggaatttttgttttgcgcatagctcagttgcctgaccacttagaaagatggcgtcttcggcaaagttgctcagtatcacaaggtctaacattatttgagccgaaaattttcgaaattttgccactaggcggcgctagtgagtaaacaatttttgtttcgtggatagctcagtagcctgatcacttagaaagatggcgtcttcgacaaagttgatcagtatcacaaggactaacattagttgagccgaaagtttcaaaagtttgccactaggtggcgctagtgagcaagtaatttttgttttgcgcatagctcagtagcctgaccacttagaaagatggcgtcttcggcaaagttgctcagtatcacaagggctaacattatttgagccaacagtttcgaaattttgccactaggcgccgctagtaagtaaacaatttttgtttcgtggatagctcagtagcctgatcacttagaaagatggcgtcttcgacaaagttgatcagtatcacaagggctaacattagtttagccgaaagtttcaaaattttgccactaggcggcgctagtgagcaagtaatttttgttttgcgcatagctcagtagcctgaccacttagaaagatggcgtcttcggcaaagttgctcagtatcacaagggctaacattatttgagccgaaagtttcgatattttatatatacgtagaaagcgggagaaaaagtttttttttatgagattgaattatcgttatgaaaaagaaggtttatattataaaaatattcaaacaagagtgtcgtgtaactaaagagataaagccagtcatagttatctcattgagattgttagcgaatggatttcctaatttattagtaatgactgacattccaacctaacttcatttctttccaatccataccttggaaaatgttcaagaaatgaagttcatgcaatgacaaaataaaaataaacatacatatttttttctctggttcatatgaaaagctaacgatcacatatttgagtagttaacggatcctcactcattctcatatcaaattattgatcaaaaattctcccaatccgtcgaaaatactaggatactagccatacatttatccgattgtaaaaataatgtatatatttttctccaggcacttttacttaaacgttacaatgcgagaataattgatagcctagtgtcatattgaacaactttggtcaggctactgagctatccgcaaaacaaaaattcttcgctcactagcgccgcctagtggcaaaatttcgaaactggtggctcaaataatgttagcccttgtgatactgagcaactttgccgaagacgccaactttctaggtggtcagactactgagctatccacgaaataaaaacttcttgctcactagtgccgcctagtggcaaaatttcgaaactttcggctcaaataatgttagcccttgtgatactgagcaactttgccgaagacgccatctttctaagtggtcaggcaactgagctatgcgcaaaacaaaaattccatgcccactagcgccgcctggtggcgtaattccgtatcagaatgagcaccacatgtcagcccttgagctactgaacaactcttccgaagacaccaaccttccaaaacatcaggattcagagatatcatatgttacaaaattttgcattcttatccctcatggttcatatagtgcaaatcagaaaaagcgcccctaccggccaagttctcaactaaaaggatgatcctcaactcctaaaggtagatcgtacttagtactgaaacttcgccgaagacagtactgtactatctcttttggcatacgagatattcaacgacacccccaaagtgatgaaatcccataagccctgggtctcctataacgtagattcctattacgccccccaaccatgtgtctaataggagacctgactgtagattttttatacgcccgtgaatgataatcgaaactccactacatgctccatccagtcgatcattacgagaaacaaaacgaaaaagtttaaatttcttttgagtttggatccaggtttcaaataagtttcaataagaactgctatatcagggtgtctactatccggagaatcctggaaaacctggaattatcagggaagtttattaaacctgaaaaaaaatctggagttttcagggaatgtcgatcataatcagggaaatcatgttgaatcagtaatacatggtagaatatgtcctttttgtgacagaaaaatatcaatcataaacagtttcggctgccccgctatcaagacgctcctagagatgttcagcccctctattttttaacgatttatccaacataaaatatgtttagataacttaagattggaaagttggtagaggcaagtacagttcccatcgacagttgggtgtcgttgaaaagcatatgaaatctggttgaaaacattccaaatttgtttacaaaactgttttttgactattacacatggaatgctacaggtattctagtgattctttctggaatacctttatgaggttctccagggaattaattccttcacaaattttatcaagaaaagagcattggaacatttcaggatttcctccagatgttttctcctgattcatccaacgattttttgcgttgttattgctaggagattgtgagatatagaatccactacgatagagtttgtagtgaggatcgattacagcaaacagttttatacgtttgtctgggacagtcactgtcatgtgtcaaagttggcatccctgagtgaaacgattctgttcagtgtgcatcgcgtggagggtgattcctttaccgcggataacgtaatctccacagagatttgccacatatcctaaagaagttcttccgcaaaggtttattccattgttccgatattttttcaagaaaccctacaataattcctacaccgattttgtcagttttcatgtggataaagaaaatcatccacgtttactgtccttcaggcattattcggtgaaaccttttataaactttttcaataattcctcaaaaacttcgacctgaaattccttattcagttcctgaagaattttttttcagaatttctctcaaaatgtttccagcatttcatcaaaatattattgctgtggttcgtatatttttctaataaactttcaaataatacttccaaactccgtggattcttcaaaacttcattcaaaatttcacgtcagttattactatagctattcttacaggtatttttcgaattattcatacttaaatttctccagggagtctctccgaactgtttcaaaagaatttcttcgaaaagtcttgtgatttaatcaagaaaattataggaagaattctagcaaattgtttcagagatcctcgttgttattcatcaaggcatactcagaattcacacaaaacatttctgaagaaattccacgtgaagttttctcaaaatttcctccaaaaaatattaaacaaatccttgtcatttccctggagacgtctctggaagaaagactatttttttttagttgaaaaaataacaggaatttctgaatgaatttcgatcttggaagatgtttaaaacgggaatgttgaagaaatttctcggaaaatcaataaaaaaaatgaatagatatatttcttgagattatgagtcttcatttgaaaatgtctccaatggtttttgaatagattactgatggaattgccgaagtaatttttatagttatcctcagaattgaattcttgagaaatgtctgttcaaatgaggaatcaaaatctcagacgtggttcatgttgggtttctttttgtattcataattcttgtgtggtctctttttgatttatgtttgtttttcaggcaagaggtatttaaaatttccaagaccatcaaacgctaccagacccaatttcctcaaaatgtcatctaggaaaaaaaaaatcaaatcggcctctagaagaatgttgtgtgtgtatcgctgatatcctttatacaaagtcccatttcaagggaaaggtttacttccttaagctcaaatagactattttcttcttatctgattttgacgactaaaggcactttcagatcatttgataagaatagttgtttgtggaaataaaataaaaatcaccatttttttctaatgttgttaacacgtttagaacaaacggacaattaaatatttgtttattgaaatgaaaaatactttaaaattcatctttttatttttgtttaagtgctttgaaaaacttttttaaaaatatattttgaatgtgaaaaaaaaatttcagttcaaaattttaaaaaccgtgcaaaaaagtaacataatttctcgacgtttcatgcaaaaataaggtttggcggaaaaattttttggaaacttttcttttgcacagccgtgtaaaaaaaaaatccgtgccaaaatagaatcgggtgtaatttggagactttctagatcctggaattgttttaacatgaacaacctgaaaatctcagggaatttcatttctgtaaatgagtagacaccctgtatatgtatgttataagctgttcgaaatttaaacagcttatcttcaaaataattaaaaaaataaaacgtaaaccaaaagcccatttatttgtgaatataacaccaatttggactgctccagagatagtggggttttgattattgtatcaattcttctattcaattgttcagttaaaaaccatattcatagggagacaagttactagaagaagatacattttctgctgggattttcggttgatggaacagaaattacctgtggcgacataaacatgattgtttccacctgttttgaaaaaaattgaacggtaacccttaggaagaaaagtggaggatctgaacattggcatacgaattatctcgagtattctgaaaagattcgaaaggttactcgacggaaaaaaatagttagtgaatgagtatgattataattcacctgatggatatgattattaagcaagcaatcgtttactgaaaaattagaattgttggagaatttgtctggaacattccggctacgaaaaacgttgccgttcatctgcctggcacgatcaacggcacggctcaacgattcaaagggcaatcccaaaagttagacttatggttgcccccgcaattagcgcatacagactttttactatcttccttcacaggacagacgttcttagggtgagaagaacttacgcaaatcatgcattcagcatccatgcgctaatgttttgtaccatgacctcacttttgtcatcgacggtattgagtggagttctggaaatttccttcagatatctggaaatgttcccatgtgacacggacatcgaacatagggcttgctttttctgaagcttcaatattatttagatcttttttattaaagtgaacaagctaatactttcgaggaagcttttgagccagattgagtactgtatttcataatgaatacttggacaggggagaatccaagttaattatttatgagatttttgatctcttctagtaatctatagtcatttgagagaccttttaagacgaccttgaacaaacgttcagttttgtcgtaataagtaaaaataaattgtgcttcttctcgtcaatatgtttgagaataaattcacgatcttcaagagtttccggtaaatcgtgatagtctcctttctttgcgatttggaaggaaaccttgatttccctaatggagttcaagatctcctgcctatatcatccaaattcggagtaactgatcacgattggtgttcgaaaaatttgtctaaagtattgaactgattgcccatttctatgcaattatcaacattaaggtgaatattcgattcaatttcaccttaaccatttcacccttggaaaaaagtgcgaattccgtcctttcctccatttctgccaggtttagtgacagtttcaaaaccaccttctttggaaggaagttgtaaactcagagattcactattccttttgttcgtggttgtaaccatgttcagtgaataaacgaaagtcgaagtgaccttcaaggaggttttttttttccaaggtgtccaagaaggattaccacctctagctttcgctaacgggtctgtggtagctagagttgatatgttaagaatttatgtatgtgaagaaaaaaaataatatttcttgtatttatttcagtgtgtacgattttttatcagtgtacaatatatttgacatgaatcttttgagcgtgcttttgattgacagttctaaaaagaaagagcgcgaaaaacaatcggagcttcatcgagaactcgagaagtcaggtagttgtgctggttcaaactcagctcatgtttatttggccgatggcggaatcggccgaaactgattatcttagcggatccggatacaacagggtctaacaaataatcgaaggtctgggttcaaataaggatcgaaaatagattaatagtagaaaaaatagtactgaaaactactgtttatgtagcatggaaaatactgttattttagaactgagaagtaccgttttgtatcaaattccgaacagactcatattccgaacactcgagttttgtatggcgatttggttaaaatgtttcgctgaaatatgtcaccaaataacacggaaatggcagtcaattgacattcaattttaacgtctccaatataatttataccgcggaagtagtgatgattctctagtttgagaccagtagaacaagctgagataaacttatttgcaagattattcatttgaatacggtttattcgggctcattcggaatatgagataaaatgagcacagtgttcggcatttgaatcaaaatattgttccatacttttacgtaaaaacaatactaaaactaattaaatcaacatttttatcggtacacccaacagccaacagttagactttgcgaaagaattaaaattttcacaaatatcagccaatttatgccaatcagatgcatttcaagtcactgttggccttaagtgttcggaatatgagtcaaaacggtatgtatgtatatttattagagaccgtttaaccatttggtcattccggtcgttgatttcatgttaaatacaatttggtcttattatgttgttcacttcttaattctaacactttttaaaaggttctatgttccatttgtttccgtggttggagatttctgcctagacatcgagggctgctacagattttgcagcttttattgcggttttcttccactgtttccttaggatagtgaggatgccgatgagcagttgtattgttgagattatcaggagaacagagaagtacggtggtattgcttaagttagtttcaaaaacttccgagaacagaaaaaaatgtctacctctcccatatgagacagttatgcttttatgggcagtacaggatatcatgaaatgtaaaccggttcgatcgcctttgtcgcaaaatgccgctaattattaccactttactaagtagacaaaaactgtataagccgattatctatgcctcaagtgctacgatttcgcgtttagtcgaacaagtgttgcacaatgccgaaaaattcataagtgatctacacgcttaaaagtattcattgacatcagcattggtttataaagatttgctgtggtcgttcaaaaatctcaaaaaaggcgtcaattcttccgtctcccgatatgcatctcatctaatctcgacgccgaaagatccctcggctttgatagttgagaaattttagaaaactcggcctcgacgacgggccacacgatttgtccatttgtcactcgtccgttttggttcggtcacatttcgctcgcgccgcattattcaagtggaaagattaattgattggtggagaatgtagcgagtgcgagtagacgaagaagaaaaccgaagcagcgcttcggttgtagtcgttgtcgccctggcggcaggcggaagttggcaggttaaattgataaattgatggttgatttgaatgatgttttggccatgtttcggagggatcgcgtgtttggctcgaaaaggcctacttggatcgagtcgagcggaaacaatttgcttgggttgctgtcattttttcttgtttccgatgatgattttggcgaatgggaagagaaactggtttgttgttcgatttgtcaaaatttagttcgtaccagcttgtatctatcatagaaaacaagataaaatcgttgcgcgtaaaaaaacacgttctcatgttggattcgaacccatgagtgttgtatgccagacgagtgctttgccaattgaacaactgaaccacttggcgacttaatagctcagaaggttacaagtcggaaatctaaattaaacaggccttaaactttcttgccgtagttgctcaggatacgcattaatagatcactataggaatgctttggaacatttctggaagaaacttcgaaggaatttcatttcgaagcactacagaaaactctagaattctagctatacgtagtaaaattatcgcttgaaatcttaacgaaatattgaagacattgtttaaggcaatattatgaaagatgcatgtatgcataaaaaaagttgaattaatttttaatgatctttaaaatgtttcagtgtaatgaaaacaaaattatttgaataatttcattaaacaaacaatcgtcttctgacggctcgataaatccaaccatcgtcttcctgaattacaacaaacaagcatacaaaaatactttttccatctgaaagaagctcaacaaatcccgggaagattaactgatccacttcaacggcgattcaacaacaacagctacaacctcgacaacatttcgtttcggcacgcgattaaatcctttcaaaagcagaaaacaaacataatcgttcttctaggttttccctgctatggttgcgacttgctctcgcacacttacagttacacccacacacgcacaaagccacccatccacctacatgtgcatgctgctgacaatcaaagtagcacgtgtcgcgtgcctcgttcgaacgcttcagccagagccagggcctacttcgtgcaaaacagtagtggggtagttttgccaaatggaaaagggagagggaaaaatatgatcatgccctaggaaaaggataagcatcctaaaacagccaataagataattcgaaggaatagataaaagatagaagatagaagatagaagatagaagatagaagatagaagatagaagatagaagatagaagatagaagatagaagatagaagatagaagatagaagatagaagatagaagatagaagatagaagatagaagatagaagatagaaaatagaagatagaagatagaagatagaagatagacgatagaagatagaagtgttcccctatcttaaatgcttgttaatttggctaccaaaaggcaaatcccttcctggctctgtgcgtagctcaacgtcacctactcacagagcaaggatatgaatcgtgacagaaatatgtaggaagtgattctgtgagtcggatcctatttccaccgttttcgtttcagcttgaagaaaaacgaaaataaaaaaccagtgaggcgaaagtaccagcgaacaacgaggcaaacaacaaaagttttgtgcctgtgagaatcgtaattgaaatgtaagtgaaagttgtttgcccaacgagtgcctccaacgtcaattgagcgaccagtggtgggggaggcaatgagtgagtgagtgagcgggtggtgcattacatccacccacaagtccagcgcatcgccgcatcgacagtgacgaagataaaaccagaggaggaataaaagagtttcattttgggctgtcgtcgttgtttccagcatatctgaaggagtgaggaagagtgcagcagctgcggttgaaagccggtattcttggggaaatgaaagcaaaatgtttgtgatgtgatgagtttttctcttcttacatttctgtgatctgtgggtggtttctgtcccggttgcaaatggttgtttgcatttgattacgtcagaaagggaagcgaattgttgtcatttgttgggtactttgggtgtgtgtaacaagcaatgggacgacggaagcacttctgttgaggtggtttggtgctgtcggaggacgaaaagacggtgaaagatgggaaattcgtcgtcttcgtcccgtagtgacaaaggaagaaagtgtcgcagtcttcccaactctccggatgttagaaggtaatgttttaagtttgttttactgttttgcaaaattgcacatttaattttctttcaagtccgtgggaaccaatgcatacgcattggtttaaacatgtaacaagagaataagtttttatttggtaggtaatgattcggtcttctgcttaaaaccgtgatgattcattatatgttgaatgtaaatcaaacatcaaacatgggtagctcttcattgacatacgtcccggattttttttttccggggcacatctcgtcacattattataatctaatatcaatagatttaaaaaatattcattacataatttaaggaaaatctatcaagtttgagcgttttgtcctaattttaacagcaaattttaaacaaacacctgaaaaacgcgaaggatcttttgaaatgagcttttgggagaataaacatattttgaggatatccatgagtaaaacttttgatcaattccaagaggaatatatcacgatgaataactctttcataaacatgtggggaattttttgaagtaacaaaaaagtttgcaatacttattttaatggaatttatagaagagttgatgaaagattacttgaaggaatttcttaacaaatctcagcaagaatccctggatgaatcatggaaggaattctcttcaggtctctttggaagaatttctgagagaaggttttcaagaatatcggcagaaatttatagaagcattactagaggttcttcagagaaattacatgacgaattcacatggatattttttgttttgaggcagtttttacggaataatacaaaagaattatttcaaatgtgttcgaagaactcaaaaaaatgtggaggtaattttaaaggattctttaaaaaaaagctggtcttcatgatgaaattctttgtattaaatctgattaaattaatcctcaaatgatttctcaaactattccttggaaagaaatttgaaaagattttttttaatttcatggaaggaatgcttggaatcaccgatagaacgtagtgtgagaatacctggaaaaagtctaagagtaatgtctgtaagaattaattgaaaaaggaggagcttcgaaaatacctccgatgaactatagagtatcttggatcgaagccttcgccagacttggattcaaaacccatagggagccggatcctattattggcacttttgattcacttcggcagtggggttttctaaaaactaccgagcacatacttggccacaatatgcgtcgtattgatgtgcttcttattgcaaagtttcagacgattcggccgagaaaaaccccccatgccagagtgaatcatggaagtgcccaagtagctctgcaccctagcacgtttttttgaggaattgtgcatttatcgctaaggcttttgaaccttatgtacacaatagaactatccaatttaggagcccaaacgcaaagggatgtaagtgatttttttttcggtttttagtaatgcataccagcatattctactgttgtcaagctttcaaatggtaatgtacagtgattttgccgtccattagagaaaataacataattcgtaggagatttgctagtttttttagcgtcccatacaatttgtatggaatgaaatattgctcaaaaaccaccgaagtcaattttcttaaaactaggtttttgtcactgtgggataaggtgctactaactccctcaactgatataatctggtaaagtacaacctgacctagtgctgatctatgactgattttgaggagaaatccatgcacaacatagaataatttctataagactttattgaacatctcctggatgttttcagaataattcccaagaggaagtggtaagtttctacagaagtaccagtggaatattccaggagaatcccaggagggattatttttatcagttttatccttgaagaaactcatttctgtgcaagtgcttggattaataccttcagatattctaggagatttttccacagaaataatagtagaaatatttaaacaaatttcaaaatacaacccgaaagggcttgaaaggattctttgaataaaaaaatatttggggagattccagtaggaattctttgacgaaaatcaggagaaattgctagggtaatctccaaaagacttatctgatatatcgttcaaagaatactttgggaatgctcagaagtatgagtaaatcatttatggatgaatagcactgaagaaaaaaacatttcttggcggatatctgaacaatttcaagtaaaatacctgaaggaatttctggtgagaggtgtccttggaatagctgaagaaaaggatgaaaaccttctcaaagggacagtcagatgaattcttggaggtaaattttagaaaaaaaatcataaaggaatttgtgtttgaaaagaaagaatttcctgatctagaataaagagaaaagtactatgaaaaaacagtttaggttgacttttttcccgactttagtaatggttacccatatgttacattgatttgaatgcatattggtactgtttccacatgaagttggtcaaagttatcaaatgaaaacactttttcaatcatgaaggtcataggtatcatctatttttcggaaatcataaactgtttccctttacttttatctttagaatgatggaaaagtattgaatttgtgtttacaactgaccttattccatttccattccattccattccatttcaaaattcaaacatttaaaacttaaaacagaacgatagagttcctcatgattgctcaaatgaattattcgatggtctcctcactatcgagtagtttaatcaatgatccctcgtcataactcctcggtagatgttctaattccatcctgatgaatagcagctgaactctatagtttttaaactgttggcatctttactatccctgtagttaggaatcgattgattaccgtaccgaagctgtcatttctctcgctgtctgtaacttttgctcaggtgttcttcgtagtactgcttccacctttcaattgtcgttcttcttcttcttcttggcattaacgtccccactgagatagagcaggctactcagcttagtgttcttatgagcacttcttcaatcattaactgagcgctttctttgcctatgttgccattttcgcattcgtggatcgtgtggcattcgtgtatcgtgtggcaggtacgatgatactctatgcccagggaagtcaaggaaatttccattacgaaaagatcttggatcaaccgggaattgaacccagacattttcagcatggctttgatttgtagccgtggactctaaccactcggctaaggaaggccccttcaattattgtacgaccgtccagtaaaatgcttgcaacccttagtcctacacatttttactcatggcataaaggctttgcggaatatgttacatccgtactttccaaattgtgtgtcgcggtgccctgatgcgctgtagcacttcttcaggggcgtacaagtttgataaaattttcaatcttcccattatcttagaaaacttttaaaaataccggatataaataatggtgaggctcgtttaaagaaaatcgttcttcgacgactttgaagcagattaaagccgttttcatcgactgtcatttgaacatttattttttattgttgaaaacttttgaatttgaacgtgtttagaattcgaggtcgtgcggtcactgacgtcaagcattgtgctgtggagtgttactttgattcccacctcagtgcggtaaacttttcgtgaggaacgttttccgattgtgtcacagggcgttgcatgccggtccgttgtctaaagtcccagtcaacattttggttggtataacttttgttatacataattttacatgaatcaattcaatcgtatagaatgcatgaaaaggctaaagggcaggaccggatttgggggggtgccaagggggcaaatgccccgggccccccgatgaagggggccccccgagaattaaaaaaaaaagaagtgaaacacaattcaatgaattatttttacgctaacgatattaaattgaaaatactaatccaatacgatctcttacagagatattatgacatgagattattttatttcaaagtttgtagcaaattcagtacgaatattcttctcgggttttctggatttcttgaattttctgaaatttctggaaagatactttaaaaattacagtgctatatgtcttggaataatcttggaaagacggagatactcagtaattcgaagattttcttgattttactttcaaagtactgaaactattaatctatcaaacatatttgagattctaccggaatttcgatatttccaaattctacactactcttttcgatttgtggcaggttttaataattttgtacgaatattttcatggttttgtcaaaatattgtaatttttagtaagagcttagaatttactaaaattttgacacaaaattacagaattcatttcaatattgcaaaacactgagagctttgaattaatcatattttttgagcaaatctacagaatttcaatccagagattaatataacaatatttaaacaatacaaattgcttagattacatcgcttaccaaggtgactcctgatctaagtaattatcttccttttccctactaacaatactccttcctgtggcaaccgtagagatgcagacgattcgtcggaactttccctccccatcctcgatgactgtaaggacgtggccggcgccgttattgacccataaaaaaaaaacacgagctttcccatctgttggttccctgtgcaattccgatagctctggtcaatcacggagtagcaactacgaattgtacggttaacttgtgctcatgctcatgctctacagaattttaattcaattatattttctccgatttctaaattattagcctaagtgaatagattatcaaggtaattttgctatggtctttgtaagatttgcgctcgagggctacttacagagactatagcattatctgcaagttgtctaagcgtgaaaagtttttccatactgttatctatttttggaacattgaaataataaagcaaggaactaagacttcagtcttggagaaggctcatatagctaattatggaagttgctaattgaccgacattgaagctcatgtgcttttctgaaagctattgcttctttcccacaaaagctagttgattatctgattaaagaaacgctagacaatcgtttgtttttttaccgtgacgaaaatcaaattatgaatttaaaaaccatatggtttagtccagtcgcgatgggatcattttgtgttataataaaggcaacaaatcagaaaatttctacacaatgaaataaaataggtaatcgagattgcttcaataacgactttgaaaaacagtcgttcatgaaatagaaaaattcgcagaaaaattgaaaaaaaatttatttaatcttcgctttagttatctaagactcgaggaatcatatagtgttgatttcaactgaaacattttcaattttggacttgattgagaacgattcggtcataattcaatctcatcatcttttatgcacgactttccaagtattctatacaggtgatttactttcacgaagagatgttggtatagtcgaattcgatcacagttttttgaattttctgagtatcttattttcataatactaagctttcctatgccttcccgctcattttgtatcaagggcccccgtgaagatatctgaccagggccccccgaagcccaaatccggcactgctaaagggtgaacacgaaattattgcgacacattcaacagggcataacttttctaccattgggtaaaaatcaaccaaattttgcacactttctcattgatgtgtattgttaacacactgttaaaaataatgaagattactcgtcatgtaaacttcatttatgcgatgtaaacatgatgccatgtaaatttaagcctgaaatcatgtaaatatgtgttatatgtcacgtaatctgacaggatcctgctagattacatgacatataattgaaatttaaatgacatatcatgtaaatatccatgatataccacgctccaattatgtgcattatatatcttagaaatttacacgtttcgttcgaactgtgcatgctgtcaaactcgaagtcgtgtttttcgattcaacgaaaatggaggtaaaccaacgcgagtcgtgagaacaaattcttttcaaaatgttgaacattcaccattcaaccgtctccagagtgttgaagcggttccagcagcggttgacgttggagcacggcaaatgagctggaagaaaaccggggccggagaagacggagggaaaggtgaaacgcatgattaaagcaaatctcaacgtctcaagccgtgatttggataaaaagatcggcatgtcgcagagttacgtccagaatacaaagaagagagctggactacatacatacaaggtacagaacttccaaaaccgcgatgagcggcaacaatcaacggctaaaactcgagcacggaagctctacgagaagatgctgacaaaatatagcggctgatggacgacgaaacgtatataaaagccgattttaatcaaattccggggttggagtttttcaccggctaaagtaagttcgatgtggatgacaaatttaaggagaagaaaatgtcgaagttcgcctccaaatatctcatttagcaggcaatctgttcttgcggactgaggagtgagcctttcgtgacaaagggcatagtaaatggcgaaatctacaaatctgagtgcctcgagaagcgccttttgccgtttagcagcagcacgacgatgctccgctattttggccagatttggtatcatgccactattctaaaagtgtcctggagtggtatgaggccaattctgtccattttgttccaaaggacatgaatccgccaaactgtccggagctgcgcccggtggagcagtactgggcaataatgaagcgggaacttcggaagagcaagaagacagtcaaagacgagaaagacatgttaggaaaatggaaaaaactgagaaactgatgctggatgacactgtaaagatttgatagagggcatcaagcgaaaatgcctttaattttatactcaaggctccatcgatcaaattttcttttaatttttgaagtaaatatataaactaccctaaaattttggtttgattctaaacattataagaaaattgacatgattgtgttcgccctctttatgtacctaccaaagtggaggctatatgcatttttattggcacgactttccagactttctgcgaacaggaatacgatgcatcaaaatttggattaaaataaaacaaagtttccgtctagtcacgaacgcaggacctctgaatcagcaatcggacacctaaccactgtaccacttaaggtgacataacatatgcgtgattatttgccaatattagtgcatgtttcatctacagcgacacttgctatgctgttcgtcagcagataccaagtaagggtgggattttttgctaagttgttacgatttcatatgatgctttctgtaattgatgtatgatctgtcagtttttacaacttgacgcgattttatgttgcactattaacggcatgttttgctgtcaacacagattgtcgtttatgaagcgcattggggatttataaacaacttgtgttgacattgaaaacgcttaatttgacaccttgtgcgattctggtttttgacgtacgaatatgtgattttgaatgcacaatcttatacgatacgtgattcactggagtggtgctgctttcaaggaacaaaatcgtccactggaaggatgaaagtgttggatgcaataatgattactgtttttatttgaatgactcaaaatacagcattcaagacttttttttgcctatatatttttggtctgaaaaacatatacagtccaagctcgtcataatgacaacttttattgcgacaaatctctctatagtgacatttccaatggtcacttccaatttccatacttatttcatcctttaacattcctctgtttcggccgttctctttgacgacattccagtaatataggttttcactcaataaaacgatatttttgcgttcgttcttcgtatgttagtgcatattatgatcgttttcttcctcaatcctcaataacgacatacaacttctttataactacttcattcatagaaacatctccatatagcatcggtcccttgcgatgtcgttataacgttaaaatgtttttttttgctacagggaaagtaaaaaatgatgtgttaactgcagatttttaaattgttaccattgctaatatttggattttttatgatatgcaagaaaatttgattcaacatttacagctcgtattttctgagctgtaaatgttgaatcatatataaagaaacgctttccaatttctcatatgttgaatgtccaaatcctgattttttttttattttgaaaactgaagcttctttttatcccattcatctcctcgcacaatggatacctttctaaacaaatcttaggaaaagttaataaaattctaaaacaatatggatgtttataaaaaaaatattgtacaggataatttcaagaatataagaaagaaaaagatatagaaaagtttggcgtttgggcattgaatgtaatttgttagtaataattccattttaaatcgctagtgatggttgaagcagaatactcacttattaggttcacgagattacattttaatttcaacagcatatttgtgtgagcatcccgagcagaatcaaaaaatgtcagaaaaagaaaattgatcttcacattttctattggagattaaactttgtcaagctttgacaactacagtaatctagcatcacatttgaaggctctgatctcaatatcttttgaaaatagacatttaaaactaaactcatttttgatttcaaaggcaaatatcaacagtgtgcactagttttgctgggtagtcctttgtgaaaccatagactaacatcgtgtagcattcgctccctccttactattgaaactccatcccgtgacaaccatggagatgcaagggtgacctcagtctataacaacgatacatgtcacatcaacacttctttcgactattttggtccatcacgcaatagcaactctagtgtctagatccacgccatcgcccgaatatacatccgtccgccacaaaaatgctcattaaactgacttctggatcacgtgatgaagttcaaaccgtttttcgcgtttattgttgaactgccaattaagatcacgctcaaaagattctagccaggtcaaatatattgtacactgacgaataaatcatacacactgaaataaatgcataaaataataatgtgttattttcacattcataaattgttcaacattatactactagttgtacggtcatcaatgctcatactcgtttaaaaatgccgtcaattcttcaaatttgtaagtaatggacaaaactgatggaagctgcttctattttaactatttgaaatcttgagaaaccttgcaagtgagtttctcccattccacaagttcagtcacgctcagtgacaccgactatcgaattgctgttcgatataaaactccacagcagtaacagctgcaaatggaggcatcaacactttcccgatgcgccactgggtgtcaatttaattacccaccactcggtggtctcccatgatggtcactgcgctccgccggatggcacccatttggagcgaaccctaccaacaaaacggtaaagttcagtgtccattccggtagtcgtcactggcggtgaatcagagcagtgcagtccaccagccagccagccagccgaacctaacggggtttctcggggcaacgacaatgcaacatcatccgggtgacttgatgtgtcgctaacgggaatgcgaaacgcgatatgaacactcaatacaaacctgtacgcccacgccgaaaagcaaacagttcctcacccagcgcagaagagagcgaaagatgcatttcggttcgcttcacggcgttgatacggagcactgtgcggtgcgcggaaagaagagtaggcttctcaagctacggggtccgcagctcctttgtgacgacgcgatctggatcatggctcgctacggttgtatgtcaagtgagttgagttcacacgagatgaaggatggcagcaagtcatgcgctataatttaccgatgttggtaaaagtccgtgtccataaattgactcataatacgactcaattccgcacctttgtggcacgggaaatgggacgcaaacaattcgcgatttgtgcgtgtaattctattgaatgcaaaactggaaagatttccatttatatgttccacctccgcaccttgctgtgactctctcagtctgtgggacgtgtttcctctgcagaccctgagttacgcaaacgagatcagtttgggtacaattcccagacaaccaaaatgtacgtataacgaaatcacctggaggctctatatgtgcaaaatttcacttataagatgttgcgaaacggccttctacgtacaaaagtggaggcgatatgcgtgcatatattatgtgatgaataataacatacaatgcgagtgtataaatattctaccgaactaacctgcaatattatgcgacttaaattatgataacaaatgatgatttgacagctggtacggattgattcgacttactttatacgtgtgtacgagacgaaacaaaatgtacaaatgaactcagaaaagaagtgttttatgcgaggaaactcatcaatctgacgagtttatccacggtgtttagcgagtatgatgtaattagtatgaataaacgagttgtaacgtgaactttcatgcgatttctggttgtctgggtttatgacttcagacgtcttcattaaggcgacatgtgttcttcgacaaaaacggtggacgcaaggaacaagacaaattgacaaattcacgccccggattggcaacatctgcagtcgatttgtcccggcccaactctttcgcatggtctcgtaaattttaaatcttgttaacgttgtcttccatttcattttccggtatattctagtgctatgcacaggaagaatccagaagctctgattaaaaggaactttcagtttctttcagacgttccatgatcgcagaggaattaactttgatgtgggtcatcttaaataccaccttttgagaaaccacgtctgcttcagttccgatcaggccatccaggccagtagtgaagaaaccaaaaaccagaccaattagcttcgcccatcgtttgcccttaggccaaacggggggcgatcaatcaacgataaaagcaaaacacacatcagagcaacacttacggggtccgcgcgggaataaaaatcgccgccattagtgcttagtgccggagagcaacatggatatggcgaaaatgcatttactggttctggggccccaaagcaggcgacgacagacatccaagaaatccatgactaagctcttcaacgcgcatccatcccatcccaaggttcaatgctagaggggggtcgatgaaccaaaaactactcggtgatgcattttcactgcgattggccctgtaaacaaaatcatcgattcccgaattcccagaatataatacgtttgatgttggcttataatgttacgggaaactggctttgcgcgttcggttatggctaagggtgtgcgatatgcacacacgaatttcctacgcaatgagcgatcattggcattgcaacaagaaaaaaggaggcaatgtcgtacgcagacaaccagaatatacgtataaggcaataaccttttgcgttttgcattgcatagtttttttttattaagggacgaatgaccttcgggttaaaatccctctcaaacaacaacaacagcatagttttaagctgggggatgcgaaatgaatatcaacaagcagccaggttgctgtcaaactaaaattttcgtaaaaattatcggagtatgcctgattatgatttcgtcacgctaaaaattgttataaaatttatgtaacatagagaccgccgactgttaaagaaaagttgagattggtccaaattatgcataagtttttacaactgttcttaaatgtgtttctaattcacatacagccggaatttttctgatttagtttatttatttgttttattgtctgcattgaatgcggtttcctgcgggacaagcaaacaaacaatgtttagcactcgtggaaaagagattgtgttcagtttgaacgacctaaatgttcgagttcgcactccctaggttttacgctgggagggaggcacagatactacacacgaaatatgacacaaagtttttaaaactactaattgaactttaacacttcactttttgcaaaaaataaaacactaaaattactagtcgggcactcgacactgaagaagtctgtaagtcgcagacgaaataggcctttctgtcaagataagcaacatattagagtttataagtatttgctcgccttactagtaattcaagtattctattttttgcaaaaagtgaagtgttaaagctcgattagtagttttaaacatactctaataatccctcccctaaatataacaaaaaaatgtgctgacaaagtttttttcaaactgcaagaaaactccagcttgtcaacgacaatcaaggcagacttgatgaatatcgctagttttcttttgttgtgtaccttcgatcttttcgggcaagcacgaaaaaagggacacagttttctatgcattttattttcgtatttagtggaaaaagtaaaatgttgcgtactttctattcaatcagaataagaggtgctatcgtgacattacttttgaatatgcatgaatagcttctcaataaattttttgtcaaatttgaagaaaagcaaaaatatgttttgatcgattacgcgcttttaacatccgggctcacagtgacagttcgtgacagcagaatctcggctcactttaacgtacataaatttcgtatcggtttcttcctcccaggttttacgtataagatatcgacagagcttatacagtatcggccatttaaaatggatcaaagcctatatctccgccctgtctcaacagaatcttttattattttctctgatgaactaaaaactacctcagttgttgaaaaagttgagtgaaaatgatttatttagtagttacagatattttgaattttgacaaaaaaaagtgataaagcagaaaaactatgagtcaaataaacatggtatcttaagcacgtttgttcatagggagcaggtcgttaggccgaatgccgttaggccgaatgagttgttagaccgaaagggtcgttgggccgaaataacatttgatcatttactgctatttcaaaaagctacttaatacattcatcagtgttttttccttctttcaatgaatgggcttctaggtaatgcaaattattctgatctaacaactaacaatccattctacctacaattcaattcggcttctaggttatgcaaattatccttaaccacccttgttaccaattcgacctcattagaactatcggtaattttcagcctaacggcattcggtctaacccctaacaaattgggcccaacggcattcgccctaacgagatagaacctattcatcaagtgagcatcaagagtgcatgagcaacaaaggcgctgagggcatcgagataattcaacgcatagtttttctgctagatcattatttatcttggtgcctttttttaaatacaagctatctgtaacttttaaaataattgtttttactggagatagtcgaattgcacatttttcgaaccggaacccgacttgtacccaactaattttattttttcatacccgtactcgacccgaacccgaaaaaaatcgctgatcaaacccgaacccgacccgaaatccgaaaaaaaatgtaaggagaactcgaatgaaacccgagttcgaaaatatgatgaattaattgtttcttattgatgagaaagctttaaggttgctactctgttcacaattcacgtcaaacccgaaccaaacccaacttttatcaagcccgaacccgataattttgtagccttcaaaccagtcccgatcccgcacctgacaaatttcaaattttcagacctgaaccttacaaagaacaacaaaaaaacaagttttcaatcgttggtgttttcttcaaatcgagtgaagaataagagtatgaaataagtgaaaaaatctggcgtccatcttggatattgacaccaatttgattttaagcagtagaatgagtttttttcccttgcctagcactttgttgaatttttcgctactgtaacgcttactctttttgtttttattttcctggcatcacgtccttactggagcagagccttcgtctaagcttagttagttataaaaaaggcagtaacatgagaattttcttttataatggtatttgtaccagaatgaatcttcggcataccttcgagctcaggaatagcattatatcttttatttatttggtccaaaaccgttgattgaaattaacaatcaattgaaccgctgagataaaaaaaaaaatgaaataatctgattgtttttttaacgttggctttatagttcaacatgattatcgctaagatggtataaaattcattcaagtgtttaaaaccaagatggcacccaattccaagatagccgctagatttttcaacttcaaaatgatactcttgagtattggcaatgcgtccacattggaacaaagcctgcttctcaactgtttaattacgctattttttcacatgtatgttgggcggctgtcaaaatgatacttgatggcacaaaaatcaaggattttattaactgaaaggcttaagattatttctataaataaatgcacttttggaaaaagagtgttctgtgtagacctaagctgtcgtgttcgttttcacgtgtttatttttatcagagtaatttctttctcagttagtctgtgtgcgttaagtgaagctgaaagtggattgtagctgctcagccaaatattagggatcaattggtgagctcgtttcatgcttttatttcaaatctgtacaatatgtattactgcacatttaatcgttacaacggaggaatttaaatattaattttaaataaactttgaatggttcgacactaaaagtgtagacctgcaaaaggtaatttttctcaacaaaatataagtgattcgccactgttattgtcggaataagagtgatgcttaacactgcgaaacagaagaataagaagaagagtatacgtaacctgttttagtagtagcctcgaaattgaaaaacaaggtgaaagactaattcttagattgaaaataaagatggcgtcaaaatccaagatggtcgaaaacatttttaacttaaattaatacttcattcgactcgaagaagataccagcgattgaaaatttgtttctttttgtacaaaaaaatatgtttgcattgattgcattcgtcaaatacactaaaataaataatatgatttagaaaatagttcattttataggataaacatcattgctcacctagtttttgtagcctatctagctcagttttttttctcaactttctgatggtaatctcagaactcgaaacaagcgatgtgccaatggtgaaaaaacggtttttctgacaaaatccaaaatggcggcttacttcaaaatgactaccaaagtttgtttagcttcagatagaagctacattgttcctctatacgatgccactaagtttgttatgaattacaatagaaatatcacataggggaacttacgtattctcggcagtctaagccgatgccacgcttctaatgtaattctctcagacatcagcagacaaattccgtgtttggctgtttgcatttatgtgttgctcaatcctctatcgattcacaccgattgacttgttaaaatgctttcggaaacgtttttacaacgctgcgaacatcttttgtcagtgtgactattgtcggcagcctcgttttgttcggcaactttcccataagaactgctggtgaatctcttcggcagctccaaatcaatcgcattttgtggcgtgttcatttgaattgatgacatctttggcgatattgtttgttcagtctcgaaaatctcgtcagcgggaagcgggcagaacaaagaatcatctgaatgttttcattgaagtgtttcgatagaaaaatactgtgtatttggcgtttgaaatttggttgccgataatagtcgaatggtgccgaagccgtaagtctccctatcacgcgaagaaatacctatgatttgtcaaaaattgggcttttcctaaaactgtttagctagctggcgtacaaggggtccactaatttgagaaacccgaaaggaccaccctgtatttttaaaacgtactagcgatcaatgacataaaattggatttctagcgatatgtaccgaaggcggcctggttccagtgagaattacttaaatgtgttctaaagaacgcttatggatagggataaggatagggatcccttatgggaagggattctcaaaaattttatgaccttgacaaatattttattataacgttcgtgtgttttattttgaccaaacactttatcaacaaaacgttggttgtgagacgaaaattgaagatgattgtgaccataataaaatgtgataggatgaaaataggcaacagtgggtgataatttcatttcataaacgagcaagattaatcaaaagcttgctgggcagtgcacaaaacgtcttgttgaagaattgtttggcattatcattgaaggatctccatagttccatggaggatttaaggtggcggcttagtggacaatttagaaatagccgaaaagtgcaaaataattttagaatttcataaacttttgacgaatcccaatgagattttagagctttctaaagagtttacaaaaagttatcagaggcttccgaaatacagtcaactttttattactctatattgaagagatcttcgagttagggaagaatcgagtagaatagaacacaaatccagtgcaaatgcgatccaaaggaccattgagtagccatcataatcaacttttactatggcctctctctgagataccgaatatcgagtaagggagagttgactgtattactaagaaagtactgttcattatataaaatgggcatcttatgtatgctttacctttttgattaattgaagacatcgcaatcggttttctgtgcgtcgtttgacgaatgttgtacaatgttgtgatacatattaaaaaagttacaaaaataattaaattccacgtgaataagaaaaatattttgaaaggccgattgttgaagcttatcaaaattaatgattattgtaagtagcttcaaaagttcgtctttatattttttttttaattttttaaaagggcttgttcttcgaaagtatcattaaaaagaagcctcttcaaaaaatcatattataattggagaataaatttttcagatatcatgaaaacaaaattttccgccagttagcataaaaactttgttttgagattatttcagggtagaaatagaaatgcacgttatagaaatgcgcttaataggagacccgaccgtgcgttttgctaaaactaaaagaatagtatttcagtaatttaggccacaaattgataaatcactctgacactaggtagtcagagattgatggaatattattggtggttttaaagctagctcctatctaaggtagagtagaatagtaaaggatattatcacaaaatttgttcacaaaaatgaggatttttgtgatgcgaaaaatactgtttaactgtgaagaacagcttatcgtatgagtttttggaaaaactatgatgttcttcaatcggaagtatttatttagatctcctcgacaaaactcttaaaatgaactatgaaatggtatcctcagataatttcgatgtaatgggatttcgatgtaaagaaaaattgttgaaagtcactttgaatcgctggagaattctaaaataactaacatgttctcgttttgccaataaattacaactacaattacaataactttcagagcttctaaaattgccttaaaaactcctgagcaatctttgaaaacacatggaattacttagatgaacctgaaaagcttggaacctatgaaacttctaggagcctcttggtaacccctgtaaactctccaagatgatgagtatgagtattactttgagtttggaaatctccactattaactcttggaacttctttgatgtttctccctgagcaaactttagtaaacattaattccagaactaactattgatacgctgatactctcgggaacgtcttaggaactactgccaaactctttagcgtttagaagttatttgaaagaaccttggaaggctaattacttggttttcgaaaggaaagaagcatcgatttttttttatttattatagaggttagcagcatcgatattcgtatgttggttattccacttttgacgcggaatggtataatgtttatagggtgagcccaaaatgtacatgtttagtttattcggtattgaaaacaagcgataaaagatttgttaactacttcatagaatatttccgagcattatctccaagggttagcggagagtctaaatttgcaaaattaagagaatgaattaatttatttaacactggtagaactttatgaatttatttttggttagcaatcccactcaatatttcgcaaatttccatttatattgcatagtagtgaaaaatgttggtgaaatgttttcaatttgacgaaatgtaaaaaaaatcgaaaaccaaaaattatgcatcttctaagtccgtggagttccgcaatattccgtttcaaacgcttttccacaaaatcatacgaaataccgcatacccttcgatatggcaacattatgggatgatgatgcgatgcgtgtagcaagcagccagtagcgtggtaaaaactcgactggattataaacaagcctcattgacagctcgatgacgagcagtgtcactttctgttatgtgtttgttaaagggcccgcctcagcgtcgaggagtagcatgatttatttacgtggagtttcgtggatttcatcgcgtctacttcggccgaggaaagtgtcggattttatgacggatttctgtgttatttcggaacatgatattttttacgacccgaacaagggcttgtggttgatggtgcgtgacgcgatgttctccgacagtttatttttttttatccaggtttatttgattcgatggattgaagaatctccaagtacctacagtcctcatgaaccagatatcaaaacgcaaattagtccaattaggcgtcacgcgcaggcagctgttgcagctgatcgagtcttcttcgtttcctcaggcgaaaatgtgtttgcgtgacacctactgcgatgtcggccttcgtgtcgttgtcttcaccgtataatccaattccagtggcatgactgtgcgctctcccaagtcgaacccatcacagtagactgccggcgatgggaaaaagtacggcgcccgagttctaactgtgttcttgctgatcggcgtccctcattagcgttgtccaaatagtaggcaaaaaagcgtaattctgcgggatgcgaaatcgcttccagctgaatcagctctcatggaaatgcttatgggaagtataagtggagaagtgcgaagcgatctctagatgatgctcaactggtgagtcaaatgaactggaacgtgatgcacgcgacttgtaatttccttgggtacagtgagacatcttctctattttcgtttcgtcttgtttgggactagggtcatttttcactgctttagaaacttatgcacgcatctgaaacgaaattcagtcagctatttcgatgcgtgagatttatatggccttatagaattattcaagaaatcgtttttcttagattacacagatatgattctggaatctaattattattccagggttttttttttcaaaaaaatctcaacagtaattcttccagggatctttcaggagattccttcaaagatttcgcaaacgattcttgcagccagaggcacgtccacgttcgaaatcatggataggacaaacggtttcaataattttgtgcagggtgaaggtaaaaaaaattttaacctcatggaatcttgggctggaaataggaaattactagctcaaacgcaaaggggtattagtggcattttggtccttttctagttaaattgagttgaggaaatactactgttttcaagcgtgttaatgatattttcaaatgattttcccgatcaacagaaaagatatcataattcttagaagactggcttgttttttgactccaacgctattgtatagaatggaaaataattgaaaaaacttcaaactagatttgctcaaaactaggtttttgccactgatactgtcttgctgtcattgccacaagatcaagaaaactttttgtctttacaaggctggtagcgactaaatgctttaaaacagaaaattagagacctgaaaaaacgagaactaaatggaacccaactagaggttgaaaagattccaaacagaaaccaagaaaacaaaacaaaacctaataggagccagaaggtaagtacttgattcttcatagcatcagagcagacatttttctaagatctaagactttttttgagaattcttcgagacatttcaacaagtattactgtatgtgtttttcatgattttctctaagaattgcatcagaaatttattcaattatttgaccaaatgttcagatattactccggaaatttctaaatgagttcattttaagaataacaatttctccatgagtttctccacgaattttgtttacgacacctcaaaatttcaacttggattttgtcaagaagaaccacagacgtgaaatctctccaaagattatttcagtaatcatttgaattcctcctgaaaactaactcgtgtttgaaagtcctaactcctccaagattttatccagtggttcattcatcgatttccctggcacatcctccaagattcctggtcaaaacatcttctaaaatttaatataggaaatccctggaaatttctggagaagttaaagctccagaaatgtctaggtatttcctatagaattgtcttccaggattaatataagattgcaactaaagctttctctaaagataccttctaccattgccttaaggaatccttctacgatttctatacaaatacctccagtgattctttgagattttctcaaaaagccttcaattttttaggaatgtttctagaaatgtttccaggaaaatgtcaaggaaatttaaagtgataaacttgtataagtttccaagccactttcaatgaacaaggaactgtgaaataactcctagtaagttttagaagatttcctagataattttctgagataatcgaaaacaaatcaattgaatctcggaatagtactccgcaggattttgtgaagaaatttttcaaaaaaacgttgaacagaatctcgaaagaaattggtttaggaatgatcggaagaattattgaaaaaaaatctctggaattatctggtaagacaacttaaataaaactttagaagattggatgaaatgcagaagaaattcgtagaaaaatgtagatttcttcgaagaaacccttaaggaattttaggtttctgggaggaaacgtggatgaatttttcacatccattcatacatgaacaggtggatgcattcttgcagcgtttgtggaaaaaaaaccctggagctattttttttttttttgaaaactctgaaataaacctttgtggatttcctcgaacaaaattcagtagatttctttgcaagatctcctagaataacaccactgtgctgtgggagttctatctgaattcctctgaaaatcgtcaagagattcagcaatgctttgatagattatatcacgagtgattgcacattcagaaattgctagcatcaccacacttgtcctatgtataacacgatgcgactggtactaaattaatcatttacttcatcagaagattcttgaataattttctgataattttcaattgatgttccagaaaaatctcaagaattacttccaagaaagctcacagcaatttttcccaggatacattcagcccaagtaacaattccacagcaatttagcattcgtgtggatttatcaatgttttatgacagtttcgtgaatgctataatagctagaagcggcatttaacgttgctagaagattatattttgtaagtcagctcttggttgttcttaaaaccttttaagacaaaatataaactcaaaatgttgtgatgatgatgatgatgatgatgattatttagccaccatcagctcaaggattacctatggctgcagaatcatatcgggatggaatgatctacctgatggtttgttgtagcagggctagttaatatctttgaagacctttggaagacaacactaaggctgttttctcatgacaaaaggctggcgaccccacgcactttcatccagtcaacagttcaattaactcccttatgctacccctccccaatacccaatatatagtaatatatcatatatagtgttattaaagtatcctgttcccacggtagactaacaagaacccattttccagttaacaagttttattatgatcaccagggtagtgaagtagtcattagtataactctcgcataatttttgaaatgctcagaagcgaaattgaccgcagattgtgcagtttgccgatctgagttgatcggaacaaacccgatcaccaatagcccttaataaaacacaggccatggaagggccaattgacgaattcaccggatccaacaataaactcaaaatgttgtggcaacaaaaccagctttattgcagcatatgataccacatttaaactgtttgaagtggcttatttgttacggctatgataaaagattgatataatacactttgttgtcataaaagctgcttctaaactgattaacttgcacttgaatctggataacttaccttatcatacctcttcaatcagtatgattggggctcttaatatgcgataacactattagcattgcgaacttataacccaccacaccataattgacattgcgttatttatcaaaaacactaaactgcgaccagaggcgcgtccacgttcggaaccatgggtaggacaaacgttagcaaatttttagtagtaaaacaaagaaaaatttaaatcctgttgcagcccagggttgaaagcttttatatttgaagagctcaaacacaacacaaagcgatgtaagtgacatttcggccgttttgagttgagttgagttgagaaaatttgtctgtttccaagcgttctaacgatattttcagatgacttttcggctcaactaaaaaatagcataattcttggaagactggtttgttttttttctcatcgtaataggctgttttttatcctgccaataatggtgaatgcatcccaatatgatttcttatacccttaagtggatttctaccaaaatacaaaaaaggtgtacgtaactcgttgcaagactcgatttttacagcggcaagcctcgttggatatacttacgactcgtgctgtaaaaatcttcattatgcagcttgttacgtaaactattactttttgactcccatacattttttatagaatgaaatgagaaaacttcaaaactgggtttttattcctgacattcctttgcttctacccctcaattccatgccagcatttaccacaagactaagaatgctttacgttgggctggtcgcgactgagtgtcttaaaaatagtctaaaagaaagttttttcttcaggattttttccaggaatgtctccggggaaatgccgaggattttttttctgaaaaataaatcagtgaggtatttctgaaaaaaaaaaaaacttatagtaacctctgacaaaattgaagtcacccttaatgaacaaggatctttgaaataactcctgaactcttgaagaaatttttgaagatttcccaaaaaatttgctaagattattataaaaaaaaattaatcgaatctcgggatagtattctgcaagattttctaaagaaatttctggaaaatcagtagacagaaactatttacaaatttgtggaataatctgagaaattattgtcaaaaaagttgtggtataaactagtgtaaagacttagatgaacttttgcaaattgtatatgaattttttgagaaacttttttaaggaatgtttggtaaaactgtaggagtaatagttggaaaaaaatgttcgaggaacttgatttcttgaagactaacaatggataattcggtaaaagtattagtgaaacatatccggaagattctaggaatggaaaaaaaatcaaagttatacctaaggaaattactggaggtagtagctttggagttctcaaggtttacctggagcaaattctggagaagttcttctaagcatcctttgaaaaagtcatcgaaagaatttctgggagaatgggtagagaaatctcttgaaaaacttctgaagagggactcagggattttttttataaaatcactatgataattcttgaagctttccctcgggaaatctgagccggaattctagaagaacctattgaacacgttatagtttctgaacattgttttggagcctgtacattccggcaataggattcagtgcaagcagaataaggaaaaggagaggctttaaagaccttttttgttgaaataggtactctaaagaccttggttggttggtttggtttgactttattaacgagatttttagccctgggctagttcatctcgggaccaacggctttacttcccttccgaaggaagtcgtcactataactttttacgtcataagtgactatgtcggggatgggattcgatcccaggtcctcggcgtgagaggcgagtgttctaaccactacaccaggtccgtccccactaaagaccttccgttaaaagtagagacttcttgcctttactaccagtgtggttgttctaattttctcatttatttctagacaaaaatggataaacagcatatattttgtgaatttgagtaaaccgaatcaaatatatttaagaaaccgtttattgattaattcagaaataccatggaggattgctccatttatttttctaatggttgaagaagttgtttgtagcaattattatacagttagtttcccctgattttcatttcagatattctcaatcgttcttctcgcgagccagaacttttgggggtcatgtacaaatcatgtcatactttactaggcatgagaatacaatggaaaaccttacgacattgatcgcgtttctgctgatctagtgttttgttttgttgaatcgtgggtaggacaaccctttgactgtcctacccaggtgttttcgtgcgtagtacatgtcctacctgtcctacccacttcccgcgccactgactgcgactaaatataatttaacgctcagtatctgcctaatcaatccaacaaatgttgaatatgttttatttttcacctggcggtttattttagcaaatgctaaataattagaaatatacacacgcactcaattttacttttttttcatcacatatcacagtaaatatcattcggcactaaagatttgagcactataccaacataaatcacttccaatatttaacaagcactacgaaataaattaccacagacgtgttttcaatattattttgttttgtttacgttggaataaatccggcaagatcgacgttatgataaaatcattttcaagatgaagcgacattcatccagaaaaggtggcctcaaaatagctaccataaatgctattttgctctattcgtatgacataaatatgcacttcatagcctctttcagagtgggccaactagtcacgttctaatctacaagagatttttggggatgcaatgaaggcaatagtgccttgaccgtggttttatgggcgtttatttatagcaccctggaagtaattcgtaaaactaaaattgttacttgggagggttggccgtaaatatttttgagaaaccatcaattttattgtagcaattattagagttaatttcccagtatttttattatgggggtcatgcacaaaccatatcaccatatagagtttgtatgtatgtttgtattgaacagatgataaataatttaattttttttgcaagatatctgcagatcttgtgtttaatttgttgaatcatgggtaggataatcctttgactacacatgtacgtagtacatgtcttacctgtcctacccacttcccgcgctactgcttgcagcaatttacccagataatccttccgagattactacggattttttcagagtctcttccagggtttcctctagaaaaatctctacaaggatgccttcttagatttccccagcaaaatcttcatgaatttctccattgattactttagaaaactctatgggtttatcctaaatttatttcagggattttcccaggattcctccataaaatcgtacaacgattactcatattttttataggttttactagggattgttccaggaatcccttaagatatttccaccggaatttatccagggatctctccaaaaacttcatggagaatcctccagaagaattgctagaggggttcttaaagtaatccccgaagatttttttggatattcagaacgactctctagataattttctggttgaatccatgtaggactaccttgtaaatccttgcagtaatttctataatgattttgctgagagtatctcggatctacatcacggattagtatttatgttgtcataaagctttaaagtacactttagatttcctgtgtccaaaaatttctcaaccatcgcactttttatcgaaatttgatttatttcatttacggcacttgcaattgttctcagtcccaaccagagaaataaatagctctacagtctctcataaatagttttacagccaactatttatttaatttacgattatgtgtttgcaattatagtgctccatttcaatagatcatggagcttaaataatcacagaataatagcctgatggcataacgcagcccctcaaaaaggtgtggagggagaaacgttccaaacaaaatccgaattgctaacaacttccgcctgttttgaagttcgtgtgcgggcatcgcggtcaatgattccactactaagtcccaatttggcattgtcgcttctggctgatgcctcacaaacttttttcctctctttctctttatgtggtggtgacactttttcgtacagctcaatggcaaactttttggattttcgtgccctgagccgtcaagagcaaccataaatctgccttccgcccactcacgacctggtgctgatgcagtctcaactcctacagccatgccatttggtaatgcatcactttcggagtttctttgtttcttaacggtaggatgagacgatttattagggaatcgcgtcgcgtgctttcggaacaagtcaacccgtccaaccggggagataaagcgcaaacttgcgaagactatcaatctttttggggagctgcgcttgccttagaggaagtgaaggtatttcgggaggaaactacaacagattaatagtcgataatgtcatcgtcaccgtcgtcgtcttcgacgacgttttcttactatttcattcggaggaacagatgctgctgccgtgggttttgatcgcatggatcagattacgttttgctgcggaagagagttcaccagtctcgtcaacaactgcggcacgaatcggccaaccgtaaatcaagcatatgcagggacaagtgtgaaaactttagttcagctccgctggatttgctattggatagataaatgttggttggtgaagctgatcggctcagctcagaggtgtgcgatttcaatgactcgctgaagtgttttgattttctatctcgagtgagagaaactcgagcttcggagtggttgtttgctggggaaatggcgagttgagttggatcgaaagtggaatggttgttagtcttcctcatgggaccacttcttatggcaactgtttgcaaacacacagcacaaatcggttcaagagggaattatggtttacctacgaaacttaaataagtaaaacactcatcgtagcgataggttttctctagtaatgttgataatttgttccgacatttgttctaatgaaccatcactattatgttcaaaattttattttgaatcttctgcagagctttctttttggtattacaacagctagtccatattcgttcagcatacaacatggctggcctggaatttgtttgaagattaaaagcttgttcttaggacaaagttttgattttcttccataagtccatatttattacattttactttaatgcccttaatgtgatttttaaaagttcaatttttatctagcataagccttaacttaacatcatctgaccaatttattggaactcctctcatcctgacaacatgtctacttgaaggtttaaaataaagtgcttttggttcatgtgggaataatataagttaagttttggaagcactaggaaaaatcttccactttttaaagtattaagaaaacaatatctaaactttcttgcattctactacatatgacacacaggcttcgtcttttgaaggaggtgtcatccgctaacaaagatttttgacatccgtgaggtaactcaggtaagccagatgtgaaaatattgtgtaatattggtcccaaaactgctggctgccttgaggaacaccagctctttcagaattgtaatgctgataattaaactgaagcgtacgatttgacagatagctttggattattctaacaatgtatgttcaaaaataaaagatttttttatttcacaatcaagtcttcatgccaaacactatcgaatgctttttctatgtctagaagagcaaaaccagtagaatagctccagatttgttggaacgaatcaatttttttacatgcagtggtgcgggaattcggtaggacaggtaggacatgtactacgcacaaaacatctggatagaacagtcaaagtattgtcctccacgactaaacaaaaaaacatacaagattacactgttcgacaaaaaattgtttttggctggatcacggacgcggttatatgggtcttgggctgttttcaaatgatttgcagcacccctggattagtttttgacaaagtttgaaaattttgcatttttcatcaaaaaaagcgtaataagcaaaatatcaatatattttcaaattcaattattcaaccatttaattagtcaaatcaatattttttagccctagatcgcttcagggaaacgtgcaccatttcagaagaatattggcatcatttttatatatgaatttggaatgttaacgatcaataaacaagcatatgaggatgtgaaccatataaatactacttatttttctattccacacatctggttcattataataattattataggttcaagaagacgcttgattaggatttaattttttgctccattttataaagcaatgagcaatgcaatccagtaacatttgatttcaacaaggatacgaatacggaaaattgatgtgtctgttatgtgtatatgggctggttggtctaataaactcttggcagtaatacaaaattaggatggacactgacatgtaagttgtcttacatgagctagccggtttatcaggagccgatggcgaagtctgtgaaaaatgtcataataatgttatttgcgatttccaaagatttttaaaggtactcattaagaatagattacctatcgtgaggtccatttgttatcagaatatccctagaaattacagactaacgtaaaatagcaaccaataattcagtaatcaacatttccacattttttgtgacaacatttgacagccactcaggcaggcatgagatctttttgattcagattgtgcgcaaactattatttgtgaaaactgatttagtggtaacatgcctacttcttacttgtaagatgaaacaatttctggtaaaccatttccgatttttttgttggttctacattttacatatttttcggcaattttaatcaaactttcaaatggagcgttagtttcttgttcaatgagatgttttgttgaaaaatgcaaaattttcaaactttgtcaaaaactaatccaggggtgctgcaaatcatttgaaaacggcctctttctacacttttcttgcacttcaagacccatataaccacgtccctgatccagccaaaatttttttttttgtcgaacagtgttatcaggaagcttgacaaataaattaaataatttattatctgttcaataaacacatacctggaagtaattcttgagtagtttcgagatcatccatgggaaataatcggaaggttattgaagaatctttgttaaagatggacaaaacggctcatactagtgaacggatgcgatacgaatcacttgttttagtgatccggatctttgaaacggttcagtgactaagcggctcgcaaaagaagagcgaactgaaccgagcgaaccgaaatagagcggtttactccctgttgcgcgacattcgtcgttcctttcgtatccttatctctttcattcttcgaacattcttctccagaaactcatgatacactcggctgattttacctacccgattcgaaaaaagaagcataacatgtgcttggcattcaagtgggtactttttcttactatttctcgaaaacttattcatatagactcaagtcaaaaaagtatactcacttgctttatcgatcctacgtgtttcgcagaagaaattctacacgtttcactctgaaccaactcgatttttcacttttagaacgtttaatttccgtatttacaaaacgacgaaagtaagattttcaactttcgcaacctaaccactactttcgccgccccgctgtacggagaaacaaagtgacctaacctcgaatcaaaacaaaacactacttgagtcgaattaacactggtagaaaaacgtcgcaagtaactgaataaaacggcttatcattttgtcataaaattcttgtgtgaaataataggaactccatagtttttgtacgcgagcgcattgtatgcaaaatttgagcaatgtacacgtcgaaaaaatgttaaaaggtgattcaactgttttggaagacaggttgtgattcttctgaattaattttcttaaaaccgtatggaagttacttacgtcgatttgaaaaagtaatcgagatttcacattttcctgtgtgcaaatgatcgaggcaaatgtgtctgtctatggtgagggcgcagagaggactgtgcagcagaaaactttgcttgtatgtgtggcgtggcgtgcaaagcaaggcacgtgtcaagcgttataatgagcttgagcttcagcttgaatggccgcccgtggttgctactccagtatcgccagatcagctgtacttacgcaaggaaccaaccagatgactgctttggattaacaggcaccctcagtgtgtaagtgctggtgatcttctctttttaggcaacaatggtgcctgccacgtcagaatgcagagggaagggaaggaattgatgatgcattcaactggctcccatggttgaccgtatataccactgcgtcaacgccagtttatgcgggaagggtgaaaggggtatttttttttaatggcagagaggcttgctggtttgaaagatacaactacaaagtgcttatgaagcagaagcggtagtcattagaccaccaaccccgtctatcacgtgtcaagcgttataataaagacgagaaacgaacaaagtaaaataggggtaaataatcggttcgtactttttccgggtcactttttgtctgatccgtgctgatcaaatgaatcgactcttgccaaaaaaagagccacagatcactggttcttttgagtgatccggacactgcaagagtgtgatattgctagcgatttctgaacttgtgatcattcttgatataatctatcaaagcattgctgaatctcctgacgattttcagagcaattcctatagaactcccacagcacactttctagaaggtcttggccgaatccattcttaattactgaaaaatgatttgataaaattcctactgatatgttgtgtttccattcatactaatatttatagcagattaggacgactcttgaaggtttttttttgcaaaagtgtagaagatatgccagcaaaatattttatggagtttctgcgtgatgaaaacattaaagttaattggcttttactttggtgcaaagataaaaaaatctacataaattcacagattttttgcggttcaactatttgttatctagaattagattaggaaatgagaactttcttactgataacttactggttgcaaaggtcagcagtttgctcttttttttgtgaaatttgtttcataaaattgatataaataaaaatataaagatagagaaatttttctaccaattatcccagaaattcttccttccagcgatctttcaaaagattattagcagattttctccagaatttgctccaggagatccttgagaactcaaaacctactaccttctgtaatttcctcaggtattgcttcgatttttttttccaaaactatcttagaattttcttcgatatttttttcactaatccttcaaccgaattgtccagtggttactttaggagatattttaaaaatttctccgaaatttctttcgagtaaatccacataggtttattcctgagtgtttgaaaaataaagcgctaaatgtttttctccaagaaaccctacaagaattcctcctcctgttcatgtggattctttaaagaatttatccttgtttcctcacagatatccaaaatttcttgagaaattcttcgaacaaatcatttttttctaggattttttccagcgttgcatttcttgttgctctactgaacatttctttaaaaaaaatccaaaaaattcccttgcaatcttggaaaattaatttaagttttcacagcagtttatacaacaacattttttcaaacaataattcctccaatcattaatacacaaatttctgtagagattttgtccaatgcttttcaagaaatctcttcagaaaatcctgcaaaatgctatgccgggatttgattgatttttttcgattatcttagcaagttatctagaaaatcgcctaaaacttcctcaagagttatttcagaaatccctcatcagttatttcagaaatccttttttcattaagggtgacttcaaaatttattcaagttttatcagaggttactctaggattttctttaaaaattcctcataaatttatttttcagaaagagatccttggcatttccctggagacatttctgaattaaatcctaaaaaaaatcaaagcttacttgagctgcttacttaaatttcaaagaattacgggaggaatttatctagaataagattttaaagaaggaatctctggagaaattgttgacggtatctttagagaaattcctaaataagtcgtatactatcccgtataggcctgagtgaaagaaaaaatactaaaactcgcaccgctcagcgaatacttaacggatttcaattttttttggtcagtatactcgtacacatatctagtttctaaaagtggtcaaaggaactgaaggatgttcatgtggccggagttattgcggtggatcactgggtcaggtcgggtgacaaaggttctgtgcttctttgccccaggagataggcaaatttcaagtcacagataatttccagaattggctataatgtggccactatatcaagaagtttcaagaaaaacacatcagcgtaaacgttctgataatcgatttatttgaataattatgtcaactgtatttgattgatcctataagtgaccattttcgggtcccgggatgcctcaaatttatgataaagtgcagaatttatatcttaacgtctgtgtcaagcttatgaaaacgcattttagtgaactatcatgttcgatctatacttttagagatttgaaacggtttagtatctaacaaatctagagccggttcttcagggaattaagcccgagtgtccgcatctggtacactctaaacggtgcaaaactattcatttgtaatgttgaatatcaaaacttaatgatgtatgcaatttgaaatgattgccagtggaaataaataaatttaactttgcatatcccaaaaaatcgcctttttctacccgatttgacccagtaacccaccgcaataactccggctacaggagtattcccgagttcctctggctacttctagaaactagatatatggaccagtatactgacaaaaaattctttgaatccgttaagtattcgctgagtggtaagggtttaagtatttttgctttcactcaggcctatacgggttaatcgtgatagacaatttaaaaggaaatccctagaaatacctagagaagttattgattcagtttaagaagaagttttgaccgggagccttggaggatgttctagacaaaccgatggataaatcactggataacatattggaggagttgggactttgttgaaaaaaatctcaaataatatttggagaaattaagatgatttctgaaataaactttggataaatttcatttccgtggatctccttgaaaaaaaaattttgaaatcttgatgtattccaaacaacattcttggataaattccctagaaaaactcgcggaaaaatttactaggaaaattcgtaaagaaataccctaagaaaattcgcggggaacatccttgataaataatcacttaatgaactcctttggaagtttccggaacatctaaacatttgggcaaatacctaaataaatttctgatgaaattgtttgagaaaatcatgaaaaacacaaaaagtaacacctgtcgtaatgccacgaggaattctcaagaaagtcttagatcttagagaaatgtctatgagagctatgaaaaatcaaactcttatctcctagctcttaggcggcatccatttattacgtaacgctaaaatttgaaatttttgaccccctccccccccttcgtaacgctttttgtatgaaaaatttcgaatttttgtatgagccgtaacgcttaagcctactcccccccccttcccctagagcgttacgtaatttgtggatgccgccttactagattccgttttgttttctcagttcctgtttcgactgttttccgcttttttggacccttttacttgttagttttttttctggcaagtggtattttctatttttaatgaactcaatcgctactagctcggtaatgacgaatagggttagaagcaaagcggcataacaaaaacatagtttagaaaaacactattcagaagttttccagtaatttttattccatacaaattgtacgggagtcaagcaagttttcaaagaatcatgttatttttctgttgagcggataaatcatctgcaaatatgataacgctttgaaatagtagaatttcctcaactcaaaatcgaccaaaatgtaccttacatccctttgcgtttgagccccttaggtatagtaactttaaatatccagttcagatttaaaatgtttcttacctccaaggcgcaccacatatttgctaatgtttgtcctacccatggtttcaaacggggatcggtatctggttcaggtatcagaaggccggctccaaaggtacgttccctaccagttgggagatttgtaccaaatatttgattcaatttttcagttagaaaaatgaaatcggagggagacatattacttgaagtgggtcattatgtgatgactttccgttagaattttcggtagacgaggaggcggagtagaagtttcctttggcggcagggttctttccatttgatttgaaacaattagaatgggtactcatagtatgaataggggaggagttcaaattacctgccacgatatcggcaaaggaatttccttgggtagatacattcgaaattaaaagattcgaactgtgaatgagcatgattataatcttcctgatgggtatgattcttaatcaagcgatcattaactgaaaaatgagcattgttcgaaactctaccaggcaaattccggaaacgaccgttatcgtaacggacattacctttcgttcatcagcctggcacgagcttcgacgattctcatacgcgaagggcaagcccaacagtttgacttatgattgcccccgcaatttgcgtatgtcaacttatcggtaccttccttcactggacagacgtccttaacgtgggaaaaacctccgcaaatcatgcattcagcatccatgcggcaatgttttgtagcatgaccccactattggcaccatcggcactgagttgggttctggttatttcctccaggtttttggaaatgtttccatgtcacacggacatcgagcaaaagtctagttttttctaaagctttaatattatttggatcttttttgttaaagcgaactaaataatattcttgagaaacccctttccaaacaatgcctgattgatttttttctcataatgattacttggactttgtagtaaatcatttatttaatttttgatctcttcaggtgacttatagccacttgagagaccattaaaggcggctttgaacaaacaatcagttttgtcgtgaaaagaaaaaaatttgtacttcttatcttcaaaatgttttagaagaagatcgcaatctttaagagtgtctggcaaaacgcgacagtctcctttctttgcgatttggaaggaaaccttgattcccctaaaggagttcaagacctccagcctaaatcccccaaatttggatatactgatcacgataagcggcattctttgttgccttacttgatacaaagagcctgggctagaggctgcttccatttgctgcttaaaaaattactcatttcaatgcaattttcaacattttccttcacagaattgaacatggccctgggtttcaaaatttatttgaacaacctccaacggaaataacatattgcagaaaagtcctccccttcttattgtaattcaaagtagcgaaccgcacgacaatgttggtggcagaggtgagcgcaaaaatagtgaaacatatgtccaatcacgtttcagcagttaacacgtccgctctgttgaggacgaccactacttcaccataatgtggaaccaacttacaatgatgactgactccgagtgactccgagtgacagccagacaaacgatggatgggcagcatctttctttctcggtgccacttgacccgccgaagacacacgccgccttctgcctgagccgccgcgggtgtaaaagtgcaaacttggaagacacgacccgaacgtgccacggatgtcccatacgacagaccaaccccagaaagaaggtcaatgagccactcgcaaaacggtcctaagcgatggcaccttcttgcctttagggtaatctgagcaactgtggcacttcttcgttggctcgcattgcgaaaatctgctcttccaattaacagttgcaccttcttgttcaaatatggctaattcacatcttgcgagaaatatgcaaatgagtattcgatgcctgatttatccccacatgaagcttaggccacaacctacacgatcccagacggctgacacattaaattaatttgattagcgggctgcgagggtcctaacgagcaagcagcctcccttcataccatccacattaggtgagcacattcgtggcagtgtgcttcatgttcatatcgatttccaacatttcgttcggattcagcattttatcttatcggttgatcgcgcgcttgctcagcggtatgcacatctcgctcgacggctgcatcaataaccattgcaaagtgtggcacatggcatgcaaaattaatgctactaaaagcgataagcaatactgtgcagctcgatgcataacgcccagatagacagatgtggtggtcatgggacgaccgtttccttggttggatggtgcttttaaggggtgcggcgaggaaaagacaaacaaatcaatttttcactttcaactacttaccgagctggtgttcgtttggttttggcttctggagttgagcgcaagatggttgggtaaaaataaccgttcgattcagtatgcgaagtttgttactctgggtcagacgaaaacgacgttctatcaatatcaagtgagagtttaaccataactaaaaatcaaaaacattatgacaatgagtaaaacaaaatcttaaatatctcagtgaacattcggagtacgagctcagaaattcgattgagtgttacttggagttgtaaacatctatcatcaaaaaataagacctcggtggcttattattcacatcattaaagcatattatcatacatgaagcatcataaaaagtccaaatgcagaagttattcaagaatcaatttgaacacatgcattttgacccatttcaccctcaaaacatgtaaacaagttcttagtgttcaatttcattgtgttgaaagtttgaccttgtcgaaaaatggcaagttcggtaaatgatatctttgctgtgaaagtattcacagacagaacgaaagatgagaagcaggctccgttatctcaacatttttttcccactgaggacccgccggaaccgattccagggtatccggatgtggccagaacctcatattggtccatggcattatatctaagtttaatatgtaagtttcagaaaatgtcctctttgggtacattcaggaaccggtgccaggtatccgacagaaccaatgagaaccattgtcattcgaccttctggcatttttttacttctgaaaaacacacaatgaataattttcttaccgctaatcttgaaaaatctacgtgaaccttcaattccggtacgaatacacaccattttaatccggaataactccggaaccaagtggcaaagcttatttgttctggatcgcaataaaccttgaagagtatgtggtttgtttcagaccaaaagatccaaaatcagtctataactggttagacgttgggggtttgagagttaatggaaggtctcaaaagtaactattttgaacaaaatagtctaaagtctcattttccttattctgtttgcaaaattgtaatggcccccattggcgtaggaacaggggggggtggcaggagggcctggccccctccagcatcatccatgcccccccagaatttttgatgataataaaaaaaattgattcacactgttttgctcaacatgaagcaaaattttctgaaccaatgtacatcacccttgttactgtcaaaaatctctttagtagttatgttattttatgtcttacaactatattgagaaaacctcgcttatctaacacagcatcagcgtggcggatctgacttcggtaaatttgttaaaaataccgtggtacaaaaaaacgtcaatatcctggaaattttgttagcaaaattagtttttttttctgaataatccaaataatactcgttcaatataaaacagtatattcactgcattctgatttctcatgtttttggaggataccctgctcgaggtgcccggtgatgataatatcccttataagagttctcaaagtccgaaaaaatagaaaaaatagctaaaggaaattcttaaacaatacacattgggaatgtttgtcgaaaaataaggctataatttaaatttataattatttcttgctttttgtgaagaaaatatggacattttgaggtttttaaatgtaaaattcgttattttttagtgagattattgtcgattctactgcacttttgaatctgtttattgctcaaaatttttaatttatggaaaattttgtttttttctatgcacttctttatttttttatgtaaatttataactgttctgttgattttacccttgtttctttactggcaaattttgcatttttttatggaaatttcatatttttttatgggacgttaatattttagccattgattaatttcctacaaattagtaccaatttaaaacaaaaacttttcgatattcttcattgaattttaatatattattcatcaatgaatatttgagaatttttgcaaatctcttgaaaattagtcaaataatattataggacttgttcacactttcaaagcgaattcctcctgatgtttacttaaaaatgttacttaatttttcaaaaattcagttttttctcgcatttcttccaaaaaatcattgattctgtcaaattaaatactgatatatttcgctgaaagttctatttgaaattcttttgcggattttttcaaatatgtttcccgaaatttttataacaaattcttcagcgaagttcatcaaaagacacaaattgcatcaaaaattcttctttattgttttctagaaattttccttcatatcctcggactgatcaagaattggaaaaaaatgtttttgaaatgtctcttgcattcgtatcttcagagcaaattcattgaagcccaccaacaaattagcatagcggtaaagcaatctgtagagaaacatgtagcaaaataactgggaagggagaatagatttattaagatatccatatagaaatttgcattgaccttcctttaaaaaagttatttagaaataattttaccaattaatagcagaatgtatattcttggtttgattttttgtgcgatactaggacggaatttctagagcctttttggcagtattctagagaatctaaagtcaaggaaggatagatttaaagaataatttctaagaaagattctaaagtaacttttttagaaatttgttttatttgtaaattcattaaagaggttttaactatcctgcaatttacctctagagaaaagattacaaataaacttatttttcgttgtaccattgctcattgcagtattgttgtacctgtttcaacattttgttgtttcttcttccttcgcatgacgctttgaggaacttcatggaaaattttttccatacaccaaaaagcaaaatttgcaagaattttaatattctaggtaaattataggagttttgaaatttttttgaattcatatacgtataaaacctattctgaaagtccatcaggaattcctaaacagattttcaaagtaatgcaaaagtttcctctaattattcattaaaatcttacattacgaattcgaccacaatacatcttcggtaatgttcttaaaaataccggcaatattttcgcgttaaacttctacagtactacaaaataatcgatgtagatctttaaaaaataaatgtttgtttgggatttttaacgataggaaaaatgggtttaacatcaatatgtttaccatagtatcatgaaacttcggagttgatacttaatattttctaagattatagttacaaacactttcagtaaaaattccatccattttaacaccaatcattataatacaatagacgaagaaaaaagaacaacattttttgtaataaatcctacaaggaacacttgagcttttctttgaggtaaattgtcgactagcctcagaaataatagaatataattctttaattttacgaaagatatttagtatattttttctaattatatttacgctataactattcaaaaaaatgaaaaaaaataatctttcaaacctttttgtatgtgtttctttaaacatcttttatggagtgattcgtagatgaatttgtaaagcaatccctaaaaaatattgagatattcctggattattttttgaaccaaaaagggagagtggataaattttaaatttttatatgtggaaaatcaagagaataccattcgaaaaaaatggagttatttcttgaacctaaaagaaaacttgatggagcttctgaagatttttttgaaaagttcaagaatgaacagcaaaatcttagtaaatctgatgaacttcaacaaaatcacatgagaatcgttattgcggtttgaagaaaaaatctgtgggaaatacttagatgaaactctggtaaattttttggaagaatctaagggaaacattaatattattcgctaagaaatccctaaacaaagtactcgggaaatccttgagaattttcgcggaagcgttttcagggctggtagcagtcagacagcaaaataatagtgacttcagtgaccaaaattatcaaaaaagtgtccaaaaagtgacttgaaatctacaagtattagtcataataatgtctagaaatgaaaatacgttctatgtgtatattaaccaatcctaggccattttagaatgaagagaactgcagtagtttcaaatctttcttaacagttatctgtccgagataagatttgattgtcatgaatggtctaaaacatagcgcatttgggatttaacttattattttttacgagacgacaacattagcttaatatatgttactatgttatatatttgatttcagtcgagaaaaaaaaacaaaaatcaaataatgaactctggtaaacgaactcgtgatcgattttttgcaatactcttatttatgaggaacttactaacaaaattcattcaagattttgaaatagagatgcaaaatgaattacttgaggcatttcttacaaaatctgtggaataaatcgatggaaaatttttggataacgacaaaattgtggcgaaaatcgtgaataaatttcagaagaattgattattgatgaactccagacaaaccaaagcagatgaatgtcgtgcattagaatatgattccacgcgtacttcaaataatcaaatttcaactgaatatttcaataaattgaaaataatcatatcactcaggggcaactcgtaacctcacgttttatctgatatacgaaccaaagacgtgtaaaaaaaacagtctcaaggattaatcgatggaaaatgtactgtttatttgttggaacttctaatgtaatttctgaaatgatttccatcaaaattagtacttgcttttgaagttgtagacgaaagtccgacaaactttgatttttttctctttttattcctagctgtctctggcttatcttccggaggtgttttgatgatgttctttcagaaagctggtttaagatttcttctatagccgttgattactcagatcagatattagtccttgtttttagcaaaatttaaaatatttcggacaaaaaattcatcctaaagtttttaaagttgcttgtaaagttttgccagaatcttcaccaagaatttcttaaattttcggatggaaatgtttacggaatttgagttcttccaaaaagttagccggtagggcggagatgaaccagtctcgggctgaatttccccatataaggagtcaatagtaatatagttagccgggagtccctatttttcttgagtcaagaaacctgactctttgatttcaaaatcaaactattcttgtacaattttttttctgtttgtgtttttctgtttgtgtttgaaaagctaacccagccttgaacttcattatcaaatcacgaaaaaagtgacttaagtgaccattttcctgaaaaaagtgaatttaatgactttttgtctgaaatagtgatatttagtaaccaggtcgaaaaaagtaaccaagtcactaaaaagtgatttgctaccagccttgcgtttttgaaagaaaagttgaacgtattccactttatagaaatttttgaattctttaaacgtttcctagttggattttttttttgagagagagagagagagagagagtttagaaggtatgcaggatgctccttgattttagagaaaaatatctgcggagaacctctctgagaaataatgaataacattttcccaactgatttctttttaatttcacataaaattctattggaatattacaaggaattcttagagtaacacctggaagaaacatttgctttttttcacgaaatataatatataatttttgttgcgtcttgtttttcaaacaatcctgtagagaaactttaggatgaacttcaaaagcaaagttggaaaaaatgttggcgaaatctctgaagaattcttggaattttgaagacatttttggtgagacgccttgaattggttgtactatctgttggaaaaatcctcagtaactcctgaaaattctacacaaattattaatgaacaattggaggatgctttaaactaataattggaatttatatgtaaaaatatgcagaggacgttccaggagaaatggttaaaagaatttctaatgcattctctggcgtaattattcaaaaaaaaaaaaaaataagcaatttgatagagactcttcgagaaattttcagatgagatcagaaagtctggtaaaactggtaaaggaaatcttggagaaagcactgaaaaccactaaaataattcaagaatactcaaaggaatctcttcaaagcagatagttgaatagctgaaaagttcgtgaaagaatcacaaaggacattccttgagagtttttttttgctagaattctagaagaattttggactggattacaaacaaattgaaatttacgaatatcactgatgtagcgcaaaatgagacaaaataacaaatacattaaatcaatacaaatctattaaaactacgaaatttgtgagaatcttaattgttgcgaccgaaattacttctgttaaacaagtatttgctaggccgcccctaggcctcctccagaaaaaaatcctagctacgccaatgatggccccaaggaaaatcttcaagaatttcgtctcagattccccgaggaaaagattcaggaattatcatagtcatatgaaaaaaatatccttggcatttttctgaagacattcctggaagaattcctgataaaaactttcaagccttatttgtgaaaatctcaaggaaatactgcaggaaattcgctaaaaaaaatctctggcgcaatttctgaaggtatctgcagagaaatcttttgttgaaaccttatataaatcctggaagacaattttaaaggaaattcataaagaagttgatgtttgaaatttagacgacattttggccgggaattttgcagaaaatccaagggaaatcgataaatgaaatcttagaagagtcaggacttacttaaaaataaaaatctcaaagattttttgggggaattcaaatgatttctgaaataatacaaaattcttggggaaattgcttagggaaattcatggagaaattcttcaggattaatcactacatgaactcctttagacatttctggagtaatatctaatcatttgggctaatacctgacaaaaaatctgttgaaaaccctagagaatggaaaacacatacagtaataacaactaccgaatagctaaacattacatataatttgcaattggattagatggacaaattgatgtgaagatttgcgaaaaagttacacgtcttctcagtgagaatcgaactcacgactccctgatctctagttagggcgtgttactcctacgccatgagaggactcatcaaggcagaagttaacctgaattcgatttcagctcaataatcacgtggtcctttttcgcaaagtgcacctctctcggtagttgttaaacttccactcggctggttagccgtaaaccacgattcaaaattataaacaagtacatacagtaatgtttgtcgtaatgtcacgtggaattctaaaaataatctttgatattagagaaatgtttgctctgatgctatgaagaatcgatctcttatcttctggcttctattaagttttgttttggggttttggctactgtttggcttcttttcggattttttttgttccattcaggtcttattttcgtctttttttcctggcaagaggtcttcaatttcctatttttaagacactcagtcgctaccagccctgtaaagacgaaaagatttcagagtcttgtgataacgactggcacgaaaatgagggggagtaagatagtttccaattggctagggagtgcttgatatatttttacgcgttcggcgacacaaggtaatactgaccctactaaagatggtacaacccattggctttaagtctcataatacatatcctaaaatgaaaaaagaggattcttatagttatatacgcaacaagttgcatagcaatgatttttacagcatgagttgtacttctatcgagcgagaatgaatgatttttacagcacgagtggtaaatttgctgcaaaaatcgagctctgcagcaatttacgtacaacattttttttgcaatttcgtagagggtatcagggtattttacaatttctgaactcaagacagttgcgcgtaatgagaaagcgttgcgtaatgaatcattacagcactggtttcagttgcgtaatgactattctcgtactgcatacttcagtgcagaaaagtaggccgtttcatgacagattggcgtgatgaaatacagcctattacgatgaaaaattgcaaaaaaaaaacaagttctgcaacgatttgcatacaacattttttaacaatttcgtaaaagaccacttgagaatatcagaaatcatatcgggttgcgttcataattattttgcattttatgaaaatcgttgtgtaatgattcattacgcaatacaaaacagttgcgcaagtaacaggcgttgcgtagctaatcattacgtaactaaattcagttgcgcaataacttttacaaggccgttttaggacagtgatggacgtgataaggaacagcctattatgatgagaaattgcaaaaagtttacaatcgcattgacgatcatttagtactttcttcagggtttaagcttttttttcgtgatttacttgattcagaagaggttctgaaaggattccgggggttgcagatgaaaagtgaggatatgtataatttttcatttgaatttgatttgctgggatttctaaaatgtgtaattagagtaactgagatatgtcaaacaaattttcgcattttgttgaaactcctatgattttagggtttttagacactggaagttttttcgtcactgttttaaactgagttttgtttggcgaagaacgtttaaagcatagcatagcattgactgactgtacttgttgttcgcgattgatcagatctggtgagaattgcacttcgatctaaatgaataagggatggaatttttcgcttattctagaagtgcacattttagcagatctcatatatttgatcggcgctggtcaagtccttacagtcagttgggatggagaagaaatattattgtgtaatgattgttgcttctaaataaccatttgaaggtgatttttagtaatgataaaaacagaaaaatatgtgtataataatattatatgaaataggaataagtcgaaacttgtactagaaccattcaaagttcgttgggaaattacataaatgtagcattgcaaccataaaaatgagttatcggaagcatgaaataagctcatcatttggttatcccaagcagcacaatttgtttcaactcaagaataaaattatctcttgaaactaatcagtgttgccaattgtagaaaatatgacttacttcttctttctggcgtaacgtccccactgggacagagcctgcttctcagcttagtgttcttataagcacttccacagttattaactgagagcttactatgccaatgaccatttttgcatgtgtatatcgtgtggcaggtacgaagatactctatgccctgggaagtcgagaaaatttccaacccgaaaagatcctcgaccggtgggattcgaacccacgaccctcagcttggtcttgctgaatagctgcgcgtttaccgctacggctatctgggccccatgacttacatttgcactgaatagcaacgtgaaaagcgcaagaggcggagtctgtttgcaacatatttaagttatataaaaattgcctatttgttgcaaaatacttataaaaaaaattaaaccgatatataaacgagaatcgaccttccgaccgcaagatcaccaatgttctcctctattcactactccagtagctcttcgaataattgcttctccaatgaactataaaagcatgtggtcgccattaatcacagcttgttgcttataactttattgcactcttcggaatacaagttcattactggcgaaattaggccaggcctgaaataatctaaactcgtaagaacttccgcgcaacgcatgagaaacacgttttgaacaaacaacctggttgctaaaccatattttcgttgttagatgatacgtaaggtacacctcaaccatattgcaacggattgaaacaaacaaacttctagctgtcatacacttagtttagtgcaactttatcgcaactgggatgaatcttcttgagttgttagtgtgtaaacgaaaattgaatgcaagttgcggatgctttaaatgaaagtaatttaacacataacattaaaaccggcattttgggagaagtttcaagagtttgtttcatggtttgtttgaaaaattgctgaaaacatcttgataaacttgacttcattgctatttgctagggacatttgcagcaaatcttgtcgtttcaaaaatattgcacgccaaacaaggagtgaaatgcatgtttattggaacggctatgaaactttacgagccttgatattgatatgcaaccgaacttgaaccaggtaggttatgatgcttttattgatacgcgattgaaaccatttttgaaaagcatctctttggaagctgattcgcatgctacttgggttctatccttggctaaacgcgatttttttttcaaatttttgttagatttttaagagaaattcctttttatgcaacaagactctcaagtttgtatactatacaagatttgtatagtgctctcacactagtttgcaatcgctttatttaaaagagatctggcactgcagaaaagatcgatgaattctgaaaagtttcctaattttcaaagaaatttaagagatttcatgatttctagtgattctcgcaattcaaaggagtttttgaattctacagggatcctaaaaattcatgaacttcattagccttatagtaatgacaatggggccttccttagccgagtgcttggagtccgaggcaacaaagcaaagtcatgctgaaggttggatcccagacgcttcaggattttttcatcttaaaaatatatcttgactccattaggcattgaatatcatcgtacctgccacataatttacacaaatgaaaaaaaggctcctctagccaaaaagctatctgatatcgaattttcaggttctaagatttcaaaaagattttatcagaccggaaaagatcaggaatttacaaaaggattctttatttctcaagagatgtattgctgtgtgcgtttgaaatgcaaatatcaaatgcggtaagatttttgacaaggaaggcaaaatcaaatgttgattttctctgctaggttggcggtgagatggattctggttgctaagtatcctttgattacttgatcttatcgcatttgaagctcagtaagactggatttgcacgtcaaacgcaaacagcaatacatgatttttatgcgattcttaggatacaggagtggctttaaatattccgaaagaattcggtattctctttatatgtatgtaactgggtgaggttttcagatattcgtgttctaattagattctacccgaatctgcctgaacaggattctaatatttaaaaaaaaatatcttaggattttgtagagattatgaaaaagaatcaaaagaggacataatttgccacaactcgtttctcttcattgaatcgtacactgctttgaaatttacaaacagatgatgagtctgcatgttgtactcccagaatttatctagaatttggcgcagggtaaacatttgatccgtcattgatcggccctctcgaaaagcagcttggtattcgtcgacaaaagactcctcatacggtctaaatctgttgaacagaattccagacatgattttgtacgccgaattaaggagtgttatccctcggtaactgacgcattccagtcgatgcccttttctggacaaaggggaaatgagaccttccaaccaactagtaggcatttgttcttcatcccatatcctcgcaatgatacggtgaaggagttcgtgcagctgctcacttccgtgtttgagaagttcggccgggagctcgtccttcccagcagccttgttgttcttcagcccattgatagctttcttaacttcatctagctaaaaacatgttgtatatttcagtttattttcatgcacatatttggagcatcgaaataaactgaaatgccaacgacgaatcgcttatttttcaatcgaattcactttaaatttacacgatcatgtaacattcaagcatctttagttgaaaatcaaacgtgatgctgtaactatagatgattttgatttacttttactatactctcctgtttacgctacatcaaagatggttaaaaggaaaaagatgatcgactctttattttgccatatattttgccgaggacacgctattcaagtaacactactgccatctgttgagtgaaaagcgcgtaaacattattttcgactaaattctaatcatcgtgcaattaaaaaacgatgaacgaagaaataaaacacgcttcaaaaatgttacacaggagtgagcacgactcacataaaataaggctcttctggaccaacacaaggttggtgtaatttttacacatactaaaaacagttcctgtgctgttttttcttcctttttacattttatggtgtttagaaatgattggctatatcgggcatccccgttttagctgtgtacctttttttaagtgtgaatgtaataaacgaccacttcaacatctggtggccaccaggagaacgttacatattagttggcttttgactcaccagagcggcgctattcatgtcgcctagaatagacaggagtcggttatctttttccttctaaccatctttggctacattgaaatttaaatatttgtatctgtgaaggtaaacctaatgtagcatatgtgaaactacatcaggtgccatttcacttcggtaaaactgttttcctatagctaatgcgcatatgattatacccaatcccccggggtataattatattcgcttttgaattaacaatccgcatcttttgttgtcaaattgcatacatctggagggatttcgatccattattgtacaccgaaccgctcattgcggatggcttttggcacaatttacctgctggtgctgcatagctttagagatagagcgcgcatagaattgcaccaatccaggtatgcaagtgcactcttttgatccggcctagcccctctctaacattaataattcatagccaagccgcagtgtaactcttttgcaatccatacaacaaccgcatagatgcaatcgggtcttgtactatttggcctgcaatgagcgcaagaaagtccgtacacgttttccaggatggcagcattattgcgccagccaaatgtaaattcgaaattttcaggaatttacatttggattaaaagcagttctttctccgctgctgctgttgcctgtctttggaatgcatttgggtcacccttgtatctattaccacacaatcggttcgcgtcgcgggttcgtctggatcccatgaaaattgggtccccttagttggatggcgccgccgcctaccttgatctacacggtcgaaatacacgtaacagtcgcatagaaattgtctagcagcatatcggcctactgcgatggctgttgttcttcccaaacgatcgccgtgtcagccacacatcaacttgggcgcgtattgcattttaaatatctaatgttgtcggttggagcatcgcgatgggtttcactatcgtatcgtgctttgtaacggttcgaaagtgcattggcgccccgtcatcgtcttcgggtgtcacatctttacatggacgtaggtaggattttcatcagtgggagggcgaaacatatagactgtattatctttgacggattccttgcatgattcgttgtggattcttgacaaaatttgtttatgaattctagttaaatctatggctgagtctagaatttccattcaattcaaatacaattttcgatatatatgaatactgcaaactaacttggaacattcaagggacaacgccctcttcctgccctgactacgcccaaacatctttctccctggatcgtgtgcgtgacaaaggtagcattgctgtttttgccagtcaaccaccaatcgtaccgacaaaggcaaaaccgaaccgtgcgaggtcgaacggttttacgagaaaattaaacattctccaaacgagattatgtaaatgtgatgacctattcgtcgtctttgtcgacgtccccctttgacacaccttcttcggtagcggaaaagtggcaggcctccaccatggggaagggacgcaatgagcatgtttaaattaacatagttttgaacgacgactgacttggacatagatccatgacttctggtcgtttgaagacgttcttcgtggagataagccgtcgtgtcaccaatcttgcaagggggggtcgctctcaaaacgcgtaggtgtggaaagttccaatggaaaggagaagtccattttcataaatttggaaagagatttaatttcgagatattactgatattgggtgcttttgactttcgaatcgatccacaccgaaacataatcccctgcaggaattattggacagcatggaatcgattgaattaatggcagcagcagcagtggaagagataacgaacgaaaggggtcaaatattgcaatttaatgtcattatatcgtcgtgtgttttgtgtgtgagtgtttgtgttaatgttttgtttcttcctgttctcgtttctggtttcagacaactgccggtcccttacaccaagccgggggtcaatggaggtacggccattccgctgccggcgaccgttatggtcacccggcgatgtccaccggataaagtgagacctttgccaccgactccgaatcaacagacgggtaagtcaacgatgtgaataaattggatattattattacacgtttatttgtttcgtttctttgtatttacacttaactggataaccggtagttcgtaaaatattcaaagcggtaattttccataagtttataaagatggaattgacgaaaggattttctgtcagatagggtaaatgatggcttcggcaccctgagggtattttcggcaacactaacttatcgtccttgttagaatttatctacggaacaagggttactttcaatgcactcaacatgttccttgaactataatctttcatataaatcacattcttgacgaaaatattatataacatgggttttattattaaatgaaataaatgcttacgaaatcatcgtcattcgtgagctgccgaacagaacaacacaagaacagcttaggaaaaactcaccacttcgaaaggtccaattctccgctccaatgccaattttttcacaaaatctacgcaccgatcacttatgcacaattaaacttttgattggtctataaagcactcgaaaatacttaatttttatgcttcaaatcacaagtaaaaattaatgaactttgttttcctcggcaatcactttttattactgcaccaggttgccagaaaaccatattcaattgcggtgtaattattattcacgatttaaattcacagaaaagatcgaacacaactaattaatttattggaattatgcaacaaagcacgcatgggtaataattgagtctttcaatgccttccttatatgaagattgtagcgcataaacttcaaaatactgagaaacatataaaatatacgtcttttaataggttaactattttggcaacactcctgttgttcaacaggcaatcagtggatgatgtgattgtgtcaaatcaaaagtgagtagatttgaaaagggtctattctgattttctcacacactgagaagaatataaaccttaaaaattaatggcaaggtttggatttttatccgaatttgctgatcgaaccatattcggagagtgacaaaaacaaaataaataattaaatcctgggacaatcgcaatcggttttttttaatacaccccaacctctttttacgaccgttatcggggggtcgtaaaaaaaatctggataataattatgtttttgaaaaatgcaacgtctatatgcggaaatactgattcgggatattcggcaaagttgaagcatgggttgagaactttccaaaatggccgttcaagttttcatattttggtaatagatggcaacactgctcgattgttatcaaaagagccaattttatgggggtgtgatatgcaaataccaaaaaatttcaaagatgacggtaccgaatgttgaccaaagttgaaggaagtgttgcgtgctatacagtcggccgaatcacaaatgttcatgtggctggcagcactgttcaagaagaataaagaaaagatcaaaaccataaaactttagcggaacaggaaaatagaatgcttagcaacatagcaatactcttcatctgtaatccagtttttcatgaagtgttcaaaattttgtcgtagctggcaacactgattaagtgaaattgcgtcaccggcagtacaagtatgcatgcaacttttgttttgcggatatctcaggatcctgaccacttagaaagatggcatcttcggcaaagttattcagtagctcaaggactatcattattctgtccaagagattcgagatttggccaccaggcggcgctagtgagcgtagaatttttgttttgcggatatctcaggatcctgaccacttataaagatagcgtcttcggcaaagttattcagtagctcaaggactatcattattctggccaagagattcgaacaccaggcgacgctagtgagcgtagaatttttgttttgcggatatctcaggatcctgaccacttagaaaaataacgccttcggcgaagttgttcagaagctcaagcgctatcattataaaagctatgcgattcaaaattttgccaagggctatcattatttttgtcaaaagatataaggtttttcccaccaggcagcgctagtaagcacgatattttttgttttccggatgtctcaggatcctggccacttagaacgatggcgccttcggcaaagttattcagaaactcaagcgctatcattataaaagctatacgattcaaaattttgcctcctggcgacgctagtgagcatgaaacttttgttttgcgggatcctgactacatagacctgactacataaaaacggtcgttaatctgaatttcggtcgttaaaaagtggtcgtaaaacgaaccgccggtaaaaaaaacggtcgtaaaaagaggttggactgtaacaccattcattctctcggtaataacttggtgaaagagcgttcaagagcagcaacctttacataccaaaaccatatcgagccattcagcttgtcagtgaatagttcaattcacggtgaaattcttgacattaaaaaaaaatgaaaacaactatgcaagtaccatcgttgggggtgagatttggccaaaaatgcgtaagttctcatttatttttaactaactttcgcaatttgacttgatatgttcggttaaatatgagaatacgttgcaaatgctgaacaaataattgaaatctgattattttcctttaaataggaatcatttgaaaattggcccaaactcaccccttcgagaaggtgacattgggccaaacaaactacactcaggaaaacgaactatcgataaacataggaaccccatatgaaaattcgccacaagaaattggattgaaattcataaatttacgtcatggaaccgaaatttgaaaacaaaaatagttttcgcggcaacctggaatcgaaccaaggaccttgcttagttttgtaacaaaaactatccaaaaacatgattttttaaagaaaaaatcgaatttctttggatttttttaagttttttttgccgaatattacatgtttcatataacacttatgtttctaaagcattttgtttgaattacaagttgaatagtgtatttttttaacatgtgcaaatatatcattgtttcaaaattatttaaaaaatgttgccaagtccttttcaaagatttaacaaataaggaaaaccagtttcagctttaagaatattgtttaactgataaaaattaaaatgttgaataacttggtcaaaacagtaaaatgcggtgtatgcaaagtttgaacacaattaaataatcttcaaaaccatgcaaatagatttggtatcggttgagtattcatgaaattatggtcaaacgaagatattttttcagtaaaataaaaaataaattggagtaaactactttttattgaaactagttttgattttacacaaatctgatgttctacaaagttttcaaaaaaaataatttttaaggtaatggtgctgaaattaccgaagttatggtgacttcactgaaggccattttttataacttgaaaattcacctccaagaagcttgcacctctaaattttaatatttttggctcaaatttcgaggtttctctactaatatgatttgaattcagaaaagtacacgaatttttggttttgagaacttttgaaaaataagccgcaccctaaatagactgtagcgcatgtgcgagtagcaaataggagcatgcatgtaactcattcaaacgcaactctgaaatttaagtaatccgataatcgcgttccgtggatttttcttgcagagcacaatattatgaatcaattaaccttgacgtcacgctgcaacttctaggttggattcgcacctgctgcaagtttattaccatgacatggcaatttttaaagccgaaatgctgccatagtgagattgatttcaaaatttattcgataaaataaatgaaaatgaaactaggcagtgtccatttatgacacaacgttaaaatgtacaattttcaaccattccccctccgcaacggtctttgcatgaaaaaaaaattgtgtttgagccgcaacgtttgagcctactccccctccccctagagcgttacgcaatatgtggacggcgccttagtctgcataaatttagtggcgttgtgtatttaatttgaatctccgctattttatttctaactgcaattattttctcagtgtagtctgtatttttctgcattgaccctttcaacgagtagaacataatgagtgatgtttaatttcaggaattgtcaacaaatacgaaatgttaccaatacataaactagtttttgcgcagttttggattgccgaagtgaacatttttgttgccgacaatagtaattgcattgccgataaaagaacaagtgcctcgtgattttggtgaggaaaaatagaagattaagagaacaaaatagtgttttaagtataacaatcaataaacgaagagtgctcaagtgtagttcaggtgtctcctgcttattgttgtgctccattgttgcgtaaaattgccttcttaaaagttcagctgcttaggctgccgacaatacgtaagttcccctagcataatatgaaaacacagaaaagcagtaaactataaatttcaaggaacttttccaaactggttttatgggttcttcttacagaattcttaaatcgcatcaaaacagcccataagtcactttagccttcctaggaaaaatttacacataatgcattggggtaaaaattacctggattatgggtaaaaaaaacttcaaaattcaacacgataaattggtagtgtggtaaagttcgtggctctcaatcagaaagttcttagttcgaatctcgctttagcatatgttgttcttttttgctttcaaatgttcattttcaagccgatttacgttcttttagcctaatatgaaagatatggaatcataaaactttttttaagtatggcaattctggacgaggtggacaatcgacaagtagggaggactaatggacgatgtgaataacaaatattcctgtggtttcaacgacacaacaatatttttgaggcggacgaggtggacaaaagacaagaaaatatgatcagcaaccttacaatgatggagtcaaacagatattccagcttgcttcaaaaaatcgaaaacgagcttcataaaaccaagatcaagcttatccagaacatctctaatgtcttcctttccttttttggtttcccttggaccctgagggatgcacataaatcggatctggcaataccgtgttcggagcaatcccatatcacatggttggcgtcttgatagtttgtaccacagctgcagcgattgctccctgtgaggagttctttttgatctttcgaagttgacacttgctcctggacagtgcagcaagaaagcccgagcagtcgtcagttgttttccctctcgggtcgtgcgcctattttctctgagtgcttttatatagccgatcaaatgagtgaagctgaaagtggattgttgctgctcaaggatgacggatcaattggtgagctcgtttcatgctactatttctaatctataaaatatgtatgactgcacctttaatcgttacaacggtgagacgtaaatatgatttttcaacaaactatgaaaggttcgtcactgtgagtgtcgacataaattctgattcataaattattaatgtctaattttttttttcaaaacacctttttcttttacctttatttttgtaattaaaaaaaaaaaaaaaaactttgaatggttcgacactacgagtgtagacttgcgaaaggttcactttattcaacaaactttgaaaggttcgtcacgtcaagtgtcggcataatttttctctacatagatattgttcatatcaaatgaaaaaataatatttacatataagcatgtttatatctcaccaataattatttatcatggtctaatcgcttatcaaagtgaatcctgtgacccaacgatccttcccattaacaaacatccctcccagtaacctttgtggagatgcagaggcaaacacggtctccaaatagcaaaggttacacactaacattccttcccccaatcccacctgactgcaaggacgtggccggcgccgttattgaccatgtataaatagaggcactgaattatgcacactgaagaagattatggccaatcccagccgatcttctagttgattctttgtgcattttcactgactccggtcaatcacggaatagcaaccattgatatgtgtagtcagtctaagctaagctaagctaagctaagcagctgcagcgattgctccctgtgagccctattcgataaaaatgtgagcctagggaatagtgattggacataaggcgacacattaccttgataaattctcttcttatgtccaaacccttaaaccacagtttcttcgatacctgcgggagaatggaatgtaaccacctgcccatgtctcctgcaccccatttttgttgccagctgatcaaagcgtgctgaggatcaattcaaaaaaatcgtcgaaggctatttgtctgtcataagtaaatgccttctatagcgcccaccttagtgagcgagtccgcttccttattgccaggtataaagcaatgagaaaggacccagaccaaggtgatggtaaacgattgactcgatagagcactcaaagtttttcgtattacgctaaggaaatacggggagtgctttaccggcctcatttaacgaatagcctctatggagctaaggctattcgtaaaaataaagtattgatcagagggaagagatgcaattagctctattgcgcaatgtatagtcgcttgttctgcgacatatacggagcaagggttctgaagttctgacccgtcggtataaaaccttttattgcagccgatgtggctgaacttgcttgcaaaaattgttggtatatgctccgagcgaagccggtctggaattccatggctttcttgtctcatggatagataaaaactacggttaaactagagaagtccggaaaacatgtttgaagaaggattgacctccagattcatgtacgaatggtacaaagtatagtacaagtcaaagtgttggagaatttcgctcgattagcttttcaaaattctcaattaccaatgggtttgacacttcacggcgaatgaggaaccttaacgacaattccacgaaacgatctgataaaggcagtactactactgctaacctaagaattcttctagggattagattaggaaatgtttttttccaagatacctgtaataaaaactctttttggattcctcaagaaatatctcctaggaattgtccagaaattttcccatggattccttcctccaaggattatagtaggtttttctccagaaaaaaaacctctgcagggatttctcctggtatttctgtagggatcccgtcagcaaaatctctacaatgatttttccagcaattcctccaaggattactccaggaattactccatagatacctccagtgattccttcagaagtttgctcaagtaatccttccgacatctcttcatcaatttacccaagtaactcttcattgattccttcaggaatttaccctggtaatccaccagagattcctacagaaattactccagagactcctccaaaagtttctccagaaatttctgcaggaatttcttaaagaattacaacaggaaaatccctacatggattcctatacaatttgttcaagagatttctttagacatttcttcgggtattcctccagatgctcctgcaataatatctacaaggaatctttcagggaattaatcaacgattcctgaagggattttcctagagattcttctagggattcattccagcattcctttataaaattcttcaggtaagttgtaacgataaaatggtttctctgatggaattacctttgctctgggaggaaatctctagtggaattcatgaataaatcgctgtagggattcggtagagattatctgggaggattttttttggtacaatctctgtaagagccactggagaaattactcgagaagtctctggatgaatggctggaaaattatgcccttgtagatcggaaagaaaaatcagaaatttgaaccgtggccccaaaactcaatggtcactcgctggaggtgagtagtcgatcaaattttcagcgcgaatggttgtcaggtgctctagttttgtgctcttgaaaattcaagatttggcttcgatgcacctacatcttcagagatcctagtaggaatacatattactttattaaaatggaattttgcatggtatttgtttcaattactacagatagagaagaaaatcatgcacacctctaaaaaaattggattgtttaagaatgtgttaaatttcaagaaaaattttctttgtttgtgctaatattttcttcggcacaatttttatgacacagtgaaaaagtatattgaaaaattcatttaccagcttatgagagcaaatccaaaaaatggtgttctatgtcattgcagctaaatttaaatacaaattagggatggtacacaaactatgtcatgctaaatttcaacctccccctctcttgtcgcgttctttgtatgagccctccgaaaaatttgtgaggcttgtcacacttggcttgaccaactgtaaaagcgaaagaaagcgacaggaatttgcattgtttcttaagtgtctggaatgtgcccgagccaaaaatacagaagttattaaggggcaagcaaagcaaagctcatgtaaattccaagaattccaaaaaaaacaggatgtctactacttggaaaaagctggaaaacctggaactatcagggaattttatccaacctggaaaaaatctggtattctcagggaattttggttaggattttcataaggatttttttttcataaattcatccacggttactttcaggaatcgctcgaacatccttcaggcattattcgctaatatctattatgaacttttccaaaaatacctcgataaatttcattcaaggattcctccattaggttaatagagaaatttctcttggaatatctccagcatatcatcaaaatattgttactgcggttcaaatatttttctaataatttttcatataaaatagcccaatttctaaggatttttcaaaacttgatttaaggttcagggattcggtctgcatttctccaagcaatagtttcacatcgtcttgtaggacattattaattttatttttttattttttaaattttttttttttatttttttttttttttttaattttaaattttaatcagacagcgtttgtgctgaaaaataagctcaatggtcactcgctggaggtgactagtcgatcaaattttcagcgcgaaaggttgtcaggttctctagttttgtgctcttgaaaattcaaaatttggcttcgatgcaccttcatcttcagagatcctagtaggaattcaacaaggcgtacctagaactcaaacaaagtttcatctgaggttactccaatcgaaagacaacgaaattcaatgcaggttttttttttatttcttcatagcaatctaaaaagttcccttgcaatttcatcggacgaatgactggaaaagtccgtgagaaattaatggaatagttttttgatggatactttctgttgtggttatctttcggaaaattccagattgaattaatgaattgaattgaaattcttcgaagaattacttagaaaattagtacaaaatctctaatcaaactcttgaagcgatcagcgaagtaatatgtggaagaaatctatagtaaatcgatctgttatacttgtcttaatgacattttcaaattcattgaaatttgacatttgagaaattcaaataaggccttgaaattatacagccattccatgaaaaaccgatctagtgggtctccgaattccgtgcaaatttgctattttgttccttatccgaaataaggatacacgtatttttggtttttttgattaggggggccatttccgaaatagggtgaccagaaaaatcgcgattttgcaaaatttttatttaaaaacaaaattataacttttgaaccgttcgaccgattttcaatctttttggactaaatgaaggctaaagattttgacttttcgggaaaaatataaaatttcacaaaaattgtgttttttatatacaaaaactcaatagtttccgttttttcgtgttttgaaggcctcgggaccaaaggggctattgctgctctcattttttctttaaagttcagaaaattttacgtaaactgtcaaattttcagcgatgtatgttttttagtttttgagatatatttttttgaaaataaaaaatcagtcatttttcatcggcacacactgtagatctcagcgcattagatttgtaatgttaaaaaaaatcataaattttgaacagctcaaccgatttccaatctttttttatggaataaaagcttaaggtctaaacttttcagaaaaaaaagaaaaaaatagaaaactttgagataaaaaaattttcacattaaaatatatgtaaatttctaaaaaaaactagaaatttttatattttttcacgtttaaacatatttttatcagatttttcaattttgtctgaatagttgaaattttaagctttcattccatacaaaaagattggaaatcggttaagctgttcaaaagttatatttttttaaacattacaaatctaatgcgctgagacctacagtgtgtgccgataaaaaatgactgattttttattttcaaaaaaatatctcaaaaactaaaaaacatacatcgctgaaaatttgacagtatacgtaaaattttctgaactttcaagaaaaattagaacagcgatagcccctgtggtcccgaggccttcaaaacacgaaaaaacggaaactattgagttttttcatgtaaaaaacacaatttttgtgtaactttttatttttcctggaaagtcaaaatctttagccttcatttcgtccaaaaagattgaaaatcggtcgaacggttcaaaagttacaatttttttataaataaaaattttgcaaaatcgcgatttttctggtcactttatttcggaaatggtcaccctaatcaaaaaatccaaaaatacgtgtatccttatttcggataaggaacaaaatagcaaattttcacggaattcggagacccactagatcggcttttcatggaatggctgtatatttagacaaatgtctgcctgttcaactcaggaatcaaactctcatctcgtgcttcctgttaggtttctttaagtattcataattcatgtatggtttcgttttttttttcatgaaataggtatttaaagttattatttctaatatagtaccagccctgatttccccaaagaaaaaatacaaaacgctcttcagaaaaatattgtgggtacgtcgctgatgtccatacatctgaattttattttaaggaaaaggatatttttttcttaagattgaaaagacttttttcatatctgaatttgataattaaaggcactttcagatcatttgaaaaacatttcagattttcgtggcaattaaataataatcaagttttcagtcaactaaaattaactaagggaatttcatttctgtaaatgagtagacaccctgaaaaagtttcattaaattctcaaaatgttttctttggatttatgaactctgcaattgttacggtacagtttttattcagtcccgtacaatttacgcctgtttcctaaacattcctgtcggtttacaatggttttcaaggaatttccaaagggtttccaagaaattatcagtggatcccatacgtctacgaaagttatttaaaatgtattcctagaagctgcagggtcttaggaggttaagggctgagagagaggagacagctggcttagattgcgagctctcaaaagtaaagggaacctgtcaccaactgtcactggaaaaccaacacattcggagggaagaacgtgaaaaagcgtcaaaattcaagtatacataattaaaatttcaagatgttttcgatgatttcacattataaaaaagaatacctaaatatagttgtgtattggctaattgctattgatttttttttgtattcatatcctttttcatagtaaacaacatgaaataaatatgattttgaccaaaataagttcatctgaccgtcgtgtactacccaagaataaaccgaatctcctctcttttaccacattaccagtggtccctaagtggagcctttaggagatttcaaaaggagtttccaaaggatctcaagaggtttccaaaatttttcgctggttgccaggattcttcttcagaattcctagaattatttcgcatcaatcgctgaaggcttcccaggggttgtacaattggatgttaaaaatctcagatcatatctcagatatcacagatatccgcatgttcctagaatagtttcaaaaggtttccagggacttcgacattgttcttaaaggaccccatggattcgcaattgggacttcaaaggatgagagagttcagctccacagagaatcacacgctaagagggtcataaggatgctcaatggtttctgagaggttgccaggggttctaaaatagtcccaagaggatctcgagagacaccaaaagatgatctaagcctgtaattcgactgaattgtccggacagaccaataacagtacgtatgcaatcgatggtcattcatcacatcgattagattgcaagtgcttaccagagctcatcgaatgattttcaaaagattcacaggaattagtttccaatggaatttgaagggtttggcctggaatgccaataatgggcggaagtgagaaaaatagatagtgaatttgttcgtatactgtctgcgtgaattcatgttgatcgcatggctgcccactgtcaagtgaaaagattattaatgtacttgccttcttttggttagtgtactgcccagggctggatttacaattgaggagccaaaattttgtaggggcctattaaagaaatctttttcagtgtattgactaagaataaggcgtaagttataagatgataattcaatccatcaaacacttttttacgtttctgttacatgggattgcctgatgaagtgaaaaatccatgactaattctaatcactccatgtcttgttaagatggaaaaagaacttgtgaactcactaaattaacaattcacttacactacgctgacacaacggaaagacaaatgtgcttgtagtaatagaaaaaaaaatcaaatttattcttacaaaaaataccaaaaatgtaatcacacaccttcattgaattatcaatttcgacagcccttagataccagtaatcgaattgatccatgcccggtagggctcgacacgtgtgtaacccgttgggtacaaatatccgcaagcctgggtgatcagcgaggctactccggtaacggtctgctgcccgtttacatcggtaatgaaaccggctcccaaatctccgttgcacacgttggcaccctcaacggtatcctcggcgcagaaatgattgggcaccgtgatctggtagtactgttggcacagggtgttggaagttacccgctggtaagcacgcatcaggtagcttggacggaccgtagcttcaagaagaagaaattttctattgaaaaggcttctggggagtattgaactaatgcttaccggcaacatcggtgaatccaaagcccacgacagtaccctgttcgttttcgaacgggaatcctactgcaacgtttagtggtggaagcgcgatcggagctacgttacctgtgataaccaatgacactggaagggtgatgactccgatgtcgttagcccgattcgctgagttaaacgacggatggggcgtggctgtgtacgaggtcaccgtgccaagctggctgaggatgatgctcccgactccaacatcccatttgacgaatctattaaatttcttgtattacactcagtgggcgaattaagagatgatgtctatttacccgaaaatattcatagcggccgtcagaatatggcggtcagaaatgatagtaccgcctccgaagtatccatagccatctgtcctagtatacacaatatacgcattgtatggattatgagacgctatttgtccattgatgatacgtgaagtgcgatctggtgccgcctaaattagaaccaaaatcaataaaatacacttgatccataaactcttccaaccaacctgagcgcccagaacgcaaagaatgactgatagtaaggtagagcgcttcattggacccaataaacgtcgtttgccttgggaacggagattactttaggtgaggccttggcaatcgacttcgcttttatagccgtataggtgtccaaatgtttcattcatcaatttctgcgagacatgtcatccttatcgaacgacatgaactgtttttggctgccggccgcccacaccttcttcgcaggttgcgtaaccgcattgcaggtatgagctgtcccagccggcaagtctgggtcatttccgaacgtaatctacactgattggcacagtttctggcttacaaagttgtcggaatttgtttcttagttatgaaacatattttataatctgtattcgattctgatttaagtcaaaatatagatggtccacgcattatatgtatatctaacagttgacttgtatctaccgatttgtcccaaaatgttaatatgattcattataaacgatatgaaagcagattgagacggattgaactttgacgtacatcagtctcactgtcaactgtacattgaacagtaacaagagcttcggatcatgatgtcgtctgtaggcagaacttcaaaagactgcatatccagacagaactttcaacaacagatgattatacaccgatataggtgctagtggtagcgaattgtgtctcatctattggacatcttgcgttgaaggatggaccagatctcaaaactggaaacatcccttttaatgaatgcatgtattctacacgtccaaacctagagaaaggccttagatacgtcatagttttggaagtcgttcatctttctacagatctaaggatctgcggctgatgtagttcagcatttgtttttttgttttaaagtgtgaaaaccggaattgttgtatccattaagacttcatactcttgcgctatgtgacgtcttgagtgacataataacggctggatggcctagaagagtggctagatgcatagctattcagagttcttagatcgatgtaagtaagcaaccgatcgatatgtaaggccttgctaacaaagaatgtccgaaaactcagtgctgtgcaaaaaacatgcgtgctactccgaaatgtaatgtgcgtctcccattctttgcgaggaactcaaggcagacttaacagaaactcctctgcgatgcaaaaatgaggcgacttctagtttttttttcaaaagtgaaaattaaactcaaaattcacaaaatctcaaacgattcgagtgaaatttgaagatatttgagacagatttgaatatatttggtaaagtcagaaacataacctgttaatgaattatgtccatcgtgtttaaggacatatccccatgagtaccaaaatggcctctaatatggcaccttacttcccccttcgctttccgctccctcctcccacacttctctcagtgttttggagagcgatcacaaaaaatgattatgtgaagttactaaccttattgtagagcggtggtttcttaactgaaagcattccataatatgtttttcacaaatcaccagtttttgaatgcaaatacgtagttattgctgtgatttgtgttgtaaaataccacgcacttccgaatcacttcttcttcacgctccgaaatattgtttgctggcttttcggtgcccgttctaaaactcactttaaatcgtatttcttctcaccgtaacaattcaaaaatctaatgcgatacttgaaacactttgatttattcacgtacgatgctcctaggagcaataaatcacttatatcagtcaatttgtgctcgaaaacagcaccggaacgcgaattcactgagccaacattgtttatgattcggatgcgccgttctcactgattggaagtaatgccagtttttatgtttgcaattagaatggtttggatattcatacacttgctacaaccacgtatcttacaatttcataatactcaaaaggtgtacaatgtcacaagtgttgcaaaacatttttgtgcgtgagaaaaacaatgtacgacgcaatttaacagcaaaaatgaatataagatattatacagtacaattgactgtagaattgaaatgcatactgatggcaactttctccgtccgtgagaagcgagagaagagaggagaaaactgccaaaaatagtaaacaacacacgcatggtgtgaaaaatgcttataattttggtcaaaaaacatgttttcactaccaaatgaaataaattgtgattttgagttttatgaagttgttgatgaattcatatcgacaataatacctttgtatgaaacgtgtgcaagtaactctacctacataattttgttggtggaggtatacatgaaacatgatgatttatttttggccgacgcacataacattgtgctccgccttgttgggtggctcgagtgggttgcaacattatgtttacgtgctcaatgaaccttcaccttaagaataatgacaatcacatattagtgatatgaattcaagttgtagtttttacgcgtgtacgaatcccaaaaagcgaacatgagacaatacgataccacgcagtccattgcattgtgcgagccagtgcagttcaaggtgctgtgtcgcagcatcgcgtgtagcactgtatgggatttgagtcgcaccctatccttgcttgctaggaaggcatacaaaatgaagaatatcatctttgctaaaaggctcccccaaatctacgcgatttttttcagcgatggcgtcaaaaaatttccgcgatttcgttgttgtgacactgcaagcactctcatatgaaaccatccttatttacgtgctccatccttatcctgcacatttcgatacgcttacgaagccattttcgggatgcattgagcatctggtagagtatttcagcaatctgtcgttgagcaaaacgtagaagaaatttttggccattccacaactattccgactgttttgtcattacctaccgcacccctttcctatttatactgaagttcagaaaacgcgcagctattcagcaagatcaagctgaggactgttagtttgcatcccgccgatcgaggaacttttcttaaaggaatttttctcgactttccagggaatcttcgtacctgtcacacgatatacacttacaaaaacggtcaatcggcaaagaaagctctcagttaataactgtggaagtgttcatttaaaaattatgagaagcagggtctgtctcagttgaaacgtaacaccaagaagaagacaaattgaattgttgcttaaagtaatctattacaatgggtcgctgtgatgtactctgactttggccagttcctttctgatggtggcttttacgcttgtttatcttgacatttctgggtttcctgaaaatgacactcactcaagcacgaagttttgaaaattcagtagtagatgcttgccttttgagacgtatgatgaatctcaacttacaatcatcttgcacaacgtcaggatgaagattctcaaatttatgacttcagcagcgataccatctttatcgaaagctttgttgtacttgagctgatgactaacatccttaatctctgtaaaggtagggccagtttcgtttccagcgtccgcagtaccactataaatatttccttcgttgtcttgacctttattacttgcgctctcttcatcattcaggtgttcatcgaagtgctgctgtcacctttcaatagcatcacattctcccatccacacatctcaactcccggcacaaagccatttcgggatgcgttgagcttctggtagaacttcctaccagattctcaacacgaccatctcgtacttcgcttcctccaggcagatttttttctcccgaaagaggaggatccacatgcctcgtagtcaatatcgaagcgtcatcatactggactaggaagtatttcagcaatctctccctgaagaaaacgcgggagaaacttttgcgctttgctaaactattctgattattaatcgttatcaaccgtaccacacatcaacatatagagtaagggtatgcgaaataccgaatgattccgtcaaatacgcttcgaaacgaaattccgcggaattccacggaactcatacaggcgaaatttgtattttgctatttcgtttcgtttcgccaaattgttaaaatatttccacggaaaattgaaaacaaacgaaataaaacggaatttcgcgaaattcgagtttaatttcgagcaaaatacggcaaagcgcttgcttctacttctagttacagtcaaaaatgggtccgtattatggatcaaatcgactgatatcatggatcagaacactataacagcaaattatctgcgatgcaaacgaatagtgtgctactgaaagcatacgttttggcgtttctttaggaatcgtcttatcttagattcataactgtggtatgggttccaatgccccacagatatcaatcaacccttctaggcatatatgtatgacattttatttcctacgaacggaacaaatgtgtttaagcatgtaattgttgattgcgatgctgtatagatttatggtttgcgttggtaaaatgggttctgcgtaattgcaactctatttgatgaaatattctccgtttaatccaactttgatccatatctgtgtgctatccataactgtggggtgactgtagtattgactggtccgcatgatatgataaacttcactgctgttgtaaagtttccaaaaacgcctatttgcccttaacgtttcgatgagaatgtgttcactgtgtttcggttggaggatagaatactgtgaacacattttcctgtaaattttcttgattttgaacgaaaaaactgcttttaataactacgaaatcaatgacggatcctgcccccttaattcctcgcggcgaatagctcaggaaaggaacaactgcgtttaatgaactaacgtaatgttatagcgttagcgtagttacggtatacttcgtagattggatactaggaacattcacgtttcatttgataacctcatatagactgctttcaggaacaaggctggggagtaaaccttggcccagtcttggacaatattaccaaaatcatgaatattgctattcccggccacgcccatctttaccgtaacttgggataagggaaggaaaagcgcaacaattttttttcgattttcgcacatctaaatctcggagaaacgaaattttcaaatattaaaaaaaatactctcgaggttcaacatttattgaaaatgtgattttttagtcagttttaaacaaagaattggaaaatgagataatatcaacaatcctttcatccagaaatcgtccagaaattccttcacagattttggaataggatcatttctccactatttgctctacaaaataatagaaataccttcagtattttcaacaaggtttactctaaaagttggcattcatccagatttgatcctccagagtgatccctccaagaattaattcgcagttcatgcaaggcttttccagaaaatttattagggacttctaaattaaccccaacaggcaatcctggtgaggttgctgccgcaacatctcttggaatttattactcttgcagttcttttaaatttatcttgattgatttcttaggtatgtgttgatggattctttaaaatgtaatttaattcaatactccagtaaatactaaagcaaatattccagtgattcctctgttctacttatttttcttcttcttgctggcgttatgttccaactaggacagagtctgcttcttcatgatcacttatcgacttgtgtccccaatcacattcatccaagccacgaagcatacagtacagcaaaaaaaaaatgaaaatcattattccatgttttatggtatatattggcataacatcacatccacatgataaaaaaaattgtaaggcatttctaaaaattaaattaattttggactccactcaatatttttgagattgttttaaatgtttgtaactgcttttcgatccacttcttagttgtaacatttaaattaaacctgctcattcccttgtgttgatgatatgttgaaatgaaatcttataaagttattaagaagatttcaaaccaacaagagtcttaccaaaacatgttaggattccgctgagcaacaccaaggtttccatatagtagaggattttaaaatacgttttttaagccttttgtcaagtttccagcttttgacaagaaaaaaaaacataaacgtgtattccgtgaaacaaactaaaaatttcgtttcgtttcgaaaaattccgtgagatatttgatttcgtatcgagttacacgaaacatttttaaatttcgtttcgtttcgtcattatcagcgcaagatgttccgcgtatcgtttcgtttcgtatcgacatggaaaaaatccatatcgcatacccttaatatagagtaaggtgtgcgcgaccaaaatttccagaaaaacaatagcaaaaggaccaaaataaataccacactgtgaatctttaacaacatattggctttgtcaaaatatttaccaattttagttatgacagtttcaaaattgattatcttcaacgaacttttgccccatcggtggggcaagagttcaaatttagtgtggggcaaaagtttgctggtcgaaatacaaaatatcgacacttttatgacagacatacttcataccagccataaatttatgtttacggaaaaatacacattattttttatcaaaaaattcattgatgatttttgatatctctaaccgttttttatcgattcatttgctggatttccaacaggcttctccatgtgcaattgtccattgacaattgtctgaaacttcacagtgagccacatttaggtagggctcttcttggacacctccacgattcacttgacacgggagattttactcggctgaattatctgaaattttgcaataagaagcacttcaaaacaacacatatgagctcagtagctttttataaatctcaatgctaaaatgaaacaagagtgcaaaaaataagaaacttttccttacatagaaatattacaaatcccgctaactattcgtaaaaaaaatcccatgagttaattaaggatttctgcaaggtatcctcaaagatttcatcagaaattcgcagctctcaaggctgctgcgaatatgtcaagagacttgcgaatggatatcttgaaaggcaactatcttccgtggacagaatttgtaaactacaaggaaatccttaaaaaaattggcatacatcctttgggaatttttgcagaaatctttagaccattacctggtcgaaagtttcactacaatctcaatgatatcttcgaaaatgttttgcaaatggttaagcagtggaaaatttcactctgttcaatccctcttataaccaccagagttttgaggaatttttcatgattcttgcttgatagctgtcagcaatttcttatgaatgccttccaatatgaccatagttttattttttcaggtcacactggattgaaaaagaatggatgcgctttgtttaattatatctggcttgaagtcttcaactgactgaatgaacagcagttgaaaggaacaaaacaggttaaagttcagaaatatttgagtgatcaaaatttgcaactcggtaaaaatgctttttaagaacaagttagatgacagattcctcattcctcatccaaaaagtgatgtatgggaaagttgtagatatagctaaaacctacaactttgctaactttaaaatgttgtgagttacaggcaaatttcgagtttttcaagtgttttttttaagtgactttttttaatttacaaaaattacgttctcacagtttttgcagcaaatgtagcctattgtatggccttttgaatgccactaaagaaacattttatcgaaccatctccatgatatatgatcatctaaaggtttcatagtttttcacttaaatttgcttataacttcaaaattacaagaattacaaacttgcgatgttcatcgtgtatatcgttacttactctgctactcttctgaagaccacattcacgtaaaactgaaaatgaaaaagttagaccaaaataactgatttttcaggaccaccctaagttaaaactttcaaaatcaatttacttatctcaaataaagaattagatcaaaagtgtcttcgacaaagttatccaaaataacattctctgaaagtttgcagaagagcgcagccacaaatttcatcaaacaaaaaagtttgagtcaaaattttaagttaaataagggccaccctattcaaatttttttttaaaagacgcacaactcaattacgaataagttctctgaagacatcgaacgactaaaatcgacgagaacagagaaaacactttttttccggctaaattgtcgattcggaccattgtgcgttggtagcccagagacgaaacgcgagttcactacttctgaataaacggatagtttaatgtattctcttggagcatttatctagcgacaaacatgacgttccgccacattataaagatcaacaagttaactagcagaacagttattggtcacacttatgaatcctacgcttcagctttgagatttttttttcttgattcggccaaacggcattcggccaaacgacccattcggccaaatggcattcggccaaatggcgatcggccaaacagtattccgccaaacggcgtcctcaatttagatgataaggactgttcattttataaagtggacaccttgtgcatgctgtatctttttaatttatcaatgaaatttcaatcggttttctgcacttcgtttgactagtattgtacaatattgtgataataaaaattctccaaaattaattaaatttcacacgaatatggaacaacgattagaacggtcggtttttggaggttatcaaaatcaatgattgttagaaattggctggaaaattcgacaatttatattttttattttcaaaaagggcttgtttttcgaaagtatcatcaaacagaagcctgatggaaaaaatcaagttatttttggaacaacaatttatatatacagatataataacatcattttccccctatatttttagagaaaaccattttaaaattgaaggggatcggtatgagtagaatttttttggttaaaagtacgtcctgacggaagtcctaatatagtattaatatgaaaaatgacttacgccttcatagagttacttattaagtccccagatgacatttaaagcacaatagatacacaattgctttattcttagaagacctttcaaagaacatcaaaattgacaacactgctgtaataaaatcgacttcattttgcacctattatttttgtaatatgttattctgagattaccaattgaaattttcggagaaaaccatttacaatttgctgcagatcgataaatatgcgtacacgatttcaaaagtatgagactttttagtaaaactaccataaacagtaaaacttgtgcttaggactgtggtttaaaacccacgatttggctctcgtttgcacaaatatagtttatttagtaaaccagaccagttttgaacacgctttttactttcctcttttgctgggagtgaaaagatggcaaatttggccataaatgggtgcatcactaaagttacctaatgtcagagaatggtggaatatagttgattttttaaagctataccttttgtagaatagtaaaggatacaaacatacaatatgttcataaaaattaggatttttgttttgcgaaaaataatgttaaactttgacgaacagcttttcttaggagtttttggaaaaagtatttggctcttcaaccaaaagcattttctaagatcttatattttaatagtattgtagaataatagttgaacgatgcacagaaaaccgattacgattttatcaataaataaaaaagatatagcaaaaacaaagtgtccactttataaaatgaacagtcctaatttggaacgctataaggtaacgacaaaaaaaggattaatcacacagcgtaacaaaaatgacaattgtgcgtttctcaaggttcaaatatgtgtttctagtagatttgaggtatctgaatctggtgctgttctcagaaatgttcctgcacgtcacaatttttagcttcaggtcgccaaagttgtttttgtgatctattctagcaagtatgcaaaataggacttcaacattcatttaagatatgatttggttgaaattgcacgatcaaatttagattaaatcgattttttcaacatgcttgcagtctccatacaaaactcttcgtttctcttatatggcaagatacaatactcttcttaaacacacaaaaataacttttgagcatcgaaagtattatgaactttgcgaataagtattgttatacacaagtttgaattctgtggcaaattaagaaaataaatttccatacaagctacaaaacttccatgcaagttggctgatatggtcggggttctgctaaaccgcaccaagtgccaaaaccattattttgagatgttcaactttaaagttcactcatctgcgagtaaatcgcaaatgactcttttgaaaattttaccgatcacaaataactaacagggtccaataagtaactcaagatagaatattcagaaaaatcataaaatattttctatttaaatagatttgatttcaaatcaagaggcacttagttcactctggctgaacgaaaattgaagaaaatggttttcagttcggtatggttgaatgtgtttcatgatttccaggaacacagaaaaagaatgaagggttcatatcatcgccatgcatgttggaatgcttgtcacaaaagtttataaaccatgaacgggaaagatttgtaattttccatagaactggccacaatgtagtggcatgaattggtacaagccaattcttgatggattatctatttcaacagaagagttattgaatcaaatccctcacgcattcaaagattcgaaaaagacaataatgatgtagttaaagaatgtgacgatcgaagaaaccagagcgcaccaagttactcgcttttagcatactttggctgaacaagttcacgattctttatgtgaagtggataccaggaatggcatgaaattgatggacaacctaaaaaaatatttatcgggattcgaactcgtgtccttcgcgtggtgattaggcgtgctacctctcggtcattttgaattgagagcgaataactcaaaacaagctatgcgcgatgtgatcaaggaggcttgatgatgaaaacaggtgaaaacgtcattttctgaacagctaaaacgcaccaagtgcttccaaattattcatacaacatcaaatttaaatattttgttgtttcattacggctcctgcatggatccatcgacatattatatatgaagcgaaggcaagcgtttagcgaatgtttatatattttctccatacaaaaacacgatttttatataaatggtactcggtgcggtgtggctaaacaaaatttcaatgatattagatcagcaccaccgaaacaatattgtattttacaaagccgttaacttacatgacatactaaaatccgttggtgttgttactgtatgttgtccgaaatggccacggggtttagcagaaccccgaccatatagccatatttgcattttctacagccaatatctccagacgtcctatgatatttttaaaaacggtagtggattcagcaacccttaaaaaagtaaatagtggtattttgattctcgaatcaaaaacgtgttccgcagttttatgctcaatagagctattaaaatcggtgaaaaacttgcacgttaatgaatctgaacttgaatttattttacagttcaatttcagaagattgaatttaattagtgagcgttttatgatgtagtgaaacattcgaaaacaattgtctctcaaattttataataattctctgcactaaataaatatgaagagttcacgcagaaacgatttctcctttctcaagtcatgctaatgcatcatttcacggatgtcagagtttatcagctgtaaggtaccatgcaatatcaaagctaggcattgcagaattcgttctcaatggaactcgaagcacgatcaaaacaagcatagaaaaatatcgcatctgtatctgtgcatgattggcaatgtttcgcgagttgtaacaagcttgatagatagcagcagcaaacgagaccctaaaaaaagaagcgatgataaaacccatttccctcgcttacctaccattgggggtaggtgttttattttactagcatgctatacaatccccaaacatccgatagcaatagtgtccccaagtttttagcttgataagacaggttttatcatgcactatttcccccccgattcaatcagagctgtagcggaagatgataaacaagctgatgtgttactcatcatgactgttccagagagcgatattttttctctcaattttctcagaattcaacccctactcatgacccatcgacgagttgtgtcttcgactcgttttgtgcatgttacatttgtttttgatctcggtttcggtgcttcccatccatacaacctaggaagacgtagttcatgaaaatcccatccaaaaccaacgcatggtaccatatcaaaacgatggcgttctagttgttctagacggtggctcatgttttgataagaatgacatgatttcatagagacgccggagagaggtataaaaggccgtgcccccacttcctgcacacagtttttttttcgttatcttgtcacgaagataattatctccattataatgtttattcaattgttagaaattgtgtcctgcatttatctcaacgaaattgttgcataatgcagaagttacattatgatttataatcattataataagcatgttcaagcccgatttaaaaaatatgtaaaattaattgagggccttccttagccgcgtggttagagttcacggctacgaagcaaagccatgctgaaggtgtctgggttcgatttccggtcggtctagcaaagaaagctcttagttagtaaccgtggaagtgctcataagaacactaaactgagaagcaggctctgttctagtgaggaagtaatgccaaaaatacaaaaaaaatgtatttatcctctgtagtatcaactcattaaagaaaatcaatacttcgtcatgaaaacaagctatcgatcttcaaatattattttaggtcagtcatattgtatgctataccaatctagacaagctgttgtattagaaagaaaattcaattctactcatttatctatagcaattcagcgcagcgaagactctaagctaagcaggctctaccctagttgggttataataacaagaaaaagaaacaaagctcgaagcagtctttctcttcaatgacaaacacaacttcataaacatcatctatggttgccgcaataaaagtttgatttccctttccgctatcatgccttttatatgttctccataattggtacaatattttccttcccgttcaccactcatacaatgccttaactccgagcagaaaaaaaatcctgtaagcaaaacatgcattaaaaactcatccccacagatccgttgcaaattttactacattttccaatctccacatactctcgacgactgctagtaacaacattttcattttcacttgtttttccattttttttttttctatccacaggacttcatccggggcttcagaagcataccctggccagcagtaatggcggtggagcacaggccggaggaagcaacccacacgatggcaacagctgcccagggagtccacagcataatgggacggcgataataacgcagatccccaaaggaggcagcaggtaaatatcgactcactttttttgtctgttgttgctctgttgcgctatctcttcgttttgtgtggtgggggataccaacaaggatgatgaaaattatgatgctactggtagcggtctttgcgactaacagttcacagtgttttatttgttcggtttcgtgcactttttttttattagcgtttaaaccactaaccaattttcagcaccgatttgaaagagtgctgaaaagtaacactttttaataatgttttttggtgggaaaagtaggttcattattttgataaaaagtagactgacatgcaacggctaatatcgcaaaatttcttggtttataaaatcgacaaaacaaagcattgtgcatttgtacgatggaagaagcacacttttcattgcttttgggaaataacggtaggtcggtttgtcggcggctggtggcggttgttgtgtttttgtcattcgagatgagttttctcgcgaaaaagcgaggaaaatgcgttcatggggagttttaccttttttcgggggagattatgagccagagcaatttagaattcacggcagcacagcaggttccattgcacctacgcacaaacacacctaaccggcttggggaccctgttttccagtagtcgaagagctaagtgacgacatgtttgctatgcgccgtggcgggcgaagtaggccttttctatggcttaaactgattaaacagtggtgtccccaaggacgacttgattggaatttatggttgccgccacggagttctgttagagatggggattcctaacttgctaaacttgtggggaaaacgtgatgaaatttatgaattcatgaatgttgaaaactgattccttaccgttaaagattgatatgtcaccggttttcgattatatcatgctgaattgccaaaatcgatgatttggagttttattgacatcgatttgactgcattagtccagtgaacaattttgcaaataaatcaaaatttaaagcgatgatgaggcgagatcttaggagtacagtagctatagctagtacaagttcagtaaacacatttgagcagatattttggaattttggaacacgcttaaagtttttcaccataaacctacgagaaactcttctagattttcaaccaatcaatatatggaattttttaatgcatgaactcactagtagaaatttagtgtgcatgtttcttataactgtttgcccataaatcgcttgcttcaaaatacaagaaaccatagttttcaaattgttaacatagaaatcgtttgggtaaaaatgaaaatttcagattacactcaaaatttgttttacttaaaaaattaggaaaacccttattgttttcaattatttgcaagttctaaattatttaaaattatcaaaatttaaagtgacgacattttatttttatcgaataaaatttcgttcttgaagtgaaaaaagtatgtttgaacagacatagaaatttttaaataaaaactactacatacatttttttacataaaaactacctaaaatcatgtttgttttaaccattaaaagcccgagacgagcctttgatttttgaatggccacaataaagatcaataaatttgaaataaattttgaagtaaatgcggtaagttgggttggatatccctcttgacccctccctcttttctaggtaatggaaaaagcgtgatcacgagggatccaaaattggccttaaacagatatcttaacatccaaatgagctagaaggttgatgtcttcggcaaagttattcagccgatgaagaactatatggcgatgaaaaatctgattgagtatttttccgcaatgtggcgctagtgttaaattttatttaaatgtctgtatcttatgatctttatcatctagaaagcttgtatcttcaaagctgttcagcagatcaagggttatctggcgttgaagagtctgattgggaattcatccactagacggcaatagtaaaaaaaatcttcaatcttctctacctcaagatccttggtagtgtcttcggcaaagatattcagcagattgagggctatctggaggtaaaaaataatcaggtaaatcaggatttgtttgcttggcgctagtaacaaattttctttaatctttcgtatctcaagttcctcatgtgctgatcaagagctctctggttatgaaaaatcggattcagaatacaaccgataggagacgctagtagcaaattttcttcaatcttcggagtctcgatataatggaaaaataattgttcatgttaaaaggtggaatctacctgaggaataatccgttgaatggcgctacagtcatctctccataactttatattcagaatctttatatccctttcgggacgaaccagcacaattgtgctgttcggcacccttgacatcgaatgactatttcagccaataaatcattgttttactaaactttttcgatttcgattattgaattatcattgatacttgtaatcaagcacaacagcttttgtttacatcgtgtttagaaaacaccaactcagggtaaacaaaaagtaaacaaacaccgtaagaattgaaaaagttttatctgtcgcaacttttcaactattcgttatttctaggtatgcacaggtacgaatcgagagtgaaagagtcattctttgaaatggtgaagaccaaatgagaattgattcacacagcaaatatttctggagggacaaagtgggaccagcacaattgtgctggtgccggcacttacccggtcgatgttcgttgtagactaccaattttcattttcagtattttgatcgaatcaagtggctgaatctggttctaatgtccacaatagtgcataatattgcattaaaacatgaataagtgatttcatacgaatcataaggatgatgtaccgttcgaaaactatgtaacagaaactcatagctttggtttaaaaacttttatttttatacgtccatatttgaaatagattgggaatcacatttaatgttttaaatctcctttagcaaagtttaagacaaagtaaaagtttaggggaacgttcaaaaataacgtcattcatttaggggagtagaggtgtatgaaagtgcgacagtgcacgtgggcaaaagcgtggtagtggacatggggaggatttagattgacttaaaaacaatggacgtaatttttgaatttccccttgctttgataatcgatcaataccatgttgacgcgataatccattttggtgttctacaatgtatgccggttcaatttctgccataatatttatgaaatttgacaactgaagctaaaaacctttacttactatttgcttccaaaccacagagttctttgaatggcatactattgatgtatgcagcccatgctagtcttcttcttcttcttcttcttcttggcactacatcctcactgggacagagcctgcttctcagcttagtgttcaatgagcacttccatagttattacctgagagcttccattgccaaagttgccgttttcacattcgtatattaggtggcaagtacgatgaaactctatgcccagggaagtcaaaaaaatttccattacgaaaagatcttggactgaccgggaatcgaacccagacaccttcagcatggctttgctttttagtcgtggactctaaccactcgactaaggaaggcccctgctggtattactcgcaaatatgttgtttatgatgtatgaaatgcgtttgaaatagtctacttaactattaaacaatgtatgaagttatggagtctagattatccgctcatatataaaatatcatttcattccttttacgtttaaaaatatattctagcataacatttgaaaagggcctatctgcaaaacgtaaacattgagaaattctaaattgaagattccgtaccatatttgtaattcctattttaaacccattcgcatttttactagtttcatatctgtgttcgacacccattgaagtctgttgcgtggcccattatgtttctaatctcaaataacacaacaactcgtaaaaattgttgaattcaaacatcatcggcacataggcccttttatgaatcttcaaaccagttaggccctttcagttaggccctttgattgaacatgtttcagttaggcccttttataatttgctaattttattgatttttgaattggtttgcataaatcttgaaaaaaaaatagcgattatgtgaaaaaaaacactatataatagctaaatattggaaattttcggttgaagattcagtaccatattgattattcctatttcaaacccattcgctttttactagtttcatacttggggaagatccaaaaatgacgtccatcgtttttcgggatttctagaacccttctaccccctctgtcacgctttttccaatacccaatccatgcactgtcacattttcgtacatccccccattggaggaggccccaattgatggacgtcattttcggataaccccttgtgttcgacacttataatggtctattacgtggctcacaacgatttgaatttcaaatagcacaataacttgtaaaaatagttcaattcaaacatcatccgcagataggcccttttacgaattctcaaaccagttaggccccttttgaatttgctaattttattgattattgaagtgatttgcataattcttcgacaacatttaatgattatgtgagaaaacaacacaatatcatacaagctaaatattggaaaatattctatacaaaatcagcaacattgattattgatatttcaaacacattcacttttttttactagttttatacttgtgttagacactcattatggtttattacgtggcccagaacgttagtaatctcaaatagcataacgactcgtggaaatggttgcattcaaatatcatcagcagttaggccctttaatgaatcttcaaaccagttaggccttatcagttaggccctttgattggacatggtttcagttaggcccctccagttaggcccttttattaaacatagttccagttgggcccttttggaatttgttgattttattgcttattgaagtgattttcatagttcttaaataaaataaagcgagagaaaaacaatgtaatagctaaatgttggatattctcggttgaaggttcagtaccttattgattatatctatttcaaacccattcacttttttgcttgttttatacttgagggccttcctaagccgagcagtttaagtccgcggctacaaagcgaagccattctgaaggtatctgagttccattcccggtcggtccaggtttttacgtaatggaaatttccttcactttcctgaatatacagtaccttcgtacttgtcacactatatacgaatgcgaaaatggcaacttgtcaaagaaagctctcagtttataactgtggaagtactcattgaacacaaagcttagaagcaggctctttctcagtgaggacgtaatgccaagaagtataagaagaattcttgcagggctgttacaaaaataaacgaatttgtttttgtgaaaatcgcgacttttggaactcgatccacaactagaggcaataaataaaaattatacaaaatttttaatgttattgatttttttttcaggataaaaaatcagtttttcaactaacttcgcattaagattatgataaaactagtaaaaaagagaatggacttgaaataggaatcaatatagtactgaatcttcaataaagaatttttattaatcaatgttgattttctcacatacctaatcgattgattttgttctaaaactttgaaaatcacttcaacaatcaataaaattaacaaattttaaaagggcctaactggaactaagtctaataaaagggcctaactggaggggcctaactgaaaccatgttcaatcaaagggcctaactgaaagggcctaactggtttgcagactcgtaaaagggcctatctgcctatgatgtttgaattcaaccattttcacgagttgttttgtattcaagatttaatacgttatgggccatctagtagactattatgagtgtcgaacacaagtataaaactagtaaataggagaaatctgaatcttcaataaagaattttcaatattcaatgttgattttctcacataatcgattgattttattctaaaactttgaaaatctattcaataatcaataaaattaacaaattccaaaagggtctaactggaactatgttaaataaaagggcctaactggaggggcctaattgaaagggcctaactggtttgaagactcgtaaaagggcctatctgccgatgatgttttaattcaacattttttactagtttttatgttatgttagatttaaaacgttacgtggcccagtaatagactattagtgtcgaacaaaagcttaaaactattagatagcaatgagtttaaaatagtaacaatcaatatgttacagaatcttcaatcgaggatttctcaatttttacgttatgctgatagacccttttcaaatatttcactaggtctcattatgtgagaaaaacacattacaatggctaaatattgaaaaatatggaggaaaattaaaaatgcacggaagggccaatctgattttgatggaaattttcagttaggcccttctatgatcagttaggccctcttagttttatcattttcagataggcccttttaaacttgaataaaattaccattaataatgcattttgcatgcccgtaagagtatgtaggagtaatttacgtaaaaaattatacgaataatgaataatcaagtttgtttacattttgcagttaggcccttttcaaatgttacgctaaatctggaattttgagacttagataagctgatatattaaaaataaaaatctgtactttattgccgtgcgtatagtgttgtaaagtaactagcagtatcgatcaaagaagtttaggttcaattcccgctgcaatatttttttcgtcagatacgtattacgattgtgccatttggcgttgcatgctagtccgttgattcgtgtgatgcttcctttaaaggccataatcgtacataatactttccaggaaactttccacggtaggattgacagctaaaaatgtacatgcaaccgaaacgaaagggaaaacaaaacttacgagtatggtcgagctttacattttccttagtaatctaacggtcacaccgattgcgaaacttcaaaagctcatggaaaatcaaaaagtctactgtttgcagctgtctagctgtaagaaaaatgcttagataattcaacggttaggtagaactaagattcagattgatgcaggttcacggtgctcccctgaccgttattatcagaaaaaaatctccatcaaatctgtgctcaccagtcgttttctatagctaagctgcatgtctgggcaaaattttaaaaaaatcgtagggcccgtttttaagttacgcccttttgattatttaagtccacaaaatcaaaggaaatctgaaatatttgaacgggttttcattagccgtgactgcagaagcaatataccatcaaaatgtggtaattagttgctttattcatttatttgtaacttatgggcggagttttgaataagaaaatcaacaaaatttggagttacgcccttttggaggtgcaataattaaaaacactaattttaaatagaataattaggcattctaataccattaagcatgttcaaatgttttcaatggcacattgcatttacatgcagcaaaagtgtttcaccattagctgatttttcataggctcaagtgctatacggcattacggagccaattatgtaccacatacaaacagacgtaacaactagaacaattatcaatttaaatcatagtcacgtgaacatttacgcccaatactaaaaacacttcatttggccaaccgcgaactaggtggcggtagtgagcaaacgtcaaactcgaacaaaagtgatgcgagcgccacgattggcatgtcggccaactacaaaatatttgaattctgctgtgttataaaaaaaatagagtgttacgtatgtttgtctgtgtcaactagctatccccttggcttttccggctaactttgtactaccccagaacataaacttcagttgccgagtaatgtagtactgaccaaactatgtcactcaagatcactgtcaatacttatgttatcatttatagcatttttcacaaattcatttggatttttcacaaatctacaactttacatatatgttccccggtcttttcgattacacaaacacgtaaaagtcctagataaatacaatagtaaaagccatattttacttgtctaccttaaccatcaaaactctcttgagatgattttataacttaacctcgaatttcatttccatgaatatcattaatccaagtgtcatcacactgaacgcactattacgctgaaagctattgaccgaaatatataaatactttgaaatgccccgtgataatggaattcgaagtaataccattcaacgaactggaactcgatgtgatggtcttcaggtttatagtgtttggggtaatgaaatttagagttaaggggtatattttaaaaaaagattaataacatattgtaaaacagagttcttcatgaattctgcgtaaatcccagtttaggttaccgaaaaattgtaaattgttctgtggccctgttggttacttgctggtctactaatcataacatggtttgaatcctacacaaactgaagatttctatgtaaagactcaccagctgctataaccctgcacaaccaaaaatcatactttgggggcgacccaaactttcccaagctgacgaagacaaaacaattaaaattaagctctgtaagtgctgcgattttgaattccattaaacaaaatgataacggatgctctaaactttgcattattttctttcattttgtatcgatgctttctacgttgtaaattttgttctactactgctacccataacgcctactatttgtatgaagtattcggagcctgtacggatttcggtcccctactgtacgtatacatgcatttcgttacacaacatgtaccaataattttcatgaaaactaatctaaatcgtaagaacatgggttcaccaaactagccagaatattgtgctacaaaaactaatttggttacattgtgaaattggctccgtaatgccttatagcacttgagcctaagtaaaatcagctaattgtgaaacactttggcggcatataagcacaatgtgtcattgaaaacatttgaacaagattaacgatattagaatgcctgataattctatttcgcattagtgtttttaatgattacacctccaaaagggcgtaactccaaattttgtgggttttctcattccaaacttcgctcataagttacaaataactataaaaaccaactttgattcaaattatagcaatatatttattctgataatcacggtgaatgacaccccatttaaatatttcagatttcctttgaaatagtgaacttaaaaaatcaaaaaggcgtaacttcaaaacgggccctacgatttttttaaaattttgcccagacatgcagcttagctatagaaaacgactggtgagcacagatttgatggagatttttttctgataataacggtcaggggagcaccgtgggttgtattacaggccagagcaaaattgccgatcaaagggatcctttggcgtgaaatttgagaatgaaattgtgagggccgcttttctccccctgataaacaaaaaaaaaacctgactacgcccatgtccctcgccccctttaaaagctatgtaggtcgtaaacgtagttcataagcaaatatttccatgttaaaatttgaaaaaacagaaacaaaatatatgtcccgattttgtcaggttccccattttgtcagcctaaatttcatcgagggggttgacaaaatcgggtctctactgtattacaatgacttaaattccattttaagcaaatagactcgatgtaaaaaataaaataaaataaatttgatattgggagccagatagccatacggtatacacgcagatactaagtaagatcatgctgagggtcgtaggttagagtccagccggtcgagtatcttttcgtaaagggaattttctcgacttccccgagcgtagagtatgatcgtacctgtcacacgatatacacatgcaacattggtcgattgacaaagatagctgttagcacagacaaacagacgtcacactctcatcattgttcatcgaccacctttaaaacggtcgattcaaaaataagttaggtggccaatccgccacccgcagcgctcgcttcgtttttgttcgtgttagacactaccgccatctgttggcccgtcggccaaacacgctgattttagcattgggcgtacatgtcctcgtgactatgatttggatcgagatttgttctaagtgttacgtctgtttgtctgtgctgttagttaatttctgtggaagtgctcatgagaagttgagaagcaggcttttttagcgtcagaaagaagaagaagaaattttatggtaattatttgcacttaaaaacgtccaagctgtcgggcacatatgacgtaaatttacatgaatttttaggaaagctgcttacgcagactgaatattttggcgtttcctttttagatttaggaacaaaatgaataattccagttatttaaaataaattagttccatgttaccaaccttatcaaaaacatcgttcaaccatcatttgaaggagggctatgtgatttcaaagtgatagtgtatatgttaggtaaagtgagtgaaagaggttggagggagtctctaaaaaaataatttaattttcgagtctagtacacgactctgacaacggccttatagtggaggtcgaattatgcgtaactgtcaaaggatacaaactgtagtggaataaaatgatatagttctcaattcggttttcatttatttataggtattccactaaacaattcgaaggtttattattattttcaattttaatttttattgcataattatctttgaggaaaaatcccacataatttaggaggatataaacaaacatagcaagacgatttgattgagccaattagttttcaagttattcacacatgtatttttacacatttttatatgacgtagacaatttctagaataatctcgataaacgccatcgtcacgtgatgctttgaatcttagagagaatatgaagtatttgtatctctcgtacattgttctcgttccatttataacaaaaaatcatattaattaaaatacataattttttatatttcaatgtgcattaagaaaaaacataattatttctaaatttttgggtcaccctatctcaataaagagcaccctaatgacgaaataaaaaaatacgggtcaaaatttttttaaaaaaggcatgactaaaacaactttctaaaaatataaaaaaaaaatatttttttttttcgaacatcgaccgccttggggacggaccagcacaattgtgctggtctgaatttgaccctaaaaagttcatggagtgatggaatagccaaaataaagaatgttttgttctacgagatgatgagtttataaggtaaattttgaaataatcactcaaatatggtccgtcccgaaagggatattgagttaaagaatcatattaaaaattggttttcatggcttcccttatacagtcgactctccacatctcgatgttctacatcacgatatctctccctatgtcgatgatttcttcgatcccttcattctgcaaacgatttcgctctccatatcccgatatctccgtatctcgatgtgttcctgttgatttttgttcctaatcaaaggttactagaccagatttaaataattcaaaacaatttggaaagtcgaaatgaaatttttttgtttattgttttcctagtaacggagtgattctcaatctagtgttccttttttttttttaatttctttattagtatcattccaaacattacattcatttcttatatctaggtgttctgtgttattagacaacactatcatcctaatttggtaaaacatatttaagatttaattaacattttgttaacaacatattacatttcatttgccgtagcagttcagattttttacaggtgagttgatttcacctgcttataagagaaaaaaaaacgctttgaatatacttaacctaacttaacctaaacatataacgcatttatcgtggcaatagaagattgtaacgatttttgcctgaaattatttattattttatttgacatttgttccaatgtatcaacattggatattctatgtaactcattggtactataccagggaggaagtctcagaatcattttcaaaattttattttgaattctctgcagagctttcttcctggtattacaacagctagtccatattggtacagcatacaacatggctggcctgaaaatttgtttgaatatcaaaagcttgttcttaagacaatgttttgatttactattaataagtgaatagagacattttacatatttgttacatttggcttgaatgccctcaatgtgatttttgaaagttaaattcttatctagcatgagccctagatacttaacttcatctgaccaatttattggaacccctctcatcgtgacaatatgtctacttgaaggtttcaaataaagagcttttggtttatgtgggaatattattagttgagttttggaagcattaggaataatcttccatttttgcaagtatgaagaaaaaatatccaaacttttttgcaatctactacagatgacacgctggcttcgtcctttggcggagaggcctgtgtcatccgcaaacaaagatttttgacatccctgaggtaactcaggtaggtcagatgtgaggaacaccagctcttacatgaagtttttcagatctggagttctgataattaacctgaagtgtacgatttgacagataactttgaattattctaacaatgtatgttggaaaattaaagttttttaattttacaatcaaaccttcatgccaaacactgtcgaatgctttttctatgtctagaagagcaagaccagtagaatagccttcagatttgttggaacgaatcaaatttgttacacgtaaaagttgatgagtggtcgaatgtccatggcggaatccgaactgttcattggcaaaaattgaattttcgttgatgtgggccatcattctgttcaaaataaccttttcaaaaagtttactgatggaggaaagcacactgattggacgatagctagaagcttctgcaggatttttgtctggttttaaaattggaacaaccttagcatttttccatttgtcaggaaaatatgctaattgaaaacatttgttaaatatatcaactaaaaatgataagctactttcttgaagtttcttgatgaggatgtagaaaattccaatatgccaggagctttcatgtttttgaattttttgataatagttctcacttcttccaaatcagtctcccaggcattttcgaaaacgttctcttgattgagaatattttctaactcctgagtaacttcattttcaattggactagtaagtcctaaattaaaattgtgcgcactttcaaactgcatagcaagtttttgagctttttcgcaattagttagtaataatttgttttcctctttcaatgccggtattggcttctgaggttttttcaagattttagataatttccaaaagggcttagagccagggttcaattgagaaattttattttcaaaatttttgtttcttaattgagcaaaacgtttcttgatttctttctgcaaatcctgccatataagtgcgagtgcgttgaaattgccttctcctcacgtttttaagacggatcaagagtttaagatcatcgtctttaatcacggattcaaattttacttcacattttggaattgcaatgctcctggcttcaacaatggaatttgttaaagtttcaatagcattgtcaatatcaagtttagtttctaaagaaatgttaacatcaagattagagtcaacatacgtttcatatatattccagtcggctcgtaaataattgaaagtggagctgataggattgagaatcgcttcttgggatttttgaaaagtaacagggacatgatcagaatcaaaatcagcatgacatcatctttctaagtggtcagaatcctgggatattcgcaacaccaacggtgttgtacaaagtacaacgcgcgactactcgcgttacaaaaattcgcgcgacgaccgaaaggttaaatagtataataagtaagctgggccaattgaaaaatatcgaattgtaagaatctgtagttacatctttcaaatttgttaatttagacgacaagaagctactttgaaagttccagtgattccatcgtaactcagggtgctccgagcttaaagtttgtatgagtcaattggccgagttttgaaaggttaacttatggtgaactgatgttgaaaacacaaaattacaaccacttctcactccattaggtgattctgaatcgcccatctgcaaatcagcaagagcaatttactcgaaaaacacacaaaaccagaccgataaatcaacctgtgactggcaaaatatttctattaacatgctttatggcttttcctcaatctctgtgccttccgccctctgaccatatctcatcacacactcacacataatgcctatgcttcattttcgtttcagtctccggccaccgcagacgacatgcaagattccggccagtccctatgcgacccaaaccgtcggaagtaaccacatcaataacaacaacaacagcagcagcaacagcaaccacaacaacaacgtcaccctaatcccgaatgggaacgttaccaacatcccaaatccgacccagaagcaatcgatgctggaaaagctgaaactattcaacagcaaagagaaacaggacaaaacttccaaatcgaccatttccaaacggaccagctcgagcagtggcttttcctcggctcgaagcgaacggagcgattccagtctgagtcttaacaacgatggccacacgggaaagagtgggaaggattccagtttgggtaaaaaatccgacactgccaacagtagtgccaaagtcaaatcatcgaagctcatctcatccaagtccagttcaaaggacgcatcggggtcaaaaatttccacggttgggaaactgggcggggacaaaagcaaagtgggtaaggatcaacctcacgatacgcacattccgatcacggcaccgaaggcgcacaaaattccgacggcgacggccatgacaactgcagccagcggaggccaaccgaagtccgaatcgaaacttaaacctgcctctgtgggaggtacgggcagcagaaaactcgatgcaaaatccgaaagtaaaactagtttgttgttgcaccaacagcaattacaacagcagcaacaactacaacagtcacagttgcaaccgccgaaaacgatggtggctccaccgtcagtcaatactgggattccgaaaccgatggccgctgtgaagggaacgagcaaaccttcgccgcctcagccagtgcttcaggacaccaaatcaaaggatgagctcttgaagttggaccgcgctctggccggctttggaggacaccagaatggcctgatctcgccccagcatctaccgaataacatatcaaacaacaatagtgatcgaatgaatgtggtgaatacaatcagtggtaacaataacgttctgggaagtcccatgaaaatgccatcccaacagcaaatccccagctgtatgagtgatagcatgcactctaactcaacgcaaggagcgtccatcggacaacactccaactccagcgagaccagcagtgtcgcctatcgccccagcggatcggaaagtggctccgaactgatctcgaacctcagctccccgcacaagtcctcgagctccttcctcttcaacgatgtcaatttgaacaacaacaataacagcaaatttaacaccgtcccatcaaaaatcctaaacactgccccgaaccaaaatgggaccatttacgagcaggaggagaagcaaatcaccgtcgttccgatgcgacctctgctccgtgggtacaacagtcacgtcacactgccaacgcgaggtgcccgcggtcatcactacatatcggagtactgcgaggacctcggcggacagggctattgcagcgatggagacgcactgcgaaagatccccgcacgctactcggactccatggagaatgggtacctgtcggaggggggtggtggcggaggcaatggtgccttgatgacacgccagcagtacatcagctccttgaggaatcgaacgccgctgcccacgaccatcgaggaacggtgagtaatatttttttcaagtgacccaaaactgttgaaggggttgtctggtcgcagagactggggcatgctattgaagcggataatttatgtttgggtaaatggtgagggccgaagtgcgtgcgtgggattcgttcgtggttgtgatatttcattgtgaatcgagaagacgattcgccgaggtatggcggggagatgtctcgtcgtggtgacagctattcggtaccggagggatccgtctgggcttggaagacggggtgcttggtgggtaataatgtgtggaatggaggggtcatcatcagcaatcgggacaggagcaatccgagagacatgccgaggagttaattcatgggattaagacgctgggtagtaccgaagaaagggaatgcaattggttgggggattgctgcatgccaatgatgactcaaaatgagttttattggcaactgaatttaatggagtgcttaagttttgcatttatagggctataaagcattctttattaaacatttcaaatcaaaattaccggtttgtgacgtcagaaattaagagattgtccataaaccacgtgtgaatcatggtctctcaagagcacggtaaatgtccagccactattaattgaattataccacaattttgcccttcagaaatcgcatttgaatcatgtgtccacaccatttttggtagactcacactcaaatctcaatcacagagtcagtagcgtagctagggaggtgcggtgggtgcggtccgcatcgggccccgagttcataggggcccccaaatcgtggtaagtgtttcatttactataaagaatttgatttctagaaaactaacaggttacaagcagatgaaaactcagtttgacggtgaccttgatcggcaatgtgtagggccccataatcaatggtattagtgattagaaaagcttaaataggtacctcaaaattcattctcgacaacaattttgaaattcatacggatctacctaaatgtgcggggcccataaccgtatctggaactgatttggaggtatgttacagacctcaccgtatttcatttcaattattatttagaatagatatcagtaaccatcttcgggacatggtttgtacatattcaaggctagtagaagatctctttttagaggcttagcctctattttaatgcaaggctttatttttaaaggctctatttttaagaaatcttaaaaatagagacttgttttaaagaaatcttaaaaatagagacttgtttttaagaaaatttttcactgttttttttaggaatttctttttaggttcctctagaagtattccttcggaatatgaggcaaaagcgaagaggcgtccggaataagaatcatgaaaaggccacacatttccatttatttaaaattattcctgttgcggaatcaaaatcttcacccaacattcgaaagttaagtgttttgaaggctcgataacgcagaagaattatacataatgaattattttatatgctttctgatgagttatacttcactgaggccttaagtgtccgtaacatgaatcagaacggtataggagatcttccctagcttcataaaagagctctttaaaaaaatactatactgttcatttgcatatgaggatttttcaaagaattcctaagagaattcctatgccagtttctccagtttgccatacaggactttttacagcaatacttcgatataacataactcgatttttatattcgttacgttacatcgaggttactttatatcaaagcaagtttttttgtatctaaatttcgttcaacatgtatacttttattggaaaatggatcatgaattgatgttattgacctagcaagcattttcagtctttcttacatatttttgcgtgtttattttttatttttcttttaattttctttttttattgttacgcaatatttgaagaaatgtattccagaaatatctttgcaggaatccttgaacactcagaaaaactctgaaagaaattcattaacgagatcttttagaaaccctttaaaagttaatgttgagccgtccattaacagttctagtagggtcgatgtaccaataaccgcaaagctaagaacaaaaattcgtataaaatcgaaaaataacgctagcgtcattatttttacatcatctgaaagcttggtcttatgagaaaaatatgaaaactacgaaaactcaaatttttgtatttattatcgcgtgtgccactataggaacatatgtgcctatattagcactatttctaatttctgttcctatagtagcactaggatgacgtcgttggcaaaatacttatcaaaacagtatttttacaaaacttctatatttttccttcaaagtgtggatcaaaagctatcgtttgatgtaaaaaaaagttcttaattcatcaattattttgtaaaataaaaaaatagtttctctcagtagtgctactttaggaacaataggtttactataggcgcaagggagctcaaattttaagatggtacttagataaatagctcctgaccttcatgtcaaaaaatgttttgaaaagatttatatcaaaagagaacaccgaccctaggcaattatgggacttgaagaattttgttatggagaactcttgaaataaatccttttgttatttcttgaaagaattttagaataaattccccaagaattctttaaaaaacgtatcagtaaattgatgtaggaatcactagaaaactccattcaaagaaaaactaacgttgagagattttccacggaaaagtttcagaacgaatacgttgtgagagtatcggcattattccaggagaattctctgggggatctggagatcttgataagtttttggacgaattcccgaatatattttgtaatacaaaatatcagtaggatattctatagacgaaaattttaaagattacttggagaacctactgaaaaaaaatcctaaagaactttcttaagaaattcctgatggaatcaaatggaagaatttcgtaattaatttactgacgatatttcgagaagattgttttttagggttttggacgaatacctgtacgagtttttagaataattgctagggcatttcaagaatcattactggatagctcttcgaaagagtcgctggaacaactcatgataaactgctggaataatttatgaatttctttactccggaaaaattaaagtatcgtaggtagaatggtttgaagaatttatagttgaatcttcttcatatcctggagaaatcacttggtgaaattcttgatcaaaggcatagaagaattcatagatatatttgaaaaagaaactagaagaatcttagggacaatctctggagtaattcctgaaggaattcactggttaaaatctgaacgataattaaaaaaaaaatctagaaaatcctttgagaaaatactatttgaaatcataaagatattgtaaacgggaatcttggtggaagttatgaaaaaacgtaaaatcattgtaaacattcctggagtacttattttcttgaacaatttcaggaaggttttttgaagaaatttatgctggaatctctaaggaaacttttatggttatccttaggggaatgctacattggattttttttagggtttattaatttttaggaagttcgtgaaaatcacacaatgaactcttgagaaaatctttggtgttcattttgtaattagttagcataatttaaggcttttctgccatcgagaatttcaaaatcgaacaaaacaccaaattctggtaatgtcaacattacgctagaattcccaattcaagctgtatatggatcattgctttccagagctactccaccagctaatatatcaacttacatggcaattcactggaagtcctctcgataattttaagtaaactaatgtatttttgaacaagaattaaaaaagaagaactgtaggctcattaactgacatttgtgtcatttaacgactacagcaacataatcaacatatcaacatatcaagttccatcattttagtcataattctataaaagctatttggtcaaagtttatttcaacagttgatttcacattagcgttcgcatttgaacggcgttcacattactttcttgagggcccctaaatggaacaccgcaccgggccccaaaaaccctagctacgccactgcacagagttctcccacaagagcaaactaatttgagatcagctacgcaaaactcacgcatgatattttgatgcaaaatcactgctgtcaaaaatgattcaatcataaatcccatcggaaatatgcccaatcccaatgttattgtttacattagaatggttcgccagaatttctggagtggccacatctgtttgtaccgagatttttcttctttttttgacatgttctcccgaattcatgaaggttgagacgtcgcacggtatgttttggacacaaaacggaaatgtccccaaacgggctctggaggtaccgactacgatgttccggaacggtccacttattcaacttatattgaaatgatgaccactgatcattatcatacgttatacgtaaaaacttcagtttagaactccaatgaaaaaataatacttatgtttgaatccgccgtgacccggaatatatccggcatggttccgaaatcagcattatccatttatgacaagcaactggtacctttcaaagtaaactgaggttggtttcaagaaaatcgaatggaaattgacgaaatggcagctatttgaaaattccttatcggaggtcgggaacgtaaaggttaatatacgagtaccattttgactcatattcccaacacttaaggccaacagtgacttaaaatacatctaattggcataaactagctgatatttgtgtaaattttaatttctttgcaaagtctaactgttagctgttgcgtgtaccgataataatattaatttgattagttttagtattgtttttacgtaaaagtacggagcaacattttgattcaaattctgaacactgtgctcattctgtctcatattccgaacaacttgattcaaattccgaacagcacgaatgaatcgtattcaaatgaataattttgcaaataaatttatctgagcttgttctactggtcttaaattagagaatcatcactactcccgcggtataaattatattggtaacgttaaaatttgattgcaattgactgctatttccttgttatttggtgacatatttcagcgaaatatttcaaccaaatcgccatacaaaaagtgttcggaatatgagtctgttcggaatttgagacaaaacggtatcttggttaaaataacttcttagggtttctatgattttttttggaaaaattgagatattgtccataacttttttcttgtcaaaccgtattttggacgtcctttctatgagtccctggtttaaaatgtgcctaatgactttcaaattaactttcaaaagatccgtgggttgttttgcctcaacgaagcccttatatacactgaggcaaaaatacttaggttttctataaattacgacttacgaatcagtgaaattatgatttcattgaacgcttaacagttttgcatatgtaataaccagtttcataagtgagatctatgaatttttaaatatcataatatgaaacaatttatatggcaatctctagaagagctgctccactttataactttgtggaagcaaatctcgagttttagttacccgatgaagctgaaaatgtgttgggttgtgcactacatatatagaatcatagtgatacatttttcgcatcgatatatagagtggttcttgggatttgcttcttcattatgatgacgcgccttatgttttcagaacatgccaatttttgagcatgcctggagtaaaaggcacagtttcaatggttgattattttaatcattgcgataattaaacaaattcattgactaacttgtaaatttctagaatgaaagtttttaccaatattataattatattattaccgtgacatttataacacttgtttgtcaccttattttactttggataacttctgacccatttcgcaccaaatcgtgagggtgtccatccatccgggtagtaagggaaaagcgggaaaacccccggaattacaaataaccgtgtaaaatacggggaatagccaggaattcggagaacacctcgggaaagtagtaattcaaacataaggctaacggtttgtttcagtttcaagcaccatagaggattttttttttcgtggattgcatcatgtatttcttttggtgagttggtagagagattgttaccgattaagatctatgaaacatttctaaaagggtactaagtgattcttggcaaggttcttggcgagatgcttattagatttccattcaaatttatggtcaatttttaatgagatctttgctggaatcccaacgggaatccaattgacatttaaccagttttttgaaaattctttctgagacatcaccgaaattgttgttagtagatttctaataaggttttcagtggattctagaaaagaaccttggctgatttgcttgaaatttttagtagactcgtagaggttgaagataaattaatagttcctgttcaggccagaagcaagccaccggggtactttaatcaagcaccgctaaagtggatgcagcatacctcatgctgccagccttgcattgtgtcattgtctgacagttcgagaatattcaatccgtcaattgtataaaactttaggcacaacacattattgtatacaacaatgcacttcgagaatattctacccaaatacaatagggtagaggactataaatacgacctcatgtaatgtaccaaatcagactgaaataaaccgtgaattcgaacgtaactctctcgtattttgtatcccttccggatcgtttctggggaacattttggtagatgtctgaggttcctccttctttttcgggtgttgaatcactgcgtccaattaatgtctgaggttgttgatgatactgattcttagcgaagccttttctggattggctaataactagtcatcgatctatgacatcgttcttaagctcttgacaagatgttgtatggattttgcagattcacagcgagttcatccaatcgttcctaacaaattccatggcgagatcgttgataaataaataaatagcgaggtccttttgtttagtttttgacaagattctcgaccaaatctttgaaagattacttggaagatgcaatcttgggattttgtcaacagtttagccagtttcatagaagaaaaaagaaacacgtttaaaaacatctttttggtagaaagatctttcattgcaacataaacatccaacatgacttttactagatcaataatttcaaaagtctaaggcataatcctgaagacttgacttttgaacatctgcacggaaatgtataattttaaaatctatctgtacttcctatgaattccaggaggtgcacgatcttcaattttatatcttactatccgtatttttgatttcttaggaaaaaaaaaatgattttgaatgaaggcccagtcaacattttggttggtataaccaattatgattatcggctacgcagtcttaatgtttcaacggcttatttatttgcccgacgtttcgacacgggaaatgagtcttcctcagggggtaaatagggggaaacgcacaattctcgtctcgaaacgtcgggcaaataaataagccgttgaaaaattaagactgcttagccgaaaagcataattgataacaaccatacagtcgattccccaccagctcatcaaaatggttggtataacttttgttatacatcattctatatgatccaattcaatcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgcactaaaacatatgatacaccatgctataaccacacaaagtattaggtaaagaaataatattgatgttttgatccgagaattaatgttgttgtagaaagaaaataatagagcataactttttcagatttaattcaacttcttaaaaatattaaacaaatttttcatatttagaaggaaagtttgtggacgaagatgtgtttgttccctttgtttagttgactgaccagtaatgacagtgtgatacatgctgtcaaattggttccgctttcttttgctgttccgctatcattgcgtttgagcctttacaattgctctttatcaccatggtaacatttcctgaatttgagcatattcatgatttaaaatcgtgtcaaaaagttggttgaaatatggcaatggttcaaaatgatccaaacgcttattcgtaaataaaatcatcgaaaaagtttacaaccaaatcaaagaagttaaaaattgttgaatttcaccgggaaaatctgaataaaaatcaatgagtctttaagttgatttagttatttgtaatttctaggaagatttttgaataagaatattaataaagtatggagttacgcccttttggaggtgtaaccattgaatacacaaatttttagtgtgttaattaggcgttataataccatcaagcacgttcaaatgtttgcaatggcacattgcacagacatgacgcaagtctttcacaaataactgattattcataggctcaagtgctataaggccaatttcattatgtacccaaaatagttattatataacaacattctggatagtttggcgaaacaatgtactcacaattcagattattttacatgcaattcatgttgcatagagggattccacggaggcatgcaagtcgattctgatcgaccatttcaaaaatatctgaaactttgcacagtttttcagttccatttaaatcgtcattttccgatatcaaatcttcaagttgagtcacgactaacttttcaaaagggtgtatgtgaaaatggttcaaaaatattcaaaaagctgcacagcaaaaacggttcgttcgattgttagacaactaaagaaacaaagttagacaactaaataaagattccaaaaaaaatacacacagtaaaaaaaacaaatttttttgtattaaaaaacataatttttgacacaaaaactcaaatatctcaaaaccctatcggaataccaacgtaattttttgagggaaaacggtccattatattagctatctaccataaaaatttggtgatggtaagccaataaacaaaaaagttatgacatttcaaatatttcacaaatttgacacttagtgaaatttttttttttttcattgttaatttttcttaggaccgcagtttgttgctgaattttttgttaagggtaccacatgaggttaacaagttgttttcatgatattttatttaattattcataactattatagcatctattaggaagttagacgcgatccagtgttgtgatctaaagtcttgatagtgtcatattttttattgtacgtaactgaagaaaaattctctcaatagtgttgaaaccttttgataaaaggaacatataagaaatctaatattgaagacaaaagctacaaaaaaagttttctatacaggtatacgactagtttacctgcaaaaagtttacctcgtagagaacaaggcgggtctatacccaggtgatctagtatacgtaaagcaggtcgggtttctcggcgctggttttctccacaaagttaaaatctgattacacctgggtatagacccgccttggtagagaatagactttgttaatcatatttgggagaaagcgagtaacttcaacaacatcaaaaacatgataggtacataccatgaacatactcacggaaaagctaaaaatatactaccactatggttataaaagatttaattgtaaaatttttcttcagtcaagcaaacgacaccaaactagtcagtaaaaacttaaaagtgattttgtttattaaaatctaacgagcaacatgagtagtcgctttctcaactgttgcaggccgtttgcagaaaaaaagtgttcgaaagagctacgaaatctcaccaaaagcaccatagataaactgaaagcggctggttatgctccaatgtctacattgaatacaaatttacgcatttgtacgtcctgccgtttaaatgttgacaaacgggcaatctgtacatcatcggtggatcaggttgcaggaagttcgaaaacaacaacaactgaggaattactagatgcaccgacaacaactgaggagttaccagaagtaccaagtgcagatagtcttgccacggtaccatcagcgacatctgtttcaacaaatcaatcagaagatgagtacatccagaaggtcaacatcgaacgcttcaacgaagggatagctggaataaaagtgactccgattaaatggacgaagatgggttacgtcaattatcccgagaaaaaataccgtgaaatcaacgaagctgtacgaagaaacctcttcaaattaggacctgaggatgtggaaaatacagactacgatgaggtaattatgaatatgaaggaaaggttctcgaatctagccacgacaaggaaagaaaaaattattgattttgtcgatggtgccaagctcgtggtctattcaagacgccattgatgagttcaaaaccaatagaaatacagcaaaagaggcaaaacaattcaaaaataactgtcttgcaaccaaaaatgctaggtcgagtacttcattaacagatgagacaaaagaaaaaataattcaatattttgaagacgatgaagtaagtagagctatgcctggccaaaaagattatgtatctgtaaaaaaaagatggaaagcgtcaagcaatccaaaaacgattaatgatgactactttgaaaaaagcgtatacacgcttcaaagaaattaacgaaaatattaaggtaggtttttcctcatttgcaagccttcgtccaaggcaatgcaagcttctatccaattcaggaacacataatgtttgtgtgtgcacaacacacgaaaatattaacctaatcttacatagtatgaaaagaatcaatttatcaaaggatattaaaatgttaactggtagtcttttgtgtgaaaatacaacatcaaattgctatctacgatcttgttcggattgtccagattcttcatcattggaaaatactttattcgctgagtttgaggaaaattatattgatcagttatcatttgagcaatgggtgaccacggataggtgtgacctagaaactattgtaaaacctgtagatgagtttgtgtcatttttttgcttgaaattagaaagtttaattcctcacgactttattaaaacagagcaatcccgctttttaaaaatacgaaaaatacattacaagatggtgaatttttagtcatttatgatttttctgaaaactatagctttgtattgcaaaatgaagtgcagtcccatcactggaacgtacaacaagctacaattcatccattcgttatttatttcaatggaagtacgcaaattgaacattttagttttattgtaatttccgaagatttaagacacgactcagtatctgtaaatttgttcattgccaaaatgattaactttttacgcgttgataaggataaagaaatcagaaagatatatttcatgtctgatggagcagcatcgcagtacaaaaaccgtaagaatttttcgagcctatgtcaatttaaatcaaagtacggaattgatgcagaatggcatttctttgctacgtcacatggcaaaggtcctgtgatgctattggaggaaccataaagcgcatggccacaagagcaagtttagccaaagaacgtgagcatccaattaaaactgcaaaagaactatttgattgggcgaatcgcagaaaagaagaagatttaacaaaattatcattttgttttactactactgaagagtacaaattaacggcatcagagctcagcgagcaatataataacgcgaaaacgatccaaggaacccaaaaatttcactgtttcattccattgtcagaaaataaattaaagcaaaactatactcgaactgtactgataatgatgcaaaagtgttcgatattgtaaaaaaaatgaataacaataaataaataaataaatagtattaataaaatgttttcatgatctcataacgcatacccaaatccaaaacttttaaagtttatatataacatttagaaactcatcgatcatactctaaacaaaaatatcctggtaaaaaaattttttttttcgtgtaatctgttaattcattttaatttatacatatatacatatacatataatatttatacatatacataatatttattcatataatatacataatactaatgaatacatgaaaacgacttgtttaattcacgcaaggcccttaacaataaaatcagcaacaaactgcggttcccgtaataattcacaccgaaaaaaaaatttttttttctactaaatgtgaaaattgtgacatgtttgaaatgtcataacttttttgtttattggtttaccatcaccaaatttttatggtagatagctaatgtaatggaccgttttccctcaaaaaattacgttggtattccgatagggttttgagatatttgagtttttgtgtcaaaaattatgttttttaatacaaaaaaaatttttttttactgtgtgtattttttttggaatctttatttagttgtctaactttgtttctttagttgtctaacaatcgaacgaaccgtttttgctgtgcagctttttgaatatttttgaatcattttcacatacacccttttgaaaagttagtcgtgactcaacttgaagatttgatatcggaaaataacgatttagatggaactggaaaactgtgcaaagtttcagcacaatagaaaaaaatgaattaaaaaatttaccaaattttggtgctgttgcttggaatcactcatatttaagtgcaagttgacgtcaaagaaagaataaaaaaaatggggcacatataactatgagttagaatcccaccaatcgaagatattttcgagacttgtcagggcttagggtatattcgtaactttcacacgatatacaaatgcagtctatcggcaaaataagttttcagtcaattactgtgcacagaacaaaaaatcgttcgcctatccgtgaacagcagtcatttttgacagttcacgttttccagaactctttgttgagcgtgttgaggtgctcaaatacaaaaaaataattgttagctgagttgtgtaactattttgtataagagccagttaattcccaaactatcaatgaaatgtttagctgatggtgtgcctatagcttactgagctaagaagctgactctgtcccagttaagatgtaatcccaagaagataaatatcatttcctctgattaaatatttcatcatctgatctgtggatgaaaaaaaaaacctttgccaccgtcgctcgacacctgatgcagtcataatcttattatctgaacttcctctgcgtcgaatcttttcatggaagccttccagaagcgaaaataacacctgttgacggatgcacccaaggttggatctttttgcaagaataatttgaaaattttcatctcaataaacgaactttgcatctgatccattctattgtcggtcgcaggtgttcgaataagcttccacaggagagttaactcccgcctgacatggtctaattgattatctgtcacttgtttggcaccgcatgcttcgatgtgctctgctcacacataatccgatcattgctgctgcctgacaagtgcctactttttgacaacgaaaatcccttcacttcgatacaacattctattcttggttgttccgagaagatggctaccgatgtaaggatggcaaacacgaattcttcgcttctttattgaattcttttgccgcaagcagcaataatttatcaaccagccaacgattaaaaaaaaaattcagagcacttgctccgtggcactccagaggagccttgcgagtatcggttggtatgctgctttatttactgacggcacggctcctcggaagaaggaagttctctctccacgatatttgagcagattcacgtcgtcacagcgcacacaaatgagccggcagggatgggggaaagcccttggatggcacagaataggaggaataaccgatgattcaattcgaataaagctgcggaggcccaccatccaaggaggtcatgacaaggccgaatggggagtgaaagtattttcggaagctttccattgaaagggttgcggtgtcaccaactgaagttgtttcgaggaaattcttcagaaaactacagcgatgttcacattagttaaattaacccttccagtaagactgttttccagacattattttcaaaatgtttgttctttaattgagaaaaacttgttggcagagccaaaccagcagcaagaagtgagaaaccaagggggtcccaccactttcctactgttacttaccaataccttttccgtgtcctctaggaccttccgggtgactctgctcggacttcacggttcggacgttgctacagaaaataagccaaaaagtaaactttgaataaatggccttccgccttctttattcaagtttacaagccgggttgccgaccgaaaactagttaaactgaacttgtcaagtgaccgaactaccctactctgctacattctactctagcgatgcctaacctaactgctgacactgttgccgtttttgttcttgctatttcatatgattttatttacatccatctgtcatctcttgtggagggccggctaccaaatgtatatgccctcctgtactttaactgtttacggctaacgttacctaatgataaattacatatttcaacacttccccttaatttatcattccacactgaggcaaaaaaacttaatagtttcttaaggaataattatgatttggcgccacaacgattattgttgaaatttgtaagttttacttatgattttggtgaagaatttcagtaatgaatttcataagtcaatcaatgaaattcggtaataaacgcaatgataataacccaaatcgatctatcaatcgataatgttgttcgccttttatttcaggcgtgcacaaaaattgacatgttttgataacatgtgatcagttttcaattaacttgtagccaacatcgaaagcggagtagttcttctagcgattgctatgataaatatttcaagtaattgttattaaagaattcaaagctctcgcttatgaaacttatgatcccattttcgaaatgtttaagcgtgcaatgaaaccataatttggatggttcataagtcttgatttatggaaaacctaagtatttttgcctcagtgcaagtaatttacacattttcaaaaatcttgatttcaaaagtggttttgtgaaaacatctgcaatctgatcttcacttttgatgtactttaattgaactttcttctcggaaatcaaatctctcatatacatgtaccgcacatcaatatgcttggttcgttgatgttctcttggctcctccgaaatcctgatgcatgggatgttgtcctcgtatatggtgaacggttgaaaaacgatcccgatctcctgcaacaggctggatatccaaactccttctctgacggcctcgcatagagaaaccaactccgcttccgttgacgacaatattacgatgttctgccgcttactcttccaggacacaatgttgccgaacaccacgaatgcgttcccagaattcgactttcgcctttcaacgtcgttcgcaaagtctgcgtccgcatatcccttgagtgcctcgtcattcttctctcggtagtagatcaaacgtcgtgttttagttccttggaggtagcgcaggattctcttcagtcctagccagtgttcctctcctggatcgctctggaactggctcagaatacttacggcaatggttatgtcgggtcttgaaatcaatgtcaagtattgtagacaacccaacaattccttaaatggtttatcagtaggcttgctcgatcgtacccatttggaattcggatccattggcgtagatatcggtctgcaatctttcatgccaaagacatctaataacttctcaatgtaggattgctgagacagttctagggtacctctttcaagatttctcgtgatttccaagcccaggaagcttttcacttcccctagatctttcatcttgaaatggtctgataacttcccagaggactcaatccgagagacagacaggatattgtaattcaggtccggaacattaagagtattatgcagtgtgacataataacctttatccgtcttcacattcacattacccattctctctgaacgcaggaactcaccaggcttggcagtctcgaccgttgccgacgcatcctacaaagcattgaacatggccatgtcgcggaacatgtgcctcgatgccccggagtccagcaaggttgctccgtcaaacagcgatggcatcggcaacttcgtcaagctcattttcatgatcttgcaatcacgcacgaaatccttcggtagatctaccagaggcatccgcaccctgaaggcaccgttgtttcgagtgaccattgccacgtctcgacgccgtccacccgagtggactgtgacttcggtttcttgcttacgacgagcagtacttcttcttgtggccacgcttgccacactcgaaacacgttacattccggtagaatggtttctgcttaagtgccggcggcctctggtcactgtcctgtggtgattgctgacgtcttgaatgctgcggggcgaacatagccacttgtgaaggacccgctgcacttctcttgcctttcgcctcctccgcgtccaagaaaactcgttggacctgctccatagacatcatctcaaggacgtctttacgtagaacggaaagagcaccaattaaatcctgaaattcatcgggaattgcaacgagcaaggtattcaatctttcggaaggtgataatacttcccccatgccttcaagttcccggcaatttgttgatgggcagcaaaaagttgcttcaaagtattgaatttttgtgacttcagcgaaaataatttcgcccgaagtccaatcatggccattggaccgtgctattgataaatctcatccaatcgctccataatttccttggcatagttacattgcataacatgccccatcggctcatcatccaaagcgagccaaagttcatttatagctgcatcctcttctttcagacgtgcttgcagcttacctttcctttcagtctcttcatcgactgaaacacccgcaaccggcttaaaataaacctcttcctcgggcgtttgctcgagggtatgcaacaaacctttatatttgaagtgttgatccattcgcttcttccaaaatgggaacgacttttcgtcccccttaaacactggaacaaccacccgtttgagtcggttctccatgtttgaaacctaaataaaaatttagcaggaagaaaacaaatcaaataaaagggccgtgaagtcttgtcagttgtctttgattgaagtgtgccccacagaaaatggtctccgtctgagcacaacttctctcaaactgtccctaagtttgccctcggaaaagaaggactccgactgagcaaacccctaaccaattgtcccacagaaaaaatggtctccgtctgaacaatggtaaagaactgcttaatctgagtctagtagtcctgggcccataacctgttggcagagccaaaccagcagcaggaagtgagaaaccaagggggtcccaccactttcctactgttacttaccaataccttttccgtgtcctctaggaccttccgggtgactctgctcggacttcatggttcggacgttgctacagaaaataagccaaaaagtaaacttcgaataaatggccttccgcctactttattcaagttcacaagccgagttgccgaccgaaaactagttgaactgaactggtcaagtgaccgaactaccctactctgctacattctactctagcgatgtctaacctaactgctgacactgttgccgtttttgttcttgctatttcatatgattttatttacatccatctgtcatctcttgtggagggccggctaccaaatgtatatgccctcctgtacttttactgtttacggctaacgttacctaatgataaattacatatttcaacaaaactctttttaatttctttttgcagatcctaccatataagtttcatagcttggatggcgagtgcgttgaaattggctcgaattttacttcacattttggtattgcaatgctccttgcttatacaatggaatttgttaaagtttcgagagcattgtcagtatcaagtatcgtttgcaaagaaatggtaacataaatattgctgtcgatgtatgtttcatatgtattccagtcgtctggcacttgaatgtggagctgatacgattgagaatcgcttcatgggatatttgaaatgtaacagggacatgatcagaatcgacatcagcataagtaacccgttggctacaaagtttgtctagatttgattgagaccaaatcaatcgtagaagggtttctagaagaggaaaaacaagccatacttcagggaattgaatttagaaacatcctgaagagcgctcatcaattttttttttttttgcagttggactcgctttacgaattattccatgagtgatgttttgcaataaagtcaccaatgacaaacaagtttaactcaagcgagtccatttttgcaagtaattttaaagcaaattatcttgccgccaaaacagccaaagttttaaaaactctcgaaaaaatggatgatgatagcaacttctccacataccccatcaagtcaatcattatgataaacaaaaaaagtttggatatctttttagtttggaaacctttgtggtgttcctgcctaaatccacaaaattcggatatactgaccacaattggcggcacgctttgcttcctctcttatattattgaaaaactatctattccgacccaccgtccaatttttcttctctaacaatactccatcattgaatatgtgtaattcaatttcctcccagtaacccatcatctttcgttcaggaagctacggctattactgctgtggcgcgcagcaccaagcaagaagatttccgccgaatgagcgctccgttttcggtagaatgctttcaagcagtgtcattgttggcaaacgcttcacatgctgctcgccccatctagtagtctgcagcgcgctgctgttcgaagagtgtggcggccatggttgttaccatggagcagcaacactgttccgttttcaaccataggtacctactacgatgcgaacagcgaggaggagcccttcattcttgaaccattttgatgcttcgattacttttcagcgcctgctttgggctcccgggaggaaatcgtcacacacaaagggaatccttgtcatgcaattttcgtctgcgtctgctgggatgcccgacgagaaccagtccgaaaggaggttgtggatgctgcccgttttcccgaggggtggtaaaaaaggatcaaatgaatagaggaacataattatgagttatgagctccagtggcagcacattaaagatgtgcgtagtgcggagtcgtgcggtgtccataaaatgggggatttgcatttagaatttaacgtctagcagcaggtcccactgtgggcagtttttgaatagtagggggtcaaaaatgaggtttgcaaattttactttaatttttccatttaatccaattgcttcttccccttgacattacgtcctcaatgggacagagcctgcttatcagtctagtgttgttatgaccacttccacacttattaactgagaactttctttgccaaagttgccatttttcgcattcgtatatcatgtggctggtacgattatattcttttcccagggaagtcaaggtaatctccatcacgatatgattctgcaccgaccgggaaatgaactcagacaccttcagcatggctttgctttgtactcgcggactcaaaccactcggccaaggaaggccctgactacaaattatcttgctctgatatttccggaatatcttattagaagtatttaccatggaatgaagggccaaaaacccctctcagaagaagtcattatttcgatttttggccacctgatcgcccatagtgggggttctgatggtccggggcatcagatgttgacgatttcgacgacggaatgcatccgatgctcggtgaaagctgcttaccatgatgatgatattgaggaggggtcgggcagtccgtttctcgttcgagtgctctttgtgtaaaattacagattaagggattttggtggcagctacattggcagagtagggcacccttccacccaacagaatccccataaagtatactttcgacgtgggacagggggaaaagtgataaaagtgatatgaattttaatgagcgagttgtagtgcgtgtacagttttaaataggtaattgtgggggatgtcaggataattactcgcaattatatggcttccaatgtgtgagcaaaagccagataaaaactgtgatggttaagttatggttcagtggtgaaggttcattttgaacataactttaaattgctcggcaatatttttcattgccaaagcttcaaaatggtatcaaaataagcaatcagtttgatgcttttgacaaattttccgagcaaaaaattgaaggagtcattagcctccttttcaacatatgtgaggaagcgaagagtatcgccaatcgtgatcagtatttatttttattaaaattttgaatatgattcagaagcttcctccttggtatagtacatagaatatccgatgtcaaaacattggaataaataactaccgaaaagccaaacattacatataattcgcaattggattagatggacaaattgatgtgaagttttgcgaaaaagtaacacgtcttctcagtgagaatcgaactcacgactccccgatctctagttggggcgcgttaccactacgccatgagaggactcatgaacgcagaagttaacctgaattcgatttcagctcaataatcacgtggtcctttttcgcaaagtgcacctttttcggaagaattagatgcccatccaaacacaacgctttctatatatatccaatgcctagcccgagagcgcattgttttttaggtataggaatagcacactacactagccagcaactgcgctgtctgaggtatctattgtgtgggcttccaatgggttgcgacgttctcaaacgaccggttacggaacatgagtccgttgcttgataaatacttgtttttatttttacgctctcgggctaggcattggatatatatagaaagcgtagtgtttggatgggcatctaactcgaattagtcgggaaagacaaacattttgtgttcagtcttctaattgctcgccataataatttttggaaaaatgaacaaactctcttcatgtgaaatcttcccgactacaactttgctgaaagccacattttaataagacgtaaggataatttgttatttttgataacaaagtctaaattatgctggaatgatcatttaattattttcagagcaccactgctgtagaacatagtagcctagattactatgatctattctactcgccagaagcaccactgttgcctgacgtacagttggtgaagcatgctacatgcaaacccactttatgattataaataacaatttatccttacgtctaatcataatttatttatttactagtggtcccggcaaacttcgtcttgccatcaagtaggctgttgaaaaacgcttttgatcgtcccacataaaatgacagtttcgttcgcgctcgtttttctcaactttcccagtgaatatcctgggatttttatacacacaaacacgtcggaacccttgacgaacaaagctgaggaagattcattcaaatccgttgacccgttcgtaagccatttcgtgacatacaaacactttttaatttttatttatatagatttatttatttcgtcaatcaattgtatagtctgttagcttaatactatgttgtgttatatctcagggaataaaaatattgcctaagcttcgttcgcgacatggtcaaattaatttctgtgtaatgctggttataaagatacatcatttgatttattgggccaaatttggcataattagttcgatgattgtttgatgcgaaaaaattccgattcctcaactgtctgacgggagtgtagaaattcaaactagataaaagattggtggaatcaatacgatgcgatacaatatcattgacaaatgaaatcatggctaattcgcgacgctcctttaaagtttggatgtcaataagcatgcatcgagcctcgtatgatggcagtggaaacattgtccagcctaattggcgtaaggcatataaaagaaattgcttctgtactgattcgattctatcctcatgtgttttcatatgtggggaccacataatactacaatattctaaaactgatcttacataagcaatgtacaaggttttaatcgtatatggatcccgaaaattggagctaaaacgcttaataaagcttaacattttggttgctttatggacaacagtattataatggtcagtaaatgtaagtttagaatctaatataacacttaaatatctaatcttatcgcacctttgaacatcttgattttctaaaaagacagtaatctgtggtgtattacgttttctgctatatgtgattagattacattttttgacgtttaatttaagtaagcttttactacaccatttatcaaatatacttatttcattcagataaatgtcgctctttttttgctattgatttccataaaaagtttcatatcgtcagcataaataagaattttaacatgttttagcacatatgaaatatcattaacaaacaatatgaataacaatgggcctaaatgtgaaccttggggaactcctgatgtagcatgaacaggtttagatatttttccctcaaatcttactatttgttggcgatctgttaaatatgattcaatccagttgaggagtctcattgcaattcccattttatttagcttgaaaatcaacctaggaatatctaatctgtcaaatgctttactaaagtcggtgtaaagtgattcgacgtggttacctctatccattgcatttaaagagtaatttacaaattccaaaaggttcgttgtagtagaacgacctttaaaaaaaccatgttgtacattcgttattctatgttttatttggctaaatacttttttatttatgattgattcaaatagttttggaatggatgaaataatagcaatttcacgataatttcgaatatcagattttttaccagaattgtaaatgggtataagaaatgacctttcccattcttttggaaatctgcccatttcaagtgacatgttgaacagccaaaataatggtgttgtaaattcattggctaagttttttagtaaagcaggtgggattccgtcaggccctgatcctttggtggaatctaaattcttcagtcctgttaaaatgtcctgtacctgtatttgactaccgccgacatcggttgtaaaatcaggaaaactcgaaattacggtcattatccgagaagtttgtataagtctcttggaaaaaatcagcaaagagattgcaaatgtcatcttgattatctgctactttattatccaatgtcattttagatggaaagtacatcttaattttaacataattgaagaaattcctagtacaagattttaaatcattttcaatttttgtgttgtactcttcaagtgcagtggatatggcttgattaagttggttaacaatatacaaataattttctaaactttcttgagttttttgtagtctgtaaattttacgagccttttgcttacgatgtttcatattttttatttgcttattaatccaaacaggattttttgacccattcctacgtcgtctccgcaagagtggaacttccatctgaataatttccgacaaaattgaataaaaacccgtaactgcatactctaaatcttcctgatttttcaaaacggactgccaatctattctattcaatttctgtttgattccgttataatttgcgtttttataatcaaagaaattctcaaagtcaaagtagtcggaattatgatgattatgaacaaagattgagtactcgatagctgtatgaaacgcttcatttttccatagtggagatagagattcgttcacacagaaatcttccattatgtttgagaataagaagtccaaatagcagttttgtcggtttttcacaagattgatttgatttaaacctaaaaatgcagctctttcaaaaataagttgtaaagattcgttttcgccaacaaccggcagcagaacattttcgttttcgcaatcacgaataaaatcagcattacgctgattaaagtcaccatagatatgcactttgaattctggagataactgcgacaaaatttcttcagcggtttgaaagaaaatttcatatgataatttgcaagcatgatctggcggaaaatacacagaagcaaatatatgtgttttaccggcgatatgtgcttttacccatacgtgttcaaactctttatgttttgatgaaacaattaattctgaattgaatttcgaagatattgcaattagaactcccccaccagacattatttgggtacggaccagatcgcgcttatctctaaatacattaaaatggttatcaaaaacttcttcactcttaattttttcgttccaactagtttcagtacccaaaacaaccgagaaggatgaagttactattcttttataaatttcgttcatttttgatgcactcctcatgcgattgaaattttggcaatataccaaaatttctgtagcttctgaaagaaacacacccctttgcacagcattacttgaaattccagatccttcattagacacatcgtcattatttaaaatattacctagaacaatttgttgaacatcatccactattggatcgtcatggtctacgtctggagactgcgtcaggttgagcgtaaacggctgagaagtcatcaggtcctggtgagtggtgtggtcttcggcaaagttgtagctgggaagatttcacacgagaagagtttgttcgctttttcatagatcatttggcgagcagttagaggactgaacacaaaaggattgtctttcccatagtaatttccaaatgaacttcaaacttggcgtgtgcacactctcatgatacattccgtttctacagttttctaaccgcgtgcgactcttttcgctgtgacgttgcaccatgctgtgagcttgactaccagacttttgagactgttatacacaaactcaatgcatactttttgcgcatgtgcaatgcaacgtgacatcagacttgtgtgcgacaccgcaacaagtctgcagacatgatgtttcatccaatcttttctgtgcaacatttggtggtttgtgtactagctggatattattggaaaagctcttctgtagaacagatacattaagcgagaaagcgtactattcttttttgctaaactggcccaagtgtactcttttccagatattacggacgacttccgaataaatctaataactttttgaaggtaatcgatattcgatatgtcatcaatgcagtcgtgcttcaaacaacattcgcatttgatgcctagcgattacagatgtgatatatccccgaggtcaagcttctcgacttccaatcttgaggatcctcgaaatgccgagaaatgaggaatgtcgtatttcctacgattttttacaatttagggtaactgggagtaaaacgcgccctctaaggaaggaagcgttttagctatgaagaacattattataagccttttttattcatcatctcatagacaaacatgttttctatcaaatagacgaaacagccatccattttcttttttctggagttaataaatcaatttttataaatcatgcttgcaaatacgttgcatacataaggacgtttgattagatgttattgatcgattatagtatacatgctgattcgaaaagtgtgcatttgtaaggttcaaatttggcacgtaagtacagattgaaataacgtttgctggaatttgaattcaaacggctgttttggtgttatgaaataggagtggccgttttgccccacgagttgattgaagtttaattctttctatacgctttttaagaataaattaaacactttttttgcgtggaatacgaactatgggagtgccaagtcgattctcggtgatactttcaaaagttttgttgtttatgccgcagcagtagaagaaataataatatcaacatcagctgcagcgcactccattgaccaactgccccaattaattaatgacttggtcgacaaaaatgccattctagcttccgatgtaaaatcgcacatcgaagaaatggcaaaaacattttcggcgacacatacacatacatgtgaaccaataatggcaaacaacttagccaatgaattgggggacatcatcaaaccctcccccagctggcgcatgctaggcaataaaaaagtatggaagcatgactggactgaatatgacgctaaacagcgttcacgtcgtacacaggaaaagaaggaaaagaaggccagacgaaggaggaaacaacgccaggaaatttacgccaggaatcaaaaccaccgaaacatcaacaacaacaataacaacaacaacagcaacaactacaactacaactacaacaacaacaacaatggcaataacaaaaacaacaacaacagaagcatcagtaacatcaacaacaatagcaatagcagaaataacagtaccatcagcaacatcaacgacaacaaccacaatatcgacaaaagtactactaacaacacagaaaccacttcaacgcacatgaattctgtgcgtggaaattcgtcattaccattggacaaagaacttttggcagcggcacgtgtacaattttctcagccgccaaagaaggacaatggaccgaaattcataaatttccaaaaaggggaaaccatcaacccttatcgccctgaaaaacctgccaggcttgaaaaccctccactttttgaccccatgcgtccacctatagtcagactcacggaagaatctgcagccggggaccaacgcttcctgaaagcacgtctacgggacccgaaaatcatggacatagtgcggacctatctttcattcttgcatgaccagaccccttcaacatgtattcgtgggcttaccaaaactagcgcatctttgacattagcagcagaaggactaccagcggacactaatcttttgcgcgaaattttcttggacgttcacgaagaactctgaatttcgcgaagcgacgccttagaagacttgaagtcgtaccgggcattcttatccagcgagcgcatacagcgactgcagcttaccagggagagtgctaataaattttactcagccggctcacaaaattttcgaaaataaagacgcattccttggaagcagacatcactgacgtctccacaacatccaccctacacacgctacctgacgcacatagtaatgtaagtattacaaataatccaaaaatttctttgtcttctcaacagaatgcgactgaaattctggtatattgccaaaatttcaatcgcatgaaaagctcagccaaaatgaaggaaattcatcaaaaacttttatcttcttctttcaatataattcttgaaaccgaaactagctgggacgaaagcgtaagaagcgaagaaatttttggaaacaattttaatgtatttcggcacgaccgaaatttgcaacactgtaataagaagtccggtggtggagttctcatagccattaatgcagactttacttctgaagaaattgaaactttcaaacacaaagaattcgaaaatgtttgggctaaagctctaattaatggagaaacgcatattttttcatccgtgtattttccacctgaacacgctaacaaacattcttttgaattattttttaaaattgtcgaaactattatttcaaatatggaacctgaagtaaaactgcatatttatggcgacttcaaccaacgcaatgccgacttcattacagacaatgaaaatgaatcacttttactcccagtcgtaggcgaagacagtactttacaatttttattcgacaaaacatcatattttggcctaaatcaaattaatcacgtaaaaaaccagcaaaattcttacttggacctcttatttacaaattgcactgaagatttctgtgtgtatacatcattatcacctctatggaaaaatgaagtatttcacacagcaattgaatattcaatcttcatacataaaacttctctccccagcgactgggagtacgaggaagtgccggaatacaataaagcaaattacaaagaagccaaacgtagactatgtacaatcaattggcaacatatcataagtattgatggaaatgtcgacaccgaagtagacaagttccattcaattattcaacaaataattaatgaaactgtgccaacaagaagaaaaagacgaatacaaaataacaaattaccggtgtggtttagcccacatctgaaaaacttagagaacaagaaacagaaagcgcataaattatacaaaaaagaaaatactgaaaccaacttacaaaattatcatgacacatgtaaccaactcaactcagccattaactccgcacatgaagaatataatcgtaaggtcgaatccgaagtcaaatcatgtcctaaaaacttttttaattatgtaaacacacaattaaaaagtagcaatttcccttcgcgaatgcattttgacggaaacgtaggtgaaaactcttccgatatctgcaacctctttgcagatttctttcaagaagtgtataccacctactctgaagaagaccgcgaccgcaatttcttttcttttttcccagaaatttctaatagtatatctattgaaaaactatcacaacaagaaatcttatcggcactaaaaaacctggacgcaactaagggagcaggaccggatggcattgcacccgtgttcttcaaaaatctctcagaagaacttacccttcccttagaacgccttttcaacatgtctctaaataatggaaaattcccagtagcttggaaatcctcatatttggtgcctgttttcaaatcaggtacaaaatctgacataaggaactatcgcggaattgccattatctcatgtattcccaaactcttcgaatctctcgtaaacgacaaaattttccagcaagtaaaaaaccaaattacttgtaggcagcatggcttttttaaaggccgctcaacatcttccaatctgctagaatttgtatcttttattctcaacacaatggacaatggcaagcacgtagaagccctctacactgacttcagtaaggcatttgaccgaatcgacataccattattaatcttcaaattgcagaaaataggaatggagccaggactcttgagttggatccagtcatatctatcacataggaaacaaattgtgcgctttcaaaataaattatcagcacccatttctgtaacctctggagtacctcaaggttctcatttaggcccacttctttttattttgtatgtaaacgacatttcctttttacttagaaaaataaaatttcttatatatgcagacgacatgaagctcttcatggaagtaagtaattctagcgaagcagaagaattccagaatgacattaacttattcttcacttggtgccaaaaaagtttacttcagctcaatatcaaaaaatgtaattcaatagcatttagtcgaaaatatgtaacaccaccaattgaagtatttttaggaaatcaagtagtgcagaagtgtaaaattgtaagggatttgggcgtaatcctagactctaaactcacttttgtagaacattataattccataataaacaaagcaaacagcatgcttggcttcattaagaggttcagcaacaattttcaagacccatatactattaaattattgtatactacatatgtaagaccaattctggaatactgtcacctagtatggaacccgtatcatgtcgtacacgaagaacgcatagaatcagtacagaagcaattccttttatacgcccttcggaaattgaattggactgtgctgccacttccgtcgtatgaagcacgctgcatgctcatcaacttggaaacacttaagcaacgccgggaattcgcaatgattctctttataaacaacattatttcgaaccgtgtagactccgctgcacttctttctcaactaaacttctacacaccctctcggcatttaagaacaagaaaattattttcagaaaaatcatgcagaacgcattatgctcaaaacggaccaataaaccgtatgatgcgtcagtataatgtacattgcgaattcattggcattactatgtccaaagagcagcttaaaacacaactaaagaacaatagaagtaatccatagcatgtaagaaagtattgtaattattgtatgtagtctacctatgcttgacgaaataaataaataaatatcggcctgaaaaatggcctagaaaataacacaaaattacaacgaaaacagcgaaaaaaatgttttgccaggaaaacacctaaaaatatatatagtgaagcattttaatacattttccattatctcgtgtgaaaaacagcacgtcgttcgttcaaaacaagggtggcgcgttttaccccaacggcgcattttacacccagttcccctactacaataatgttcagaaaagacaaaggaatgatactacggttcaatttttatggttaggaatttcgtagaacaaatactgtagagaaatgtatgttttacaggtactttgatggatagaaatcaattttatgatgtcaaaaccatctttaatcggcatagagtaaagtggggcaaaagttcgagtggggcaagagtttcttttaaagatttctagctcaaatcaaatcaaaacttagaaatgtcatggtggttcgaatgctattcaagtaagagactttcactccaaatatcataaaaatcgtttgagatttggaaaagttatggctctttgttgtttttcgacgtaaatattgtaatatttggtcaaactttcgatgcatggaaccaaataaagataaaatatttttcaatattttatgtaagggcgtttctaggcctatcataaggatacttttacgtgtattagtttttccataaatagttagtatcaaattttggcccatagcggggaaaagttcgaatctgcggggcaaaagttcgacccatgtataaacccacggaaaatttttcaaatttgctgtaatctacatattatcttcaaatttagcgaaatttgcctgatcgtgcgaaaaatgtcacaaaaattttacattttcacttagttttgcgaaaaactgctattttttgggtgtattacaattaaccctgttttgggcattttttgatgaaaatttagtgtgtatttttcggcaaacataagtttacggctggtataaagtatgcctggcataaaagtattgatattttgtgttttagccaacggacttttgccccacactagattcgaacttttgccccaccggtggtgcaaaagttcgtttaagacaatcaattttgaaactgttataactaaaaatgggtaaatattgtgacacaagtttgttcagcaaagttatagccaatatgttgaaggttcgctgtatggtatttgttttgtttcatctgctattattttcatggattctttgatcataccactaaggtcgaacttttgccccaccttactctacaatgttctcaaaagttgtaaagtacttataatacgttcaactagtggtatttattttgattttcgtttttccaaattctcgttagaattttttgaagataaaaaatagtcaaaaaaaaaaaaacacaaattcgacttgaggcacctcccaatcttctccaaattggatgaaaatttgtctggtagtttgttttagtattgcaattaggactagggggtgactggttgaatcttagacatttcgatttttgtgaaatggtctactcgacacgtctttgtcactcgatttttcgacagttatcactctatgagacaggattactataggcctctgcacggttatgattttgtatggaattttgacgtttactggccttgttgtttacaaatttcctgaaagagtgaaagagaggcaatgatttttgtgcagagccctatagttgtcgacgggtgacttccgaaatatgcatgcctactgcgctcgacagtgaatgcagacgagtcacatgaatctgcttgatttacaaaataggcccctaagattataagctctattctataaggcgaatcgatcaaaatgactcaagtggaccaaaatgactgtcgatcaaaaatttcgctcgactcagctctgtcactcgagtttattggcagttgtcactcgaagggactggattaatatgggagacgacgggtgggacaagtgacatctgaaatacacatgcttactttgatcgacagtgactacagacgtgtctgctcgatttacaaaatagacccccaaataccacaactaaacaccatcaataaacgactgattacgttttagatcctaaggcctaagttccatgaaatccttcaagcacccagaactttgcgtatgaatcagtattgttctacgtttacctatatgaaggatcaagattatataccataaacaaatactattacaagagcactggttacgctagtcctatgccctatattaaatggagttctctgagaaccaataatatcagtaaaaatcaatacaacactacggttacttatatgaagatttaggattttatgccaaagcaaaataccatcaatatataacagcttatactcgtagatcctaaagcctatattccgtggagtccttgaaggaccaagaagatgcatatgaatcagaacaatactacgtcagcttatatgaagggttaagattatatgccataactaaaaactattgctacagcactggctacacttgttgttcctaaggcctgttgtacatgtagtcctcgaagaaaattagtacagataagtacattgatcaatttacttaaataaagagttaaaattttatgccaaaacaaaatattatcaatttataactgcttgcatttgtagatactcaggcctatattccgtggagtcctaggaagaccaagaacatcgacacaactcaatgcaaacttcgtttactaatataaatagttaggagccttcgcaatattaaagaactatctattgctaattggtgctaattctaaggctcgatagtgattttgtaagaccaagaacatccgtacaaattaataccatataccgtttactcatatgaatggttaggggccattggagtatttgaaaactaaccttaaattacttactacggtcgtagatcttaaggcctatattcaaagagaccttggtggaccaaaaacatccgtacaagccaataaaataattcgatgccttaaatgaagatttattatcatgaaaaatgttgcttttcgtcacaaatctggaagatttaatatgggtttctgtgctagtgagagaggcagtagtaacggtttgaagaattatgaaacatcgccaaaaattgcgaaagctcgtttgttatacctgaacacgtcattgattctatttcatgtaaaaataatcttagaatgatgaaatcattgaatcaaaagagccgatcaagccaaaacatgctcttttatccgactttttggttgcttgggagtggtgtttgcaaacttctgttcccaagataatggtgtgcattaatttcccataaggttcactattataggaaggtaccaacgtgctaaacccttattcttgtttcataaaattttaatttacacgtatcttttattttcgtcattatcaaaaataatcgttgaatagttcgacattatgaatcacatactttttattattcgtctaccaaaattctcttttcatcacgggacaaaaatgcaacactggttttaagtaagagttcttactcaaagtatttttcctccataaccatggatcgcatcatcgaccacagggggctccaagatcactttccttcctcactaatcaacaattttcccgtggtgattgtggagatgcagaggtattctcggtctctagaagcaacaatcattatacgctaacattccttccccatccaagctgactataaggacatggctggtaccgttattgatcaataatatgagagctgcaaaaattttcgcttcgaaaataagtgaaaatggaactcttcttcatttggatcgaagtgcaattcttactagttcagattaaccacggagtagcagtcattgacatgtacattcagttcatgctatgctagttgctccaagatgctcttgagtgcatcgaaaggattaaaatagagaagaatcaacgaaaaagctctgacgattttggacacctaacacatatcatagagtcaaatatatcctacaaaacaaaaatgtatagtaaaatctggatccgcactcatctttgcatcctcaaaatgcttcatagtatgcgaatatagtaaaacttttgcctggttccgaaaaaataaagaccgaactcggaagcaacgcccaaaagtgctgtcttccgcctggctggcacacataaaacgttactgttatggctaacgatggtgtcaattttttacgcgttttgtaagaacaacagtcactggttgtatccgccctggtaggtacgccatcgccgcaagaaacaccagacacgaacattacacacctcttattcgcgcgttcgctcgtagctatatgtttgaacaagataaggcgaattgcacagatgaaatcataaagcttgttcgcacttgcctcgggtgggatgatgttttggggcgggagatttccaaaagtaattattcccgtgaggagtgtaaagcttggattgatacaattttatccttggtggtgatgagctttttgactagtgctgcttcagtagcgacaaatacgttggaatatttcttgtgaaagtattgcggttatatggtagggacgatgtaccaataggtgatcaactaagcacaaatatttgcataaaatcgtaaaacttgttaataatgtaaataacaaatagtttaaattaaattcaaaactattgataaattattggaaaacaaacaagcttggatgcaatggtacataaataagtagctccagaacatcatgtcctggaatattttgcaattattaatatcaaaacggccgtaaaaagccactagtgcgactataggggactgtcttctaagggagtacccaccttatgcataaactagaagcaactgaatttcagaatatacacactttacaccacaacattttttactcaaacaggagtttcacctcacctaacgaagaaggccaattttacatttgcatcctttatccttcggacgaccaccgtctgctactacacattctttgcaaacatggcaccaaactcgcttcaagaaaccccaaaaacacaagtccaatttatccaaaacggcacgacgagcgaaaccacatgcaacagagtgttctgcttccgctctctctctctctgtctcccccccatcgaagcaaccgcgcgcgggggagaaccaaatggtgagtcatacggacatttagcagaggagtggtgatcgactggacgtggacgcacagcacaaggcatactttgttgttgttccgtagttacctacccacccatccatgtaggtggcaatgagcgcggtgagtggcgcgcgaccatgtggtgaacggttttgcttggagtggaaaagatcctttttttttctttccggaaaattcacacccaaatagggagcgccatggcacgtgagtggataagagagagagagtgctcttgagactgcattcattggatcagaggttcgcaactggttttaaatttcgacgaagatcttcttctattttatggtgcctgtctctcagcttagtgttcttattagcacttccacagttattaactgagagctttctttgccaattgaccattttagcatgtgtatatcgtgtggccttagccgagtggagtccgtggctacaaagccaagccatgctgaaggtgtctgggtccgattcaaattctttttgtaatggaaattaccttaacttctctgggcataaagtatcatcgtatctgccacacgatatacaaatgcgaatcagatcttgattcaggattttttgaagaatatatgttatgtttacatattcgcaatgtaaaaatgatatcgtctattatcatttcgaaggtgaaaataattgattttgttagaaatttgaaggcaggaggaaaatgaaaaagcaatggaaagttgataaaacaattaaaattggttcacggttgtaatgttatataatttacgttcgaaatacaatgttatctgctagctacattcatcttatgatgtttcgtatttattaattatttgatatcattaataatttttttatctaaatagcatattttactgcttatatcgaatacgattgatccaaaagcgtggcatcgttaacccgtataggcctgagtgaaagcaaaaatacgaaaacccttaccactcagctaatacttaaaagattcaaataatatattgtcagtatgctggcccacatatctagtttctaaaagtggccagaggaactcgggaatactcatgtagccggagttattgcgatttgttaggtattaaaccgcttcaaatctctaaaagtatagatcgaacataatagttcactaatgtgcgttcccacaagcttgacacagatgtgaagatacaaattgtgcattttattatgaatttgaggcatcccgggaaaccaaaaatgatcaaatgcaagtgacataattattcaattaaatcgattatcagaaggtttacgctgatgcgtttttcttaaaactccttgatatagtggccacattatagccgattctggaaattatctgaaacttgaaatttgcatacctccaggggcacagaaacacaaaacccttgtcacccgacctgacccagtgatccaccgcaataactccggccacaggaacatttccgagattttttgaccactttgagaaactagatatgtgtacgagtatattgacaaaaataattgaaatccgttaagtattcgctgagtggtgagagttttaataatttttctttcactcaggcctatacgggctaagaaacatttgaacattttcgtgtaaacatttaaacaactttgttaactttcaaacctttttttagtttttaaatcattgattgaataagttttcatgaaagtaattctgacagacaactctttagtaaaaactgctttattgaaatattaaatgaattacttctatagcttttcaaggcaaggagttgtttatttatttggtcatgttctgcatgcaactttctcttgacaggagctttgaaaagggtacaagatgtttcttattttgtgaacggttcaaatcttgacatttcaaaacaactcgggcaatatgccacttccgtagcaatccataagcaatcgtcgtccggtaaaagtttttgtaataagtatcggtcgtaaaattttaatgcaaaacctgatttacgatatatttagaatttcttagattatttatacttctcaaagaacatacacactacatttcataaggggctgtccatttattacgtaagacatttttcggggattttaaacccccctccccccatggtaagattttttgtatgaaaataaaaaataatttgtatgacacgtaagaaatctcaggccccccctccccccataaaccctttcgtaattaatggaccgctcctaagtacgatgagaagttattcagaaggacaaggacgaaatctaactctgcaatgcatttaaatttctccacacatttgtgaaacaccagtttgatttaataccttgtcttatgcaattcctcttgatagctcttacatgatttcatagtcaaaatgtttaggatgaagttcattacaagaaaatatgtgaatttctgtggaagatctaaattgtccttaagaaattatctcccttcatacggtatctgtaataatcttataattcaagttttaatatttccatatgcgaattgaacaatagtggtgatttttggaataatcatgaacatcaacaagtgatccattccaagataaatttaatctcagaaatgtgaatataattctacgtcttacatgttttccagaaatcagtttgttaaaatagaacacagtaaaccagggctggtagcaggtctatttttagaaatttggtctttattttaaagcaactctcttaaaagtctatatttttaatgaaagatctctgaagccaatattttctttctcctagcagtgaattatgattggaaataactaattttgaggtgccgtgactccttcgggtatggccatgtagacgtcttcttcaagctcagcgtacaggaatgcggtctttacatcgagttggtgaacgtgcatccttcggtgggtagctaccgcaaaaacagttcgtatcgtgggcaaattcgctactgggaaatacgtttcgttgtagttgactccgggcttctgcgcgccttgtaatgaactgggtcgccatggtttgattcggaagatccatttcgacttgaacgaaaccacaccagcaggacatcttaccagttgccaaagatgggtgtccgctagcgactgcagttcctcaccgaccgtttgttgccaaagggcaacatcggctcgtccagcgatcaggctttcaggctcatcgaagatcaaacgctcggcctcatcttgtcccacggaaccgtcgaatggcacatcaggaacgttctgcttgaggccagaccacatttccgctgtagtcttccagccagataccgcgttagttggattcctgctcgttaggtatatcgccgctatgattcttcgaaactttggcttcaatcagcatcgcacgcacctgttagatgattgtacgattgaaccattcggacaccccattttgcagtggtgtgtacgctgcggttggctcgatttggatgcccttggaaacatagaaattccgttgatccttggagcaatactcgcgcctttgttagacagtcaacttagaaattgaatgttccagagcagcactagccatggcttcgtattcttggaacttctggaacacctcggacttcttcttgatggaatatgctactgcaaagtgcgttcatttatttagttaacatctacacagacaacactgaatcaacaatttcacgccacaatactcggttcgtggccgcatctctccatcctcggttctgccccacgcgaataccatctttgcagggttgctgtccggcattcttgcaacatgccctgcccatcgtatgcttccagctttggccaccttctggatactgagttcgccgtagagttgggcaagctcgtggttcatccttcgccgccacacatcgttcttctgcacaccgtcgagatcgtcctaagcacccgacgttcaaagactccaagtgcttgcaggtcctccttgagcatcgtccacgtttcatgcccgtagagaactactggccttatgagcgttttgtacatggtacatttggtgtgggcgtgaatcttttttgaccgtaacttcttctggaggccatagtaggcccgaattccactgatccgtatttcacggctaacgttattgtcagccgtcagcaaggatccaaagtagacgaactcgtcgaccacctcgaacgtatcaccgtctatcgtaacactgttacctaggcaagccctgtcgcgctcggccccaccagctagcatgtattttgtcttggccgcattcaccaccagtccagcttttgctgcctcacgtttcaggcgggtgtacaggtctgccaacttttcaaatgttcggccgacgatgttcatatcatccgcgaagcaaacaaattgactggatctcgtaaaaatcgtaccccggctctccgcataacaccttctagtgcaatattgaacaacgggcagtcgtagtcaccggtgggatccaaacgaactggagtgttcgcctgaaaccttcacacaattttgcacaccttctatcgtcgctcttatcagtctcgtgagcttcccgggaaaactgttctcgtccatgattttccatagctctacgcggtcgatactgtcgtatgccgccttgaaatcgatgaaaaggtgatgcgttgggacctggtattcacgacatttttggaggatttgccgtacagtaaagatctggtccgttgtcgatcggccgtcaacgaagcctgcttgataacttcccacgaactcgtttactacaggtgacagacgacggaagatgatctgggataatactttgtaggccgcatttagaatggtgatcgctcgaaagttctcacaatctaacttgtcgcctttcttgtagatggggcagattaccccttccttccactcctccggtagctgttctgtttccggccagcctttccggacccatctttatgagttcagctccgataccatccttaccagcagctttattgttcttgagttggtgaatgacatcctttacctccctcaaagtgggggctggttggtttccatcttccgcagtactgacgaaggcatttcctccgttgtcccgtccttcattgcctgtgttctcagcaccatgcaggtcacggtgtgtttcgtagaacaagtttattacaaaaaaataggtaagtctaaaacttctccacaataaagtctaggtttctcgcgttcatttgctgctaaaaccaaaataatcggtcggggggtccagagtatttttttttgtttgatttcgagagacttgcacatatgtttgaatttgcctatttatgtgtttatgtacattagggcggttcaaaattaaaacatgtttgataatttaatctcacatatgttccctactatccttactataaaaacagtgttctgtgaaattcgcagcattctaggtggtgatttaaggtggccaattaagtttatatggaaattactatgaagaaattttgaggtatgttccaaacacgcttgtactgtaatgtaagtacaaacttattatcccattaaaaaagctcattcttgaaaccattataaagaaatttgctgaagagagaaaggcggcatccacaaattacgtaacgctgtagggggagggggggagtaggctcgagcgttacgactcatacaaaaatttgaaaattttcatacaaaaagcgttacggagtgggggggggatttccaattttagcgttacgtaataaatggacgccaccaaattcaattcgacagatagctagcagaagagatattcatgagtttgtttgctattattaagcttaaccccactaccggcagcttaattttttcagcataaaaatatatttgaatcgcgataacttttttgtttttctatattttcccaccattttttcacaacttttcaaaaaactcttccacttttggaatccatgtcggtattgaccattggtcaactagttttaaaaatacgtcggtgttccttgggggaccgacacttcccatataaaatttcaatatgatgttttaagaagttttcaagatctcgttacggctagagtggtaccaaagacataaaagctcattgtcaaaaacagttacaacgatttgtttaatttcttcacaatagactttcatcaaagtttagttttgaaaagcgaataaccgaatatgagaaaaaaactgtagccagagataattacgagagctatggctatgcgtcggtcccccaaagaattttggaatatctccgaatatagatgaccaatgctcaaaaccgatatagattctgaaaataagagagttttttgagaagttgtggatttttttttcaaaaatattgagaaacaaaaaaattatcgcgatttgaatattttgaaaaaatgaagctgccggtagaggggttaatatggggttatagtactgcaaacaagtacaaaaatcccaaacactttttagccccatgatgttagtttctgatcttttcataagcactgtgccataaagaaaataacataaaaaatataagatttgaaacttctcaaataccattcaaattagcgtatttttcagcaccatggggcaagtatattacatgccttataacaaggtttattacatgccctctactagttaattcaaataactgaaattgtgttgtttgaaaggcgaataagtcacttttgtaacgagtgaaaagagaaatctcgcataatttatgatctcgtcctaaaagccatagcttgttattactgagcaaacgaatagatttacactttatttcacaatgctacgacgaagagaagatcctcctctgtctcccagcggtgacagtttttattttggtccgtttatctgcttaataacaacgagctacacactcggttatcaatggttttaagggtgaatatacatagaagccaaacctcaaattttcaaaagcacaagtctagagaagcagacaaccggtaactcactggttactcgctggtggcgactaatcaataaaatgttcaacgcaaaaggttgtcaggttctcaagatacaaatctacaaacaagctcttgaaaatttgaggtttgatatcgatgcatcttcacctattgaaaatatttcctaataaattcttacatcattatgaccaatttaagtacgattttcaaggtttttcgtaaacaataactaaaatgacgtttgagacagttttgcaattatgcgtatatcatatgtcatatatgcttattacagctcttttgagcaagaacaactttaccttccaagccaaggttttcaaatggtttgatcttgcagtttgtcccgtatctatgttcaatgcaatgtgtgtcggtaaaaaaacacatatccatgaatacttcacacaaaataaaaaaaaatgttctggaccccccgaccgattattttgattttggtcgcaaattaaagagcaaagtctaattgtttttagtttgaaatttcagacttacctatttttttgtaataaagttactccacaaagacaccgtgaggtgctcgccgaagtgctgcttccacctttcgattacctcacgctcgtccgtcagaatgctctcatccttatccctgcacatttcggctcgcggcacgaagccgttgcgggatgcgttgagcttctgatagaacctacgcgtttcctcagaccggcacagctgttccatctcctcgcactccgtctcctccaggtggcgttttttctcccgaaagaggcgggtctgctgttgccgtttccgttcatagcgttccacgttctgccgggtcccttgctgcagcatgaccgcccacgctgcattcttctccttcaaaacctcctggcactcctcgtcgaaccaatcgttccgtcgactccgtcccacgtacacgacgttgctctcagctgcatcgttgatggctgcttttactgttctccagcagtcctcaagaggggcttcgtccagctcaccctcttccggtaatgcagcctcgagttgctgcgcgtatgccgctgcgacatccggttgcttgagccgctctaggtcataccgtacgttgttaacgacggagagttttgggtgcagtttcaccatcaccagatagtggtcagagtcgatgttagcgccacgataggtcctgacgtcgataatgtcggagaagtgccgaccatcaatcagaacgtggtcgatttgcgattctgtctgctgtggtgatctccaggtgtatcggtatggaaggctgtgctggaagtaggtgctacgaatggccatattcttggaggcagcaaaatcaattagtcgtaagtcgttttcgttcgtcagccggtgggcgctgaagtttccaatcgtcggtctgaattcctcctcctggccaacctgagcgtttagatctcctatgatgatttcgacgtcgtggcttgggcagctgtcgtactcgcgttcgagctgcgcgtaaaaagcgtctttatcatcatcagtgcttccggagtgagggctgtgcacgtttattatgctgaagttgaagaaccggcctttgatcctcaacttgcacattctctcattgatcggccaccacccgatcacgcgcctctgcatatcacccatcactataaaagctgttcccagctcatgtgtattgccgcagctctggtagatggtatggttaactctaaacattcgcaccattgatcccttccaacacacttcctgcaacgctacgatgccgaatccgcggtccttcagcacgtcggcgagtatgcgtgtgctcccgatgaagttaagagatttacagttccacgtaccgagcttccaatcgctagtccctttacgtcgctgtggtcttcgccgattgtcccggttcgtattctctcgttgattattcgttgcttgatttttttacggctggcttgcagggcctgacaccaaccccctagatttccggaggaccattccccctaaatgttcggaggaccatagtgcgcagtttagcttagagtccttctctggcactcggacgatgatcagccgcccctgacatggggaacagacgctgttgtgagccgctcctaacatggagtacagacgctcaaggtttgcagaagcaaaagcaaaagcaaacccccccttccctgtcagcatacgaccaaagttccgaccgggggttggttacccgatcttccctaaggttactcgtaccccggccagtaccacgaggaggtagggataggagttgctgggcaagaggcttaagaccacacaaagggaaggggtctattttattccttcaggtacgcgaggtaccaatggtacgccatgcccagccatttaccatgcaaagtgcgtgtactcatcaataaatatgatgaactaccgagaaccaccccaagccactggtgtgattggaccgcacacataggagttcactcgatctagaggtcttgcagcacggactctccggactttccgaaaacacaaatatcgcaaaaatccattttacatggctccttgggattacctataaccatgtcatgcttaacgagtgtctgaaaatccttgctccccaaaagggccaaacgacgattccacagataaccattcacagctctgttgacatgttgaccgccacagtatcgacgcggagatcgagctcgttaaagtctccccgcataggacaacttgtaatcaggtcacaaccgtgcttaaggatggcttcctttttcacgaatgttacatccagatccgtttttgccatctttttcacagatagcaggttcgctcgaagatcaggtacgaaaaggacatccttcaggctggcatagttagctgccttgttgacacctctgatcatgcctcttcttcttcaacttcttcttcttggcacttacatcctcactggaacagagcctgcttctcagcttagtgttcttatgagcacttccacagttattaactgagagctttctttgccaaattgccatttttgcattcgtatatcgtgtggcaggtacgatgatactctatacccagggaagacaaggaagtttccattacgaaaagatcctggaccgaccgggaatcgaacccagacaccttcagcatggctttgctttgtaaccgcggactttaaccactcggataaggaaggctgcctcggtgccaggaaatcagggattgatcgtccttcgccacgttgatgacgacaggatgcttcagtttcgtgaggtcagcgaaatagtgcttgacattgagcaattccaccgaacatgacgaattttttttttaatttaatttttgtattttttgaatcgcctgcaaattggcatacagattctttatgaccaaaaatgccatttttcaccttcagaccgccgttttgaacctcgccttatttttgagaagggcgtatcggaaaatgcatagcaaatctttaaaaaactgtaactcgaaaacggtttgtccgatcgatttgagatcttctacaaagttgtaggtattgcttaggactatatggagaaaaatatgcacggtaaaaaaatttacagattttttatttcaaaaatatattttaaaatcaattttctccagaaacgcagttttgattttttttttatttttggatatgttttaggggacaacttatgtgatttattgcacaatgtttcaaaatggaagaattatgaacaaaaaagttatgattttttaaaaaattacagatttaaaaataaaatcgaaatagaggaaaacaatatttttttatgtgattatttgaaagtacagaaaaattgcaatcgaaaagtacttaagtaatttttttctaggttgcatcaatttcgagatatactcatatttatataaaattttcaaataaaaaaagtaaaataggcccttttcaaacatatttcgtgtttctccattccagacatattttattttgattgagtgaatcgtagctgaactgtttattatttgatcaaaacctatatactaaagtatttaaaaaagtatgcacggtaaaaaaatataaacgaaattttcaaatgaaaatttgaagttcattgttcttaaaaaccgcaaaattgatgtttttaatttttggatatgttttgcagcatattgtttgtaatttcttgcacaatgcctcaaaacggaaaatttttggataaaaaatataaataatttattttaaaacgaattgaatttatgtaaaacaatatttttggtgcgttttttttgagtacagaaaaataactatatatttttaaatatgaaaaatttatattattaaatatgaaaaatttagctgagatggatcacttccgagatatacacggtaaatctaaacgtggcattaaaaatgtgattctatcacaacggggtacctttggtccccagggctaagcccggctaatgggtaaagccctctcatcgcggcaaaatcgtacaaccatggagaaggagtttgttgttttttttttgttttgtctgtcaatttcatcaattgtatttaacttgaatatttttcttcttattttttattaacttcttcatattttcgcttaacataatttattgaattcatttttttacgatcaattgaaaatgttaaaatactggaaatttattcgttaaaaatttcaatatttacactttgtgaacatttacctaattcagaatcagtcgtattgaccgaggtcattgacggtacagttaccaaagactcctgacttgaaacattcatttcagtatcagaagttacatgttcatcactgctcgatgattcatcgctactagatagttgagtacaattagacagttttaaacgacaagaatcacaaattttaagcttactatttaatttattctgttcagcaattcccaacaaaatcaatttctgaatattatcttccgtaagatttcgacaatgtttagaacaactttgtttgaacactttaatacatcttgaactgatataactcattgcgaaaaaatgatatttgtacagcttcacgcacaacaaaaataaatacctctgtaaaacgcctccttaatccacaatataatgctgtatcttctttcgtagcacgtcaatttcacaggcaaataaacgccacctacaattactgggggcccagatagccgtagtggtaaacgcgcagctattgagcaagaccaagctgagggtcgtgggttcgaatcccaccggtcgaggatcttttcgtaaaggaaattttctcgacttcccagggcatagagtatcttcgtacctgccacacgatatacacatgcataaatggtcatttggcacagatagctctcagttaataactgtggaagtgctcataagaacactaagctgagaagcaggctctgtcccagttgggacgtaatgccagaaagaagaagaacaattactgaacaatcactgttgatacaacactaatgctctcacggtttcagacttaccttatatactacataggtacttcacaccacgaagtttttgtaccgtatttttttcaatgatggtttttaacagtgataaaacttgacaacatagcgcattatttttgtacccatgaagtacgtttaaaaaaagcatcgtttttcttttattcattaaccatgtccaaatgtatgggtatgggaaaacgtgtttggtcatcatacctactaacacaggcaaaagtgatgaaaacccttgtgaagcctgtttagtagaatgcctgtaaatatacaaatatatgagtagtactgttccttttaattctactattgtatccttcgacagatacgcatatttcaacctcaactgtaaagccgtcttcagtgttgtgtacttgacttgacttggtttatgttgttgaaatcaaaataaaattttccggaatggagaaacacaaaatatgtttgaaaaggggctatttttctttttttatttgaaaaatttatataagtatgagtatatctcgaaattgatgcaacctagaaaaattttacttaagtactcttccaatgcattttctgtactatcaaataaacacataaaaaatattattttcctttatttattttttttttcaaaatttgtcatatttaataaaattaaaacttttttgtccaaaattcttccattatgaaacattgtgcaataaatcacataagttgtcccctaaaacatgttcaaaaataataaaaatcacagatccattttcatagaaaatcgattttaattttttttattcaaaaaatctgtcattattttttaccgtgcatatttttttccaaatagtcctaaacaatacctacaacaaccgcaaaatatatccaaaaattaaaaacatcaatgttgtggtttttaagaactattagcttcaaattttcatttgaaaatatcgtttatattttttaccgtgcactcttttttcaatacttaagctgtgttttgatcaaacgataaatgatttagctacgattcgctcaatcaacataatttttttgtggaatggagaaacacgaaatatgcttgaaaagggcctacttttctttttttatttgaaaattttatataaatatgagtatatctcgaaattgatgcaacctagaaaaaaattacttaagtacttttcgattgcaatttttctgtactttcaaataatcacataacaaattattgttatcctctatttcgatttttttttcaaaatccgtaatattttaaaaaattataacttttttgtccataattcttccattttgaaacattgtgtaataaatcacataagttgtccccaaaaacatatccaaaaataaaaaaaatccaaaccgcgtttctggaaaaaatcgattttaaaatatatattttgaaataaaaaataatctgtaacttatttttaccgtgcatatttttctccatatagtcctaagcaatacctacaactttgtagaagatttcaaatcgatcggacaaaccgttttcgagtaacagttttttaaagatttgccatgcattttccgatacgcccttctcaaaaataaggcgaggttcaaaatggcggtctgaaagtgcataatggcatttttggtcataaaaaatctgtatgcaaattttcaggcgattcaaatattacaaaaataatcgggtttgcgaaacggcgtggaaccgctccattacaaggtggttcactaacggatggaacagctcgggaatagtagcaaacaactgtgacacaatttcgttttcttcaagcttcactccagatagcttcagttaccggatcagctcttcgaaggatttcaggtgatctataacgaacgaaccttccatcatccactgcttcgcaagtagcttcctgaccagtgttgatagactcacactcaaaatctcaatcaatacgctctcccgtgaaagcaaactcattagggatctgcttcgcaaatctcactcttgagattttgatgcaaaatcaactcaatcaactcaaaccgtaaaaaatgattcagttgcaaaacccggcaaaaactcgtgaaacctgaatgttgttgtttacgttagaaaggattactataattttaccagactaacaagaaattattgtcgtgcgtgagtaaagtgtggaaatacgagacaatgagtcaaaaaggtgagccaactcatccatgattttttgactgctgagttgcatgattgacaactcacgcatgaaaaatctcaagcgtgatttgtaagaaattgagtttttcacaacgctgttcctgaggaacgtttgcgacgagacggaatttggttttagaaatatctcctaaatttttcaagaactttcttaatagattattaaaaaatatccttgataattttctggaaatcttccggcataaattcattgaaagcttttcttggataatctcctaaggaatttcttgagaactttttgaagaaaacttcggaggaagctcttaaatgatttctaaagggacaccactgtttgaaatcttaaagaattcgataatcctaagaaatcaatagaggcatctctggagaaattaatgcttgagcaattgaatatgttctaatttcaatcaaaatcacaactattgtaaaaagtaccacaacgttacagcccaaaagttaaatagcacccacaattacctacttgaataccagaataatctggatagattcttattttttttttaaatcaatatgatcaatgattaagactaagaatctgttgagaatgtaataagcagtttgagaaccactgaacccaacagggagaagaacgagaacgcattcgctcccgcccgacagcgatgtgagagtgagttccactccctctggaggggctggccgtggtttactgtaacaactagaagtcagacatgtcactcgacttttggcgaaaggatcgctgctttttcggggcggcatatttgcacatcctttgaagcatcatcagtggaaggttcagttcggtggtaaaccatcctcgagggtggtaattgtggtggtgccagagggcggcgggaggattcctttcatcacacacaattcggagaacaattaaaagtgacgacaatgggtgactcctgtgggtggatgaatggagcaacaatcgggatagtgaatgcattctctgccgaaggtgggatgcagtgatgcagaatcaagcgaatggaccaaatcaagtgctttacttcctgctcgggcggaatcgatttccagcgagccattatactggaaaagggagagataatttattgtgttgagtggagttttgtgccgcttttcttcgtcagtgggtgcagataaggaaaactcgacagaactaagttttgcgagcgtgtcaaatgttggctgtgtgatgatttgttatatccattagtgcttgccgttggtgctttatgtgtctctggagtagtttttattgggccttataatttatatacgaactagtgtaattgagtgtcgttaccccgttcgaaatttgccttaaatgttatgccaaagaagaagcttctcaacgtgtctagcatacgccaaagagggatttaaagtgcgataggtggaaatcctccgaagacagcaaagaaacgaaaagaacatcgtgcgagcgtggaaatatcctcccctgactcaactttactcaccggaagcagggtggaacgcgaaccgaatcgagttaaagttttattgttttggttgttttcgacggaaaattcaactcccccttcttcggaaaacataaggatgaatcaaacgaaaaagtgagccaccgaaagcaatcgccgtgggaagaaaataacaatatcaataaaaacggcttttatctctttctgaagaaacatttcgggggctatcgcggtggtgtttcgccaaaaacagtccatacgcgcgaatcgcatctccagaacacgaaaaatataaaaacacactgaatgaatcaggcgaacatccctcctcatccgactcacaactgatataaaatcgatcgctcgctgctcgtattcaacatcggcgaggtggtggtggtgatagtgattggctgcgaaaaggatacgtcatcatcgtagttggccgaggagcaaaaaaaaaattgcacatcgtaggagtccagttcgccgctgtgagttgcatggatatacgtataaaaacccggtgcggggtaaatggctttcagcgtgtttgattaaattgtgcacggcgcacttttctcgccacgttttccctttttcgtcatgttctgtagggagcatatgtagctacgtaatatggaaagctgtctatcctagcgctaggacagcgagcatgcagccaaccaaccaacaacaatgatcctttcgggttgggagtggttgcgctgcagcaaaattgtgatagcctgcgttgtagtggtgaagcgaagtgcattcgaaagccgtgtgtacaatttccggcgaggggtcaggtcggttagttggcttgtgtgggtgtggtgcgaggatacagcgaacgttgaacaggtgtttcgaagggggtttccgcttcgaaaggatatgtaggtatattgacaactaataagattcaacgagttctcagtagtaggatggatagggtttggataggaaggacaatggcgacaggcatatgtgtttgcgggtcacttggctagattggttgttcaatgtttattcataatgggatggtaaacgacgtcatcatgcaatgttggcggcgattgcttgtttagattatgtattcgactttccgtatcataaaatgggcatctaatgattatcggggaaatatatatgacagcaatttgatgtctatatttattaattaatttttcaatggttgttccaacaaatattagcaaaatgtaccgttttgaacttaagttcgtaagaggcgacagtcggtctagcagctctccatcaactgcgaaaattcacactgaaaagaatttggtcttcatagataagtcttcttttgtgtttttaaatagagggagagagagttttgattatcaacaaagctatttagaacaattcacacaaaatagggctcttcttaatccatatttattatttatggcattgcattccaactggaacagaacctaattatcagtttattgttttaagagaaattccacagttataaactaagagctttcgttgcgctccgttcactacacaacataataatgtcatgaaatatgaaatgcgcccctatgattcatgaattgacatttttttcgcccaccttccttaattaacttttatcatataattgaaattgcgcccttttaaatctgtatttatgaccttttattttatatcgtacacaaaattgcgcctctttgatcctggaattaaaacaagtttttttgtctacctcttcatttaatcatttaatacaactaaagtggcgcccatataattcagaaattattgcaatttttcgcccaattctctattgggttataccatgcaatgaaaattgcgctaccatgcttcagaaataaaacccttattgaaaattatcgtgtgatgaatattacgcccctgtgattaaaaaagcatgaaaatcgcaagcttcaaggactccagtagcgtagttaggggggtgcggtgatgcggttcgcaccgggccccgagctcttagaggccccaaaatcgcagtgtggataatgacataatttgcaggaaactggcaattggttaaatcccaaaaataaaatgagcatggcaagcatacattttggaggtgactttgatccgtgatgtacaggggcctcttgattattctttattttcaatacctagggctaagtttaaaatgggtcgagaggcccagggaaatatttacttcatgaatgttgataaccaatcgaatgtacgcaagattgtaggtctccacaaatctggaacataagttagctttgagctttcttacgatacgatacaagttacctaattttagaaattttaattttatttttttcttttgaacagtgaccgaaaaagtaatttactctctaaatgtttttaggttgtttgagttgggattgttgtttaattaaatttgaaaacgttaataccctgatagggtaaagtagaatcatgtttcttctcccccgtgatgacatgaaagaaaaataatatttgtatcagccttacctcaaaatcaatcctttagcgataacaactggtatttcttcagcgtttctgccataaagcaaaccaatgatttgttgaaattgttttaggaagtattttgatgattcatcgatgggttttactaaataatccccaatgactcctgcgtggaatttattgtacatcgaaattccttcaggtattgtgtttaagtcttccaaaactacctgccaaaaatcatttaaatttattatccggtgaccttaaataattcatcagaatatttgtttacaaatttctcttggtaatatatatgaaactatgtcatggattttacattttttttttcattgaacttatccagagattactccaatacttcgttgaaaaaatgagaaaagacttccaagaatttgtttaaaaactctttcagggatttttgcagaaatttcaacagggtttcttcagaatcaacattagaaacaaaaccaggaaactttttctagcgcttccatgtacagaatattctgagtgatactaccaggaaattgaagaaagaattgcttcgggcgtaaaaccactataataaagctattaataatctttttatccctacgtcaattcattaagggatatttagagaaattgcggcatagatttaaaaaatgtctaaacggatttttttaaggattcttcaagaattcctacaggaattattcatgcaaattatatcaaggtttcattaataaattccactggagagacctctgagcatttttcgctggaaagcaccgaagggatttcttggcgtacccttggccaagaaatttcgtggttttcccaagtataactttactaatagctccaaaaattcttccaccaattatattatttatttcaaatataccccttaagatttatcgatgattttttctgatattttgcgaaaattcctcaaatgatttgaaatccttttcgatttgtcctgcatttttttttcagagagctttacttttttttctggcgttacgttccaactgggacaaagtctgcttctcagattagtgttctaatgagcacttccacagttattaactgagagctttctatgctaattgacaatttttgcatgtgtatatcgtgtggcaggtacgaagatactctatgcccaaggaagtcgagaaaatttccaacccgaaaatatcctcaaccggtgggattcgaacccacgaccctcagcttggtcttgctgaatagctgcgcgtttaccgctacggctatctgggccccttagtagagctttacttagatttgtctattactacaaggagttcttaaagtaatttccccagaaaattttaaaatatctaccagttattttttcaagatttcatctaaatattcttgaaaaatgtagtccaagacttcttttcttctcaaaaaaaatctaagaatttaagggttttccagttttatgaaaaaaaaacttacttcagtagaacctctaaatgttttttttattttcaaagtgtattccaaaattatcatttaggatacctctacgctcgattttcctcagaaaataacataaatacatacaataacatcaaacattttatcttgattgcctcttagacatttttcagtgatttgcgcaatattagaatctctgaaatttgtccagcgatttcacttactattttcttaagaattttttccaagatttttatcgcgaatcttcagagttactgaaccttctggaaaaattacttcatatatattattttgagtcctgaagacatagtatcaaaaactactacctggcggaaattccaactcatatgggtgaatttataccgggagaatatttattgatatcctaatcatgaaattttcttacaaatgttcaacgttttcggaaaaaaaattgaaggtgtgagttatgaaagccatattttgcaaacccctatttgaggggccccgaaatccacctccgcaccgggccctaaatactttagctacgtcactgccaaggagtaattagatatcgtaaaatttgctccactttgatttaggaatattggggtgcgcccgtacgattcaaaaataattaatcttgccccattgaattatatcatgtaataaaaatagcgccataacttaactatgcgaaaagtttctatcatgaaacagtcttatgaaatagcacccttttgatattatcctttactatgcagatcaatgtaatcttatgacaattttaggaaaatgtaattatcatgacaattttaggaaaattctcccctatttttcatgaattgtgacaatttttccgcccatctccatcaaaatttaaatgaagtgatttttattggatgatattactcagtaatatcatccaattaaaattccacaattttgattattgaattttagcttttttcagctcacttcttttaatttttttttaagacatggacaccgtcttcagccatttagctgcacagactgtaacttaacactagacaacggacaagcatgctccagtgacacagccgagaaacattcctgacgaaaagtttcaacggctgaagcgagaatcgaacccacacctcatgacacgaagcgattactgcctggtgacactaaccactcggctacgaagcccaaattttaatatataatggaaaatgaacccttatgattataaaatctttatctatttttatccactagtcgaaattcctcgccttctagtgcgccccatagggcaccatagttcagaaattgtttcgaatttatcactcatttcttataagggttctatcatgtaatgaattaaggaattatgacagtttttcatccacatacccttttcgactgttatcgtataaataaaattcattgattttcgaattaactccccacaaggattctatcattaaatgaaaatagcaccctaatgatccaggaattatgatatttttctgctcaccttctaattgcataaaatcatgcaacgaaaattgcgctccttggcgttaggagtgatgacgatttatttctcttacttcgctaacaaatactctcttctaatgaaaattgcgctcgttcactatacatcagaatgctctcattgaatgaaaagtgcgcccctatgattcaggaattatgatattttttccgcccaccttcccttattaagttatatcatagaattgaaactgtgccctcttaaatctgtatatatttcctttttgaatgccatatacaaaatacccccatgacccaggaaatattgcaattggttttgtctacctcttcattgaataatttaatgttattggcgcatttgctcaaaaggacacgcggcgttcccctgaccgcggttttgcttattcttatggcaaataacgttgcggtgtttcatcaaacgcggttgttctctttctggaatgcgcgtttttgggaactttacaataaccgcgcggtgtatcatatccagcgcaccagtcaatactatatattcctccttataatcaagcaataatggtaattttttcgcccacttccttattgagtaataccatgtaatgaaaactgcgctcctatgattcagaaaccattttttaaacatttttcaggttatctaccttttttgtattaacgacactttacaccagaagggtacattcgtgtcgatatggttacctacctgcattgaatattatcatgcaatgcaaataacgctctatgatatagtcccaatacaaccgactatgcaactgaaaagaaaatcgcctatctcaatgcatgggaaatttcttgctaaaaattgtcaagaaagtcatttttcgttgatcacagtacgcagaagcaatgccatttcaatttttttttttttttttttcatttcaaaagaatttcttgaccaattctgttcaagaaattttaacgtttctacagcaatacagcatacttagctataaggaataatatcatatcgtgaaatttgcgtccatctgattcagggataatacaatacttcataatccaattctttaacaggttctattttataactgcaccccagtgttccaaaaataaggaatttgttttttccttcacctcatacattgaaataaatcatctaatgaaaactgcgcacctttgtaattattgtaattatgacatttttttcataaccttttaaaaaatttctatcaactaatgaaaattgcgcccctatgatctcatccactagtcaacaagccactgtaatctaataaaaattgtgcccctattatccatgaattatgacaattttctcgcccacctgcttattatagaaaaattacgacctttgcttcaggaactatggtattttttcactcgctactcaaaaatgttctgcctttcatataaatttcacatcaattatacagaaaatatataggaaattgtcctacttccttttacgaaatactaccacgtaaaaattgtgtccatgtcattcatgaattgtgacaacttttccgcccatttccacatatcgagtaaaatcatctaatgaaaattgaacccctttaatttattatttatattttttctgaccgcttcccgtttcctaattttcatcatataaaggaaattatggcgatatcacaggttatgcgattattgttcagaaattatgacaattttttaggtattgaaaattattatgttatgaaaattacacccctgtgattgaggaattatgacaatttttccgcccaccttgagaagcaatgacaaacatctcaatggtccaacaaaaatgaatcttttttgtcacccactaccccagtgaattatatcatgtaatagaaattgagcacctttgcttctgtaaatatgacaatttttgtctatgatcttatgctttaatcagcagagtcctggtatctcctgaaaattgcacctctattatcaagagattataacaacttttccgccaaccttagcattatcaaaataatattgtgatatttttccgttcatctcctctcaaagagtaattcgatcctttaaatattacgcccttataattttttttattataactgtattacgcccattttttcttttaaattttggttatttaatggaaaatgcgaccttttgattatggaataatttatgttatgctctttttttatccaccattcaaacttctttgcctacctccgcgtgcaataaatttgctccccatagggcaccaaagtacagaaatggtttcaaatgtatcttcgcttctaataagggttcctaaataacctaacctacccttatttaattgtatcgtgtgatgaaaattgagcccatatgcttctgctattcacttctcaaaagtgttctatcattcagtgaaaatagcgtccttaaaatccaggaattataatttcttcttccgctcaccttataattgtatatacatatatacaattaggaggtgattgtagaatccccagataaattctcggtggaatctccggaagaattcctggaagcgtccatcgaattgcagagttgctcgctgtcactatcaatgatacaaatcggatcattccatgtcatatcaacatcatgctatctactccatcaccagtgcattgatgtcgatagactatgtatatcactgatggattaagtttagctttaaattaagcaattaaaatagcaatttatcagtgcacatcgtaccttcctgctgtgcgtacacgaattctctctgctcttggaagttttcttaaaaactacctaaagcaataacacactacttttcagtgctactaaaacagtacttttcagtactattttttctattattgatccctttacgatccttgtttggacccgtgccttcgatttgccacaattaggaaacaaaaattttgaaaataagatttctcaattggaccctggctctaagcccttttggaaattatctaaaatcttgaaaaaacctcagaagccaataccggcattgaaagaggaaaacaaattattactaactaattgcgaaaaagctcaaaaacttgctctgcagttcgaaagtgcgcacaattttaatttaggacttacttgtccaattgaaaatcaagttacctactcaggacttcgaaaatattctcaatcaagagaacgtttttgaaaatgcctgggagactgatttggaagaagaactattattgaaaaaaattcaaaaatatgaaagctcctggcgatgatggaattttctacatcctcatcaagaaacttccagtaagtagcttatcatttttagttgatgtattcaacaattttttttttcaattagcatattttcctgaaaaatggaaaaatgctaagatggttccaattttaaaaccagacaaaaatcctgcagaagcttctagctatcgtccaatcagtttgctttcctccatcagtaaactttttgaaaaggttattttgaacagattgatgacccacatcaacgaaaattcaatttttgccaatgaacagttcggattccgccatggacattcgaccactcatcaacttttacgtgtaactaatttgatccgttccaacaaatctgaaggctattctactggccttgctcttctagacatagaaaaagcattcgacagtgtttggcatgaaggtttgatagtaaaattgaaaaactcactaattctgacgatttatttcactcacttcttgaatggatactctcgtcacgaagcgtgggtttgattcccgctccagtcggtgaaaacttttcgtcaaacgaaaaattcgtcactgggctactaggtgtctgcaggaatccatttcatattttcctagagtaatccctggaagagtctctggagaagctcctgtaggaaggattatctaaggtaattactgagggactcctggaagcttggagatatcccaggaagaatcaatgtagagattttgctgaaatccctagaaaaatcccgggaaggccagctgaagagattttcccgaaattattctccatggagaaatttctgtagaaatccatgatgagattttccaaaaggaaaaaaatgcagagattttactggaggagtttttgtaaacattttcgaaattgtcatcacccgcccacggaggagcaagcgtcaaggtcgaaggatcaaacactactcctatcctgtaaataaagaataaaataatatgttaatcagtccacagttcgggaagtctctcttctacgccaactgcagccagtacttacacagcaaaaaaaatcttaaatttacatgtcacgtaaactttcatgattgtcatgtgaatcgaattatcatttgacattaaacgataaataatgtaaactggctcattgcattcaggaatgcttgcaaacttgagcgaaactgaaacatttcatgatcttgcatccaacattcgccaatattgcatgatttcttgcatcttgaaagtgaaattgaaaacaagatcgctcagtttacatgattacacgttgaatattctgccaaaaataatgcacatggatggatcgacggcgtgtcattccatgtgcattatttatgattgaattttcagcgggaaaattatgtaaatcgagccgttttgcaagcaacattctttgagagaaggcgtttcgcgttcaatattaaggaatttggtaacaatgttgtatataatagatgtgtttataggttttatcattgaataatacatgagagatggctttacatgatcgaatctaaagtaacgttacgtgtgaatctaagatttttatggtgtgtatagcttagaaataccgtaggtacgaacagataaaaggtaccaagtcaaaaggtagaatttttttttcctttactgtagagcctatttaaccacagcgtccattatttaggaatattgtggtatgacgcataattgatttggtgcttatcatatatcctgtcacaactgagatgtgatagacattggttgatatagcacacgatcccagttaggctggacttgttttataaagtctataaccctgttgggattactttgccagatttctaggggctctaataacccttttccaaagattgaccttctttgattgaacaaaactccatagctgcagagtatacacagcaaaaaattctcaaatttacatggcacgtaattttgtatgataatcatgtaaaacgagttgcaattgaacattcaacgataattaatgtaaactgtctcattgcattcgataatgcttgcaaacttgagtgaaactgaaatatttcatgatcttccatccaacattcgccaatgttgcatcttgaaagtgaaattgcaaacaagaattcccggtttacatgattctacgctgaatattctgtcaaaaataatgcacatggatggatcgacggcttgtcatgtcatgtgcattatttatgattgaattttcagcgtgaaaatcatgtaaaccgagccgttttgcatgcaacattcttcgagagaagacgtttcgcgttcaatattaaggatattggtaacaatgttgtatataatagatgtgtttataggttttatcattgaataatacatgagaaatggctttgcatgattgaggctaatattacgttacgtgtaaatctaagatttttttggtgtgtattttcagcagtttcgttttcgatttgacaaaaacgacattcagaagattggattttttcaattttatacagatgatacctactagggcagtgaccagtcaacagaccggttattaccctcagatcccttttatttaaatttagcatagcctgggcttttgaaccactgggctttataaacctctttgcttgtcttgatgtatccgtggtattccagttggattctatcatagacatttccaaagatttgagttttgctctcagagcgcactctgacactccacaaaatggctcgggaccaataaaattcattgaagaaccttgtcttgctaaactgtcggccatttcgtttccatcaattccacaatggccgggcacccagtataaagtaacttcgttcctactggccaattgtttcagagaaagaatgcattcccacactagcttcgactgacaagtgaatgccttcagcgcatttagagctgcttggctatccgaaaaaatacagattttagcaaatctgtacttcttttcaatacagatattcgcacattctatacaaaaggtagaataattaaaatcacttgagataggtagacatgacagtagccatgataaccaacttttactatggttctctaactcgatatcgagatacggaatatcgagtaagggagagtttactgtagtagtaggcttgaatttctagaaactcacgtgtcccttttcagtagtttaaaattgtgaatctcataatgaattttccaaatcagtagtgtcattgatggctaaaaatgcgggaaattcaacgagatatagaatatttttctacagtcgtcttaggttgcccttagcaatgggtgttttgcaattttcaaggcattttgcctacagcagcaataggcgtgagtttcattagcttcgctgactgtgatttgctgcgcttgcctattgtattttatgatttttcccaactctgcctgggaaaattcctcaaggaaactcttaaggaacctctataggaatttatgaagttatcccgaccagtggattacaacagagatgtaacagattttgttactcagtaagcgctctttttctaacaaaatatgttataattttggctggttagtatttaaaataacacaaattataacacagcgtagaggaacgctaaactaaattataacaaaatatggtttaatttgaacaaacatgaaacatgaattatgtttcaaattaaacaaaaatgtaactcattttattatttttcatgtctgaattattacaaaatttgttataggcaataactcttaaatttgtataacaagttttgttataattttgtttcaaattgaacaaatttgaaacagcctccgttattatgactgattttgtttgaattatgttataatttactccatcaactcagagtgcttctaacaaaaatgaaacattaaatgttatttgtaacaaatcttgatatgattgtgctacaaatttattgttatccactggtcgggatttcttgtagaatccctagataaattttctgtggaatctccggaagaattcctggaagcaaccatcgcatttggtaagatatcaagtaatacgacacaagataagcgtatagaaaggcgaaaagctcaaaaaaacagctgtcaaaacaatttcaaatagtcaaagcatgaagcgagacttaaatttccagccctacttttgagcatctcctctgacattgacattcatttcgctcataggcttttgaaaaggaaaagtttacccactcacatccgagtcagcaaactagctcaccaatttcattaaaccagcaacaaagttccatacacaagtcgggaaatgccccatccgccacttcggacatttttcctgcctctgagcctcgcacaacaaaagcttgctttgatctgtcaagcttgatttattcgaactgaaatttgttgccaccattatgatgaggctctttgttccagcatgatcatagttatatgtactactaccataaattagtgacgtttacatgaagaggaaagtctcttgctcccaacccataaccggattcacatgaattagcgtgtaataattaattaatttgcacagctttagggaacagcaacttttttttgtaactcgagcaacgcgaatagagtcacggtacaaagcgagccgacagatgtataatttacgtaccatgaattaattatggctccggtagagctttcggcgtgaaatcctcgacaccaacccagccttccggtccccggtgaggacgaacagtgaaatgaagggtggtttttggaattaatccgcagacagaatttcaattaaccaatcgaacaccggaccggaagtggttgatgtacggttgagtggatggcggggtgctgataagcgtatgaaaaggcgctgaaattgttataaatctcacactcccaggtgctggggaggttcgttttggcaggcgaccacaatgatgacctgtagaaggatttagttacgctttccaattattggggataaaaattcggttgaattcgatggatagccatccaagtaacaatttcgcttatctatggaccgatgcacgagttcactcatctgacgtttgagcggtgccaaattcactagttgccatggtcacgtaaataacacggcaccgctcaaacgtcaaatgatgaactcgtgcattggtccataggggaagtggtggtaaaatgaacaggggtggtaaaatgaacaccgtgccttttaccgagaaaaaaacaaatttcgataatttttttcacgcacggatgatttagagcatacatctgagtgttcgagttgataaggaggtcaattgaagtgaaaatatcaacaaaaactaagattttagaaaaccacgtttgaaaattagaactgacgtaacttttagctcggaagacttgagatttttcagtgaggtgaatatagttatgatatgatgtcaaatctgatacctttcgaattctttttgaatgggttacaatcattattggatgtattttcggtggggcaatgaaaattttcagaaatatttgttttgctcacgttttttgcatggtgttcattttaccacctaccgctgttcattttacccacatagtgcaggtaaaatgaacatttgcatcgctttttgatagcgatgaaaatatgtgaaaatttagcttttttagtctgaattcatgtagctgctatagattacatccctatttttgatgttgtgcgattgaactataaaaattcctcgtttttctatcagaaacaagatgatttccttaaggtgttcattttaccaccccttcccctattttattgtacactataacctcttgtagtgtgtacattttgatcagcaatagcttgaagtaagtgagaaaaaactaacgatgttacttgcgttaaccatttgggatgtatcaagagctccacgcaaaattcgtcggaaaactttaacaagcttccactcgactcaacaactcaattaagtttaatcccctttgttgctcgcgtttgttagttcatcacgagatttcatggcccgctgcaactggaatgcagcagcagaggcaagatttcatcacatgcaatttcaatctcatagccatctttgtcccatccttcgcaacaaagtccaggcctcactctcctgagtatccagttagtgtgcacttggagctaatttcctacactccaaggaggagtttcatcacgattcatcgctactggatgctgcgtctggatcgatgatggcgattgagtgagtgtgtaacatttcttggaagtaatccgcactgccggcgaattgtggaatcaagtgaatggatgctggctggcacttgagatgagattcaattttcctcaatcattgcgctgctgttgctgctctgttgaaaagtacaaacggttctcgaaccaatggacgatcatgggcgtagctgaaaggagaattttgaatttgacgaagcattcatattcaaataataatttggataacagagttcaactgaaattcatacttctttaaaatctatacttaaaacattcaaagatatcgatgttgcctcaatcctcctctttggtcaatgtaagaactttcgctgcggaaatcttcaagcactacatttcaaagatcctacagaggttcctgcaggaatttctttaaaaagtactcaaattcctggaggaatgtctgaaagaattcttggagtagtctgtacaggaattttgagataaaattcaatagaaaactcttcaggaattctttcgaggaatcttttatgaactctttatagagtctacgtcttctgtttcataaaatagttcaaaatatccgttttgtgagaaattggcgaaaaatgttcctcttcgatattaatcctgacttcgcccctgttgacaaccgatgcgatgatgtaacacacagtttctgaagatctagttcgaacgcgaattcattagtctcaatttgcgctgccgactgctgacggactttgtctaatacgaatctaattgtttcttgacaagtcccataatcgagccacacgctgagcagaacagacggacgacacactttaattgggcgtttattaatgggatggctttctttctgcttgagaaggggtggtgtttagtcgataggaacgcacctccagccaacgggggattcttttcatgtcaaggtattctcggaatgcaggacccactttcgcaaggcgttgacagctcacgaaaaacgaatcaagtgagttttcttgctggcttttcgggtttggcaggcgtgggggagtgattgatggtatgaatggtgaaagtaagggggcacgtcactccttagcggggccatttcgctgggcagccacgtaatcaagcatttaaagaaggggagcactctgtgatttgtcaaaaaatggcaataaaataataataatgtcatacggaaacaaagatttttgaaatcccagaggtaactcaggtaagtcagatgtaaaaatattgtataatattggtcccaaaatgctgccttgaggaaaaccagctcttacagtaaatctttcagacttggagttctgaaaattatcctgaagtgtacgatttgacagattactttggattattctaacaatgtatgttagacaattaaagtttttttattttcaattttacaatcaagcttccatgccaaatactgtcgattttttttttctagaagaacaaaattagtagaatagctttcagatttgtccaacaaatcttggtgaaggttagatgtttcctaaggcacgataatatttttcccatttcgctgcgttaccttgggtcagtgcctacattggcgaacgattgcagacgtggttcgttttttttttttcgtaaatagggataatccgcaataataaattcctgcccgttcgacgacctagtctacggaacgtgtccgtttctagtgcaaatactcctgagactaggacaggtgcagcagttagttgtatgtatccctttcggtatgatgcaacaacaacaacaacggaagggttgcacagcatttgggttagtttacctggaataagctcacgtgagcaaatataacgacgaggattatggcagtttcgtgtacatttgtgttgctctgtgtgtgttgcagtggcataaactaatttggatctaaaaaagttgggttttgggtcgttgatccggattgcaaacaattgcaaatgggtccggctctgggattatgtctttttacaattacttataacaagcttttattagagcaatttttgttgtctgcttggttttcaatttcgactactctacttttttgacgttcatattatttcatagatttttctatgttttctagcttgctccaaccttgatttttttttcgattgtgttggaatatcattagcaacgagcatcaggagatatcttccagttttgcaagtataaagaaaaaatattcaaacttgtttgcaatcgactacagatgacaagcaggcttcgtgctttggtggagaggcctgtgtcatccgcaaacagagatttttggcatacctgaggtaactgaggtgagtcagatgtgaaaatattcagtcttagtggtggctttgaacattgcatcaatcattaggttcaattgttcagttagaaaattaaaatcagaggcagacatatcacttgaagtgggtatattatctgatgatttcccattagaattttcggtagacgaatcggtccattcgatttgaagcagttagaacgggtactcatagtatgaataaggtaggagttcaaattacctgctacaatatcggcaaaggattttccgtggatagatacatacaaaatttaaagattcgaacggctacccgacgaattaaaataagtttgtgaataagcatgattatgatctacctgatggttatgattcctaatcaagcgatcgttaactgaaaaaatgagaattgttcgatactcttccagggaaattccggaaacgaccgttatcgtaacggatattactgttcatctgcctggcacgagcttcgacgactctcctacgcgaagggcaagatcaaaagtttgacttatgattgcccccgaaatttgcacaaatgaacttatcggtatcttccttcactggacagacgtccttagcgtgagaagaacctccgcaaatcctgcatttagcatccatgcagcaattttttgtaccatgatcccacttttggcaccgacggcactgagtggggttctggtaatttactccaggtgtctggaaatgttcccatgtcacacggatatcaaatataagtctagctttttctaaagcttcaatattatttagattttttttgttaaagtgaactaaataatattcttgagaaaaccctttccaaacaatgccagattgggttctctttttcataatggttacttggactggggaaaatccaagtatatcatttattccatttttgatctgttcaggtgacttatagtcacttgagagacctttcacaaacctcagaggttttttcccaagacggtgtccaagaaggattaccaccgctagctttcgccaacgggtccaacgaaacatcgaaggcacgggtccaaacaaggatcgtaaagggatcaatagtaaaaaatagtactgagaagtactattttagtagcactgaaaagtaccgtttttaattttagcacttaaaagtactgtttttgtagcactgaaaagtactgttttattgctttaggtagttgttataaaagagcagagagaattcgtgtacgcacagcacgaaggtacgatgcgcactgctttacacattcttattctatgtaactggttatctttgttctcaaaatgctacttcgtaaaaagttgttcagactcataacgtaaaagtgaccgtaagagattgaaaaagagatcaaaatcttttaaagtttcaataacacaaatcgctttatacatccttatcattttttataatactactttggaaaaaaggggactcgctctctgtaagatattctctcagagtactcgctgttttggcctatttatttagaagactcgtttcgtgtacgctattttctcagtgttctactgtgactttttcagaaaactcactttgtcacctatcaattcaggtattcgcattatttctgttatcttttcacaggtctcccttttttcacttccctttcaagaaactcactttatctcaattactctctcagtatattcattttgtgttagctactctttaggtagtttatactctctttaaaatttgatttaactatggtctcaagagacacgcttaatttatttgttaagttcagaggcgactcgtaacctcactttttaccttttctatgaatctaaaaatgactgatgtggcaaatttagattataaaacacaaagtaaatggttggaatcttgctttcttacaaagctctatttgttagatgcaaatttgttcttgaaaatcaagaattcgtattcgtagaacaggtagatttgaggttagggaatcgccactggttaagtttattctttaaattgcctttcgttgtcgctctttaaaaaaaacgcttttggcagtaaccctcgtaggagattcagctttcctctcatgagattcgctttctacgaactaccttctcagtggactcgttttttttgtcgtttaccctctcaggggccttgctttcctagctaccctctcagaggactgttttactattagctatcctctcaggggactcgcttttctagctcacttgctcttttgtaacttactctctcaggggacttgatattatcgtagcttaccctctcaggggacttgcttttttctagtttactttctcaggggactaactttctgttagctaaccatatcaggagaattgatatttactttgtttaacctctcagcggacacgtttttttgtcatttaccctctcagggaacttgcttttgtagctcacttgctcttttgtaacatactctctcagggaacttgatatcttcgaagcttaccctttcaggggacttgcttttttcgtttgccctctcaggggactcttttcttttagctactctctcaggggactcgtttttctagcttaccttatcatgggacttgattttttttgtcatttaccctctcaacggacactttttttgtcgtttaccctctcaggggacttgctttcttagctaccatctcaggggactcgcttttctagctcacttgctcttttgtaacttaccttctcagggaactcgatattatcgtagcttaccctctaaggagtcttgcttttttgtcgtttaccctctcaggggactcttttctgttagctaccctctcaggggactcgcttttctagctcacttgctcttttgtaacataccctctcaggggacttgatattatcgtagcttaccctcgcaggggacttgctttttttgtcatttaccctctctgaggactctttcctgtaagttaccttctcagggtactcttttgtattacctaccctctcagcggactcgtttactagctcacttgctattttgttacttaccctatcatgggacttgctttttttgtcgtcttccctctcaggggacttgcttttctagctaacctctcaggggactcttttcctattagctactctctcaagggaactcgcttttgtagctcacttgctctgagagggtaagtcagaggacttgatattttcatagcttaccctctcacggtcttgcttttttgtcgtttactctctcaggggactcgcttttccagctaccctctcatgggactctttttctattagctactctcccaggggactcgcttttctagctcgcttgctcttttgtaacttaccctctcagggggcttgatattttttgcagcttacccccttaggggaatcgctttttgaagtttatcctctcaggtaactcgcactctgttagattccctctcggggaattcgcatttccatagcattccctctcagaggactcgttttaaattatctattcttctagtggtctttttcaggacagtcaaactattatttatttatcatatctatataaataaaaatggaatggtgtttgtatgtcacgaaatggcttacgaacgggtcaacggatttgaatgattccttctccgttttgttcgtcaagggttccgacgtgtttgtgtgtataaaactcccaggatattcaccgggatagttgaaaaaaacgagagtgcacggaactgtcattttgtatgggacgattcatagcgtttttcaacagcctacttgatggcaagacgaagtttgccgggaccactagttcaatatagggtagaagtaccaattatggctatagtaccaattatggcaatagtgggaataaaaagagatttttcttattgtttcactagactataatggcttatattcacaggaatgattaaactatttgtttttgatggtaactaaaccttgaaaagaacattcgtgcaataagcttcgaaaaatgaacatttgaaaattttgcctcacatatatgtcaccttcttagcagttggctatgggacctccgttacgaaatgtatgttttcatccggataaactgtttcaaccgatgaatgtatgttacctagtgagaacaaatgaataaatttagctggtatgcaatcaattctactgtttcatgttggaaatcgtgttatttccactatgtcgataactggtacaaagagtgtatgagagcccaattatggcaatactctggaggcggtttgtttacattttttgatcagtaaaataaaagaagtaacgggacggttcggtaaggcattatcttcatgttttgtactcaattactaagatttttcaatcacacgttcgaaaacgttcacgagcggaagatgctaatttcatgatagagaggggttttcagcgacactcgatttttgaatttttcctctttttccgttaaattggattggcactggaaaggtaatgtgagatcattaatgctgttttgtatcataatttgcatttacactacattttgacttctttttcgaaaattaattttctcccatgaacccattgcaaaaaattgatttaacatctatttaacccaaaatttttggaaaatttaatgagcgatatcttcattacatattagtgttgcattatcattcgctctttatggcgtttgagttcatttcgtgcaaatattcgatagtccataattggtacacttgtatgtcgaatgctaggaacgctattgccataattggtacaaagacaacgctttttaaaatcgatttttagaagcttaaagtcaatttagtattaaaactgtttaaatcaacagattcgcaaggctttaaactagtaattgacaccaacaagtcatgcttgcgttttagaaacgcggttacaacttgatttttattactactgttaacatattgcatccataattggtacacctaccctatttattaaatttttttgaaaattgtcaactttactcaaatccattacccacacattcacttgaggtgaaaaacactgaaaactgttcattgtaacggatactttcagattccatttttttttttcaaatccccacaaactaacaggaaaaatcgaaaaacggaaatttcacctaacaggtcctcagctctgcacacgttctttctctcccctctttgagcagatgtgccttgtagtgactagacctttttaaatagccgaatttacacactttccagatcacgtttccctaataatttcaatagagctagactaaataattaacactttcttcatcattataaaaccacgtttattcctcccaaaccacttcaacaaactgattcctctcttccattcgtaaacctatgcctactatgatctgaattgatttcattttcagtactagttaaacagttctttcagtcaacagttcgttggctctcgaacatattttgttttaactatactctgcttcaaacctctcataatccctacaccagggaatcccggaagaaactgtatgttattagctgttagaatatggacattcagcctggggaatttcagcttcgaaaaacgttgccgttcatctgtctggtacgagcctcaaaaattcgtttgcgcgaagggcaatcccaagagttagacttatggtggcccccgcatttgcgcatacaaactttttagtgtcttctttcacaggacacacgttcttagtgtcggagtctagcaccagagattaccttcgactgtggacaactgttaggctccaacacgtagtagttttggggattccatacgggctagtttccctgaagatggtcgaacaatgggtttcttcagtccattaaagggcgattgggtagcttcttcaggtttccaatggtccatgacaatccaataactttcacaaaaacatatatttggcgttcacattatacactaaacatgattttattttacaatatgtacaattacaaaagttactggtttaaaacattcaacattcaacacctatgctgcagtccatgtagactctgtcgtggtttcctgcgcactgagtagtcttaaagagtgtggtgagagtgatcatattcttctccgtggggatgatggggtgaggtggagccaataagttttattgagaatcaagcctgggatattagattgacttactcccatggtcgagtattcccgtaatacgtccaccagtagttatgtagatatgactgatcacgaaagccaattccgacgtgagcgagttggcgcgaattgccttaagtaatggttgcttcgggtttccattgatccataacaatccaataactttcacgtaaaataaactgttgctactcagctctttaaggaggttacgtgttgataaatggggatgctggtaaaatgcccacagctgccgcagtttatccaacaggtgctgaagccatcatcaccggtgggatggccgggctaacgctagttgggacacatccttcacagacagcgcacctaaccctggcaccgacgacggtggtccccgcggctgtggccgttcctaccgattacaccgtcatgaatggcggtactctcaacaccaccgtcactaaccagaacaacagcaccaataacaacacaaacaatatcagtagtaacagtagcaatatgatgctatcgaacgaaacggcagctggtgagtactacgtggacaacaacagtgcagctgccctcacttcctcgtctacagttaccacaaacattaacaacaacactagcagcaatcagagcagtataactgccagcaacagtaacgttaataacaacattagcagtaatgttagcagcagcagcacgcagtcaacaatgggcagcggcggcgcaggtggtcccgttgctgctggcattgtcaatagcggcggtattggtggccctgccgctcctaccgccaacgccaccaccagcaccagtgataccagtagtaccgaaaacaacggtatgcctttagagcagctgaagcagcaactacagacgcagctcgattactatttctcgagagaaaatctagccaacgacacatatctgatatcccagatggacaacgatcagtacgtgccgatctggacggtggctaacttcaacctggtgaaaaagctcaccaaggatatcaagctcagcacagaggtgctgcgcgattcgcccaacgtgcaggtagacgaagagggcctcaaggtgcgaccgaatcacaagcgttgcatcgttatcctgcgagagataccggacaatacaccgatagaagaggttaagaacattttccaaggtgaaaactgtccacgattcatctcgtgtgaatttgctcacaacaattcctggtacatcacgttcgaatcggacgaagatgcccaacgagcgttccggtatctgagagaagaaatcaaagaatttcagggaaaaccgataatggctcgaataaaggccaaaccgatgaacaggcttccgctcgctacagcagttccgttgaagaatggtttccgaacgacaccgccgccaccggctggagcagcggtggctgttccaccgggtgctgccggtacttcggctgctgctgccgccgcggccgcagccgcagcaacggctgctatttacgaccctgcacaagccgcagcagcggttgcctttcctggacagcagcggtacattgcactgcagccgaatccgagcgcgatacctcagggaacggcagtgccagcttataacgcaccagttcatatgtttccattccagcagcagttttatcccggcataatgcaaccttggccaactgccccaccgccagctcaaaattactacgatttgagtacgtttgttgcgagcaatgggcttcaagttcccttcaccaccggcggaggaaagcaacaaaatggtcgatttagcatgcagggtaacattggtggaccccatcgaggcaacatccgcagtaaacgacagccgaacccatcgataccaactggcagcaacgagcatcgttccggtggtgctaacacgggcggtggcgggggaggaacgaatgttgcaggccaaaacaacgcagcaggatcagtgacaaacgaaagccaaccgaatcatcgagtttctaatcaaccatctcactaccatagatgttcgggagtaagacaggcaaaagcatacaaaaacactagttgggctcatcagactgtttcatcaggtaaagtttgcagtatatgcctggccgaagccaaggctttttgtgtatactacaccacctcttctctctgggtaccatcatactacacgatatttatccataggtcactggttcatatccggttcgaaggaccattatgtcggagtctagcaccagagattaccttcgactgtggacaactcttaggctccaacacgttgtagttttggggattccatacgggcttcatttccgaagatggtggagcaatgggtttcttcagtccatttaaagatgattgggtagcttcttcgggtttccattgatccataacaatccaataactttcacgtaaaacatatatttggcgttcacatttatacacttaacatggatttattttacactatttacaattacaaaagttactggttttacaacattttacattcaacacttatactgccgtccatgtagactctgtcgtggtttcctgtgcactgagtagcgttcgcattcaaagtaaggaaagataaatttactagccttttttgggggatcttggggtgatatgggatcggatattttttataatttttgtatgcttttgcctgtcttactcccgaacacttagcgtgagaagagcatccacgcgacaatgtttggtaccatgaccccatttttgacaccgacggagctagttctggaaatttcctccaggtttctggaatttttcccatgtcacacgaacatcgaacttatgtcttgcttattctaaagcttcaatgtaaataacactttattaaagagatgtaaagatcagttttattaaagagaataaaataatattcttgagaaaggcgaatgtccgattttcataatgattacttggactgtagacaatccaattaaatcatttatttatttttttttatttcttcagagacacctttcaagacggccttgaacaaacgtttagttttgtcgccataagttcaacatttgtgctttttctcttcaagatgtttgagaagaagttctcgatctctaaaagtttccggaaaaacgcgacagtctcctttatttgcgatttgaaaggaaatcttgattgtcctaacagagtacaggatctcctgcctgtatcctccaaatccggatcaactaactacgattggcggcattctttgtttcttcacttgattcaaagagcctggcctaaaggctgcttcgatttgactcgaccttttttgttatttattttaacatatcacagatgaatctatttcaaaaggtcgaaaggacaaaaggtcgaagaacaaaaaagaagggacaaaaagtcgaaattctattttcaagtaaggaaaaatttcgcaccaaacaaaccattttcgaccttttgtctttcgaccttttgtctttcgaccttttgtctttcgaccttttgtccataaaccatcaaagatatatgtgtttttgagtttgacaatttggaaattagctgaccaaagcaaactcgtgtcatgaaaacaccattcctcagaaatctatgaaatctgcgtgaaatcgtgcaacttttcttcaatgggtgatcaaattagtaatttaggagaagatgaaatactcttttcgactaaaatgtttatccagcagaagccctttttccttaatattaaggatcatgacccagatgtacatacattatcaggtattacttggaaatactgtcaactctgcctcgatattggggatttttttttattatcgtacaaattgggccgaagggtctcagattttcatgaaactttttccacaggcagggctcatggatatatgaataaaaaaaaaatgagaaaaattcagggtcgcctatttttccggaaaactcaggtggaaatattttgttttcccttgacactacttacttcgaaaaatcataactcaagaacgaagcatcgtagaaacaaagtttttatatgaaaatttgagcaaattttctcaaaaatccaaaaaaaatatgaactggaaaaagttttccacaaaattttccaccgtttgaaaattcgtaaagaaaagccggaaaaactatgcccgaactcgtggaaaatttttaaaaaaatattttcgagaaggtaattttataagccttaatcactgaaatttttggaatgcacttttttttcgtttttgagttatggccaattttgtgaaaaatgtccagatgtgtcatataagacttttctttgaaaaatcataactcaagaacgaagcatcgtagaaacaaagtttttatatgaaaatttaagcaaattttctcaaaaatccaaaaaaaatatgaactggaaaaagttttccacaaaattttccaccgtttgaaaattcgtaaagaaaagccggaaaaactatgcccgaacccgtggaaaatttaaaaaaaaaattttcgagaaggtaattttataagctttaatcactgaaatttttggaatgcacttttttttcgtttttgagttatggccaattttgtgaaaaatgtccagatgtgccatataagacttttctttgaaaaatcataactcaagaacgaaacatcgtagaaacaaagttttcatatggaaatttaagcaaattttctcagaaatctaaaaaaaatatgaactggaaaaagttttccacaaaattttccacctttagggaaattcataaagaaaagctggaaaatctatgcccgaactcgcggaatttttttattaaaatattgttgagaaggaaactttataaacttcaattctagtaacttttaggatgtactttttttttgttcctgaattatggtcaattttgtgaaaaatgaccatattagccttttctttgaaaacaaatctttgcattttttacaaaattgaccatagatcaggaactaaagaaaaataccgtcaaacggggtaacttgcaacacttttcaacttcaaagctatgtagaaaaaaaatttaaggattcagatgaaacaaaaaccatgtggtatcctaatcgccacgtaaagaataccacgcggtattaaatttatcagcatttggttttctgggataaggagagacgaaaaatatacatttttcaagctccccctgatgtggggtaacatgcaacacatagtgctaccaaaagttcactattaaaaagttatcctatatcgtgttattatgaatatataataattttatgcagtaaaagcatgacaataatcaaaaacagagtaatctactcttagtaaactaattattattgtttgaattaggagtattaaaccaattcgattgaaaactctattggatgtttacacggggaaattctagcacatcataagtctctaaagttggaaagccaacttttctacaaatataatggaattttaaattatacttcgcataacttatatttttatacatatttcaatcaacgcaacatatcacatattgatatgtatgccttgaaatagtctctgttggtgttttgacataattatcaccatatttcatgcaaaaagttcctaatggcagatccactaattaaaattaacttataatacagattaatacagattttcaaaattattcacagttttcatgaagagaataaaaataattataattataatgaaccgtattgtaaactttgaaatattttgtaccaaacgtgtattgaattgattgaggtacacaaattttaatgctattgaacacatatatgttaaactttgctatttcatgtgtttttgatgacgtgcggcaagaaatatcgaacaattgagataaaaattgctgttgcaagttaccccacaagggtagtcaaaaacgtttttgaatttttatagtgtttaagcatcaaattatcaaaacttttatattgtcaatttgtacactactaagtactgtaactgatagcaaatgcctcgaatgacatatttctaccgtttgtgtggcacgaggaacgattttcagcattattttcatacaatccaacgtgaaatatgattttcacctccagcaaaccaaccataaaagaaacaatacccaaacactcgccaaaatcttctgttttataccttaggtcaataaacggcgaaataaattacaataatttaacttaatgctaaaccaaacgttaattcggttacatgtcaaagtgttacaagtatcacccctgttgcaagttaccccgtttgacggtacatcctaaaagttatcagaattgaagtttataaagtttctttcttaaaaatattttattaaaaaatttccgcgagttcgggcatagattttccagcttttctttatgaatttccccaacggtgaaaaattttgtggaaaactttttccagttcatatttttttggatttctgagaaaatttgcttaaattttcatacaaaaactttgtttctacaatgtttcgttcttgagttatgatttttcaaagaaaagtcttatataacacatctggacatttttcacaaaattggccataactcaaaaacgaaaaaaaattgcattccaaaaatttcagtgattaaggctaaaattaccttctcgaaaatatttttttttttaattttccacgagttcgggcatagtttttccggcttttctttacgaattttcccaacggtggataattttgtggaaaactttttccagttcatattttttttggatttttgagaaaatttgcttaaattttcatataaaaactttgtttctacgatgcttcgttcttgagttatgattttttaaagtaagtagtgtcaagggaaaacaaaaaatttccacttgagttttccggaaaaataggcgaccctgaatttttctcaattttttttattcatatatccatgagccctgcctgtggaaaaagtttcatgaaaatctgagacccttcggcccaaacccgtacggtaataaaaaaaaatcccctattccgtttctcgagttacaccatagtaaagttggttatcaaggctaactcctaccaccgagttgcacttgttttgtgttctgtctctcgataccttcctaactcgatgcacagtggcggtccttcatacaaaggtcggacaaaacctcaaatacgtctcaaattgctagataatagttatctattaattatcttggatatctgatatcatcccgttggaaataacagtcaaattgaaaattcgattttctagtgaaattggtccaaattaagttttttcatctaatcgtataaaatggctatcactacatttgtttgttgtactgcagaaatttttgcataaacctgaactagaggtacaaattaaacttccttttagaaattccactaaagtttcaatcgaattatgaccaattatatagatttgaatggtgaaatcgataaattataatgaaaaatgaaaaaggaattttcacctctaggggcaaaaaggggcaagaaaaatgattgcacgtttgaaagtaaggatgatatgctgcttcttagtgagtgactcattttcccgaaactcttcacataaaacgtacgaagtttagaaaatttaacaaaattttggagaaagattatttgaaacattttttgctacaaataacaacttgatatgttaaaaattatataattatagtcaaaactaaggcttataactacgctttcaaatggaacctattgagcttaaatcggttttgatttcgttgagatacagatgtttgaagtttggtaggtgaatcgaagttgatgaatttcgagcagtccaattttgctgaccttcccacacttacgatgctgccaaaaatcgaaaacagaacagatcaatctcaaattttgagaaattgtcgctcaatagtaaagaagtctataaaaaatattgacgagtgattttgagaacatgagtttttgaggttttgtccggccatgcgccactgtgcgatggtcccttcaatatcaagttagggacagttgactgtagtacgaattatgaaacagatcccgctttgataaataatatgatagataatcttatcaggtaatttatttgggaaaccagcactgattctcagacagatttgaccaaatctgtagaaatttcaaatcatcctactgaaccaccttttctccatttcgagtgaagttcaacccataacacaatgtccaaaaggtcaaggttcccaaaggaaatctataaccacgcgcccgtgacttgttttatgcacccatttcgtgcaatcgctttgaacgcccccagctctaatggccaccctgattgagccctttcactttaattgacctactcacaacaaatcaccacattgtcgaatgctccctacacgcaatttccccagtaaataaacactgccagtgagaaacgagttaaattgcgatgcttgtgttctgctactgccatcactactagggggaaaggaatttccatggaatttacttttctcgctcggaaaattgctcagtggaaaaaacgccaggatgaacgcgataaaatgctatgtacaatgtggaaatctcctcgtcattgtgccgctttcattttcctccatctgggatgcaaaagtgggtgtcgtttttcgcacatcaattacaatagtgtcacttcgtcttacatgtctacttggtctaaccatttatcaaaaaaccacttctaatatattgtctgctccatgtccccaaacactgcgagcagcataaatcctaacgctagccgtttcctgtttagggcactgcagttgtccatggcgcttgcatcgctatgcaaacatgcaagacagaaattgttgtgtggcactaaatattgcctctttctccgctcggctggaagtgacgttgatggctttgactgcatacataattactggctctgtgtggaaagttttgcaaccaactatccgaccacagaacgaccctttcactttatgaatatctgcaactcatacccctgaaagtatgcattacatttacttatgcttctcgttctcgttcatagatgtcgtagcagtcgaggcgataacctggatagtatcggaacaagctcagccatggatgcggtaaatggcaaaatttcacgacagcagaacggttcggcaccgggacccggcggtcgcgaatactggggacgaatgccagaacctccgtcgtcgaatggtcaaccgccatccagtaaccacagtcaacagggatcacaacctccgagtcccacttcgagccggaaggatcgtagctctccgggccactcgaggaagagcagttcttcgtcgaaaattgtcagcagtcgatcgaagggaactccccaaggtttcggatacgtcaagaagacgaatggagttgtggaccagcaggggcaatcgttactcacgggtggacgaacggcacatgtttcggctgtgcctaggtctggtaaactgaaggtttccggcggtacgcagaccacgacggctgatttccaagcaagtaagtagacacttcagcaattgatgtcgtgatgtattctaacctcgtattcatcttttcagaagcgcaacaacacccccagtatcgtagtttctcgttgaccggaccgggtgcggcacagttgagtcaatcggtcaaagaaaggtttggatccggaacgcatagtttgcctaagcccggtttagatatgcatgtcttccaacataggtttgtttcccattagttctgtaccggatctaaccgaactcgccatctaacgagtcattagagttactaaccgcatctgtttcgtctctccatccccattttctttcattttctcctccccaaataaactaaccatccctagaatgtcctcccgtgggtccactaagctgaacgatggtagccttagcgatacgcaaacctacgccgaagtgaagcccgattacggtagctatgcgatgtggctgcgtcattccaacactgcctccagtcgcctttcggagggcgagtccctggagaccttttcgatcggatccggaggtggggctagcagtggaggtggtgccgcaagtaattctagcggcggaggagcaggttctggcattcccggggctactcgccctagtaagctgctgcatcatgcaaggggcgaaacgcaacccgcaatgcaccacgctggcacaacgcacagccctcggttgaacagaagcaatagcataaggtaactatccgccgatgtgatcgatgttgttctcgatgttctcgatggcttcttctaccacttttaaattgatggcttttttcgatgttttctaccataattcgacgtcgttcgtttatctctaaaattttcatcattgtttgctcgaactaaattttcgttgcactatttcgaacacttcaataaccggatcgattggatttgacgaatcaaatgtctttttcgccccctcattcaatatctcacgcgatgcagctatttgaaagaacggacctaccccaggtagatattgctcgctaatcatcctttctcatacccaaccaaccccatccatcatagttatttttagcatggcatgcagagaaaccaatttgcacgcatcccacccccattcctgttttccgagcgcctatcctttctgtgcttatctattttggcatcatcatcatcaatcgaaccgaatgaattgattgactttgtcagctttaattatggtggtatccgggtgttttatgcccttctggttgtcaacgggatggtcgagtagtactagttagcctctagattgataaaagcgtatccggccgtgtgcttttagtctagttgaaaatttgattttcagcacatttattttaggagcttgacgctacgatgaacttctgagaagcactcaacgaacctgcgcccaacagacgttgagttataaggccgtaatttagtttttctattcttggctacaacttttcatgcaaaacatcctggaaagtcggctgagtggctgtttttggcagatatttttttgattcaacagaatctactcatcgtcctccatcatgctgaatcgtaaaatgtttcgaaaatcgatttaataccgtgtacttattcaaagagaaaatcgtcgaagagaaatcgatcactgcagatacgcctgtatgatactaaacgcgagatatacaccttacatagccttgaggtggaatcttttaatatatctgttgatcctaatatatgaagatatttcatgaaatgtccttaattttaaaaggtagcttgggagaagtttctgatattatccttgctggaatgtaagataggtttttcaggagttccttgattgttttcacttctccatcgagatatcttctttaaataccttttaaaagacttgaaacaccgaacgaatttttatatgatctctgtataaaatcttggatgcgtcttttgagtaatttctagccgaactttcggaggtatacaatgaatcttccattcacgttaatcccaacattcgagttcaacaaatgtttgcagtcatcaaaaaaactccattgagtatgggcttttgaatctacaagcgtaaccaaagatctctcggagatgtatgagtgagattaataatctagcatgttttgagttaaataattctacccaaaaatttcttcgagtacagggctgttgatcaactcctgtatcaccattttttgaaagtagatgaacaagggttgcactcatacaggctcattaagttatgttataatattttttgatttctgctacacttccaggttattcatgaaatcctttgaatattgatcccagatctacaagcttggccagtatttttccggaatataacttggtaaaatatattttttgagcctgtgcgttagttttcttcctcttgttttttactttacgtccaaactggtacagaatctgtctgcttagtgttctgatgagcacttctacggttattaacttatagcattctttgccaattgaagtagaaaaactttccaaccctaagatatttgaactggcgggattccaactcgctatctttagtatgatcttcatgaacaactacgcgtttactgttacagctatctaggctctccacttcctgcatgagtatgaacatctttactgaatctataaaagctcaatgattacagttgtagatctgaaagtcttttcgcccatcggagttcttggagaacttttagaatttgtgctagaaaaattattgaacttcaaattttctcggcatagaatattggcaataatgctctcagtttataattgtagaagtgcttataagaacaccaagctggaaagctggttctgtctcagtttgtacattcagtgccgtagtgtggtttcatgacacccttgagccacctttattcaaatttcgcctttaatattgaacttcgctcattcttttttttttttttgccgtcggtctgtgcacacggtcaggcgagtcattctcgttttgcgcgtttaaacacgcttctcagttttgtttgggatcaaagtaatttaatacacaggtactggattcctgaaaattggctcaccaacacattcgcgttagtattgtatagtatttttatttctattctctagtccgatatttcagtaaaattcaactattctttacatgtaaaaatttatattcttgcgtttggaacaattttatggtgtggataacgaagagaatagtgtaattattctatgacttaaacaacttgtttaaagtccaaattccaaagtccaaatatattatgaagcaaactgcattactatttttttcttttctctgtgatacataaacatttgcgggaattcggtacttgtgttaaggatactataggatacttgtggttacgatggcatattatgcctgtgaagaaaatctacattatgaagaaatcgtcacggaattgaaattagaaaccctaataaaaaaatccaaaaacacgtgtatcctaatttcggataaggaacaaaatagcaaattttcacgaaattcagtgacccactagatcggtgtttcatggcatggctgcatataaaaagagttgtccaaattcctactaaaaagatcatacataaacttttcctagctttcaaacatccgccctgaaaaaacgtaattgggacaaaattcacaataaaatttgattatgaagcgattacaatcaaactatctctgaaatacgaaacacgaaaacgtcgtatggcagcgtccatttattacgtaacgctaaaattgtcaattttcgattatattggaaatgtgtttcatttctgaactaggatgaatcaaatcaatccaaagaggtaggtacttcttcccccttcgttacgcttgttttatgaaaacaatgaataaatataattacatgggccataacgcttgagcctactccccccaccccttagatggtacgtaatttgtggacggcgcttgttacatttcacatttgggatcgtccgaaaccatttatgaccagaagtctcggtcaatcaatattttaacagttgtgtggacaaaggccacgagcggagatggggggtctaaaattccaaaaaaaggactacgtgttaaatagacagcccctttagttacacaataaaaaaaagtgtgaaatattacattcggaaaggattgatttgattcatcctagttcaccaatgaaatacatttccaatatatttgatggcagtttatgatcttttgaagactgaaaatttctgttatgtttttccatagcattttacgatatattctgttattttatcttgaaattttattatgtttgttttagcaatcatttttaataacaattgattcatcattgtaaacttttttaataaataaaaacattgttttgatacatataaaaataacaaattaaatctacttttcaaactcaaaataattcagacaccttgaaaacctaatacttcatcatatgttctcaacaatgttttatgtgcagaagcacaaccaactaacatcttggttttacagacaattttcgttaaaaaggaactcggatgacatgaatgtcgatcactgtatgaatatttatagcataaacttgatacggtgccgtccacaaattatctaacgctctagggggaagtgaggagtatgctcaagcgttacggttcatacaaaaagcttaacggaggaaagattagttcggaaattgataatttaggcgttacgtaataaatgcacgctgtctaatgaattttaatgttgggaaattaaaacttcaggttttattaacccctctaccggcagcatcgtttttaccgcaagaaaaaaattcaaatcgtgataacttttttgtttctctgtatttttgcaccattttttcacaagatctcaaaaaactcttctagtttaggaatctgtgtcggtattgatgattggtgatctggttttaaagatattccaacattccttgggggaccgacattttccatacaaaatgtctgaggcggccaatttgttttacgtcaactcatcgaaaaaataaaatgtggacttcacaatgccatgtgatagggagctactctgaaaaaatcatacaaactggttaagtattctaagagatatctgaaaattacgaaatgaggtttttgtagttttcaagaactttatttggccagcgtggtaccagctacttaaatgctcattactcaaagacagctggaccaaattgctccactttttcacaacattctttcattaatgtattgttcagaagaatggatatccgaatacgataacaattctgtagcctgagatatatacgtgggttatgtttacgcgtcggtcccccaaggaatttcggaatatctctggattcagatgaccaatgatcaatgttaatacagattcttaaactagaagagatttttgagaacttgtgaaaaaatggtgcaaaaataccgggaaacaaaaaagttatcgcgatttgatttttttttcttgcggtaaaaaatgaagctgtcggtagacccggtagttgtatttcaccaaaattctactatacagattgttacacattactagtaccaataagaaggtatactaatttctcatccaaacccgtttatgccgatttcagttaacaaggatacatagtagaaaagttatgagttatgttttacatttttctttgtttagaatttttctagcgtaagcgccaattgattgaaaaatgtcactttttccaatatgcattgtagcccaaggacgaacaaataactcgcacgtaacatacgaacaaataactagctagtaacacaccataatcaggttttgttcagtagttaaaatttcattttggtatttttaaggtttcgaaaatattgtttaaaacaattaaaaatacctcatagagctattcgaaacttttaaacatttaacttttatataaaagtcggccaaatgacccaaaacctgcattttcactctggatcatttggccgaattgcatttggccgaattgcatttggccgaatgccatttggtctgacgccatttgatcgaatgtcatttggccgaattccgtttggccaaaattgataacaatagagaactaaagctagtatgcgttcgtaatgatgtcaaagaacagctatttttaagtaagataaatcatcatcgatatgcaagtaaatagctatttagtgttagttcaacaaatattcagtgctgtaataaaaacttcctaagtcttaactattattcacttctctgctaacggtaatagctgccagcataggttttcacattgcgtttgcattcagctttagacagttacttaaacggtttacgactcattcgttcttctgcaattcgcttcgatcatccaaatcgcactaagtaaattatttcatagttctagcaatcacagtgagcttctttgcgaaagtgtttaccgagtcgtttggtttactaatatacgcaagcaacggtgtagacttcagttcacacgttgcaatcttaatcttggaggagaatgacttctcacctaagttaatacttgtgctaaaaatatgttttgattaagactatttatgaatgtattataactcataatttcaataacaatgaaaaatatttttctcttgaataaacaacctattatcaaatgaagcacaatatattacaaaaaattcacttgcttaatgcaaataatcgttacatcagtataacaacaatgaaatgccgatgtaattaaaatatagctaaaaattgccaacagtaataaaaccagaacaaccctaaagaatagcctatgattggaagaaggaaaaaaaagtaagaggtcatttccgagatacgaccgccaaattcacgttggataacgtttcttctatttcctggcttgagaccgtcacgaacctatgaaagatttctactgctaaaaatccaatcaattttcacactatttgttgcatgtcaattctgacctattatggacattttgtgttattttttgttttggtgcgcttaacacttaacaatagaaccggtctatggaagaagaagcatgagcgataacttttgatcttgaaacaaatattccggttgaacgttagatccacgcacatttttggtttccgcttttccaatacacggagccaacaattacgtacgaatttcataagagaacacttgtgaattgcattcttgactgggtttccttcttccataagattcttatgaaacacaaaacgtccgataatcacaagaaattcttgtcgctgtcattagacatcactgctcgtaattcataagatttttcgtatgaaatttttacgaaaatcgtactccattagattgtcttatgaaagccaacgatcaatgcgtattattaccaaaaatagtttcctacaaaattatatctgtttatgttatgggtattatttcataagtcttttacggaatattacaaaattctcgaatgaaaaacaaaatacttcttatgtcgtaattccataagaaaatcttatgtagctcatacgttccatttcctcagtgaataacataatattatcgatatcgaggttcataagtgtgcgtatgacattgattagtaacttgtgaaaaagagtcaacttcttatcaaaaaacacgtaggaatttcatacgaatttctaatagaataaagaaataagaagcagctgatgagactcataagaaaaacttgtgaacttccttcgatcattgcgttcataatacaaatgagtgtaatatcagaagatactcttatgaaggatcatggatataaaatatggaattctttaggaccattatgtatttagagaatcgatttttaaatttaagaaaagagagatattcataagatctctaatgacaacaacaagaatttcttgtgattatcggacgttttgtgtttcataagaatcttatgaaggagcgaaaccaatagtttgttgctaataatcaatagtgttctccatttgaatcaacgcgtagataaatttccgatcgattgatggataagtattgaaaatctatcaataaatggctgggttattagcggtcaaaacctgaccatttttcgttacatgctcaatttttcgtttttttggaattgtacccccatatgttggcgaaggacgttatccaacgtaaaagcacttttattagaaaattttggcacatgagtcaaagaggctgaccgtcgtaattgttttcctgcattcagttgtttgacattttcaacattattgaaaacagacaagaaaaccatgaaaaaggatcaatacttcaattcgtctaataagcggtttattcaccaccgcttaggccttaaacctggtttaatcgtatgggtaaacgtggtttacgggttaagcgaaggtgaagaaatcggccctaaaccttataacagcaagaaaattgtgcttttctatggaatataagacatgcctcgatatttacccatttatcaatagttaagtcttaacaatcaatagttttcattattggagtcaattcgtagaaagatttccaatcgattggggcaagaaactcggaaatctatccgggcgttagtatgttattaacagtcaaaatctaaccacttttcgtgacgcgaccgattttcgtttttcgaaattgtacccccgtatgttgccgtaagacgttatccaacgtcaaaatatctgataataccatttgggttaccatccgtcctgatttagcaggacatgtcctgatttatttttcatatttaaagttttattctgctttttcttgcttagagaacaccgtggaatgtcacaaaaaagtaatagctataataatacaataaaacagcaagaatgttcaaatggcatctatttcaaaatccatgttgaattttgtggatcagaatccgacatcagcagcacataaagtaagttagcagcacataaagtttcatactgtatcacaacacctttagattcagacgattatgatgatgaaacacaagctattatttttatatattttcaaagaatgaagagatctccaaaactcgtttttttttagtttcagcatagatggtagcgactattggatcataaaactgtttcctatatttgtgcaatatttgaatgcttcgcaatgagacaatctttcctcattttgccaaagaaatataaaatgagaagttttgaatttattcatcggcatatcggtctattttgctcgaagtaagagggagcatggagaagaaagcaatgaatactagacggataggtaccgtaagggaacggcgagagaaattggattagatgttgaagagggcataccatatgaaacagtattacttgaaacgtcacttccttgtggtcgatacctttgtatgttaaataaaatgagaagggtcgtacgtttgctggcacgattgaaaatgtcctcaaaagtctcaatttgttttttttttcttttgttggtcgtattatcactgcagccttttagttgatccttcaacgcagttaatgtttataaaaatcatatgtttattctgcgcggcgtgtgaggcgaaacgagtcgaatgtggtgacaattgtcgactcgctcccacttgattagcattagtcgtctcacatcactctaagtgagagggactcgtcttgactcacacactgcacagaataagcccaagaaactacaaaattaaactaggagatcaagaatgtctgttagaatcgtgttgataaaactgtcgatttctagtgaaggtctttgccacatctctcctaatccaggcggcatttccttgaatgatcttttataaaaccccgaaaagactttgagtggatttcgattttttttttagtttctgtgcttcatatttttgatattctcaggctggtttttgacattctttgtagtttcctagcgggatctttatctgtcactaaacagatttctttgaaaataatcggtagattgctgacaagattgttgcagaatttactgaactgagtgttttgagacctcgatatattcttaaaggattcctgttcttagattccgaacgagatggttaacgtaattttaagcgacacactggcaaaatgtcttataagcggtttcttcaccatcgcttaggccttaaacctggtttaatcgtatgggtaaacgtggtttacggcttaagcgaaggtgaagaaatcggcccttagtcgtattgtcttagcaaaaggtaattatatttaagatttttactcatgcttattagaagtttttcgaaatcgtacagtcctcaacataaaaaaaaatttgtgatcgcttctgataggaatataagtcatgttgagactttgagacaaaatagaattcacacagcaaaattgcaaaatgtcctaattttgaatctccaggatatggtcaccctagacaccattggtgttattcaatactaaactgttggtaatctagagacgaattaaccattctaacctaagtctttgaagtgtacagttcacaacttcgtcctgaattaacgggtcgattttatattttatatagtgacaaacatgatgtcccgtcacataataaaaattaactaactcattgactaaccagttattgctccacacttcggccaaattgccggacaacaaacattcatgttgtattatttacccagacaaccaaaatgtacgtataacgaaatcacctggaggctttgtatgtgcaaaatttcacttataatatgttatgttcgaaaaggccttctacgtgtaaaagtggaggcgatatacgtgcatatattatgtgatgaataatagcatacaatgcgagtgtataaattttctaccgaaccaacatgtgatcttatacgacttaacttatgataacaaatgttgatttgacagctgctgcggattgattcgacttactttgtacgagtgtacggtacgaaacaaaatatacaaatgacttcagaaaaaaaggattttatgcgaggaaactcatcaatctgacgattttattcaccgtgttttgcgggtttgatgtaatttctatgaattaacgagttattacgtgaactttcatgcgacttctgctctgcccataactgcatatttgtaacattcgacaaaagtaggcattgagtaaattgaataccaagtgtgcattttatggcagtatgggaaaaaactaaaatttcaaaaaataccaggaactgaaaaggacttatttgaggctgatattttgtacaactcatatagcatattgattgaatagtcaaaaaataattctgatgaaaatttcattgctattacattacgaggctcatttataatctcaatgtgactgttttgcggttataattaccaatgtgacaaaacaacttggtatttttttcgaacaatctcacagatttcagtaaattgatcgaaattatttatcatttgttgactctccatggtattaactccaatttatcaaaaatgtcgaatgtgactgttatgcagttatgggcagtgcttgtctgggtagttattgatatcataccagtttttttcctaattaccagtttggtgtttgtagaatacgcatgagatattatttgaggtatttacctcttatgtagcgctcattcaggttgaatgtattgcaaattatctggtatgctaggagatgaatcagcctatatctgaaaataataaagataataataataatctcgtatggaataccttagtttggtattcagaagcaacttccttctgctcgagagaagctttggtctaaattggattgttaagtgatcaaaacagttttttttattactggctccaatggattcattttattttttaaaggttgatgtagtaaactatttaaaaagttttcatctacaaatttgccagagtgcgaaactttctaaattgatttttttttattttcatagtatcatagtaaacattactttcatttcttacgtcttggcgttctgtgttagacaacactattatctttatttggtaaaacaaagcttctattaattttcgaaaatttttacagatggggtgatttcgcctgcttataagagaaaaaaaataaagtaaaacgtatttatgcgaaatggttctcttacttgtggaggaaaccgagatactgacttgttctacgctgattcttgtaaaattacgactggtgtgatcgaaactttttgtgaattgaacaatatttagtttaatgtgatggaaaataagtcacttgtaacctgttttacattttaatatgacgggcacatatggcgtatattttcatatttttttcttagtgtgtagtgaattaattttcagatataatgagttttgggtttgtatttctatcagaactctcacacataggtacctttcaatttataattgtccaaggaatggaattgagattcaaatctatgcggtaaatttcaacatgcaactatcaagagaatccactaaagatttcgtgacatataccaaggattttttacatgcaccttctaaacttaacgttgtaagaaagtagtcggaacatttcatgttacgagatttgtaatttttctttagtgattttaactgacagtcaatgaaacactgtattgcagactgacccaattccattgcagaagccttgaattccacgaagaaaacataacgcgagaaattattccacgtcgttccaacaacaaaattatattccacaagtttttcaattagaactttggtgccaaatgtccgtttcttacagctcttaagtgcatagtaatttgacaagttcacacaactagaacaaaaggaaactcacccactacatcgattccgcagtcctgtcttccgaaaacttttcgacctgctttcgaaagcatccctaaagagggggtaaaatttactcgcaatcatcacgacccacttacctatcaactgattcgggtcgccttttgttctacagcagagtgcctagcactcatcttcagtgaagtgaaattgaacccccgacacctcggtaggtgagagtaaattggattttgaagaacaatcgagctatgacgcggtcggtcggtatgatggtatgtttgaatgtggaatttgcttttgcgagttcgaagtagaatattcaaaatttgatagcacccaattcgtgacactattctagtgagcaaatggtaattggatagagcttgtcgtaccgtcggacgaaacgcttcaaaatttgaataggttttcttcacaagtctcataagcctggaatcgcatgaatttaatatctttgtggaatcatttgtctcacctaatcccatttgcatttgcatgcagttcactgttcacagaaggaaatactgatattcaacagaggttctcaacttctaagatgtacaacatgaactagcgtgttccaaaatttaacctcaacagaaaacttcagggaaccttttaactgtatagctaagggtgttataaacgaacttttgtatgtgggaaatggcggaattgaaaggcacaattttaaaatctactttttttattctctttattgagtttctgctgagagggttcgtatacgtaaaagaatccagattggaggttgagtaccaacggattgaaattttaggacaccctagtataaaggcttttgttaattatatgttttcgaatcagttatcggtaaatttacaaataatttatccttattcataataagagtttgtttcgcatcagaagttgatcggcaaacgctgtttatttgcatccttggtccgagtagccagtaagccccaaaatttgaataaacgtttgcattgcaaatgtttatcttccatctcacaccccatcaccagagaatgcaacccccttcacagtatgtctccatagtttatctgcaatcgcagaacttccccagagctgcacctcgtttttgtgcaacattatcctctaacattcatccatttgccccgcccaaacagatcaaccaagtcggagaagatgtacccgtcgatgctgagccggggaccggacgtggaaatagagccgtactactgcctgccggtgggaaccgtgaccggtggcagcaatgggatggtcccctggagtcaaccgacctcgcccacaccgccggcacgtggcttcggaggattgctatcgcccacgcacaccaacgcttcccacaggctcacctacccgaaaaagaacgatgaaggtgagtttttctcatttgcatcccctcatagcatgtaggtgtatggaggttccaatataaaaaaaaaacattgaaaatctctccttacaatcctgttaacttcttttaacatatgagccattttgttaaagttttaaatgttccccaaagacatttaaagattaaatgaagatgtacgaaaataatctaaaatcgatttttcaagcactaagttagtaaccaaatgctgtttttccttacaaaatgtctaagtttggggctttgtaatcttttttttgtaatttttgtaatttgaaccaccctagtgagtcattattcgcctccccctgggggtgcacggtatcatttcctctttggggcatcgttagtaaaactttttctacttttcgtctgattgtttttttttccttctatttcgaatagtgcacggaagccaagcttcgctcttgtccggtggttcgtccctgtacggatcaactgaggagcggcaagcaacggaagttcggcgcctgaaacgagaactcatcgacgcccgggaccaggtgatgagcctctccagccagctgtcaactaatgtgagtatcctgtggagatttattttaatagcagatttgtttctgtgttactcttttctaattagtttgaggtggtcgtttgcttcgtgattcgagggatgtagtattccgaaaaaaaaaagcaaaaaaatgtagagtttaaccttgaactttcaactcttttaaccaggagtgctattcacagtgttttaaattaattccagaaactaatgcaaagaagcacgcaaactgattgctatcattcggtttgttccgagaagctttcgaataagcagtattgcatacatagggacggtaattcaacaaatggtagagcatcagttacacattactatcatccaatggataaaaatacatcaatgtcttcctttttcgtcatgtctagacgtctgggtcggcccgagggatgatttcacctgaagcaataaataaacacaattaaggtagatgttagtgatgaacaaattaaagtagctagacatctatccgagagaaagtattacgcaaaattttcccagttgtctccaactggggattttttctttattaccgtacgggtttgggccgaagggtctcagattttcatgaaactttttccacaagcagggctcatggatatatgaataaaaaaaaattgagaaaaattcagggtcgcctatttttccggaaaactcaggtggaatttttttgttttcccttgacac

SEQ ID NO: 87 - DNA, 73551 bp, Aedes aegypti
  misc_feature (12153)..(12252): n is a, c, g, or t
ccctataactgccttcggcgcaaaatggcgcagacaactgttacaaatcatgaaagtaccatatcttccttttcggcagatgatgaaaacattcgtatatcagcgtatatagcgtcttttcatgggttcttgctattgaacaaataagccttaataaaacgatttctactgataattcctttactttaagagatagagaggtgcgatgttcagcaaaaacacgcgttctaagatatctaacaactttgtagaagacatgaaaaatgttaaaaatcttagtaaaaagttatgaacaataatgattttgaacgattttatcatacagctttatgtacattctgttaaaaaaatcgtaactcttgtttaacattgtgacagcatcgctgttctttcttacacacaagcctacgatggcgctatctttgcatttcatagcggccgttttggttatattaatgaataatttaccacggtttaatataggacgctcattttcaagagctaacgcttgacacaaggggcttgtcagcacgcgctgtatgtggattatttggtgtggtctctcaccaatatggcactcagtctatgctgacagatgtactaaaaacaatattgcgatggaaaaaatgttacatggaaagtgtcggtttcctaaggaatatcggaaaatctctataaccagatcaccaatcatcagaattcacaaacagcagagtgctttaagaatttgcgaaaaatggtgcgaccatattttaaaaataattaaaaacattatcgttttttgaatattttttgtggtaaaaacaaattctgccggtagagaggttaagaaaagatcgaaatatctgatcaatgttaccccggattaaggtattgtgtttgatcaataagtataagacactaacagctgatattataatttctcaagcacattcgcatggagacaaaatcatcaaactaacataaatattcctcagatatcaatttacatgtatttccataaatatgcgactggccttgttgtttacaaatttcaagtaggagagaaagagggagaatgatttttgagcagagccctatagagtgacgaaatagaaatacaataattaggctaataatagaacttcctccaaagatttcatttacatattcccctgaaaaagctgagggtgttattgattgtctttgttatagtggttttttgcgcttggcgagttcgctgtgcggtgtttcctaagctttgattatgattatgattcaacttagatttaagagttcgatactttgtttaactggacttgaaatactggtaagtcagctttttcgttcgaaattgccgatgttcgttactgacttacgatagttgtcatcactgaacataggttatatttaggctttaccggaaattggactaaaatcagtgcaattaaataccgaaatttcagtatttactattttgtactgaagagtcgtttaaaccaaatgcaaacatgtaggtaactgtcaaccagaagaaactatgctacaaaaatgcaatggcgcgttgaaccgatttctactcggcagtagagatttgcctcctaatcaggaggtagaattactcggaaaacttctcttttttgttagaatggcagtatgtaggtaagataagtaattgaaaacctgataggaattgtctccagagttgctgcaaaattagattatcctcttcaacacagtatttttggcggtttcgtgcagttctagtttaattcttacatacttgtaatattatgtcactggtagtaactgaccattatttcgaacttttatagttgaatgatctactttttaaaacataaatgaaagaaaacgtctttttaaggatttccccaaaggaaattttccgagagctgcactgctcatattcgcatagttgacgtaagcgccaatatgaccaaaatgcactttttcatttatatgcattctttacctaataaaacactggttggacatgtgaacagcgcacagtggttcccctataggtcataaatgcaaaaaaaacgattttaatgaaatcgtgatatttgttcaatgatcttcttctttctggcattacgtcccaactgggacaaagcctgcttctcagattagtgttcttatgagcatttccacagttattaactgagagctttctttgccgattgaccatttttgcattatcgtgtggcaggtacgaagatactctatgccctgggaatcgagaaaatttcctttacgaaaagatcctcgaccagcgggattcgaacccacgaccctcagcatggccatgctgaaaagctgcgcgttcaccgctacggctatctaggccccaatgatatcatgttaaaaacttatagaacaaggttccgtaatcatttttgctgaacatttgcttttacgtttctatatggatcatttaagtgagatgagttaagtggagatatagatcataaaaaaataaacatttttaacactttcattacgctatcagaaatgttgacgatactttacaagtaccgccgtgcggggtgacattgggcctagggggtgactttgaccgcctctttcgatgcttctcatggctagtaggttcaccgaatagctaatctatggccatctattggctatttgtaatgtattctcgaatcttgacacattgttttcattattctggcattagcttgctgtaaaaatgttggcccaaagtcacccttatggaccaatgtcaccccgcacgacggtacgctatcaatggcactggttttcaataatgttgttcgatctgagtgaaaataaaattaagatttgcatattttgtttggaaactacatcgctgatatacagccttgatttgaaaaaaaaaagctcgaaattctgaatacattcgctaagccgaaaataatgtttcccctcctatggggcccagatagccgtagcggtaaacgcgcagctgttcagcatgaccaagctgagggtcgtgggttcgaatcccaccggtcgaggatcttttcgggttggaaattttctcgacttcccagggcatagagtatcttcgtacctgccacacgatatacacatgcaaaaatggtcattggcatagtaagctctcagttaaaaactgtggaagtgctcataagaacactaagctgagaagcaggctctgtcccagtggggacgtaacgccagaaagaagaagaatgtttcccctccaaatcccctcgtgcgttgttctatgaaacttaattatgtatttcctgctgagagttcgactgtattttcaatgattgatgacatatcggcaacgctgtcttttctgttaaaaacgagttttattatttaacccgacgtttcgacgctggtatggcgtcttcttcaggggaaactgtaattattttattgtttacataaggctttagtgttaaattaagacaattacttacaatcatagagaggtggcgggaaattgatacaaacatcaatttggacatgtttcttgagattgttgagctttgtatggaagccagttacttttgcttcgagggtcagtttttcattcaaacatatggaacagccatgggaagtccactatctccgattctagctgacatcgtattagattcagtaattagcagagctatgagcactctatctttcgagtctcctatatttagaaaatatgtggatgatatcttcatggttatcccacagcatgctatccaacaagtgctcgatgcattaaacgcaatagaaccgaggctgcaattcaccttagaggttgaaaaggatgggagattaccatttctggacatgacggtaatacgcaatgaacaccaagaactatcaaccgaatggtacacaaaaccaatagcgtctggaagaatgctcaactatcattccttccaccaacccagatacaaaattaatgttgcaaataactttattcatagagtgttcacattgacctcccatcaatcagatgaagaaatagtcgcaaccataaagaagcatttaagaatgaacaactaccctaaacagctgatcaaccgcctcatccagctttatactagcaaacaatccaacagtaattccgccctgtccgccaaccctcctacgatgcccaatcttcgaccaccgttttctcaacccactgcgcctccacccgccaccgagccaaataatcatccgccgtatccgtcgacctcaagctgtccaggaatccaacaaagtccatcgcctcaccaacaacccaatacgactcctccaggaaacagactctcatcgcaacaaacaccaaacgaaacaatccaggaccacattgaagaaccgattcataatatcagcaatccagaacatcattccgaaagcacatcgtccgaaagaaacgaatttgacaacacaactagcatccagcagataattccatcagagcagaagatgtaccgttccatcccgtatgttccatcgctatcagaacgcatcacctaaatcttgagcaaagattatcctaatatagcaatagccaccagacagatccgtaccataaaagcaatccacagcaaagtaaaatttcctgtaagtaaagaagaacaaagtaacatcatctacaaaattccttgcaacaactgcgaaggttgttacataggaatgaccaaaaataatctacgtaaacgactagcaggacataaatcaaacatcaacaaactagacagattgttaaattcacaccacacagacacagcagtaacagctttatcagaaaccacaacagctttaataacacatagtgtagaaagatgtcacacattcaatctagaccacacaaagatcatagaccatagttataaaaccaatacactgcctttcttggaaatgtgccacatatctaacacagacaacacagtcaacaaacgtacagatgtagaaggattgaacactacatatgcagccttacttcatagtattaagaattttacccactgcgaaattagacgagattgatagaaggaaataattcacactgagaaatgtttcatgcaagagaaaaccgttgcaacaaataacagtgaaggtccaactaagaattctacagataaagcgcgcaaattgtttcgaaaaatagcttgaaatatcctaaagttcattgcaattgagtgtaagtttatttaaaagttcatcagtgattctcaaacgaaaaataacgatctttcgccaaatttacagcatgtactaaaaattattacacttgacagttaaagttagccacaaccctagacacaaaacgaacgtatcattgtaagtaattgtcttaatttaacactaaagccttatgtaaacaataaaataattacagtttcccctgaagaagacgccataccagcgtcgaaacgtcgggttaaataataaaactcgtttttaacagaaaagactgcgttgccgatatgtcatcaatccttaattatgtatttatattacattttgcacataaatgcagctgcgaccgttcgcgatcagattggtggtaaccgcttaagtgtcgtatatccaatttaccaaaacataacttggttaacaactaacggtagctatcaagtatactaattttgagtttcaaatgtatagcatagtaggctgttcaacaatatatgtataaagtcttaagtgtactgcttttgcgactatgttcactcttctggtacatgtaagtaaataaagctgaaaccatgtcaaaatcattcaagtcaatatgtggaggggaagggggtgaaaaccttagtacctccccctcttatcataataaatgctttgcatgtagaacacgactacgtttcaaatagcatgaatttgccaacattcgtatttatgaccgccctcctaagggacgaatgaccttcgggttaaagtccctctcaaacaacaacaacaaccgccctcctatgaagctggaaccactgtgcagcgcttatttattctgaaatatttgaactataagagaaaaacggattgacatgagcacatacaccaactcatccaaagaaatacccggtttgtaaagtgtttattcttatagtttagcgtataaaccaagttgctgacagtgacctggtgtttacatcaatttttccatataatcgttcatcaaactcactgaatggacgaataaaacgacgtatgcgtttgcagattacaaaagtaagaaaactttatgcaatagcgtttgatagcaaagcagtattgagttctgtttgatccttcgaccttgacgcttgcttctgcgggggcgagcgacgagggcaggatcaaacatgtcgcgcgtcggtctagtagcttagcttagctttgattagactgcctacacatatcaatggttgccgaatgcaccgaagtcagtgaaaatgcacaaagaatcaactagaagttcggctgggattggccataatcttcttcagtgtgcataattcagtgcctctttttatacagggtcaataacggcaccggccacgtccttgcagtcaggtgggtttgggggaaggaatgttagtgtgtaacctttgctatttggagaccgtgtttgcctctgcatcaccacaaaggatactgggagggatgtttgttaatgggaaggatcgttgggacaccatctttacaggcttgttgtccggccttcttgcaacatgccctgcccagcgtatccttctagctttagctaccttcacgatactgggttcaccgtagagttgagcgagctcgtggttcatccttcgctgccacacgccgttctcctgcacgtcgccgaagatcgtccttagcattcggcgttcgaaaaccccaagagcttgcaagtcctcctcgagcctagtccacgtctcatgcccgtagatgactaccggtcttatgagcgttttgtacatcgtgcatttggtgcgggggtaaatcttgcctgaccgctgtttcttgtggagcccatagtaggcacgacttccactgatgagcgccttcgtgtttcctgactaacgttattgtcagtcgtcaacaaggatccgaggtagacgaacacgcccaccacctcgtaggtatccccgtctatcgtgacactgcttcctaggcgggttctgtcgcgctcaattccgcctaccagcatgtactttgtttttgacgcattcactattagcccgactcttgttgcttcgcgtttaaggcgggtgagcaaatctgccactatttcagtttttctcctaataatgtccatgtcgtccgcgaagcaaacaaaaaatcgtgaaaaacgtgccttgacttttaattccggctctccgcatggcactttcaagcgcaatattgaacaacaggcacgaaagtccatcaccctgtcgtagtccccgccgagactcgaacgaactggagtgttcgcccgagatcttcacgcagttttgtacaccgtccttcgttgctctaatcaatcttgtgagcttcccgggaaagctgttctcgtccatgatcttccatagctctacacggtcgatactatcatatgccgccttgaaatcgatgaacagatcgtgcgtagggacctggctgacgtagccatcgctttcgctgtcctgaccttctgtgcctgtcttctctgcgccattcaggtgttcatcgtagtgctgcttccatctttcgatcacctcgcgtccgtccgtcaagatgctcccatctttatcccggtacagctcagctcacggctcaaagcctttgcgggatgtgttgagctactgatagaacttccgcgtttcttgagaacggtacagcaactccatctcttggcattccacctcttccaggctgcgctttttgtaccggaataggcgggtttgctgtttccgcttcagtctgtatcgttccacgttttgccgcgtaccatgctgcagcattgcagcccaccctgcattcttctcctctaaaacctcctggcacttctcgtcgagccaatcgtttcttgagctccgttccacatatctgacaatgctttcggcagcgtcgttgacggctgctttgactgtcctccagcagtcctcaagaggggccctatcgagctcgccctcatccggcaacgctgcctcaaaatgctgcgcgtacgcattggcgacatccggttgtttcagccgctcaagattgtatccggtgggcgtcggtaccgtacatcattgataacggatagttttgtgcgcagtttcaccatcaccaggtagtggtcggagtcaatgttaacgccacgataggttctgacgtcggttatgtcggagaagtgcccgatggacggcatcaaatcgtggtagatttgcgattttgtctgctgaggtgatctccaggtgtaccaatacgggaggctgtgctggaaataggtgcttcgaatggccatattcttggagttggcaaaatctatcagtcgtaggctgttctcgttcgtcaaccggtgggcgatgaattttccaatcgtcggtctgaactcctcctcctggccaaccggagcgttcaaatctcctatgatgatcttgacgtcgtgactggggcagcggtcgtactcgcgttcgagctacgcgtaaaatgcgtccttgtcatcatcagtgcttccagagtgtgggctatgcgcgttgattatgctgaagttaaagaatcggcctttgattcttaacttgcacattctttcgttgatcggccaccacccgatcacgcgcctttgcatatcatccatcactataaaagctgtgcccagctcacgtgtgttgccgcagctctggtagatggtatgattacctctaaacgttcgtatcatagaacctgtccagcacacctcctgcagcgctacgatgccgaaaccacggatctgcagtacatcggagagtatgcgtgtgcttccgataaagttgatagatttgcagttccacgtaccgagtttccaatcgctagtccatttccgtcgctgtggtctttgccaattgttccgatccgtattctctcattgacgttcctgtgtttttacggttggctttcagggcctgacaccaaccccctagattgccggagtaccattccccctaaatgttcggaggaccatagtgcgcagtttagcttagagtccttctctggcactcggacgatgaccagccgcttctgacaaggggaacagacgctgttgtgagccgctcctaacatggagtacagacgctcaaggtttgcagaagcaaaagcaaacccccccttccctgtctgcatacgaccaaagttcccaccgggggttggttacccggacaggagctgctgggcaagaggccaaagactgcacaaatgggtctattttattcctgcagatattctcggagtagttgtaagaattaattctaaaatgctagaaatgactaaaaaaattacagaaaacaatattcaattaatgtttacagcttttctcaattatatctctgaaagaacttttagagaagtcctaagatgtatttcattaaaaatctttaatgaaatttctttgcagagatccttaataatattatacggtagaaaatattgtatggtagaaaaaaatattaggagcaatttctaaaacaatatcttgacgatgcatgagcgtgttatatcctgtgtcaatgcttgacgacactaaccacacggccacgaagctcattataatatggacttttccaaaccgttaatggacataccattcagaaaaaaatggatctagatgggttttgagctctacattgccaactgtgaatgaaaatcaaggatgaatgtcgttcatagtttaacgtttcatgcaataagggtgcaaagattgtgtataatgatcgtttatgtgtgaatttcgtgaatgaacttttatgatcgcttcgcggaagtcatggctacgcccatgtacacacaactgggtggtttataccagatactccaatttcaagcaagcaaacaaagacatagtgggagattccccagtaccggacacctaaagtcgataaattcctaattccaaatttattggttttatgcgatcatatttcctatttatgatacatattattaactcagtatgtatgtatgtatgtatgtaggtagccaccatcctagcttgagtcttgctctgcatgcggttccacttaacagtacagtcaattttcattatcaatctgaattcaacataccattgtatgaagggccaaaatggggtgtggcggacccgtaagcagagacacttacgcgaaacccgcgggaaatagagaatctccttccaataatatgatccaacggaaagtataatgaaatttgcaatacctgtcaagttatccacgggatggtttgttataagaagggcgcgtcaaatctattacaactgttgggatagaagaacccatctacaaggatgttacggttacttcaacccgtgactccggctggcactccactccattgtccagctgtaacttcaatgatgccctgatgcaccctcccaatatcacccattatatgattcagttaaatgattgttatgtaataaaatgaaatacaataaaagtataaagtataaaatatataagaaatcatgcaataactcgatgatttgaactagaatcgttgaatgaaagatgattaatattaaataaataatgacaatcgttccaacaagcctgaataaaaaaaacaatgacaatgtttataataaacgacggcttcctgcaattatctattgctgatgtattctaaaaaatacatgaattaaaaatatcgtttgcaggtcctgtatctgtaatcaatttttgaattaatgttcaaaattagcaacttagcccatggctgccattcttacatataattatgatttgcaatcgaatcataaaatttagtgaagtgcgaactcgattttgaaagaatgaatccatgaacagtaaatataatgacaaagatccccgaataaaaatcaataagttgtaatatgcggttaaggtactgacatcgtggtggtgacaatctcagcaatgacctaactttgcgatgatgttacccgacaacattcttcgagaagaaatatcttcaccgcgagtcgtttaaaaagaaaatgaacttctgcacgaagaaccagagaacattcggtcactggatgttgctggattttcttttgggtttactgcctacctttggaaagagtacgaaggaaaatctaaagtaaaagaaatattttggataagtcaattaacatttacaatcaataacatcaaaggcgcatttttttccgggacagccagctgaaaaaaatgaatactatgaatacatatagccaccatccgtcaaatctattgcaagtgttggagatatgcacccatcaacacggatgttacaacgcattcccctagactccggctggcactccactccatcgtatagctgcaacttcaatgatgccctggtgcaccctcccaatacccagcaatgaaatgaaataattataatgaaatatacaaaaaatggaaattatagttatggataaagatgttcatttttggatgttatgaattcaacttcattccctaagaaagacatgctgaaatatgaagagcagcgattaagttagtatctcctatttgcagactcattatgcgccagtgattaatgttaaattaatgaattagtgttgtaatttacggacgacctattcctgggattttttcttgaaatatataagagaaagttacagtttcaataaccaaatattcgaatagttcaatttgcctcaaaaacacagctctcaaaaaaaaaaaaaaaaaaaaaaaaaaaaaaaaaaaaaaaaaaaaaaaaaaaaaaaaaaaaaaaaaaaaaaaaaaaaccctggtccccgttttggggttaaaaaaggggtaaaccaacggggaaatttcaatttttaaccaacttccccggggggtaacccatttttcaagggcaaaaggggggacaggttttttttttttttttttttttttttttttttttttttttttttttttttttttttttatttattttttttttcgagagagcggtgtgtgtgagagacaaatagaactctatgtatatgttgagtcacacactgtctctctctcatatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcgaagtgactcgcgacgcggcgaagttggtcaaaaatcgagcttcgcacgttggttcatccattcttagtcgcgaagcagtataaatattttacatgttacaaactcgtcagttgttagactggtgtagagtaaaacacgatccctgataacttctacacattgttcgaaacaagttgcaagcctgctcacacttaaaattaatctgcatcactgaacatacactacacaatgttagaaataatggttgatgttgaacgaggctgaaacatatatcattagcaaaaacaggttttatgatacagtggccgttcgatttggaaaacacttctaataatttaatgttgccaaaatcgaaaggtctcctccaatctatagtacaatgatcggttttgttatcctacagcaataatttttaacaaaaaataaaaaaatattaataaataatgctataatatgaataattttggataaccttgccgaaatccaaatctggaactgtcactgtatttactttcatttgcgttgaatatatacaagaaccacttttagtatttaaaagcatagtggttttcacgctcaatggtatgggtgccttagtgtagatgtatatgtgaaccttagaggaaaacaatatgcactctgtctcgaaaaacacccagaacccgggtatattttttgcaaattgggtaatatttccatatgtattttgatgagtctggaaagcgtgtgcaagtttcttcgaggaaaacaaaaacaaactgtgtatgacgaccgtatgctagtctacgtgtgttcaaatgtcactaagctctatagaacccttacccatacccataaaaaaacacaaaaaatttgtacgaattgtaatacatgacgagcccactcctcttactcagagggaggtgaacttccacccaacactgcctctgccatgagtaaaattacttctagtaccgtgatgaataaaagaacactataaacaatctatctcctaattactccaacaaacttggtgagtgttttctttcaagcgtgcacgcagataaaccgcctgtaaccaccagagcatgtgtgggaaaggaacataattatctacctctctcagccttttacacacgacacctaacataaagagatgcaagagaataaagactacaaaagggataacaaagaacaataagtcaaaaggagagaacagaaggcaatctcggattgcgtggacattaactaaacacactccgtagcgttataagatgtcattgcttacgaaagtaaacaaataatcccatgggatcttgttgcaacacacattcctaaattcttccaacccaagtcatgtttattcactcgccccacatgaacgtccaacatacatttcaccaccaccgctagcttcaattccaataagaagagtgaatggctggcacgtacacatgcttctgcgtatgacaagcaaagggaccgtccataaatgacgtagcattttatgggggaggggggagtctacgattttgctatggaccatgtattaggtatgggaaaataggctacgaggggggagggggtgtcaaaaattggccaaaaaatgctacgtcatttatggatggtcccaaaatgaaaaagaaagctcaacatgtgagcagttcagcgctactttttcaacatcatcgtttcccttccccctcatccacatcaccataatttgcatcggcaagctcgcatagcagaccgacattaatgctgaaagtcaatttcatttcacaactgttgaaaaaagtttactacttctcctgccatcgaccaacgttgacacaacatcacaatatatctctcacgaagccggaacttttccatcgttgtcgtcttcttcaggtcacttgtttgttcagccactagacagcatgctcttcgccattttttaaacattctcaagttgaaaaacacttcctatctacgtaataagccaaatttcactaagactccaattgtttgtcactgaaccattgctgttttacactaaaacacaactcctggtaattaattactgcaaaatcacttattttccaagtaaatatgcacagcgcaactttcacgccgtcttttctcggcaaggttgccagtgggacctgatacatattattaactcagtagcgtgcaaaaatcaatttgaaaatatgtataacaattttgaaatttaattttgattatgcattttagtatcaaattgataaatctttgaaggtggcctccaataccgtattgtatcaagaaacggctcgatttctttagatgtgtatatcattgaatgttttaactccaataacagtaattcaacaaaaattcaaagcaatcagagcattcatatgaataatttgagttctatttggcctgcagaacgtccatccaaaaatctctcttgatgagaaattgcactatttttttatcggttttcaaacatacctacttttcagaaagagatgcatattacaaggttgctacgcaaaatgttgctctctataatagtttccttttgttctgatcaccatgattggatcatggtttaacatttttcgattatgtccgttattgggtgctgtccggtactgggggatctcctcctatttctattcgaatgtatatggcgtaagtgtcatttcttaatgattataacaggcatattaattatcgcgaaacaacttgcaatctgtcgagttccaaagttgaatactcgtttacaatcgatagccttgagggcacaagggtgaggtgagtattatttgcgttacgtattaatttatttttattttctacttagacagcttaaagaacacccatgtacacttgaaccaagcatgatgtcattttgttgattatagctttagtacttttactccataacccacaatataacacagtgtatggtaatcgtgcatactatatacaattttgtttatttggaaatattgtttattttttgacatggtattgtcgattgtttcacaatgtttattatataatatacatacactccctgtccaaaagtgtgggtccatcccctcaaaaacatacaaatgtaattcgtccatacctctgtaattacacgtctaattgaaactctttatggcgaattcgaatggttaataatgagtaatggggtaatcatactgtgtaggttttatgacataaacattttttgagacctgtttaccaaatttttactcaaagttgtaacatttaaaaaacacactgcaataatcattgataattttctcaacattggataacgaaaattttaaatcaatgccttattagcaccattatattatattcctgaaacagcaaatgcgaaattttggcggaaaaatctgaagtttttatatttatatatgtgccagaaaccgttattaacacaaaaaaatgttcaagaatgtggcacctaccattcaaaagatatagcattcaagcatatttgaaaatattctaacgagggaatcgaaagttattgttatttgaaggttttgagctattttgcaagggatattcacatgcttcaaaatattccccaacggtgcatcattattatttttgtaaaccaaccaagtaaccatcagcttttcatttagcattataaacatgtgatacccaagcatcttctctgcaaatttgaaattatttcgtcgagaaaatcagaagttacagtgatttgtatatttacgattatttctatgaagtttgtattggagcttatttatatggctttgttttaaaattgtacataatttgcaaataaaaatctcaaaaattagcaatgttgttcagtgtgtttatttttaatgtcacaactaaaagtagaaatttagtgaacaaacttcaaataatctttatgtcgaaatacctaattcattgttatttgaatacgccataaagagtttcaattgatcgtgtaacataacatgttctgcacgagttaagattttatatatttttgttgaaaatttatttggatttgctagagaacatttgacaacaaattgtgaatagagaacatttgacaaaatcatggagagacaaaagacttataactttttaagtgttttcaatagaaatttaaataccgaatttcagatttaaggtacaataggggaagtatattaaccagtggaataagtagatcatttgttcgacttaagtacccgaggaggaaaaaataactccccaacaactaatgcatgccatattttggtatcataccaaaattaggtattgttcagttgtcaatacctaaatttggtattataatagtattggaaaaaatctttaaaacaatttaaaatacttcattgatgtattgaacagctattgaggtctgtaggaggtattgaactactattgaaaaatttcacttgtatatgaaaatccatcaagtaatattgaggtattacaatacctgatctaattatcagtttggtgttcgtagaatatgcttgagatattatttgaggtattttacctcttatgcagggctaattcatacctcattcaggttgtaggtattggaaatcaactgcaaaactggtgctacatgtgcactaacacaaccaaactagttaactgcaaaaatcaactcatttcataattgttttctgtcaattaaaaatccattatatctctgcttaaaatcgaatattcagttcttattaaatgaatcgcaatggaaaaatgtgatttttataaataaatataaatacattggacgcagtacacttccatggtacttaagatggggtaagtggatcaagtattgttatcatatacaggtatgttccgttttcatcaacacgatcggcaattttcagttgacaaaaacggaaccctgacaaaaacggaataattttcttagacaaaatattttacaaattttaaaataaaattgcagttttacctggataatacacaatttcatcataataatggacagtattgatgtttaagagctgtgattagcaataagatttttcattcgcataagttcgtaaattaggtcgattgaagactctaatcaataaatatgataaattaatgtgatatatcagtaatagtttaagttctctttgttagaatttaaatgtatgaaatatggaataataaaacgataatcacataaatgtgttttgcatcgtgagataggacatatttgtaaaaatagctacaaggaagtgggtcacgctgatcaatgttttttttttcaagaaagatttaacaagaaataacttttttttcttatctttatcattattcttctgcttcttattcttctttatggtattacattccaactgaggaagagcctttttttcagcttactgtttttataaacacttccgtagttatcaactgagagtttttttttgccatggtacattttttgcatttttgacaaccgattagcgattaaatgtggggttatgttgcaaaagttttgcaagcttaagaatatttatggtttcctgtgctttggattgtcaaaatatattctgtaaaatgattgtggtgatttttcttctaatgttatcagtaccaactaagactgggatgcactaatcgccattctagaacagtgcttcatcttttagctttgcgttagatcacgaaggctaccactaaactaatctcaagttctagtgctttctttagtaaaacaatattgaataggtttatcaaaaacacaaaagtgtacaaactccagaagaagcataacaaaattaaaactttttggttagaatttcttttgttaagttttaagaataagcgtatggcagttggtataagctcttaattaaacttttgctctacgcgtaaaaaagaggcgcgtatctactcaaagatcaagatcccaacaaatttgaaataggaaagtgcttgacgtgggaccatccagtatcaaaagtttctcaaattatcttccttgatgcaaactaattgtatagagattccaaatatttcaatagattgttaagttttgctggaccttttcccctatccttgcaacaggacctaatcaatggctgttgctacaatctgtgcaatgttatagaatttgagagataaaagatatgtaatgtaccaaatatgacggggtcgatagtcttatcaaaaataaaatgtactcgatcatgtcccttgcaattactaaaacattctcgatctaattctcaggtacatccctgacccttataacaaagaactgataactcattgatatatgtctatcacattcacatcgaaaattctattatgccatgttaagaaaaaggagagatctcaacaactctcttaagtacgtatcacaaattccagttgttgctagcaggcttgataatactccacaacatcatcagagttataaaatagcgtaatgcttttgcctctttgcgagggagcgaaaaaaaaataaacagagaagcaacgacaaattaacgaggaagttgcagaacagagcaaaataccaaagagtgccatcacaactccgcgaggactgtcttgttcgggcggcagactcaagagttcttttaaagtgtgagtaagtgtgagcatagcaacaaaagagaaaaagtaccaggaaaaatcctcgtattttttgcactctcactcgaatcgtttgaggatctgtgttgaatcatcaagatctgtgttaaaaccttaaaattgcttcatttttatatcgcagaggagttctgtcaagcctggttgcaaggacgtggtcagagcaacactcaactgttgaaagatgcgtcaatcttgtccaacattccatgctaagtttgaaaactctaattgaatttatttatttcatgtcgtcaatcagaagtagaccattttgttacaattttacacttaatattatatagtttgaaaacgttattttcttaatctagttcgaattttgatatgacataaatttttgttttagttccgatttcgtcatagtaaagtcaatggtttcgcaatgtttattgtaaacagacattatttgatttaaaggctcaaatttggcataatttgtgcggtgatggtttgtataaaaaatactacgacttcgcagttgtcttgaaggagcataaaaatttaatttagataaaagtgtcatcgagtcaatacgatgcgaaactatatcgtttacgaacgagaccattgcaaattcgcgacgtttcttcaatgtttgaatattgcatgcatcgtgcttcataagatggtagaggtaaccttgtccaacctaattttcgaagtgcgaacaacagaaattgtttttgaactgattctatacgattttcatgggttgatgaaaatggtgaccaaactatgctacagtattctgaaattgaacgcacataggttatgtataatgtttttatagtgtatggatcgtgaaaattatagctaaatcgttttataaatgctaacatcttgtttgccttgttgataattgtattatagtgatctatgaaagtaactttggaatctaaaatcactcctaaatctcttattcttacgcatttttctactagttgattccctaggtagactgttgtgttaggtatactacgctttctgctaaaggatattgaattacattttttcacgttcaattgaaggaggcttttattgcaccatttgtaaaacatatcaatttcattttgaaaagtatgtatatcttcatcgtttactatttcaagaaacagtttcatgtcatcagcatatatgagagctttcacttttttcagaatgaaggaaatgtcgttaacgtataaaataaagaataatggccctaaatgagacccttgaggaactcccgatgtaactttaattggaatagattttactcctttgtatctaactatttgttgacgattagtaagataagactctacccatttaagaaggtccggttgaaatcctattttttctaacttaaaaagcaacattggtatgtcaatgcgatcgaaagctttactgaaatctgtatagagagcttccacgtgattaccattatccatggctgtcaaagaataatgaatgaactccagcaagtttgtgcatgttgagcgtcccttaaaaaaaccatgctgagtatgagttattctgtttttaaccatatcgaataaaattttatttattattgcctcgaaaatctttggaatacaagagataatggctatcccacgataattacgtatgtcagattttttgccacttttaaagatcggcactaaaaatgagcttttccatgtttcagggaaactacctgattgcagagacatattgtagagccaaaatagcggagatgcaagttcgattgataacattttcaaaaatacaggtggaatcccgtcaggtccagcacctttggagacatctagactttttagtgcatctacaatatcatgtacattgatttgattgacgcaaatgtcatttgggatttccggaagaaatgagaaatattcacgatctcgattattttccgaataagtagtgtaaacgtcttgaaaaaatgttgcaaacagattgcagctttcttcagggttcacaccaattttatcatcaaggtgcatttcagatggaaagttgttagatttggtttttgttttaacgtaattaaagaaatttttagggcatgatttcaattcacgctcagttcgttcattatactcttcaaatgcggtatcaatggcaagatttaattgatcgcaaatattcaaatagttaattaaatttgcatcatttttacatttgttgtatgttttatgtgccttttgcttacgattctttaaatttttgatttctctactaaaccatataggatactttgagttatgattccttcttctttttattaagggtatatcgtcgtgtattatgtcgtttaaaattttgtaaaactttttaacggcggattcaacattttcttcgtttcttaacacattttgccaacttacttgattgattttctgtcttatattgtcataatttgctgaacgataatcatgaacttcttcaaagtcgcaatctttaggtctgttatttccatgcacgaataaagaaaactcaatagctgtatgaaaaagttcgtttttccataagggagtcaatgattctaccacacagaaatcttcatcagtattggtcattaagagatctaaataacagttctgctaatttttaacgtggttaatatggtttagacctagacttgccgatgtatcacatataaattgcaaagcctcattttctccaaatattagcagcaggatgctctcgttgtcgacgtctgggaagaaatcaatatcacgttgattgaaatctccatatatatgcacttttgtttcgggaggaaatccgccaataacatgttcaacaatattgtaaaatttctcataaactattttacgagcgtttttcggcggaaaatacacagacacaaacacatgcgtttcgcctgctatatgtactttcacccatacatgctcaaactcttagcggataggaaggagtcaacccatattgaatcgtatatgacttgacatctataatgtatcgaaggtgatcaacactaacataaagtcggaatatcaagcctgaggctgttgaaaaacatttaatatcttcaaaataagtttttagtttatattacaagcattttaaaaaaataaaaataaaatattttattttgtgttgataaaaacggaataatttgttgacaaaatcggaacgtgacaaaatcggagcgtgacaaaatcggaacgtgataaaaacggaacatacctgtattggcagattgcttacgcgttttgaataagttttaatattctcaaatgttgttttccttcaactttcttccattcctagcttatatttgtcataatttctattaatccatctaaaagttttttagagtctcttttgtatgaaaaatttaaaaaaaagtattgcggaattcaaacaaaacataatttattaacgatactttaccctcgttagggcattcgtgtcgagattttttagtggtttatctaagctaaataacagaaaagcaaaatatacagattctaaaattgaaagaataatatcgtacgtatttggccatatcaattgttatagataaatgatacaaatatattcacaaatagaataaaaagatttcagtttgtaaaacacaagtaaatgtgatgattatttttaaacaacgagataataatcctacaacacatctgtgttacttatgtgtataaatgaatgtgtattgatgaatttcctccaaaatattctggttacttttgtttgctaaaattagtgtgaactaatgtgcaaatatttttcataatactttgataaaattaagattttttaactatccaaatatgtaatatacaaggagaattatatcaatcttaccatacatgattacatttgttttgagaacagattattaatttattggtgatccacttaccttaccatagtggggcaagttgatcatttggcgcaaattttcaagctcctaatattctatacgtaacaattagaaaaaaataaaaaaaaatagcttttctgaagaatccaaagttagaattacattattcacgttagctgaacatataaataataaaaatgaagttaactattgatttttctatactcacttaccccaccgcaccttggttaagtcaaaccagtattcttttaaataagcagcataaattttcgataaatagatgtttcaacgtaaacagaagggtttgattttgaccattttgaaatcggccagagctgaaatatgatttattgttttcatccaaattttatataccgtaaaacggggtatctttgataatccgggtaactttgatagtgcgtaacccaccacatactaaacgaaatatcataatttctgttaatcagttaagcaaaacgaatgcaaaactaaagaatattagtatgacacttcatttaagagtggtttttatttgaatcaagaacatttgaggctttttatacaaatattaaaaatagacacaatttgagcattttcgaaacgcttacaaacaatctgttctacgatcattatttgatgtagttttgaatagttggccacttatctttgaaagcctagttatcttagaacttgaatacgctctcaaatctcttagcgaaaagcattttcacaaactgggaccatttttgtaatctaagaaatttccatataacgttgaacgcctagaggtatgcaatgccctacaaatgttcgttattcattcaattttgttcgattcatactccattatcaaagttaccccaaaacagaaaactaactttcgattgtatgaaaaattatatatccattcaaaataaatcttttggcaatctatcgactgcaatcgatagctaggatgccagtacttgttttaaaaatataaattataattctttgaaacaacatgcatacatattcaagttttctttgaaaaaactatcaatgttaccccgttttacggtaccttaaatattccattaaaataaatgatagtctgatcaatatttttgaatttttatagaacataccttctaatctagcacaatttgagtgcaacaaaatcacccagaaacaacgcgatttgtgtaaaactgttaagagatgcttcaaacaaatgtcacgccatttacaaatgatcactataaaatattttgccagggtcatagttttgagggcatttgcgtcttataggtttgatatgcctttattttttgttaaggttgaataaaaaattaatacggaggcctattacagatttttgaggatgaaatatgttccttcggttagagacaacttatatcaatactcataggtttggagcaaaacggatccgcttatctcacttatatgaaggttaaatcaaagctctccaaaatgagccgttttttcgaaaatttgtttaagtctccatttatcccggtatgaatcaattctatcattagatatgggcatatgctggagacaaggcctgtgaagaatctcacgccatcgttgatgttttagaagctttcatcacacagatattgaactcgacgtccgcatgataaaatttgaaggtatgcttctaatttctctctggtaaggtgaaagtaaaagataaaaatcatgttcaaagcgaaaacctaagtctaaatagattaaacaatacaagtaatggataatatttatgtttcattcacattttctatgtaaaaactaccataatacatgatatgacgattttcgcatttttttatgggccatactgtaattattcatcgctgtcatcattatgacaacttaataggctatcgacatggatgaagaaaccatcttctagagtttccaatcccgggaacatttcccgggaaattcttttctgtttcccgggattcccgtatttcccgggatttccgtatttcttgggtaatttgagttcagtaaggactgatcatttcataaagtggacaccttgtatatgctatatctgtaataactgtggaagtgctcataagaatactaagctgagaagcaggctctgtcccagtgaggacgttaatgccaataagaagaagaatatttgtataaaagagagctaaatcttgagttttatttgcactcttaggtacatttttttctctttctggtcgttttattgaaaaatctcatacttttcattgaaaaatctcatacttttaaaatcatttacgcatatttatcgatctacagcaaattgtaagcgtttttctccaaatattttgatcggaaatcttggaataacatattatgaaaataatacactcataccagtaacctggtatgaaaaaatcggctgtatagaacgttgtgtcttattcatgtgaattttaattattttggcggcttttttactatcccaatattttacattattagtcgaacgatgtacataaaaccgattgtgatttcattattaaattataaatatattgcatgtacaaggtgtccactttataaaatgaacagtccttagatcatttgattttttgttttttgtaatcaaattattgttgatacaatggatatcttttaaatgatgttttttcaacaaaagattatatgctatacaaaataaaggaaagggatcgattccacgaattgatcaggcttataaagttttcatagatacaacagtcacaattttcaacataacactctagttggtttttattctagtgttgaattttggtaaatattatttgagcttcacatgattagttaagaataagctcaacatggaatgttgctcaatattataaactatctcttcttcgctgcctttcacagagtttttaacgaagccaacagatttttttgagaaacataaacaaattacttaaaaaaaaaggtaaataaggcagcgtccatttattacttaacgccaaaaattgaaaattttcgatcgcctcccccaactcctctgtaacgctttttgtataaaaaaaaataagccaaaccacgaattttcagcatcacaaatctgcagacatccattcactctgaaaattggatcgattgtttgttcgctggtttgttggaacattcgagctgttgcctagatgcattttcacttttaaaaaagtattgtaacttgccatattggataaacgaagaactttgtataaacatttcaggcatgttcaaaaactcgatttaatcgtacaacttaacccaaacttaatccgacatgaactttgttgttgcattagagcaataaaaagtttgtaaacattaataaaaccagtattttatacaacctgtagctcaaaattataacgtgctgctgtatattattatgatttgatcagttattgcattaaattatcacacagtttgtatactcacccattcattgatgaatattcaaatcaatcgacccccagtcgatgtgtatgccccaaagacatttatatgtatgtcaccagtgccctagtgctgttggttattttctttttgccgtttctttcggttgcaaaatcaaaccatttgaaatctacgtgttttccaaaattcaatgtcattgccatcacgttgcagatggacgtgactaagtttaataagtttcgaatccactatacttacaacatattgatcgaccacagtgcaactaatggaatcgaatcgctaccaacatagcaaagcttagtgattactgcctagtccttcatatggttttcgtaaggatagcatgggtgcagtctgtagagtgtagatcattcaataatagcaataggacagtatttttcgcaaataattcagtgtagaagtattcattattatttaggcttcaaattaaacctaagaggtagctataacaacaatattacgaaatcacgcttttattgcagccaatttggcctatttgtcagttaaggtactacaagagtgaatacatattactattgtctatcaaaagtattcacagggtaggaaagtttggggtaagtgtgccttagaggcacgtaggccactcctacttttcacaactaaaggctggtttgctactgactagaaaagtaatcgcctatctcgatgcgtggaaaatttcttccaagaaatggtcaagcaaatcatgtttctttgatcgtagtacgcagttgagaagaaatgtcatttcaaatggcgctctctgtaggaaattttcgtgacccattcattcaagaaatttctttacttttcttgagcgaaacagcatacttagcttaagagtaaacgttttttttctcttagagcttaacaatattttttattgtatgtctgagtacaatgtacaaaacattataaaaattgctttttttacatctcgcttaatgtatggcctctccattaaagcaattgataaccaagtgtgtagcttgttgttactgagcattcgaatggatttacatgtgatttaacaatgcttcgatacagagaagattctcctctatttcccaatgaagatagttgtttacttgatccactcatttgccttaaaacaacaagctacacactcgcttaccaatggcttatagggcaatatcataaattatgcgagatatttattttttatcaatttttgtataaacaaacacagacaaacagacgtagcaatcgaattattttcatcgttctgtcaaatagcgtactaagaaaattattggaaataatttgtgaactatcaaacctcccatagggagttgtaatttttgattgaatgaaaacttcttaacatcatattgcccaaaacaaaattcgaaaattgtttgtacgtgaattatgcattcacaggcgttattttcgttgtttttgtgagcgagtgtagtttctgattactgtagtatattcggacataacatcgctatataagacatttttgtcctttttctttatataaacctaaaaactgtaccgaagcaaaaaaagtatggagctttcagagtcagaaaaatcgtttgtttgttgtatactctgggtgttttctatgaccacaaaaatgtttttgcgagcatttgcgtcatatgggtttgttgtgcttttattattattattttatggttcatggttcatggctcatagacttttagcaaaacagagccgcgtatcacacttatatgcaggttgacttttttgaaagtaatcattttcatcacaaagatattgaactcggaggctgcatgataaaactgaaggtatgcttccaattcctctctagtgaggagaaataattattatttatttagttaacatctacacagatatcactgaatcaacaattgccacaatactcggttcgtggccgcatctctccatcctcggttctgccccacgctcgccaaatcgatacgcacttgatccgcccacctagcttgctgcgctccacaccttcttgtaccagcaggatccgaggcgaataccatctttgcagggttgctgtccggcattcttgcaacatgccctgcccatcgtatccttccagctttggccaccttctggatactgggttcgccgtagagttgggcgagctcgtggttcatccttcgccgccacacaccgttctcctgcacatcgccgaagatcgtcctaagcacccgacgttcgaagactccaagtgcttgcaggtcctcctcgagcatcgtccacgtttcatacccgtagaggactaccgaccttatgagcgttttgtacatggtacatttggtgcgggcgtgaatcttttttgaccgcagcttcttcaggaggccatagtaggcccgacttccactgatgatgcgcctccgtatttcacggctaatgttattgtcagccgtcagcaaggatccaaggtagacgaactcgtcgaccacctcgaacgaatccccgtctatcgtaacactgctacctaggcaagccctgtcgcgctcggccccaccagctagcatgtactttgtcttggccgcattcaccaccagtccaacttttgctgcctcgcgtttcaggcgggtgtacaggtctgccaccttttcaaatgttcggccgacgatgtccatatcatccgcgaagcaaacaaattgactggatctcgtaaaaatcgtaccccggctgttaagcccggctctccgcataacactttctagcgcaatattcaacaacaagtacgaaagtccatcaccttgtcgtagtccccggtgggatccaaacgaactgaactgttcgcctgaaaccttcacataattttgcacaccttccatcgtcgctcttatcagtctcgtgagcttcccgtgaaagctgttctcgtccatgattttccatagctctacgcggtcgatactgtcgtatgccgccttgaaatcgatgaaaaggtgatgcgttgggacctggtatttacgacatttttggaggatttgccgtacagtaaagatctggtccgttgtcgatcggccgtcaacgaagccggcttgataacttcccacgaactcgtttactacaggtgacagaagacggaagatgatctgggataatgctttgaaggccgcatttagaatggtgatcgctcgaaagttctcacaatctaacttgttgcctttcttgtagatgggtcagattaccccttccactcctccggtagctgttctgtttcccagattgtgcctatcagccggtgcagacaaatggccagcctttccggacccgtctttatgagttcagctccgataccatccttaccagcagctttattgttcttgagctggtaaatggcatccttaacctccctcaaagtgggggctggttggtttccatcttccgcagtactgacgaaggcatttcctccgttgtcccgcccttcattgcctgtgctctcagcaccattcaggtgctcgtcgaagtgctgcttccacctttcgatcacctcacgctcgtccatcagaatgctcccatccttatccctgcacatctcggctcgcggcacgaagccgttgcgggatgcgttgagcttctgatagaacctacgcgtttcctgagaccggcacagctgttccatctcctcgcactccgtctcctccaggcggcgttttttctcccgaaagaggcgggtctgctgttgccgtttccgtttatagcgttccacgttctgccgggtcccttgctgcagcatgaccgcccgcgctgcattcttctccttcaaaacctcctggcactcctcgtcgaaccaatcgttccgtcgactccgtcccacgtacccgacgttgctctcagctgcatcgttgatggctgcttttactattctccaacagtcctcaagaggggcttcgtccagctcaccctcttccggtaatgcagcctcgagttgcggcgcgtatgccgctgcgacatccggttgcttgagccgctctaggtcataccggggcggccgtcggtatcaggtatcagaaggccggctccaaaggcacgttccccaccagttgggagatttgtgccatcgccatatttgagcctatttcatcatctacccgatgggagaggaaagggaagggaaagatgggaggaaataggagtgggatcccttgaagagggaagatcgcataagcgaaatgagagcatgtagctccataccacaatgggttcgaacagcgccctaaaaagggcactgcaaaacgcatgagcgtaaaagagagcctatagctcattaccacagcgggttaagaataacagaatgtcttgaagattcaggcttctgaattcagtttcacttaataagtgttgaccaagtaattggaatcgcatttgcgcaaaaactggacagttacatatcaggtgatacgaagttccataattggagtcacaactatcacacacaaatgagtcagcacgctgaatatttgccatgtgatagttgagtcggcagtggcctgtcaacgctctgaccaagagactgcaattctgctttgacagatttgttaaatacttcgccacccttggagatggctcagtaatgtacaattttgtttgacgacatgactccaaactattccaatattgcttgtgttgagttgccgcccaagagtttatctgaagcttcacccagcacttcgaaattggaatagcaggctcagggccaatgaagtcatgcgatgctccatcgcgagctagctcatcagccaattcatttccagcgatggaagaatggccaggtacccatacaaggtttacagagttgactgaattcagttcctcaatttgagttcgacatgcgataacaagcttcgaccttgagttggccgaagcaagagcttttatagcagcctgactatctgaacagaagtatattactttacccattacgctctgttgaagtgctgattgcactccacacataagagcaaatatttccgcctgaaaaacggtgcagtttctaccaagtgagtaaaactgattcagccttagctcacgagaatatactcctgcaccagctctaccttcaagaagggagccatcagtgtaacatactatattgtttgatatacttctttccaaatagccagacgtccactcttcccgtgaagggaattgtgtggtaaatgtcctgtaaggaaagttacaagcaattgtgagatcacttggagcaaggacaattttgtcccaattcaccaaaagtggaaacaacgaattgtgtgtagatctacgattcactggatttttctccagtagatccagtacccataaacggtaagagcaagaaagtgcttcttgtttaagatatatgtgtagtggcgcaacgtcaaaaagggcctcgagcgctgctgtgggagttgtagagaacgcaccagacatcgccatcaagcacatcctttggagatggcccaattttgatcggattgttctcacttcgcccttttgccaccacacaagacatccatatgccaatattggtcgaacaactgttgtgtaaatccatttgatatatttgggtttgaggccccaagttttaccaaaggttcgccggcattgaccgaaggccatgcaagcttttttgactctgaattcaatgtgacgtgtccatgaaagtttggaatcaagaatgactccgacatactttacttgatcagtcacattaatctcagtgccaaaaagacgtaaaggtcgaattccatcgcggtttcgtctttccgtaaaaagaacaatagatgttttattcgggttaaccgaaaggccatattggcgacaccaactctcgactacctgaagagcactttgcatcaggtcgaatagggtgcttatgcacataccaactatcaaagatagatagtcgtcggcaaatccataagttggaaaaccgcaattattgagttgcctcaatagcgtatctgctacgagattccacaaaagtggtgacaagactcccccttgggggcatccgcaaacactcaattttcgaatcgctgcttgacgcaatgtcgagaagagatgtcggtttttgagcatttgatgaatccaattggtaatcattgtaggtagcccatggtttcgtgcagcttccaatatggcatcgaaagacacgttatcaaaggcaccctcaatatccaagaaaacacccaagcaggattgcttctgagctaatgctttctcgatatcgtatacaactttgtgtaaaagagtcacagtggactttccagattggtaagcatgttgattcacatgaagaggcatgtttgccaaataaacatcacggattcttcttcttctttctggcgttacgtcccaactgggacaaagcctgcttctcagattagtgttcttatgtgcacttccacagttattaactgagagctttcattgccgattgaccatttttgcatgtgtatatcgtgtggcaagtacgaagatactctatgccctgggaatcgagaaaatttactttacgaaaagatcctcgaccagcgggattcgaacccacgaccctcagcatggtcatgctgaatagctgcgcgtttaccgctacggctatctgggccccacatcacggatgtgatgatcgataatacgttccagacatttcagaagaaaagaggtcagactgattggtctaaaactcttcgcttcttcatacgacgcacgtcctcctttcgggataaactttacagtaatatcacgccaggatctgggaatgtacccggtagcaaaactgcttacaagtagttttttcaaaacatgtttgataaactcaaaccccttttggagcagaacaggataaatcccatccgctcctggagatttgaaaggagcaaaactattaagtgcccattgaatcgattcagtagttacgatactgcgagccgaggccagagactcgtaactacatgaaaagacatttggttcatccgtagatgctatgtccacacatccggggaagtgtgtattgaataaacattctaaaacttcttcatcggaagaagtaaaatcaccattaggtaagcgaatttcgttcacttggaaatccttagattttgcaaggattttgttcagccgactgacttcattcaaactggaaacatttgtacaaaggtttttccagccggatcgttcagcagaacgaagagccttcttgtaagccttgcgagccgacttgaacgactctgatccagctgaacggcgtctgttccaactccttctacattgtttcctgagtctagtcagatcggaattccaccatggggtccctcttgtagtctttacagaccgcagaggacatgcttcttcaaaagcttccataatgtaggatgttgtagtatcaacggcatcatccagatcacttggattttcaatggatggagaatatccatgaaatttggtcgcaaccaattcaataaagagttcccagtttgttgagcgaggattcctaaaacgcaaagtctgcgcagttacatttgaatgttcaaagaagatgtagcgatgatcagaaaatgattcctcatctgatacatgccaattcgtcaactcgtgactgattctattcgagcagagcgttatgtctaacacttcttctctattagaaaccatgaaggttgggcgattgcctatgttaagtaatccaaggtctgtactacttaagtattccatcagactggagcctctcaaattgatatctgagctgccccagatgatgtgatgagcattggcatcactgcccacaatcagcggaaggctttttgttacgcagtgtacgacaactcgtttgaagtcatccgttggggatggttcatcatgtggtaaatataccgaacaatagacgtatttcctgttgaggtcaccaacagaaacatcgattgtgacagcacatacatctctggtagttaactcagaaatgagtgtagcaacgattgctttattaactagcacgcatgcgcggggcatggagcgcgagtttgccatttcaagtttgctaaaagtagcaaaaactgggtccacaaggttacctagatagaagttccctctacgaaagtagggttcttgaactagcgccacttgagctgcaccattttgcatgagtctgcaaagattgatcgttgctgttcttttatgctgaagattgatctgagctaacctaaccgtagccactacccaaactaggcaggattaagctttttgcaatctcagcacgaaaaagaccagcaacgaaaaaaccagatcggtatctatttaaagtcgctaaaggcgaaagagcacagaatacactgtgtaaaacgcataatgcgaatccatataggtgataatttaaattaaatgtcaacatattcataatcccacccttattaagcctcaggatagagactgaagaagggcagccgattatctcggagaaacacaaggtcacctgcaccattgctccgggtagcacaggaaggactcaatactgtggagggcgccctggtaccccacaggctccgttagcggttaggttttatttagaccccctaaccattcattcctaggcacggtacgcagcacaccatgaattaggggtcacctgttaggtggacttttaccaccggaacaggcagtccgtagtgttaattcttagccagttgaaacaaccgctaccgacactacacggctatctaggctgctcgggaaaaggaggttaatattgatgattaactcctgacgtgcccaagcagcctttaaatgtaatgcagcctcgagttgcggcgcgtatgccgctgcgacatccggttgcttgagccgctctaggtcataccggggcggccgtcggtactgtacgttgttaacgacggagagttttgggcgcagtttgaccatcaccagatagtggtcagagtcgatgttagcgccacgataggagaagtgccgaccatcaatcagaacatggtcgatttgcgattctgtctgctgtggtgatctccaggtgtatcggtatggaaggctgtgctggaagtaggtgctacgaatggccatattcttagaggcggcgaaatcaattagtcgtaggccgttttcgttcgtcagccggtgggcgctgaactttccaatcgtcggtctgaattcctcctcctggccaacctgagcgtttagatctcctatgatgattttgacgtcgtggcttgggcagctgtcgtactcgcgttcgagctgcgcgtaaaaatcgtccttatcatcatcagtgcttccggagtgagggctgtgcacgtttattatgctgaagttgaagaaccggcctttgatcctcaacttgcacattctctcattgatcggccaccacccgatcacgcgcctctgcatatcacccatcactataaaagctgttcccagctcatgtgtgttgccgcagctctggtagatggtatggttacctctaaacgttcgcaccattgatcccttccaacacacttcctgcaacgctacgatgccgaatccgcggtccttcagcacgtcggcgagtatgcgtgtgctctcgatgaagttgagagatttacagttccacgtaccgagcttccaatcgctagtccctttacgtcgctgtggtcttcgtcgattgtcccggttcgtattctctcgttgattatccgttgctagattttttacggctggcttgcggggcctgacaccccctagatttccggaggatcattccccctaaatgttcggaggaccatagtgcgcagtttagcttagagtccttctctggtactcggacgatgatcagccgcccctgacatggggaacaaacgctgttgtgagccgttcctaacatggagtacagacgctcaaggtttgcagaagcaaaagcaaaagcaaacccccccttccctgtcagcatacgaccaaagttcccaccgggggttggttacccgatcttccctaaggttactcgtaccccggccagtaccgcgaggaggtagggataagagttgctgggcaagaggctaaggaccacacaaaggggtctattttattccttcaggtacgcgaggaaccaatggtacgccatacacagccatttaccaaccctagtgaggagaaagtaacagataaaaattacgtccaaagcgaaaaacagagtctaagcagattaaaccatacaaatagggaataataggcaaatagtcttgactagacttcgtattggtcacgcctggttcacgaaacgctacctctttgagaaaaatcctcgtgaaaaatgcactctctgtgaccgctacctgtccgttcatcatgtattggcatcatgccagtcgtacaacgcggcgcgtcgagaactaggaattagtaacgagctacgaagaattcttcagaacgaaaaaacgaccgaaatcaaactcattagctttacgaaaaagataggaattttcaagtgcatataatatgtaacagttactaatgtttatttttcaaataaagtattcaatagagacgaatgccccttctgggtaaagtctctctaaacaaaaaaaaaaaaaatagggaataacacttttcttttgtatacattttccaaataaaaactaccaaaaaacattatatgaggattttcacttttcttttgggttgcatctattctttccataaaagctggaatgaaagaaattttattttatattatcttgctatttaatgaggtgttgcttaagaaacgttgtattgttattgttaccctttatttaaatacattggtttcttttctttttttccagtggacgactcatcaggaaaatataaccaaggatatttttggggcaacaactactggactggatcaataacgcagtgctcttttatatatcggaaaaatactaacaacaagaacataacgaagatcaacaaaaacaccgatttgacttacataaatgggaactttctcggagcgtcagaaatgatgcacgaaaatcctccattcataccaggattttacatgctaaaagtattgttaaataacacacatacgttaggaccggtgagtgtttcttttccattctagcatattcttgattaagacacttaaattattctcagcctaggactgtgctgatgggattatgtctacccggatcctgccaactgaacgacgtcgtagagatgactcagaaagctgaacccccaacgaaaaactttcaagttataggcgtgagatcgcctacattgaataatttttccttatggaaagacttcacgttccagatactattgtaattgtggttattactttttcttgttttgtttcaaatagttatcaatgctttatattcatcgtattactctcattacgcttttattttcagatgagctcaatgcattttaacaatttattctacacttataattatcaacactacatagctgacttggaaacttttagaaatttcgtacaacttcagattttatgacaattattgaaatagatcactgtttttggaactacagaaactacgtttactacgatgtggggtgtccgcggatcctcaactgggaaatttggaattagaaatttaatgaattttggttgaggttacaacattagaagcaagaaatataaatttcaaaaattttcattgcacttgtttccaaacagtgaatagaaatcaaaaacaaagaattgaagctttctgttttacaatcagcaataatctgccgtatatatcgctttaacaggattaaatttaataagcgcatacaggagcccttagtagttgatgcgatttgggggattatcgacgaatgtaatcagagtgtagttgacctgctattcaaataacttaagcaacagacactaagttttttttttcaaaaatttacaaatttcaattgtattcccaaattctgccaaaaacggatccattttgttgccaaaaatggagcatgccaaaaacggaatcccactatattttaaatctagactagaagctaggactaggacgaggacgcctggaggacgcatacagtttttcaaaagaatcaattaactcatataccgctactagcccaacaacgtgcatagaaatcttttgcaccaatttaagcgaaaccgcatagataaaatgtgccttacatgatgattgctgtagtttcttcatcgccgtttaagccttaaaactgatggttggatgtaattaacagcttgaggaaggtgaaaaaatcggcccgaagctacttcatcttgtgaagtaatcaataaatgtattgactcagacaaacagacattgcacacatttttctatatatgaagttagacacggatttagtctaggaatcttagtgagacttttccaactttttaagattcatccggcgcaaggcgtctgtagtaaccaaacttttcctgtaactattttgcgctttctcgcagtaagtagtcgaaatttagtgacaaaatcaacgattaaatttatctactcagaaagattggttagttttgttggtttccatacaagatgccaagtggtatatttataaattcatcagcatcattgtgtttagctcttgtatggaaaccaacaaaataacaatggttttgtcacacatttttcgattacttccattgagatacgagattatcgaatgtccatgtcgattggtgttttaatttgcattgatttttgaaaaaatctgtatccggatgagcaatgggttaagtatggggaactggaaaagtcagtcaaaacgctccacaattttagtgattaagtcggtaaattccatcaatcaaaacatattttggtctactttttttcagtgatcgtaaaaataaccgaaaaccccgtagttcaaaaacccagtaaaattttaccgaagttggtaatctatattggctgtgtacacgtttttcttctttttttgttctttctactttctttcttcttgtgtcatattttttgttttttctttcttctctttttctctgtacttttttcttctatcttcttctttctttcttcttgtatctttcttctttacttgttgcttctttatttttacttccttttctttcttccttcttctttcttaatattaacttctagttctagttacagtttcttaataaaaagcttttttttgccaaagtcgccactttgcattagtaaaccgtgtgtcaagtacggtatttttttaagtacgaaaagttcctggaccgtctgggacacaaacccagacatctttagcatagttttgctaagcaactagactaaataagctgattcttgaaatcatatttcaagagtgtgctgaaacaggatgttaagaaatatgatcgatgtataatcgtcggtcctctttctgtaaataaaggtgacaagattctaatgttgtgccattttttcatcttaaaacgcttggcattgaagcaatcgttcaccatgaaggtgacatgataataaatttgctttttattactttcattaactttgcagcaaactaaacaaatgttaaaaattttatagaaaaagttatgatgaaacatatgattcgtagtgattttcacatacaacagcatatatcttaaaaagtaaaagagatagaaaagtttagtttagccaaagttgtttcaaattatcacttctacaactttgctgaagacaccatatgtctacctaaatgttatgaaaaactaattttttgcaccaaaagatgcgcttgaaaatacaaaaaaaaaaacttgtcccaattaactccgatagttcaatcatattcttcaatataatttttaaatgactatatttttcattccaacaactgctggtgtgtgcatgaatttgtgaaattgtgaaaaccttagaagaatcttagaacttggacattagacgcaattacctcgctgaacgtggcaactgggacccatccagtttcatgcgtcaatccacatcagtaagtctaccattgcaataatagaattgttagatcatagaattttaattttgtgtacacaggagatcaaccataaaatacgtaatgctaccttaaaacgtacattaaccttccagtcgtcgtgcggtctgccattgtcagaaccaccgcgctgctgttgtgaacgagaagcgagttttttcagcagtgttgtacaaaatacaacatcacgacgactgaagtgttaaatagtgcgtcacatcgcactaaatatctactgaaatttcttcactaaaagcgtaaacatgttcaaaatatacaaaatttataggttacttataaaaaagtagcacgtaaactttcaataattgtcgatattgtaaatttgttctgttatcattgctacgcatggcagaaaaccacttaataggatggaattgtttcccacaactactaaatttggtagaaagagcaaataaagttcaataaaaatagaaaaagtaattgtaactatgatatattttgaattccatctttgtctttattcaattttggattcgtatttcaaaaataaaaaacaaaatatataaaaaataggcattttccctccctcaaaaataattacgttatttgagattgatttaattgataaaaatcatttgtttgaatgtttagtgctactctcttggaacatgtttgaaacatgtaggaaaagtttttattctagtgcttgttttgatgggtcccactatacacacaaatacggtcgtagactttctggtggccagataacctgccagtcgacataccaatcagtttgtacaactaatccaaagtatatgtaatgtttagtatttcgatacttgttaaactttcactcggctggttagttgtaaaccatgaatcataattcttcattcttcatgcaacatgcctcgtacaacttgtactaccttcgggatgctaggttcgccgtagagtacagcgagctcatggttcatccttcaccgccacacaccgttctcctgcacgccgccaaagatcgtcctaagcacccaacgttcgaagactccgagtgcgtgcaggtccttctcgagcatcgtccacgtttcttgcccataaaggactagaccggtagtcagcgttttgtacatggtacatttggtgcggggacgaattattttgacctcaggttcttctggagcccatagtaggcacgacttccacagatgatgcgtctccgtatttcacggcaaacattgttgtccgccatcagcaaggatccgaggtaaattaattcatctaccacctcgagggtatccccgtcaatcttaacgctggttcatatgcgagccctgtcgcgttcggttctgcccaccagcttgtactttgtttttggcgcattcaccaccagtccgactcttggtgctttgcgtttcagatgggtgtacatttctaccaccatttcaaatgttcttccgattatatccatgtcatcagcaaagcaaacaaactgactggaccttgtaaaaattatgcctcggctgttaaacccggctctcagcatgacagtctatagcgcaatgttgaacaataggcacgaaagtccatcaccttgtcttagcccccggcgggactcgaacgaactgaactgttcgcctgaaatctttacgcagttctgcacaccgtccttcgttgttctaatcaatcttgtgagctccacgggaaaactgttctcgtctatgattctccatagctctatgcggtcgatactgtcgtatgccgctttaaaataaatgaacaggtgatgcgtagggacctgatattccagtaattttcggaggatttgccgtactgtaaaaatctggtccgtcatcgagcggccgttcacaaatccggcttgataacttcccacgaactcatttgctattggtgatagatgacggaagatgatcttagataatactttgtagacggcatttagaatagtcatcgctcgatagtcctcacattctagcttgtcgccttttttttgtagatatgacatataaccccttgattccacttccccggtagctgttctgtctcccagattctgactatcagtcgagacaagcgacgaacttctccgggcccatcttaataagttccgctccaataccatccttcccttgttattattgagctggtgaatggcatactcaacttccctcaaagtgggagctggttggttgctattgtccaacattccgacgtagtcatttcttccgctgcctcgaacctccgtgcccatgctctcagcgccattcaaatgttcgtcatagtgctgcttccacctttcgatcacctcgcgtccgtccgacaaaatgtttccatctttatccctgcacatttcggctcgcggcacgaatcctctacggaatgcgttgagtttttgatagaactttcgcgtttcttggtgcaacagctccatttcttcgcattccgtctcctccaggcggcgctttttcacctggaacagacgggtctgatgcttccgctcctgtctataacgttccacgttctgtcgagtaccttgctgcagcattactgctcgcgctgcgttcttctcctccagaatcattctacactcctcgtcgaaccaatcgttccgtcgactccgttcaacgtaactaacaattttaattttctcgccggtaacgttgatggctgctttaattgtttctcagcagtcctcgaggggggtttcggagagcgaatcctcttccggcaacgtttgtttgagatgctgggcgtaggctgtggcgacatctggctgttcagttgctcaaggtcatatgtcggtaccgtaggttggtaacgacggagagttttgggcgcagctttagcattaccaggtagtgatcggagtcgatgttagcgccacgataggtcctgacgtcgataatgtcgaaaaagtgccaatcaaacgtggtcgatttgcgattctgtttgctgtgatgatctccaggtgtatcggtacagcaggctatgtaggaaataagtgctacgaatggccatattcttggaggtggcgaaaccaagcagtcgaaggccattcccgttcgtcaggcggtggacgctgaactttccaattgtcggtctgaactccacctcctggccaacctgagcgtttatgtgatgatcttgatgtcgtggcttggacagcgatcatattcacgttcaagctgcgcgtaaaatgtatctttatcatcatgagtgcttccggagtgtgggctgtgcacgttgattatgctaatgttgaagaattgggagctcgcactatacaaatctcagtcagcacatcgttggcgaatagtgtttggtatttcaatacctaataaataatgcgctctcgggttaggcattgcatatacaatagaaagcgttatgtttggatgggcgtttaattcttccgaaagaggtacgctttgcaaaagaggattattcagctgaaatcgaattaaggttcaggaattctgcgtccatgaatcctctcttggtttagcggtaacgcgccctgtcatgagtcatgttagtcgtgagttccattctcgccgagaagacgtgtaactttttcgaaaatttcacatcaatttattcatctaattcaattgcaaagtatatgaaatgtttagtttttcggtagttgttaaactcaaaactaggttaacgcacgaatctccagaattgagtggaatgaattcaattttgagtacttcattttctccgtttacagtgctcaacccttggctcaaccacgttttgattctgccgacagaacgcttgcccttttttcacactgtcaccaatacgtttgcgaaaacggtttagaacttgcgatgcaaatagaaatcttcttccaaggcccgcaacatcccctctttatcaatatttatgaatttctcgtacagctgcggcaccctttcctacttcctgatccgctgcgccgttataattataatcttgggtcaacgtcaaatcttctagcgcctctggcctacgaagcttattctttttgaagatataatttttcgtcaacttaccgatctccaaaggggtcatgcacaaattacatcacgctccaaggggggaggggtccggtatagcgtgacaagccttacaaaattgtgtgaggccttacaaaaaaaacgtgacaaggggggagggaggaggtccaaaaagtcccaatttagcgtgacataatttgtgtaccatcccaaactactaatatcagttactaatatcgactactggggaactaacgtattttcatctgtcatggggggtttgtaaatgaaatcttctggaatcaacacatatatgctgaaagtattgatgcaacatttgagataaataggttttcgaaaaccacccaagacgaagtgaaaaaagatgccgaaaatacaacaagttaccctatgtgttaccaggagcatcctggtatgaatgaatgatggcccattttattgcaaacagtctgcatttaatctttgaatattgcaaaaaatattagcttttataaaacatatattgaaggattgcaatcattgcgcatatattttttattttttttttgttttgtattcatggactttttttcatttctgccctttactgcattcattaccagataatagaaatttaaagatttttcttacagctcagctacaatcattgtcacactgctactgattggaggaactgggtacgatttagtactgagaaagaggtatgcagataaaatgagaatgaagaaatattcaaaggatctcaactccgaatcctcttctggtctgggatgtacaacgtatgacctcacacaaggtcttccggacaaagcaaacaaggcaaattgtactgctttcggcatacctactggagtgaataacaataactctgatgaaaatttagcaattgagccaaccccagctgacgatgagaaacttggtacaatcaggtgttgttctcaacattatatattttgatgttaatattcgcatactttcaggcgtttgtgctgagctgctgttgtcgttttctgtggttaccaacttccaggcgatctgtgataagaatgttggaaatgatacgattccatccatccatgggttacgagcgatttcaatgttgtgggttattttaggtaacgattacatctcattgcagagctgacttcaatttttattgtaattctatggaggaactgtttttatgctttcaatgggttcaaaatataataccggtttttcgtttcagctatacgacatagggcatatatgtttcaaaatgcttttgtttcaggcagaaaaatatcaatcaaaaactactaatcacttgaataattgcagggcacacaatgattgttgtcttcaaatactctgataacatggagctacgaaaagttgtcgaaaaggaagtattgttccaagccatccttaatggcgcgtacagcgtggacactttctttttcatcagtggatttttagtatcctatatatatttccgcactaatgccaaagggaaactagaaaaactcactcaaggcgtcaatgagttcacagctggtacttatcatttctttggattagtaggataccgatttgtgaggtaaattgttcaattgaaagtttcaatataaaatggatctactaataatcgacgatatccaactcaggttaactgcaccctacctttatgtccttggagttgtagaagtcgttatgagatatttggaacaaaattctgtctttgaaccccctacgcaggaccacataaactgtcccaaatattggtggagaaatatcatgtatgtcaatacattttttcctgtagagcaaatggtaagtttagaataaaattaatgaaaactcaaactttgtagttgtagttgcttataccttctatagcatcgctattaccagatgtcaattacaagtttcgtaagtttcttttatcattttagccggcttttccttacacctaatacatagacagtctgctaaccaaagcaagcctatcggtcataattcacctcatcccctatacacatacactcccacatgaactcacgtagacgaagtggtactgtcagcccacaattatggatcgtctaagggtcatttctaaaaaaaaagatcattgtgacgtttaacaaaacaaagaatatacctcaaaattcgcggttatttacgaaaaatgccaatttcgttagaaatttcaaatcgacttatattacggatcagagcactaagctgtatggaaaatttcgatacttccttaaaccattacccgtgaaatattaagttagctaagttatttcgacattaaaaaaacaccttgagccgcgaaatacgcctacatgtagacaatttcctaaggaaattctacactcttagaagtaattcgttaacgttgcctaattgaataaacttatggaagttgtaacaacggaatcgttttcggcgatgtaaattttagtaacaatcgcaatttcctagctcatacagtttgcagatgtcatcttcttatttttcttcttggcgttacgccctcactgggatagagcctgcttctcagcttagtgttctaatgagcatttccacagttattaactgagagttttctttgcctaagttgccattttcgcattcgtatttcgtgtggcaagtactatgatactacatatatgcccagggaagtcaagcaaatttccgtaacgaaaagatcctgggccgaccggaaatcgaacccagatagcttcagcatgactttgctttatagccgcggactctaaccactcggctaaggaatgcccctgcagaagtcatgtgagacatgaatctttggtagtcccgactaagggtacataacaaaattatatcagcatatgttattatgttataagtttttttcgaacataggttgttacaaacttgatgcaggatgttgttaaaataactaaaattataacaaaaagtgtatgaatagtaacataaacataacaaaatatgttttaattctatcaaaaacatatccaaccaagttataatgtttgatacaaagtatcaaaattataatactgttcggtatacgataatattgtatattattgaaatgcataactatctatttattttgttataaagttgtaaaaaatgaataaaaaaatatcttaaagggaaataaaacacattatgttatatttctgttttattatgttctatggagaacggagcctaacaaaattgtatcataatatgatatgcatatcatattctgataaaattttattatatttttgttacaagcctctagtcggggtgccatccaaaatgtcaaaaaaaaattatttcgaaaagataacaaatttacgcatgaaccaaacgtaattttcgcaaaaacctcatttctcattagctcatgaatgtaaggcaccattcataatttgaaaatattccatcaatgaatgatgatttgaacatttttcgagatgagtgataccgatcaatgttacccctctgtcaatgttaccccggtcaaaacaatgttacggtacggacaaaacaataacaccatctcagcgcaaaatatttatctcgctgattattttggttttctttctaataataaaaagctttcaacaaatctagaaaatatgaggactagaaaaaatatgaaattcatatttgaagttaaaaacacgagtggccaaaataataagaaattatttttcgattaaaacggcatgtgctattttggttgcattctattaccccgaacgccactgccccgaattggtcactaccctgaaagccattaccacgaatgggtcattaccccgaacaatatgaaatacagtgcagtatcttgtcttgcggtaaaaaaatgaaaaatcatctgcgcgttcaccgctatttgcgcttcttggcggtgaccattagtgtgcgacaaaattaagattctcgctccagtccactttttggattgcatttgggtcccataacaactgtgcaaaatttcagctcgatcggtgaaactatattttagcgccagccgttcaaagtttgtatgggatttactatgggaaaacttacttttgcaaagaaaaattaccagaggccgcacactggggcagaatcgaaaaaacgcggaaacaacctgtagttctttggaatgaagagatagacgtttgatgtcttctgcgaaaatgatcctttcaatgagaccgatgttttgggatgaagttatattttttaatgttattcgcataaatgactcatatgccatttcggtaaaatggcagtttaggtgtatggtttcttcggcaaagttgatcgttattttatgctgaaaataattgctgaagacgtcaaatttccaaggcctactatcttttgaaatataggcatttaacaaaaatatgtgctaaagaccgatatttttaggtttgcttgtaattttttaattaaaataccatatatcacctgtgattatctcattaatttacgtaaagcaggtctggtgaaaatttgatggtaaaaataatattttgtttgatctttttcagtaaaattttcgaaaaacagggatattgcgtataggccattcttgcgatcgggcaagttcgggcagatgttttcatcgccatccacttgcgaaaggtcagaacattcatgtcttatttttttcaaggatatgatatttaatatattttttctatgtgatctggaagtatgctaagcttataaagagattaaaaattattttacttgacaatgtaaaagttttccaataaaaacaaaagtccaccataattatgggcattcttgcaatgtactggtagctaaatgtacttagctatttgctttttacattgcttgtatatttgctactcgcaaaaacgccgtaagtgccagactcattatttcaaaaccatttcggtcgagtggaaatttaggtatatgatttcttcgtcgatcgttattttaagctgcaatcaattgctgtagatgtcaaattttcaaagccaaccatttttttgaaaaacagacaatcttttgataaattttgctaaaaccgttatatatatataagttttgtgtttctttagtttgaataccatttatcgcctctaattatgtcattcattgacataatacagagctggtaagaatttgatgatagaaacaaaaaaaatgaaaaaaaaataacagagataggcctataggctattcttgcagcaatgaaacaaaatttttgttttactatcaaatttttaccagctctgccttatgccaatgaatgacataatcagagacgttaaatggtatttatactaaaaaaaaatacagaacttatgtatataacagtttttagcacaatctatccataaaaaatattaggttttggcaattcgacatcttcagctattgttttcagcttgaaataacgattgactttgccgaagaaagcatatatctaaatttcaattcgaccgaaatggtgtgatattatgagtctggcgcttaggacctttttgcgaatagcaaatatacaaacaatgtaaaaagcaaatagctaagtacatttagctaccagtacactgcaagaatggtcatgattatgttgaacttttgtttttattggaaaacttttacattgccatataaaataatttttaacttttttgtaaactaacttccagaccgcatagaaaaaatatattgaatatcatatccttgaaaaaataagacatgaatgttctgacctttcgcaagtggatggcgatgaaaacacctgcccgaacttgcccgatcgcaagaatggcctatacgcaatatccctgtttttcgaaaattttactgaaaaagatcaaacaaaatattatttttaccatcaaattttcaccagacctgctttacgtaaatcaatgagataatcacaggtgatatatggtattttaattaaaaaattacaagcaaacctaaatatatcggtttttagcacatttttttgttaaatgcctatatttcaaaaaatagtaggccttggaaatttgacgtcttcagcaattattttcagcataaaataacgatcaactttgccgaagaaaccatacacctaaactgccattttaccgaaatggcatatgagtcatttatgcgaataacattaaaaaatataacttcatcccaaaacatcggcctcattgaaaggatcattttcgcagaagacatcaaacgtctatctcttcattccaaagaactacaggttgtttccgcgttttttcgattctgccccattgtgggccgcgcattgacccctataaaaattctgaacacagaccttgataggtatttctacgatgaagaatattgccgatgaccgtgaaactatccgacacttctaaaaaaagttattcaatgaaaaccgattggcaaggccacgttgattaacacgtgaaggaataacaataataacaaaattgggcaaaattaacgaatagtttatgcttaataacttttttcacaatcatcggattgttttgcagtctttgacgatgttattcattctccaaatacctaaatctaaatatcgatgtctgtgttcagaacttttatagatgccaatggcgacctatgtcgatttttctttgcaaaagtaagttttcccatagtaaatgcggtgattaaactttggaaggaaaatccaattggcgaagaaattcaaaaacttcggttcaaataaagatcatttgggcgaattaggggcatatgagacgaggcacgaaaaaatccaataagtaacgcgacattcatatgaatccccgaaaaaccaacgctacaacatctagccgttcaaatccaggatgttaggcaaagatttgtcgtttcgattgtgttgttcatatatgaccctctgttagttttcaactttcaggggtgatcggagcaatatgggccgcctaagggaaacctcatggaatgcatagaaaaacagcaaaaactatggtttaaatgcatgtgacttgtactataaaatgttatcttccatgttacgtcgataataaatgttaacatcaacttgaaaattattttaggagttttttggaaaaccatgtttttctacgtgttcaccaaccatatggggcattgtgaggcaccctacggggcagtatgatccaccgcattcaatcgaatgatttttatttgaaacagtatagagaagagttagtggtgaagagtacattattggaaaggaaattgtattagctttgcttgaaattattgattctagcggcttattttttaaagatacataatacatagtaaacagaccatgttataatagtactaaattgcgatacttggctcaacttattttctagcaaaatgttccacttgtaatggagtataaagatgactaagcagtaaaaaataatctggtatacttaggcaatgcatttttatgttcaaaacatcgtttattttgcaaaaatctaggtggctcattttgccccgccccttcatcttgaaaataatgtattgtttttcaataattttgtttacgaacaaatcaaatttcgctcacgaactgttaattatgatcagatgcttcaatgggttggtaaaatttaccagaattataaggcttataggcttaatcgaaagctttcaaaattataagcttttcatgacgacggacaaatttgtacatttttgtcaatatcttgagtgtttaaacgaatattcttacggtttttattgtagtggctatttgagacatcctttagcagatcataatgacactagacattaaaacactggtttttgaggtcaaacccggggtggctcatattaccccgtatgttcatattgcccccattgcctttattcatttctctcgtcgctcgcttgcgattctatccatcatattccactttgagtagtatcgcactcaccgagaaaagccaatgaatgctaataatgacatagtaaatcccatacaaactttgaacggctggcgctaaaatatagtttcaccgatcgagctgaaattttgcatgcgacccaaatgcaatccaaaaaaaaggactggagagagaatctaaatttttcatataaccgtgtcccaggctagtgaccatatttcaattttgtttttttttaacaaatattttcctttcttttttatatgatgaatccttgttttagtaaactgattaatttttaacattgtttatcagctttggttggttagacgtacaaatatcgttaaagtctcatggaatatgcattcgatcctcttttttaaagatatttacataacttgagtcatacatttggaaaactaacatttaatatactttttttctctttttcagtgcatgctctggagttggtatctagccgatgatacgcagttttacataattggagctgtcattctgataattgcggttagacatttcaagtttgctgctggcatgctgacagtctttatggtttcttcgtgggcgaccacggcatatatagcattctcgaataatcacatgccaaatgctgatgatccttttgcactgtttgataagatttatgacaaaccatggactcggttaggtccctatttagtaggcatgtgcgttggatggatactgttcaaaaccaactgtaaaataaaaatgtccaaggtgggtatctaatgcaatctaattcacttttaacggccctacttattacgactttctctctacctcacggttctatgctactcatgaatattcatgagatattaggtatattatattaccgttttcgggggtaacagcgcggcaaatattagaaatactgatatacatttttttgcaatttctcatcgtaataggctgtttttcatcatgccaacctgtcatgaaacggcctagtatgcagtgcggaaataaccatgtaatgattcattaagcaacgctttctcattacgcaacttggcaagcctcgtagggtaaatttacgactcgtgctgtaaaaatcatcattctgccacttgttccgtaatagtagtttacggaacaagttgcagaatgatttttacagcacgagtcgtaaatgtatcctacgaggcttgccgagttctgcaacgagttacgtacaacattttttgcaatttcgtagaagaccacttgagggtatcagaaattatgccggaatgcattaaccatcattttacaatttctgaaaaattgttgtgtaacgattcattacgtaactcaaaacagttgcgtaatgagaaagcgttgcgtaatgaatctttacagcactggtttcagttgcgtaatgactatttccgcactgcatacttcagtgcaggaaagcaggccgtttcatgacagattggcgtgatgaaaaacggcctattacgatgagaaattgcaaaaactactattaattaattatactgccgtcagtcccatctgtaaaaagtaggcatagagaaaatggtcggtgaaattcccaaactcgttttccatgcgaatattcaaaaaatccagaggattgtaacattttcaaatcttaatgaaactttcacaatttgttttttgcaatttctcatcgtaataggctgtatttcatcacgccaatctgtcatgaaacggcctactttcctgcactgaagtatgcagtgcgggaatagtcattacgcaactgaaaccagtgctgtaatgattcattacgcaacgatttctcattacgcaactgttttgagtttcgtaatgaatcacaacacaacgattttcaaaaactgtaaaataatgatgaatacattccgatataatttctgataccctcaagtggtcttctacgaaattgcaaaaaatgttgtacgtaactcgttgcagaactcgatttttacagcactcgtcgtaattatcctactcggcaagcttcgtaggacaaatttacgactcgtgctgtaaaaatcatcattctgcaacttgttccgtaaactactatttcactacgatatatttctgggaaaatataaatatgatcaaaacacggttaatttatgtgtaacgctgtgcggaaatgtgtagtgggactgatatgcggttacttttcattatggaacaatttgacttgatgttttttcctactttttccgaataaatctttttatctcagctgaacgagtattggaacatatgttgaaaactgaactcaactcagttttgatgaaaatgcagctgggactcacctgcgatttacggcagtatagggtgtcccaggaagtacggacacgactttaatcacggaaatcatagtaatttttcctaacatttttttttctttatggcatttcaaatactagatgtgataactttgtttaatcaaatagctttttaacatcgaagtttctatttttagaaaattaatctttatctggccaaaaaccttactcttttgttttgttgaagtataactattttttaatctttcatagtggttagttcaagttcgttatatataagattatttatataaatttttatttgaaattttatttggatttgctaggaaacatttgacaaaactggaaaattcttcaaaatcactagtttttttcttcacataagacactatcacaaagttataatttctcatgtatttcaacaggtataaaaaacaaatttcaattaagtcaaatttctattctttcggataggcagcataaattttcgatttattatgttttaacgtaataaaataatttctttttaaccctttttcaattcggccataagctggtttttcgtttttattcaaacttaataatttcctatgaaataaatgatagtttgatcaataactttatcgatattgataaacgcatattttcagatttttgtagtacgtaccttgcgatctagcacaaattctgtaaaccaaagttacgcagacacaagcagttgaacgccgttttgaaatgtaaagtgaaatatatcgttccagatccaaaatatatgcttgatggatgcaagaagcaaatgcgttaatttttttttttttttttttttgtaactacaatagtcttcaaatggcagcatggtgaagttgtgcccatactttctgggacaccttccctaaaaacatcatcagctgcaatcaaaaaaatagatctcgaagaattttatttttaataaatcattgaaaacactagtgacataaggccttttctaatgatcaatttaaagattttattaaaaatatcactttttagtggatgactactatttccaaatctcactgtcaggtgattcataccgtgtgggatcgaaatccgtacagcaccgaaattcgtacacttgattgaattttcattatttaagtattaaaatgaatacatatacaattttaaaattacacatctaattacaataagttataagttgttgttcatgctaatttgatacaagtaggccatgatttaaaaatcgtaaaaatcaaaatgtgaccgctcataattgtaatgattggtttgtgtgccttcttagtgatttgctaagaagactgagaatagtttccaacatattaatagtcaaattcgcattctgtctgaaccaactgttgaccatgatgacttcttatagtgagtatttgtaattcctcaggagtaaatgatatttctgagcagttcaataattgtttgggaggactattgtgctgtacggattttgattcataattccaaattgaatcttaatccctacagtgcaaaactttaacatatttcatcacgtttcagccaataaatatgatagtatgaagctgaaataaaacgctgatgattaaggaaaaggcgttgaagcagtgtataatggccaataattcccgaaagctgcgaatgctgtaggtattttgaaaatcaccttcagagatgcagtaataaatacaggagataggcaaaatgattgagataggcaaaattttgcctaaactcaaatgcttataactttacaaaaaatggatgaaattggatgcatccagaaacagtcgacggcaaatttagtctagtatcaggagcttgcttggccatgcatattagccttcggacaccggaaatgttccgaatattccgagatcatgttcaaatggcattttttctgtggtttgtatttttgtgcgatgtgaagttgtatagatgtctacaatttttcttgaaataagaactaattagaagttaaatgccggtgaacggattaagattcgttagaaatcttcagatatatgaccatttccgtaaaactggttccgaaaaatatggtcagtcatgttcgcatttccaatcatgcatttacatgtaaatattatccgcagctatatccaaatgggcatcaaacttcaaaattgtgctttcggcaacatcgttagatgcacggaccactgtataataggtgccctgggggaaatggccgattaggagcatgtctggaatcatatcaatatgggtgtcaaacttcaaaagatggtaaagctcccgggagcattttcagaaccagcggctgctagagcactgtataacaggttacaagtgccccgagagacttggtcatgttccgaattggccaattctctagggtccctcggcatatactatagagtggttattacatcttgtggttctaaaaatgctccacatcctccaaggaacatggaacctactttccatggtagacggggattctaaaactgctttcggaagcatgaattttataaatattaatctttgttacccaaaatttatatgattccgtacatgtgtgaaattggccatttccattggagtacctccaacctactattcagttgtcatggcagccggtggttctggaaatgcttccggaattatcattttcaaacatcctgaagtttgatgcccatactgatatagttctaaatatattccaaattggtcacttcccccagggcatctggaacctactatagagtggtcagtgcgtctaattattctgaatatgctgctggaagcatcatgttgaagtttgatgcctacttggaataaaattgacgtctttagcatttgagttttgaatttaaggcagctgtacggatttcgaatcacgggtgtacggattttgattcaaccttattagagtgtacggatttcgattcaagacaagtgattttaattcttgtctttttaaggtttctactaaacttcaggctcattttgggattaaatatgtcagtcaggcagcactggatggaggcagtcacctttgacgacgctcctgtgaaaatttaattttaactagcgaaaaacgcggacctaatgctgttttagtgactaaagagtttagttggtgatcgcggaccagtgtatagtgaaatttaagcgtttccaggacataatttcccctaagtaacgattttcaaacgctgcctactgcgtgctaaacataaccttaattcgtggtcctcaactactgtcgctacgttacgacaataacaaaacattgaagtgcgtgtagatgaaatcaggaattcagccaccgtcggggcccctgacagacgttaccatctgaagtgcctacgtgtcgcgaagaaccgccagcgctggggcgtattgctgtgtgtgtcgtgaattgcagccattgtctgagcttccggcagtcgtgtttcattaaatttccagtgcctgaactcaactagtttgccccgaaagtcccgtaatcatcactatgcaactgtaatttactagtaaacttggaatcgtcgttcagtcgtgatagtaccaccaaaacatgtccgatgtagatatttgcaaagcctgcaatcgtcccgacccaccgtcgaagaagggaaagaagtccagcaaagccaagaaaaaactacctgtcgaatggatcaactgcgacgggtgttcagagtggtatcacactatttgtgttggcatacaccaaacatgcatgccggaaatccaaaagtactggtacttttgcgagcgatgtgcaccaaagggaaatcttgttctcaaatccgagccaatcaacgttgtttccaacaatgatcttgagcacttgaagaacgagatccaggcgctcagtgccaagcttcaaaagctgcaggatgaactcactaccatccaagctggcaccaaaaagcagatgcaacgtcttcagaatcaaattcaagtgatgattcgcactgaagctaagtgtgagaaaaacgacaaaattctgaacaatatcgatcagaaactcgaaatcatcgagtccggtgtgaagctagctgaaacgtatagtcaaaacgtgtttccgtctaccgtacaatccttcaaaatggaccgacaggtcgatatcacctacgattgtaatcgtcttcgacggaaataagattcgacagtccgttctccaaaagtactacgaaagacataaggatttcaggctttgcaaccttggaattggtatgccacttgactaccgattcaccatgaacgtccatctccagtttccgtgcccgaaatcttgcgcttcgaatgaaacagaagaaactcgttcgatcagttttcgtccggcacgacagtgtctcagtgctactaccaggtaatcaacgatatacccttgtgaaggattctcagcatttgctcgagttagtaagattcgcagacagcacaaatgattcatccgttttttcgacgccgaatcgactcagatttccctttcgtctaaccaccactaactttccgcatgaactacgacgacgattccaaaaataatgaatatgccacgtccgaacatatcaaatttgcgtatcggccacctcaacgtacgaggtttagaacgacacatcgacggaattaagttactacttaacaaacaaacataccacttttttggagtaactgaaacaaagctgaaatcatcggcaccagtcggtccaattcgagttcccgactataattttattaaacactgcctcccacgcaatggaggccgtggaagcaaaacgtatggaggagttgggctgtatgtccgcaaaggtgtgaaagcagtgccgatactgaaatcagaacatgatccgcaaataccgaagaataagcgactcgaatacctagtagttcgcgccgaggtaaacgacctcaaagttggagtaggtgttatatacaatccttccggggttaacccactattcgctcaacaatacgagaagcttctggttgatttgatggatttcgacctcgatcagacctatctcctgggtgactataacatcaatgtagcctcaacgacagcatcagctaatgttgcggcacttcatcaaatccacaccactttcggtctcacagttttgcccacatcctcaacgcgtattaccgagagcagctctacaacaattgaccttatggtaactgaccaacctgctttaatccagtgctctaggacgtctactggaaatactatctccgaccacgaagtcatcttcttagtcgccaatgttcgtgttcaaaatcctcgccctcaacgcattaaggtacgtaactttaggagaattgatcctcaggcgctccagatcgatttccaaaccagcaatctgcatcaaattaataacgcaacagatgtgaacacgaaggcagaactactcacgtctgcactacagtccctgatgcaacatcatgcccccgagaccacaatcacagtccgcgaccgacgaacgccttggattactgcggaaatcgagcgacagatttcacttaaggacatggcttttgctctctatagtaggaatccaaatcgagtcagaggagacgcccaatggcgtgactacgtgcagaaaagagatagaacaaaaacactaatcttcaaggccaaaaagcgttacgctgagcgtaattttgattgctctctaccagctaaaaagttatggtgtaacttgcgccgtgaagggatccataacagtgctaaaaacgtttcacccgaggatcctgtagatgctgaagccctaaatcgattcttctctgaaggtcatctatctctcgcaaatcaaaatgtaacgcaacccttcaacggcgtcagaaaccatcctctcccaaatgaaccagttgaaaatcctagaccaaatgctttcgcttttcgacccacgaacgtgcgcgaggtcgctaacaccatatttgaaattcagacgagtgcagttggcagcgatggtgtaccagtaacgtttattaagctgttgagccccactatactccctgtattagtcaacatcttcaacgctatgatcgaaaccaaatgttttccctccatctggaaaaaggcagtagttacccctattcccaagaagacatgccccgccactccacaagactttcgtccaattagcgtgttaccgtcaatttcaaagatgctggaaaaaatcctgcttctgcaaatttctgaatacctgaaggaagcagaacctccacttgtcgctgccaaccaatctggatacagaagaggttacagtaccagtacagcgctgtctaaggtaacacatgatatttatgcgaacctagataacgggcgatgtaccctgatggtgctagtagatttttcactagcatttaactgtgtaaaacacaagaagcttgaagacaaactacgacgcgaattcaatttttcgccttctgcgatcaatttaatatcgtcctatctcagtggaagaagccaggttgtccgtgtaggagacgactattcaacagagctaccagtggaagacggaacgcctcaaggttcgtgcctaagtgcgatgctgttcagtctatatatcaatagcatagccgacgtaattgaatgtgaatatcacctatacgccgacgacctgcagctgtatgcctctggacggattgcggaagtagacgtactagtggacaaaattaacagggatcttgcatcaatcgaacgctggtcgatttccaatggactgtttcccaatccgagaaaaacgcaggccatcatcttttcacgcaacggcaccatcgccccgaacaacagcatctccttctgttcgcaacccatccagctttccagtagcgtgaaaaatctcggcctgaaattggacagcaacctctgttggactgaacaagtcaacgatgttactaggaacgtctataatacacttcgcacgtttagacgtttttcgagcattttgtctaccgaaacccgcagaaagctggttgtagcagtaattggacctctcttcatgtactgcgatacggtatactaccctggcctctctgttggtcaaaagcaacaattaaaccgagcgtttaaatcagcagtcagatttgtgttcaatctgaaaagacgcgacacgactgctactttccggaattccgtatttggacgagacctcgatgcgaactatcaccaccggacctgttgtctcttgagaaaagggtaccatagtgaactacccagttacctcctgcaacatctgcgaagaggacgaatggacaggacactttcattcgttgtgccagcccatacaacagcttccgggaaaagtatactgatatacggggcacaatgctggaatcgattggcagtagcaaccagaagatcccctacgatgacatccttcaaagctgctctggacgctgagcatactcgacagtgactaagttacttgttagaaattaagatgtgattctttgattaactgtccgctgttaatttttcttatttgtatcttcacttccttgacttgaataatggttgttaccaataagtttacgtgatgttaacaataaaattacaatagaccatttccgtgaaaaaattttattcgctcataagcttcctatcaatttactgatcaaactttcccaagtaacccatatgttttgaagcctctaactattgaaaaacaatgaaaaactggcggcacgccatatcaccccacggtctccaacatttttgtttatgctggaaaccctcttgaccccctgttcccccctgaatttaccacgaacgttgtggtgaatattatcagctgactgtcaaatatttttgtttttatttatatcttcattaattgttattgttaatgtccggatagctcccgtctagtgcacaaccagtgtttcatcggcggtcatcgattttaagaccagctacgagtacattggcacgattggcaccaagattgaagaactgaaacatccgtccgaagtgtctcagagctttaacgtctctgaaagtactgctgcgataaatcacaacattgcccgtggaacaccgcgtactggatcaagagcagcaggaaacattacaaaaaaggacaacgtaaaacaatgattgtttttattgaagaattattcttcaactttccagttatatgcttggaacgcttggaacagacgacatgctgcatgaatggaattcgaacagtttccggaacgctttggtatccatcgactcttgcgaatgtttgtgttgtattgtgcggaacttgaagttgaaagccaaaggtaggttttgatccagtatcgatacatccgaagacaaaactttaagagacaagtgttattaagataagtattcattatttatgcctaaaggaaagagattacagtgactgaggatgcattctaagtgaaaagctcttctcacgtatagtcactatatttagcagggctggtaacatgtctcttattagggactaggtgtctattttaataaaagtcgctaaaaagtatagttttaatggaaggttattttgaccttccatcaaaaatataccaatagtgtctaccattttctttcattattgaggttcattcagatatttcctaaggccaaaacaggtcactttaaacccctaaccactccctcgtacactttttgtataaatgttctgcaaattttgtatgagccgtaacatcatgagtatagccaaccaaccactccattcagtgttataaaatttttaaatgtacccttatccttgcagcaaaccttgatgtaatttcgtcgcagtttcctggggaaaaagcttcataaatttttctagtaatttctccagagatttcatctagaatactttcaggagctccttcagggatctctacaaaaattgttctagtcatttttgccagaatttaaagcagaaaattttcaaatgatgtttagaggaattccttcaggaaatccttgagcacttcaacgctattacctacctccagtattttccttgggtattactttggatgtttttctaagactatcctaggatttcctccaatattttttccaccaacccttcgaccgaattctttagttgttgttttagggaatcaatccacaaagttttcgaaagaagcggagggatttttacaagaaacttttggattaattctacgagtggcgtgaggtgacaattgtcacctcgctatacgacaccgacgccactcgtagaattttcctccgcgtgtttatatgaattccattccatatccaagttttctctcagaaatccacatttccttgagaggttacacgaggaagttaagaactcttccaggaaatttccaataaattcaacttgagattcatcataaagctattctgacggagggtaagtatttcgcgccagtacatcatccaagtagtaatcttgtaattattccaaacatgtctataacacgttgaaaaactaatcatggattcttccaaggttaatttaaggctccacgccagttcatactatatatatatatatagtacctgaatcctcctttaatttctatacaaatttctttagggattttgcccgatgtttttcgaggaattcctatagaaaatccagcgagatattattccgagaaacgattgatttatttttttttttaattatcttagcaatttatctagaatatcttctaaaactttcttaaaagtccaggagttctttcagaaatccttgtttattaaggaactatagaattcacacgaatttcatcagattgctttaggattgattgttagttattataacgagtttaagtgatggttttagtttctatttttatcttcctactgtatttagtaataataaatacagtcagatattttttatggaagatacgtaccgcgtaagttcaaaactcggttcaactgtgtagcgaaatatgaaaaataatttttgttttttagtagttactttttctttcaagaatctgttcttacagaagttcttccaagataattcccaagaatgttttgcaaagttcctacgctgatttctccaatcagtttcatacgaattccttctggaattaactcttccaggcattattagtagaaaacaattaagatcttttttttataaattcatctagcaattcgaccagtgattcatcaatatttttttctagaaatgtttcatttaatccatgaattactactccttcacgtcttctaaacaattctctagtaattttctaagtaaaacctccatggattcatcaaaatttcatttcaaatttcacattagcaaatactacagcaattatttcgaaaatttctacacagtattttctttatggactcttttcgatattttacaaagaatgcctccagaaaaatcctggaagattttatgcaggtattcaattgattattttccattaattattttagcaatttatctagagaaaccttcaagactttctcttttcagagatcgtcgcaagagaatttcatcaatttctagaagatttgttatagcgatacgttcagggattttgccaataatgtgttaaaaatgactttacgattccctggaaaagtcctgaatagtttcatagaaaatttttttgaagaatgtctcaaagaatgtctgcaagagtgcaagactttctgaataaatccttggtgaaatcctatggctcacactttgacaaaaatgtcagcttccgcgaatctctcctataatggatcactacttacgaccttctgtgttgaacgatgggtttcacagtttgaaaaataatgctagggagccggatcctattcttggcacttttgtttcacttcggcaatgggttttgttttagagcaacaaagctcatatttggctacaatgtgcgtcgtactgatgcgcttcttattgcaaagtttcagacatttcggccgagaaaaccccccatgccaaagtgaatcatggaagtattcaagtggttctgcaccctatataggggaggctataccattgactcggtcacgtttactgcactgctcagtgattttagtatacttaaattttcgtagatttaaaatcgttggcaggccaggattagggggtggggggtgccaaggcactatgggccagaaatcaaaatttcgcgacaaaagtccaaaaaccttttattaataaaattaataattgagatgaatttctcattattgagaacatgtgtaactgtataccaactatcttatttgattaattacattatttcattgcactttatggggctcaatattgtctataatgtaaaacttgaatttcaccctatcttaagaaaatttggtttgagggggaaaatggcaagaaaaattattgtgagtaaatttttggaaagcaaattaagtgcattttacatgtctggtataaaaataatgttaattttaaattgaagcattgattttacaatgtaccagtaatattcactatatttttactatttcaccttaaaagttatggtattccaccgtattcgacttgcaaccattatgaagtggaagcctagactccactctttcatgtgctaccaaaattttttgcatatatttgcggatggccgagatacatcggtttaagtacatgcgataatttggttgatttgttaacctcatatttttaactttgctgctgttcatacaatcacaaatttaataagtttgattggtataaaacaactcaagcagtcataatccactacttttgagtaaatttccgttcgtgagctaggtgacatccagtgagtcggttgaaaaattacaaaaaataataattttgctaatattctttgaggccatgatttataaggtatgataagaccataacagaggaatctgtttgaggttcgcgatatagggactaatgcgtggtttttggacaacattcaggtaaaaatactagatttttgaagaaatatgagacggctgagattgttttgtgtctatgttttttttttgttcaaatcgcagtggcttaaattgaatatagacagtagaaattttctaaatactatcatacaaactctgcttattatttttcaaacaggattaaaaaaatggtataatattttacaaaatttatgaaaattaagtagaaacatcgataacttgcccgttttaagtttgatggttcacatagagtgaatagatttgccctcatagattataaaagaattaggcaacctcctgtactatcttcccaaactacgttggattatcagaaaaatacagtacaaaataatgaaagaaaagaataataaaaaagacagcaccaaatggccaggtcaatggccatcaacgaagaacgttaaaaaatcgttttaatccttttaaattcctaccagaaatatcggctatttaagcgtaatgttgtcgggagaatgttactagtttaatcagataaactattcatttgtacataaaacaatcatcttattccggcgaaaggaaatgaagatttttaattctacttgagatctggacaaaaaatcacgtttcttatataagagcttgctgcacgtaatcatataatgaatttcataagcttgtgtaaaccagatgttttgatgttttaacatatcaagttaggcctccaatacagcttgaatatttctgaaaataataatttgaaagtgattttgattgaaacgtttcaaacaatttgaatggtcacattttaaatcagcatagcatctacaaatatgtaattcatattatattgttccattttgaaccatgcctatataactctctgatgattgtatggctttttcataggttatgtacagtaacaatattgcgttagaaaatttcaatagtaaattaaatacaaatgtaaggtgaaaaaccaataaatacatcaaataaacagttgtcaatgcattccaaacaactatgataactatgatcacatttttcatgcttttttactacagtaaaacctccgtgagtcgatattgaagggaccatcgactcatggaaatatcgagtcatggaacacctattctttggaaagctgtttgaagggagcatcatagtaaccatgagtttatgtttttagtatggttccatgagtcgatatcgagtggagggatgactgtattcagagaagcttaacagtgtatcttcaaaatactttcaaatgtttgaaacatatctttgaaaatacactatttattttgtaaaatgatttatgagcgaatatcaaataataatgcctatatttacatattttcccaaatactcataatctttacaaatattctcaattcaattcaaaatgaatcttagtcattccaaacacgacatttgcatgcttccttaagtttgtattacttttagattattttttgttcattttggaagtgtttggaattttgtcgcgaaattttgttttctggcccatagtgcaagggggcaaaaaaataaataaattaactttggtctaaagttaatctgaatgcacaatattctatcaaacacatctaaaattctacagaaaattcgatgtttccatattctgatgtactcttttttatttgcgtgtcagattttttaaaggttttgtttagatattgccttttttaccaaaagcttagaattcaccagtattttggctcatgcccaaataatttgtttaaatattgtaattttcattaagggctctgaatttaccataaattttatccaaatctaaagaatataaatataattatatttcttcgatcctcaaattactagcccaaatggatagatagattatcgatgtaattttgctatagtattcgcaagatttcggttcgtgggttatttacaaagaccatagtttcatctgcatatggtctaagtgtgcatggttcttcacaactgttaataggggtgatcggggcaatatgggccgcctaaggaatacgtcatggaatgcataaaaaacagcaaaaatatggtttaaatgcaagtgattttataaaatgctatcttccatgttacgtctataattaatgttaacatcaacatgaaaattattttaggaactttttggaaaaccatgtttttctacggggtggttggtgacctatggggcattttgagccaccctacggggcagtatgagccacctcattcaatcgaatgatttttatttaaaacagtatagagaagagttagtgatgaagggtacattattggaaaggaaactgtatcagctttgcttgaaattattgattctagcggtttatttgttaaagatacataatacatagtaaacagaccatgttatactagtactaaattgcgatacttgattcaacgtattttctagcaaagtgttccacttgtaatggtacataaagatgactatgctggaaaaaaataatctggtatatttaggcaatgcatttttatgttcaaaacatcgtttgttttgcttaaatctaagtggctcatttggccccgccccttcatcttgaaaataataaattgttttacaatgtattggtaaaatttaccagaataataaatatatttgtctcataggcttcattgaaaactgccaaaattataagcttttcatgacgaaggacaaatttgtacattttttgtaaatatcttgagtgtttaaacgaatatttttacggtttttattgtggtggctatttgaagcatcctttagcaggtcataatgacactagacattaaaacactgtttttgagatccttgccccgtatgttcatattgcccctatctggaacatcaaaattataaaacaagagactaagttttgagccttgaggaaggctaaaatagctaattcaagtattttagttgtcagttggaccaagagagaagctcatgcacttttctgaaaacagttcctccttattcgcaaaagttagttgaatatcagatgaaagtaacgctagacaatcgttcgtttctttaaacttgaaaaaaaaatctgcgcaacaaatttaatagttaattaataacgactgtcattcaagttcaataaaaaaaaaaaattaaatatgaaataaaaaaaaacatttatataatcttggctattgttattcaaatctctatgaaccatctagtcttgatttcaactaatatatttttcattttggatttgattgaaacgattcagtcaaaattttatctcatcttcattatgtgcgaactttcaagtattttatacggtgatttattttacgcaatattcacgatgtgagtatagtatagtgaaaattcgagaaatataatatttttctggagttttccggctattttattgacgcaatactacactttcatgtatcgggctcattttgtaccaaggaccccgtctaaggatttgacccgggccccacgaagcctaaatccggcactgatcgttggcgcatttcttagttttacattagtttatccagtttttccatgcaatccttgaagttttcgtaggtggctcatattgccccgatcacctctatagcttacgcgtaacaagctggatgccaaattaccatcaaaatttgtagaccaagctcttctcaacaatcgaacagctttttgatccaggccaggcaccggaacttatccgggatgtagaacggttcgaacacgtatggaaaggggtgtccccatcgaactacgattcccacctgatcagggtcatgtcgttgacaactcgcagaacatctagcgtccgttggcttcgtttcggtgctcgtggtaccaccactttcaactcaggcgtatgcgcacagtatgcctcgggactctgccagtaagtcctatcatccaccactccgcaagaagcccggaacgtttcacattcgaaaatattttcgctcctgtatcggtacatccagaatatgatcaatctccgggaagatattgttcgcaaaatgcattccagccgctccggtagtggctggtcgcaaacccgacaaatccttgtccacacagcggcgagttgaaaaaacgcattccttgtcgtacttttgctgcagttttatcgaccggcggaacacatcaccaacgccgaactgtccagttacgagacaatgtccatcgcgttgtcagtaccctggagcttgttttcttggtgttaccctctccatcggggcagggtcttccggcctgtgaagatgctcgcgttgtggcctctattgaaaccgccgtcttctagactaatgcaggaccgttaattttcagcaggtttgtatctcacgattccctgtgaatgaaaaacacaacatgtcatggtgatcaacacaaaacgttcagacttttcatacagaaagagccagctatcaaacctggaaccctacagaccgggctcattgatacgcgggctgggattaacttacctttcgagatgatttgatccgagaagatttatgcctgattacacccgggatggcagggaaaaaaacaaagtaccgcttcttgtgattccaaatgttatttcgcattttctttttgacgtttcaaaacgtaaataacagctgagcatagggttatcagtttctacggttttcaccatttatctggggtggtgaaaaatgaagtcaccacgcttagggttaccatttttgttccgcatggctcaaaaagtggtgaaatcgtcatttttcgaaaatttattaaaaattcaagaatacataaaaagaaaagaaaaacacaaaaatgttagtttgaaaatattatctttcgagaaaaaatacaaaacaggggtgttaggtctgacggaaatggtctattacaattacaattacaattacaattacaattaaaagatgtgaaagtcatagaaaaagagtgataaattgccttttacaaatccacatattttcaacagcggtttttatttggttaagtgcttaggtgtacggatttcggtcccatacagtatagaatatttatcttgattgttattttgcgaattaaattattggttgttgggcccaataccaccccttcaaagaatgagaatgagtccattttttgggtcgagttgttcaaaacagtcgcttggtcaagtaattagcgaaagagaaatcgatcattgcaattacgcccttatgatactgcacgcgtttgttgattaaatgcaccacttgcacatgtattattcgtgaacgtatttttggatttagaagaatattttcaatcaaattacaaaagttatttaaaaatcaatcaaaacatacgcattttggcccaatctcacccccggcgatggtactaaatgatgggagattagatagaatcgtaatcaattgagaaaggagaacagtgtattatcctatttttaaaactagcgatttttagaacagcatattgcatacgaatgggaccggctattgtacccacgaccttctgttttccaagcagaagcagctgtggttatgcttgtctgggctgcaaacttctctattgccataaaaccgatttattaaacccatttattttttactaatacaccacttttatatttctagcttgttgtgatttcaggatggactgcatcggtagtcatgatgttatatttactgtttggtttgtttaatacgacactaactcaactagcagcagcggcatacagttcactcagtcatacagcgtgggctatgtcttgtgcctgggtcatcattgcctgttcgacaggtcacggtggatgggtgaataatcttctatctgcaccacttctatatccattttctagggtaacgtactgtgcgtacttagtgcatccaatagtgaataggatatatgccatggaatctgattcacctattcacatgtcgccgaacagcttagtaagtattttatagtcaaaaatagtatattaattaatctaattgtgacatctttgcagacaaccttatatctaggacaagtagtgtcatcttacgtattagcatttttgatttcgttatcgttcgaagcacctgtggttacgatgctaagaatattatcacctaacaggaagagacagatataacacccacattgaaaatattttctaagatatgcttttcacatccctctcactcatcaatccttgtttgtattcaaatatttatgtgcaacattcctatgctaggtaaatagagattaggtgcatatactaaaggtgaacaaaagttgagtagatagttaactaagcgcctctgtgttctgaattttcttgttatgcgaatccaagcgaatctaagagagatatcgaaaaatgctcaatgattgaataagtatttgtaagcacacacacaatgacatttgactgatgctattaaattatatgacgaaacaaaacaaaaataaatgaacaaacgacaatcttgcgtttttagtgctatcacagaccataacataatttactaaattagatgttgctgaatcgtttgcagttttcaaaaatatcatagcgcgtcgagttcttaagatattgactgttgaacatgaaaaaaatactattccagccaacttgcatgcaagtttgccagcttgtatgccaatttattcgcttaatttgccacagaatacatacttcatgtgtattacaattattatcaacagagttcataatgctttcgatgctcaaaagttaatttttcatggtttcgtaaagtattgtattttgccatataaaagaaatgaagaattttgtatggaggctgcaagcatgctataaaaatcaatttaaactaaattttatagagcaatttcaacccaaaatatctgaaatgagagataaagtcatgtcttgcatgcttggtggattaaaacacaaaaaaaaagcttgataaatcataccttaaatttcatgtaccttgaaacggggtaactttgatagtgcgggactcatcacatgcaaaacgaaataagataatatctgtcaatcagttaagcaaaacgaatgcaaaagtaaattatattacaatgacttttcatgtcagagctattttcatgtgaatcaagaacatttgagatataatatacgaatattaattattgatgcaactttatca

SEQ ID NO: 88 - DNA, 7745 bp, Aedes aegypti
  misc_feature (5903)..(6062): n is a, c, g, or t
ttgttctaagcacaaagaaaaaacaagctagtccatttctgcagacagggcagacagctactgactgatcactcaaataacaactgctgttccttttatttcatccaggtatctacaattcatttccactaagcacagcataacatacctctaaatactaccaccgacgattcccgtatattctacctacgggtgcgacactacaatctcaacagaacccacgaccctcagcatggtcatgctgaatagctgcgcgtttaccgctacggctatctgggcccctaccgaccctgtcatactatatgtaaaaaattaaaaaatacataattacacactttgaacattgttttttttttgttaagttttgatgatgaaacgtgtaaaattcagatgttcaattattttctattaaaaaggctgttttaatgtaattttcattttggggcttggcttactttcattcaaacttaagtgaacagaaacgagcgtgctgatcttcagctgcttgcatgcaatgataaaccacaagttccacaaaagctcgccagtcttctgacactcatcagtgataatttattttaatgtcacgaccgtcacgacagttcagtcagtgttgttggctaaaatgtcatgccactttgttggctaatcattattgtgttatcgttcgtatacgaattaacttgttaaattctactccttctgtttattcaattgcaatcaattactgttaagttcatttcatagacgctaattgctactatttcgatgcagtgatcgtgaacatcttgtatttacgggtatcctcacgcgagtagattaggtgctaagtccgactaagatcttttgtcttccatatctgtttatagattaggtgcaaagtttatctctctacgtttcgttgcgctaaagaaaagacagcagctgattttgttttgtgaaacgaatattattgcttgaatgcataatttgctctagtgttgttatataattgatttagtgataaggaatcaatcatggccaggaatattctacaactgtcgaaatgtaagtatcaatttcaaggtataatttttagctttatctttctaaattttccactgaaatatatttaaattcaaatctaatatgaattcaaagttgtattctaaaaacgtgcttctgctttcgatttatatacatttttgtatacgtcatattaccggcgataccaaagcacgtaactctttggactttgacctgcaattctcggtagccctattaatgtattgaaacatcatattcagcattgtgagaaggaggtgaagtcataagatactaaaatctatcgtggccctagatcaaatcgaaatacagaacagaaaatcatcaaataagtaccataaagtgtcataattctgcgcagtcagagtcattaggttagatatcaaaaattatagtttttgttcttttactgtgtttttcatagacagcaagcaaaaggagcaaatgacaggtttccaaaatttcggataaaatgcgttacaatgggtaatacactgaattagagcactttacggcagtacggttatctaatgcaagagatgttggaatatatttcaaatacctacaaggcatttgcgaatctaaaaaaagatttgtgaataatataatgtccaattagaaactggtgcaatccaatttttagcagagtcattgcctcttcactctctgccgttaaacgcataattgtcccatgttaattttttgtccattttgactttttgccattcagctgtctatatttacgtatacagttgaggaaaacccatacaaattgactttgtttgacttcatgaaaagcaaaccaagtcagtttgccccatgtttaatttccacgtataaatgtcccgtaactacgaagtctctataaaaaaacagtgatatacgggagaagatggttgaaaatgaccatgtcttgtgtgacgcaatttatggatgatctcttatggttgctaaagaaataaaaaaaatctcggataccggtaattaaattgtttaaaaaatatatatatttattccaagtcgcattattgctcgcatttgtattgtaaaaatagtgcagaacataaatatctacgaaatgcacatgtaacacctccgggccaatttataaaaaaatcttcgagaggaatctcgagaaatcttgatatgaagtttttcagtaaaaaagtttttcactaaaagaataaaaaataatgcatattgaaattacgcaatagcaaaagaaaacacaaaagcggtcaaaaagtaggctaagtaaattatttattatataattgttgcagttgttataattatatatattttcagcttacttaacttgccaaactcatctcaatatgtgtttgtattttatgtcagtgaacgaagcttggagtgaaaggtaaaaaataaatttcaacataatgttgatgttatgttaattgaaagtggaacattccctgctgaatattatttaatattatttttaatttttaactttatttttcgactttcacaccaagtgacttcttaaatctgccgtatttattttgcttaattatattagcttctttgtaatatgatgttaatctcggtgtatacgtttagttttccactgagtattgtcctctgtattgtcagtctcaatagcctccacgatacgagaaacatgtcagaagtttttcaaaataatcaaagtctttaagtcattaggactccaactctctatacctgcaaccacgtaggtactatgttcttgctttgaccgtttttatcaaaacgcttttgaatttgacccccgctaatttgcaaatcgttcaaattaaaaattgttcaaacgtcatttagctcatggaacgcaatgaagtgaaatggaacgttgtgaaactggacgcagaattaaaacaaaccagccaaagagatgcccagaaacacgtttttttgttatacgtagggtagctcgaaattcaaattaaaaatggatccctctggtttgcatgaagtaccgttcaagttagcgggggttcacggtatttcgttttgaaagaattcatagtcatctgtttgatttctagatcgcgttcgactcggtgactaaaatctagcttatgcagctaatgtcttaacatgaactaggaaagctgattgtgctgacaattaaaatctagtataacaattgcatacaaaatgttaactttgtttgttaaggtgattatagaacgaagccacacttcaaattttcaagagcacaagacttgtggaccacatcgctccgcgttgaaaatttatcccattgatcaccaccagcaagcaagcaatttgattgattttcaacgcgaactgttgtcagattctccagtcttgtgcacttgaaaattcaaagtttggcttcattttataatcaccttaaattacatggattaaaaagaagatgcgtttctgaattcactgttcaatattgcgttctgttgaatatactttttgactttgcagacgatgcacggggacggaattcaactcaattttgagttgtatcaacgcaattccgtagttgagcccaataactcaattttggctaaatttccaaggtttccccactaggtagtttggctttaattccattagaaaaatatactcaattttgggttgatttaacgcaaaattgagttctttcgacccaaacataagaaaagttgcatttactcaaatttggcttattgggccaaagtacccccattgggtagatgcagctctctctatttttgacaacattcgtgtgggagaaagagaaaaccgagagattttgggttgaaactataatcgatatacttaattttgggtaaagtaaactcaaagatgaggtaaaaatatttctccgtgtggagtcgatcactgtgtccataaacgcatacttgtcccatgtgaataggaaatccagcaaacatgggactgacatgcgtttatgggcagtagcaggatttcgctatcttgaagataacgaggatacgcttgtaatgctattttctctgtcctttatctatctatgtatattattgcatgtagagaaataaggtttagcggtgtagaagctaaggcagtggagatggagatggagatgtagttcaagtttataacctatgacgatgatgtttcccttatcgtattctggctgcgaatatgaccttttatgaattgcgtaaccagatgaggaacccgcaacttgtaaaagaaaactatattttcaaactggagcttatttaaagctcatctaacatcatccattcttttttcgttaataaatttgccagaataaacaattccgtaatgtttctatcttacgacaccgcgattctctatcatacaaacaagtgtttcgaaaagtaaatctgttttctataataatgtgaagagagcaacgatgaagaaagaccgacgattgcaagtatggccaaatgaaaaatcaaagtcgatttgctctgtacaagccactgatctttctggtagctctctaaggacaggagcaggaagattgtcaaacgaataaatacggcatacttcagtgagctggtcatttagtgcgaatgtcgaaaaaaaaaacaagttgcagcaatcaggaggaggtcgactgccccgtggaaggcatctgtgtatgttcattctgattttgacgtgagcgattattgcaatacgaacgctttatgtatcgttttagcatcactccacatcatgaccctgagaaattcgattttcaaagtgcttgattgtattgtattctatactctcagctgaaacagtgaatacattttcatcagttttcacatgctcatttttcgcttattctcaaactaaacgctaatcatgtgcattacttgcagttccgcgagttcttttaaactcccaccgtaactattccgaggcatcagcacaatttccgaaaattacaactcactacactctgaacccccgagacaaggatgaaagatgggcaggtaatttatttctactgttcttatctaagaattgtctaattttcttccttttcgcagaagtcgacatggaacgtttcgccgacgaagccgatcttctgattgttggaggtggtcctgctggattttcagcagcgatccgtgccaagcagattgccgctgagaagggacaggaaattcgggtgtgtctggtagaaaaggcctctgaagtgggcggtcacatactttctggggcttgtctagatcccgttgctttgaacgaactaattcccgactggaaggagaaggaagctcccctgaacactccggtcacccatgataaattctcgtacctgacgaagagtggtaaattgccaatccccatctttccgggctggcctatggataaccgaggaaattacgtggttcgattgggtcacgtagtagcatggctcggtcagcaggcggaagaacttggagttgaaatctaccctggtactgcagcagcggaggttctcttccatgaagatggctccgtgaaaggaattgcgactggcgatgttggcatttccaagtctggtgctccaaaagacactttcgcaagaggcatggaattgcatgctaagaccaccatctttgccgagggatgccgaggtcatttatctaaacaactaatgaccaagtttggcctaaatgctgaaaacgatcctcaaacctacggaattggtttgaaggaagtatgggagattaaaccggagaatcacaaaccaggcttagttgagcacaccattgggtggccactggataaaaatacctatggtggttctttcttgtaccacttgaacgaaccaacgccactcgtttcagttggttttgtaattgggttggattacgtaaacccgtacattagtccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccaaacccatcccaaggtgcgtacagtcttcgagggaggcaatcgcattgcatatggagcacgtgccttgaatgaaggtggcttccaaagccttccgaagctcacgttccctggcggatgcttggttggatgcgctgccggtttcatgaacgtgcctcgtgtgaagggaagccactatgccatgaagagcggcatgctggcggctgagagtgcctgtgaagctattttatctggtgccactcaggacaaaacaggactggaaccgaaggactatcctgacaggtgagttaaaagttaatttacagttctatcattcaatacttgatctgtgttctggagtcaatatgaagggcctgtacttttttgtaagttaatcgatatgtgaattttgtttcaaacgttgttgcgtttccgcgagtttttttttcgaacttaaccccaaaccgagaatacttttcgaaattctgaaattgctgtcaaagcacagacaacctaactttgttttgtcagagataaaacaataatgaatattcttttctttcagaatcaaagaatcgtatgtgtggaaggatctgtacaaggttcgaaatgcccgcccaagtttccataatgcattggggctgtttggcggtgtggcttacagtggatttactctgctggtcggaggacgcgagccgtggaccctcagacatggcgctccagatcatacgcgcttgaaaccggccaaggaatgcaaaccaatcgaataccctaaacccgacggaaagataacgttcgatctgctttcatcggtagcgttgaccggaacaaaccacgaaggtgaccagccggcacatttgaccctgaaggatgacaccattccggtaaagaacaatctcgccatttatgacggaccggaagctcgtttctgcccagccggtgtgtacgaatttgtaccgaacgaagagggtggcaacatgaaactgcaaattaatgcacaaaattgcatccactgcaagacatgcgacatcaaggacgtaacgcagaacatcaactgggtcgttcccgaaggtggcggcggccctgcctacaacggaatgtaactgtgcaatacctacctctttcccttcttgaagcatttatccgaagcgcatgcccgaaccgtacccgaattttgtaacttgtgttattaggatagccaaatttgagatgtacttatttctttccttcgtaattggaataaacattgtcgtccagcgatgagaactacttttgcaaatactgtaaaatttatttatatccattttcataaaaaaaaactaaaaaataacaaaatttaataagaaaaacagaggatactaaggcattgggcaggggctgtgaaatttttaaatattctgggcaggtccatccaagcccttaaaggcaaactggcgggaatgtcttcagtaggattttttcttcattatcttcataaataacaccataactgtaataaaaaaaatgaattagtctttacaaaaaattcagatttccctatgttcgggcgcattagattacactgtggaacacgtttttatctcaagaaccagaataccgctattcttaataaagggttactaaatccatcgccgtttttaaaaatttcacagcacgtctagtttttgagatattgaccgctgaaaaagcaaaatttgcaaaac

SEQ ID NO: 89 - DNA, 24125 bp, Aedes aegypti
gagccaaaatttaccaacaacagtttttatattaagctagaaatagttgagcttagaaaattttatataaatatgcaacgaatctcataatgaaaatgagaaaaaacataattaacattaccttgtgtacagatactttgctgcttgctatcgcctttgcctccaaaacaaaagcgattagtcatacgcagtgttgccacaagtacagatttatctggaaaggtacagattttcgaatagtttttggtacagattctgtacggtacagattacagattttcaccgaaaagtacagattggtacagatttttggaattggcgatttttgtaacacaacatccaaaaaatgcttgaaatttgaaactaatttccacgaaactattattgaacaataagtatttccatagaatttaacatataaagagtgaatttatttcataaaaactgtattagatttccaaataaattaagattaaagtttctttcaacaattaatgttgtgtgtggtacagattttcagaatctctggtacagatgaaaaagattttttagccctacggtacagatataaatgtggcaacactggtcatacgagaggaagtggaactggaagtacctgtgcgaatgtctcgaggcccaaacaaaaaatagtgatagtatactttgtgcatggtccacccggacagcgaatcgactttcctgacgctggattcaggaatctggacttatttgcgcgtggaagaaatctgtttcggagcagtaacaaagcgctgatttgaaatgacgcagaagcagcgactattggtagattcttccgacgacgatattagcgataacgagtctcgtccagggaatgtatgtacctaatattgaaatcgaaattgatcattgcatgctgaataaccttcatcgtattcgataggggaatcttatcatcaacctggcgccagaggaaggcgattccgatggggcaggtaatggtgcgatgcccaacaatgagccagtattcagtttgaggcggcggaagcgcggacagtcacagtacgaggtaagtccccatcgactctggaaatatttgcttagttgggttgggatacctagaattgcgtactgtatagggaggctagtgagcatttaaggctgagaatgcagtaggcagtgatgactaaagttgcaaacgattgcatcatctgatctggcttgatagcgaacgatcgaacgttgaagatgggggcattttttggctttaatatgtaacagttaagtttagggtaggacaatatacatgtcctgcttattagagtggttcaaaaaatcgtgtttgcttcacaccgctcattcgattctagttgaaattctgagtgtcgtcccaaaatttgagctcatttggatgaaaactgagactgcacaaaccctttaaaatttgtatggaaattactatggaaaagggaattagtgaattcaatcagttgtagtgtttgcccatgtgctctttggggattagagctacgttggtactgtgagatacattcatcagctacaactttgccgaagaccgttttcaaatcggacgtctcagtaattagttattgatttatatttacccaatcccaaataccacagcgtaacaaaaatgacatttttgcgtgtctcaagtatcaaattatgtgtctctagtctcattcagtctcactgaatctgatgccgttctcagaaatgttccagctcgtcacaatttttagctacaggtcgccaaagttacataaaacactggttttattgatgtttacataaaatttaatgtattatttatcaaaatcttctgtggtatactatttcaaacatgctaaataggacttgaactttcaatttagacacaatttagttgaaatttcacgataaaattgagtttaaatcgattttttccaacatgcttgtagtcttcatataaaattcttcgtttctcttttatggcagaatacaatacctttcttaacgaccaaaaaatatcattttaccatcgaaaatattatgaactttgttgataacaattgttttatacatgaagcttgaattctgtgacaaattaagcgaataatgttagcgaatgcaaatttgcaatcgaagcaactcatgactttagtgttaagattgattttgaataaaaaatatataagttgttagaccgtcacctagaccacacgcgtcttttattagctctgccccaataggttatgggccgtcgacacgtgtctagtggaagcggaagaaaattcaagacttgaagcttttttcacttcaagaatggcgaatccaaatgcaagaagcagcgcatccggcgatggcgttttggtacgacagcagcagcagagtttcaacacacagggccacccccacatcgagcggctggtcggtcgagaaaactggaggacctagaagttcgcagtcaagacctatctggaagtggaagatctctgggaagcagcggaaccaacgcccaatgaagacggaacgctccccgctgtggaccctcggaaggacagaatcgcacgaactaaaattattctgttcctagacccggtgaatttcattcacgtcgaggaggtaaaaactgcggccgaagtgtagaggaagctttcgaacacattcgatgacactggattgacccagggtgggtgtacggctgtcaactacaaacaaagctcgcctaacaatcatctctcacgcgagccgtcccaaatagcatcatatctccagggctgttacaacaggcgcgaatttcgcgattctcgcggatttcgcgattttcgcggatatgtagcggatttggccagccaagcgcgaaaatcgcgggtgaataaaattatgtcgcgaaaatcgcggatttcccaaatcatgcaacaaaaattgcagttatatacatacagtcgtgatttcataattagaaaatttttatttaaaacaaaaaaaatcatgtctctttttgagagcagtaaagttcagttagtatagtcactgatatcgaaaattttgttcagggtaatataaaaaacagtaacattttatttgtaaaccattctcattttatttgaagtcatatttctcgagggtcgctaagcaatcaagagatcgttcttccctaaattcttaatgacacaaatctaatatttttatttgtgtttacggcgatcggtaggtttttggttaaataggttaaactggaaatagaaaattttcatttctttctcgttaaaaatcttagaaaatggcgctcatttggcttggtttttcaaatatctgaaatcagaaatgaatgaatagaatatgtcaagacattaaaccatgtaggaatttgtgcggataatatgcggacactctggttgagttttggcgctgcagtcatagttggttaccctatgaaatcttatcatctatagaaaagtttaaaagaatatattgctccgcagtcaaattaggagttttgtcagtgaagagcattgtaaacctagatgataaaaattacttgaagaataatagaaagcaacactggaaattgtatgtataattaatgcaacagtgaatgtaaatataactaaataaaacctttaacagtttaagctgatcaccataaaactgttttacgatctgctttgaaaatcagtacaacgattgaattaccaccacaacacaccagttaaaaagttagcatctgttgaaatcgccaaattgtaactctggaagaaattgttgaacacctataagtgaagaaaaatttaaacacacttagaaaaaatcattgaaatttatgtcatatatgcccgacatattgaagcaagtagtaaaattaggtaaacttaagtcacaaatgacgtaactttccgtcataatggactaaagattattcgaatcacaaaaattttttagtcactttggatgttattttacaagaaggacgtatttttaatttctaatgccatcaaacttacgttacgtacgtaatattagtttcttcttagtgtgcagtactatgacaaatttggtgataataaatttgaagatagttagagttctctgtcaaaattttatgcgttttgctcaaaggagaacaaagttttagcatgttaaagttgaatattctatatgaaaatcggctttcactactgttattctgaacactgtatgtaccagtgttgcatttgaacgcgttcagttttctttccagttcaattttttttgaaaaagagatcaagtttttttgaacattgatcagttcaaaaatttgaactcagaagagctgaaaagtgaacgtgaaaggaaaattgtttcatggcggattaaaaacaaatttaaaagcagaaagaggaagctcgacttaataagcatgcagcgttcgagcactcgacactgtagaagtctgtaagtcgcaggcgaaataggcctatttgtcaagataagcaacacatattaaagtttaaaggtatttgctcgccttacaaatgattttagtattttatttttttttttttgcaaaagtgaagtgttaaagttcaatttgtagttttaaaaattcgaaatttaactttttatttcaaaaaaacctttacaaactaattatggatgttcttggcatgtcaactatttttgatttgaagttattctactaaaactaggaagaaaatgcataattgttcctaaaaatttaaaattctaaagaatttaagaaaaaaataatcagagtaatggcatttttcctcaatatcttccacatccatatcgaattgtgttaagtatagttgcaaactaggcctcctctctgcttgtagtgacgctaccatttatcgaattgcacgattttctacaaaaaatatatattgaaatctcgattacttttccaaatcgacgtaagtaaatttcatacaattttgagaaaattaattaggaagaatcacaacctgtcttctaaaactgttttaaaatgaatcacttttttaccattttttttaccgtgtacatcgcttaaattttgcatacaatcagttcgcgttcaaaaagtaggtggtttccactatttcccacaaaaaagttataacaaaatgttaagccgtttcattcagttactttcgacgtttttgtaccagtgtaaattcggctcaagtagtgttttgttttgattcgtggttaagtcactttgtctccccatacaacggagcggtaaaagtagcggttgggttgcgaaagttaaaattcttactttcgccgttttgtaattccggtattaaacgttctaaaagtgtttgttttgctcaatggtagatactttaagataaggcgaaaatattcacttaaagtaccattaaaaactagtttttgatcatgcacgttttcgcattttttttataatgaatagtgaaaatgtcaatgaaacagatttcatttcggcgcggaacgaatttctccagtcgcgattttcgcggatacgattttaagatttttgtaacagccctgtatctcacgcgggccggccaaacagcacaggtcgaaaacgcgggccatgccaggcagcaaatgctgatgcttttcaacactcaaacagcggaatgtctagcagcgttctgagccacacgaacacacctacaaaacatgaacggtaggcgcacctcgttgcatatacccttcctggattgacccgccagtggtgccttctccacaagctaatcacgacgaatttggtcagttgtggatcgatggaggcctacgtgaaccgtatgatttcgacagcgcatcagctcatcggaattggctttcccttggacgacagatggatcggcatgttactgttggctggcctaccgccggaatatcgccccatggtgatgggactggaaaattcaggaatacagataacaggtgacaccatcaaaacgaagttgctgagcgttcaaatcacctatgatggcttgggctgcggtcgtcctcgcgttcaagctgcgcgtaaaaagcgtctttatcatcatcagtgcttccggagtgagggctgtgcacgtttattatgctgaagttgaagaaccggcctttgatcctcaacttgcacattctctcattgatcggccaccacccgatcacgcgcctctgcatatcacccatccacggtgccccgacagaccgttattatgtaaataaaatgtccatcaaatctgaatacagggctcgattcctgaggtcattctgcatctctgggccatttttttaaaaaatccctaggaggaatcttgagaaaacttgatttgaagtttttgactaaacatttcgatatagaacattttaaaattacgcaatagcactaaaaaaacctacaaaaacgttaaaaaaatggccaaactgtgcgcatctagtatataattgttaccgttgttataattagaaatatttacaactgatttaacttaccagagtggcttaagtatgtttttacatggctcaaaccagtaagcttagttaactagattcaaatctaagaaaaaaaatttcaatatgatattgatgttttgttcgataaatgtgaatcactcaatgctgaatattatttatttacaatctatttttcgactttcacactaagtgaccaacccacttaagtctgccgtatttattttgcctaataaaatttgcttctttgaacatctgatactactcttggtgtttacgtctagttttccaccgactgttgccctcagagttttacatacctgttctacattctcagccacaacgggatttttttctacacgaaaaacatgattgttatatgtcacaagtgttcgaagattatcaatgtctttaacaacttcaaacaaatcccgcataagtattacttaactatccacatcactaggacttgcattatatatacatgcaaccattcacttcattttaatagaattcattgtcaatctgtttattgatttctaggacacgttcggctcagtaacgaaaatctagttgtggcatagacttaaaaaagaaagttttatcttaacattaacagggaaagctgattaagctgataaacaaaaattaagtgtaagaattgtggacgaggtgcctgcctttttttttgtaaaattacatgcaatgaaaaggagatgagttttcgaatttactgttcaatattgcgttttgtcgcatatacttcttgatgacttcattggaatctatcgcaatgcagtagaacagggtttcactattttaagagggacaactaggataagcttgtagtaccatttattctacccaaacctatatggttgcatgtagagaaataggcaggttcagttgtgtcgtggcagaggcagtgcttgatagggatgtagttgaagttgttgaagagccatagaacgcttgtgacgtgtgatattgatatttcccgtgttgttgttgaatttcctcgcataaaacccttttttctaagttcctttgtacattttgtttcgttctttacacccgtactaagtaagttgaatcaattcgtagcagctgtaaaatcaacatttgttatcataagatcgcagattagttcgattaaaaatttatacactcgctattgtatgctattattcatcatataatatatgcacgtatctcgcctccacttttgtacgtagaagaccttttcgcgacttcttataagtgaaattttgcacatgcaaagcctccaggtgatttcgttttacgtacattttggttgtctgggttgcaatcctttatcgtacaacactggtcagtttttcgaaaagtaaatcagttttcaatattaatgcaaagagagcaaagatgaatgcatgcacataaaacagacgttgaagtccgattgtaaaactgtgtaacacaataaatggtcattttgaatggcaacacaagtagcaacatcgtggtggcgctgtcatcgctaagttcccaggacgatgtcagtggtgaatatgaaatatttctagatactgatattcaccatttattgacgcaattcgctgtgtggcggcgctagtgattgcaaggagtttccatttgaatatttacataggttttcagaaaatgtttgttccagcatatacatctgttatctgtgatgcaagcatgcccaaatgaaacatcattgtcaatttgccctgtataaaccgctgattcttgactctctaaccatatttatttacgaacaggagcgaattctattcaataggcaaacttcaatgagatggtcattaagtgcgaatgccggaataaaaagttacatcattcaggtgggggtcagcggctccgtaaaatacatccgcttaagttcattctgatattgacgtgagcgtaccagagcaactaaatcattccaggttttgaacaaacgtttgatactttctctaatcggctataacagtaatcacatggcttatcttctgactactatcatgtcacatttattctaagatccttgttttatcaaaatcacaacattagtaattgtaaatttattattttgtattatttcaatcggtttaacgtagaaataaaacaatcaattaaacttaaaccattaaactatgaaaaaaacatacttaagccactctggtaagttaagtcagttgtaaatattactaattaatacaacagtaacaattgtatactagttgagaacagtttggccaattttttttagcgtttttgtaggttttttcagtgctattgcgtaattttaatatggtttatatcgaaatttttagtcaaaacttcaaattaagatttcttgagattcctcctagggatttttttaaaaattggcccagagatgcagaatgacctcagaaatcgagccctgtactcagatttgatggacaattttttttacataataacggtctgtcggggcaccgtgccatcactataaaagctgttcccagctcatgtgtattgccgcagctctggtagatggtatggttaacctctaaacgttcgcaccattgatcccttccaacacacttcctgcaacgctacgatgccgaatccacggtccttcagcacgtcggcgagtatgcgtgtgcttccgatgaagttgagagatttacagttccacgtaccgagcttccaatcgctagtccctttacgtcgctgtggtcttcgccgattgtcccggtccgtattctctcgttgattattcgttgcttgatttttttacggctggcttgcagggcctgacaccaaccccctagatttccggaggaccatattgcgcagtttagcttagagtccttctctggcactcggacgatgatcagtacaggacgatggagtacagacgctcaaggtttgcagaagcaaaagcaaaaacaaaccccccccccttccctgtcagcatacgaccaaagttccccccgggggttggttacccgatcttccccaaggttactcgtaccccggccagtaccgcgaggaggtagggataggtgttgctgggcaagaggctaaggaccgcacaaaggggtctattttattccttcaggtacgcgaggtaccaatggtacgccatgcccagccatttaccaaccacttgtttgtctgcatcggctgatattcagaatctgggaaacgaaacatctaccggaggagaggaagcaaggcgttatatgctctaggcagcatccatttattacgtaacgctaaaattggcaatttaaggaccccctccccccgtccgtaaagctatttgtatgaaaaatttcaaatttttgtgtgagccgtaacgctttagcttactccccccccctccccgtagagcgttacgtaatttgtggacggcgccctatctacaaaaagggcgacaaattgtagtgtgaaaattatcgtgcaatcactacccgccttaatcacaaagcaacaagagtcggactaatggtggatgcgttgaaaacaaagtacatgctggttggcggaactgagcgcgatagagtccgcctaggaagtagtgtcacgatagacggggataccttcgaggtggtggacgagttcgtctacctcggatccttgttgacggctgacaacaatgttagtcaggaaatacgaaagcgcatcatcagcggaagtcgtgcctactatgggctccagaagaaactgcggtcaagaaagattcacccccgcaccaaatgcacgatgtacaaaacgctcataagaccggtagtcctctacgggcatgagacgtggactatgctcgaggaggacttggaagctcttggggttttcgaacgccgagtgctaaggacgatcttcggcggcgtgaaggagaacggtgtgtggcggcgaaggatgaaccacgagctcgctcaactctacggcgaacccagtatcgtgaaggcagctaaagctggaaggatacgctgggcagggcatgttgcaagaatgccggacaacaacactgtaaagatggtgtttgctacgaatccggtcggaacaaaaaggcatggggcgcagcgagctaggtttattgaccaggtgcaccaggacctggagagcgtaggtcgcagtcgaggatggagagaagcggccatgaaccgaatgaattggcgaaatattgttggcgaggttttatcaagataattgatgtaaaaccaaataaataaataaataatatgtccataactggtacacctaccctacttcaacatttttcaatagtaattgagcagaacgacatacacttaaaaaagaacacgggtataccacgaacgatcgaagaaaactagtcgcagtggtttatccctttggaaccttttacaaatgttcactttacagaccacgtgtttagaattgtttgaacgtcataaaacaaattatgaaatttgattgttcacaaaatcgtaataaaatgtccataaaatcgaagtactcgtctgtgcaccagatttcgttcatttgaggaaaggtatgcgttcaaatgtttattataaaataactattgtatcgatcaatactattttttatgtcacaatgtaactctaagtataggtaatcaatcagcggcaaaataaaaagaatttgaaaaactttcataaaaaaaatatttgattacatttgttactgcagcttagtgttcctatttccgttcacggtaaacagatttcgtgacaaatttactagaaaatgcattattttgaagttcgttatttatcctgatatattttatggtcaaaccacagctactacttgtaactcgctaactcaccggcttatgggattgggatcttcagggtcgtatggacattcaattcacccaatacgcaagcaggggatgattgattcaagcaggagtcaaatttcaactcttcacaaaaaggatgaatacagaataggcaaacatattacatattagaaaaaggggggggtttgaatgcttagtgatcaacaaaggacaaggcttgatggttccttttgaacccggagaacgacacaaagagaacttggtgaaaggcctttagaattcagggctggtctctctacagatttagctacacctgaggcttcaacattttacaacaatttatttgtgacgtcacatattgggtacttagcttttaggtgttctcacggatccggagttttgctgatggtgttgatgggttggtgcatggtagaagggtggcaggatcgcgatggccgacgccggtgacgctattcttggcggccaaagagaatggcggcaggcactcgggttgtaacacttcccaacggtcacatcatcgaggtcaacagaaccggggcaacggaagctggcttgatcttcccggaaggcacatcgacggcactgcactgacgatcttggaataaagtacaaagaaaaaggtcccttgacgtggacctggacaccaagaattatcaccctgcgacgtcactacctaacctctacttttccgctgtttcactgataattacctttttttattgtttttgcttgtttgttgtattcgttatttgtttgtatcactgttcgaagctagtttcactataatttttaattgattattattttaggttagatttcagacactacaatactaaccatactaattacgtttcaacatactgtttcttctaacaagtataacataactttactaattttaacaaataacattttcacgttacctaatttaagaaaagaagcaacacaaaattaaaaggaatttcaccattaaagaaaaactatcaccattaaatatactattaacacgcgcgcgcactctacttccttcttggatcactatttgttaaaagagaccgaatttctgtaaaacggcttcttatatagaatgccgtttccgataattgtgtatttgacatctatgttttatgctttcatgtttgcacatcctgttatattcagcaccctctgtgtgtgaaaacaaggctaacagggctgtgattattttgcccgaactcaaacagctcgaatgtatatcacatcttgtctacttggtacggttatgaaatgggaacacgcactcattcataacattttcgtcgaccagtgagtgtgaaagttcaacatttgaaaaggtctcattaaggaaatagaaggaataaaccttgtggtggagccaacaagttaatcttggaaccgaacggttacatactgcaataaataaggctgtatactaaaatcgacatttctcgattactttttcaaatcgacgtaagtaacttttctacggttttgagaaaattaattaggaaaaatcacaatccatcttctaaaactgttttaaaatgaatcacctttttaacatttttttgccgtgtacttcgctcaaattttgcatacactcagctcacgttcaaaaactaggtagtttctattatttcccacaaaaataattataagaaaatgataagccgtttcattcagttactttcgacgttcttctaccagtgtaaaatcggctcaagtagtgttttgttttgattcgtggttaagtcactttgtctctccatacagcgaggcggcgaaagtagtggttaaagttgaaaatgttactttcgtcgttttgtaaatccggaaattaaacgttctaaaagtgaaaagttgagttggtacagagcggtacgtgtagaattccgcctgcttaacacgtaggatcgataatgtaattttgtatacatttttgacttgagtctgtatgaataagttttcgagatttctttaaaattttgtttaattttttgcatgagcggttggaacacacaaaaatacctagtaaaaaaataccgcaataatagggaaaaccgcaataatgggcaaattaccctccattttatgaaatttaccgttgagcttgtgaaccactgcttcagaatcccttctttggagaaactcgagctgcactgcattatcaggaatccacgcaagagcgatggttaatgtattacacaagcgaacagctacagtgtctttcgcatgacgcatccagatagaaaaatccctttctgttctgcagtgcaggtcagctgggaagccgcgtagggttttgcagctgataagtcataataaatcagaattggtatcagtaagtattacgaataacgacgctaaacgtggcggttatgtcgcggcgcaaaagcgtagatcgagaggaagtgagatagttttttattagttacctttctcaacctgagtcttggcaggtagattgaaagcgtgtttgttctggatctccatttcagagtctggactacgatgtgtgcgagaatgtcctgtggacagaggagcatcaaaagatcgaacagcgcaccaccgtgcggaaggactttgcccgatggatcatctcgatgcagatcggcatcgggacggccctggtggcctgcgggatcaacatcgtcatcgatcagatgtcgttcctgaaatattcgtttctgaaacgtgaggtcgatcagaacgtgctgaacggcgatctcagcattccctacctgtactgggtgttgaccaatgtggtcccggtgatggtgggggccacgttggtggcgtacgtggagccggtggcggctgggagtggaataccgcaggtgaagtgttacctgaacggggtgaagattccgcgaatcgttcggatcaaaacgttggcggtgaaggctgtgggcgtggtcacttcggttgtgggtggactggccggtggtaaggaagggccgatgattcacagcggagcggttatagcagctggactgtcccagggaaagagtacaacattccggagggatttgaggatatttgaatacttccgggatgatcacgagaagcgtgattttgtggttggcggtgcggcggctggcgtggctgctgctttcggagctccgatcggtggtattctcttctcactggaggaagcggccagtttctggaatcaatcgctgatctggagaaccttcttcgcttccattataagctctttcacgttgaacattgtcctctccgcgtaccacggcctgagcagcttccgataccgaggtttgttcaatttgggcgaatttgaaccgctgcctttcgagtactatgaactaccgatcttcatcttgatgggtgtgttcggtggtatgtccggtgccttctggaattgcgtgaacaaccggatcaacatcttccgggctcggtacatcaaatcacgatgggctagagtgctagaggcggcctttgttgcagctattggggctaccggtgcatgtgcgatggcctactcgatcaacgattgccgtccgcttggcaacgatcctacactgactcctgtccagctgttctgtgaagataacgaatacaatgcagctgcagcgctctggtttcaaactccggaggcaacggtcaaggctctgttccacgatccacccggatcgcacaagattcttacgctggcagttttcgtcctgatctactatccgctgtcctgtgtgacctatggcttgagcgtttcgctgggtattttcattccgacgttgttggtcggtgcggcctggggccgattgaccgcatcattcgtggttctggcgttccccggatcaagtgtacgtaactttagcagacattcactccattccgaacagtttgcataattcttaaacctttcagatcttcgtccaaccgggcaagtacgcattgataggagcagccgctcagttgggaggtgtcgtcagaatgacactgagtttgagcgtaatcctgttggaaacgacgggaaacatcggtttcgtgctgccaatcatactcacgttgatggccgccaagtggtgtggagactacttcaacgaaggcgtatacgataaccagatcaaggcgtccaaggtaccgatgttgccttggcacgtagatccatcgctccggcagaatatcgcggaagatattatgaatcaaccggtagtttgtgtacgccgcaaggagaaagtgaactacattatcgatattttgaagaacaccacgcataacggattccctgtcgtcgaggacgccgaagatgtaagtcgatttatttttacctgggaaatttgatattttcacatatgcattcctttttttcagggagtccgggagaacgggaaactgattggcctcatcctgcgctcccagctggtggttattctaatgcgaagcatgtacatcgaaacgagtcgattctggagagatcttgtaacgatccaaaacttcagaaaggaatatccccgatatcccaccattgaggtaacaggtcttaaggattgttcattttataaggttgaccccttgtttataatatatcttttgacgttggataacgtccttcagcaacatatgggggtacaatttcaaaaaacgagaaattgagcatgtaacgaaaaatggtcaggttttgaccgctaataactcagtcatttgtcgatagattttcaatatttatacatcaatcgatcggaaatttatctacgcgtcgattcaaatggaggacaatattgatcattggcaaaaaactattgaaaaatcgtaaaatgttgacccctttcttatctaaccaatcacgttcaagcacatttttgggttccgcttcccactataaaagcgcaccggtcctgcttcttccctcattcttctttttgcggtcgtactgtgaacacggtcgggcgagtcattttcgctttgcgtttgctcccgccgtcacagttcaatttgtgtcgtcggaagaggaagacgcaaggttgatttgcggcggcgatgccgatggcttggacgcttctccgagcggcgaactactgccgctcggaaaagcgtccaagccgtcgtcatcgccgccgcaaatttatccgcgcttgcagatttcgactttgaattcagcatcggtggtcaagaagcaagcccgctaggaacgaaataccacaggccctctgagttgctgatccgaggagatgctgccaatcgagcgtcggacttgtgaaatcgctcaagattttaagagtgagcatcgtttgcagatttcgacttatgcccggtaatccacaacccgttgctcttgtgcgccatccacgtcacgtcatttagctggttcgtcgtatacgcaaatcggcgctttttggggccatcaaatgtgttgaaaagagttaaaagaataatatttccgaccttattacatcttatatttctcaatcaatcccacagcttcatacaaaaaataatttgtcatgaataattgatggcacgacaatatgatactgtattcgcggacgcagctgcagtgccgtcggggtgagtgctcacaacgattgtaaaatagagtggcattttcaacagcttctaagacttgccatattttatgagaacatatgtaacaaaatagcgacatatttagaatgcttctgaaaacaaattctcattgaacaattttcataattttggcacccatggatcagaaattttccttcatacaaaagaaaactaataattatcaataactaaccaatgaatattggaaatctttctacgaatcgactccattaattaaaaccattgattttcatggataaactattgaaaaattgataaatatcaaggtatgtcttattttccataaaaaatttttacacatttttcttgtgtattcctagcacagacatcattgctcgatatcttagccactttcgtcatgcaaagagaaacgcccctttcggtcttcttcttactcctctttattctatcgtgttcagtcgcacatcagtcaatcgtcgtccagcaattggagaaggaccactatcggaataaattttacacatttgtcgctgccgctgcttctgctcttgtttattcccaacccaagctaaatgctgcgggttccgcaaaatcgctcatcaaccttggaaattgtcgtcggaggagtgagcaacaaggaagcacaaaattaccgaccgcatttcgatttaatcgtcttcggtaatcttttggtgtgtttctgtctaacaatgcacattggaccgaatcgacaatttagccggaaaaaagtgttatctctgttctcgtccattttatggtgtatgggaaagttgtagatctaataaaattcgtcaactttgctgaatatagtacgccgttaactttaaaatcttgtgagttacaaccaaatttcgagtttttaagtgtatttttgaagtgaattttctcaatttacaaaaaatacgttctcacagtttttgcagcaaaagttgtctattgtatggcctttcgaatgccactaaaagaaaaaaattatcgaaccaactccatgagttatgggcatctaaagatttcatagtttttcacttaaatttgcttataacttcaaaatcacaagaattacaaacttgcaatgttcagcaaaaatatgtatctttacttcttcacttcctctacaactcttctgaagaccacattcacgtaaaactgaaaacaaaaaggttagatcaaaataactgattttatgggtccaccctaagttaatactttcaaaatcaatatacttagctcaaatgaagagttagatcaaaagtgtcttcgacaacgttgttcaaaataatattttctaaaagtttgcagaagagcgcagccacaaatttcatcaaacaaaaaagtttgagtcaaaattttagctttaatatgggtcaccctatttaactttttccttaaaagatgcaaaactcaattacgaataacttctctgaagacatcgaacgtctaaaatcgacgagaacagagataacacttttttccggctacattgtcgattcggtccaatgtgcaatggattgacaacccagttcgatcaacggtgactagccccaaccgtccttttcagacaaccatttcattttgaaagaattgtgataattttacaccgtgaagagcgacattactggtgattggatgtgattgattcagattttggtcagtagtttgcatgcaatcatttatcacggctaaataatgctcctcgagaatcacagtgtcaagaaatgaaattcccattgtgcgcgcgcggacaatcgtgtgtgcatgagtcggataaatcgcgaacggcacttgaattaagaatccatcacggtttgcttcgcatttagtgatgattgaatgatgccgttgtcgtcgtcgcatgctagagcgatcagtatcaacctggcgaacaaagagctaaaacttatcagcaacagctttgttgacgttttgatttggtaagaaattgtcgatcgaatcgaaatatacacacagagaaaactgcataaatgtaaccgccacccgacccgagcgacgggaacctagataaaactttgtttgccatttatatccattgaaaacttatcattcgaaattacaattgataactaaatattaattaatcaattgtggccctgtaaagggttgttgttcgaaattgtgcttcaatgcaatttaagcgccttcgtcacggatacgacgagccagctggatgtacttcggcatgatggtgacacgcttggcgtagatcgcgtacaggttggtatcctcaaacaaaccgactagttaggccacgctcgcttcctgcagggccatgacggtcgtgctctggaatcgcagatcggtcttaaggtgacacgggagaccgtgttatttttcctatcttttgtctcactctaacaattatcatgaaaactttacagaagcaaatctctagttttagtgaaccgattaaactgaaaatttaatgggttgtgcactacatatatataatgctagtaatatatttttcgcatcgattattgagtggtacttgagattaacttttcaaacggagagggtgattaaaacaccgtcccatggccttaatcaagaaatcctgatcgatttcaccgtcagcaacaacgattgctgtggcgcccaagattcgcaaactctgcacctgttatgatgtggagctgggcttgtcagatgattatggtgatatttgcgctgccgaaatcactataatgaattgtcgggcactactggtttgcctctacatttctccggataccacaatgaagcagaagaagttcttcatggcgcggaacttcttcaagtatcaaaaggatcgtgacaggtaacttcaacatccatttgagcaaagaggagtacacagatttagcggacttcatggacaagaacctcaacctcaaactggcttcggaatccactaaagcaaccaatcttagtggatcatgaatggacctaacgttcaaccggtatatttgtttggagagcaaaagttaccgctcatgcttcatcttccatcgaccggttctatcggtgttgaagtgttaaccgaaccaaccaaataataacactcaatgtccacaatacatcagaattgacatgcaacaaatagtttgaaaattgattagatttttgtcagtacctagaaatcttacataagttcgtgacggtcctaaatcaggaaatagaagaagctaacgttatccaacgtcaatttggcggtcgtatctcggaaacaacctcttacttttttaattattaatgaaattgtaacagattttctttatatcgttcaactacttttctacgatgtgatggaaaatcaagattaactgaaacgcttctggtggggaacttaacagtttgcatgaacactcgagaaaagctgttgaacaaatttaaacattacttttcgtaaaacaaacattctcattgctatgaacaaattacactgcggaacaggattttgtctcaagcccttacatacatatataatgaacgcaagcagtatcacaagggcgtaactgaagtgatcgatttctcttcatcgaaaaaacttcaacaaattattaggccgaatgaatgtttccggctgctatttttgattcagcagacgagatgggcgagatgcagagacgcgtgattaggtggtggccaatcgacaacagaatgtggtggtgaattgaaggtggcccaaagacaatgtaggtatacaaattactatggagaaattttgaaagcccaagccatcgttatcggagatctcaacactcagtttggccaggaggagtaattcagaccgattatagggaagtttagcacttagctacgaacaaaaacagccttagactgatttatttcaccgcctccaagaacatggccgtacgtagtacctacttccaacacagtctcccgtatcggtacacctggagatcactccaacaggctgaatcacaaatcgatcaggttttaattgatggaagatacttctcagacattatcgacgtcagaacctctcgcggcgcaagcattgattcgggccactaccttgtgatggttaaagtgcgccaaagacttttcgttgtgaacaacattcggtaccgacgtccgtcacggtataatctggaacgactcaagctacccgaagccgcaactgattacgcgcaatgccttggagcagcattgtcggatgagtgaaagctcacctaagatcctcttgaggactactggagtagtgtcaaagtagtggaaagtgccattaagttcgtggaaggaaattgacgatatgaatgcagcgcgggtgattatgctgcagcaaggcacccgtcaaatcgtggaacgatacaaacagaagcgaagacagtaaacccatctattctggcaccgcctggaagagatggagcggctgtatcgttctcaagaaacacgtaagttctacaagaaactcaatgcatcccgcaaaggctttgtgccgcgaaacgaaatgtgccgggataaagatgaaggtatcttgacggacgaacgtgaggtgattgaaaggtagaagcagcactacaatgaacacctaaatggcgcagaggagggaaaccaaggcatcaggaggaatgggttcatcagtacggcggatgagggaaacgtgccaactcccacaataagtgaagttaatgatgttaacagcttaagaacaacaaagcagctgagaaggatggtattggagcgcatcttattaaaatgggcccgtataggttggctacttgtctgcaccgattgatggccaggatctggaatacagaacagctaccggaggagtggaagaagggagtaatatacacaatatacaaaaagaaaacaagttagaatgtgagaactatcgagcgatcacaattcttaacgctgcctgtaaagtgctttcccagatccactatgggcggtttccatacagactggcggccaacaatattttttccatgtcatgtcgtatttatgagttttatgatataaatttgatgtttattttcaaaaacatgttttcgagactaacttttgaatagggcctatagcgaaatattaaactttgttacttataatgcatataagccatttatgcgatttacgttgtgcaaaccattatgaatattaaaacttacatggaaatgatgatatgaatgatttagttaaattcagttattttctgaattagtttttagctgttttcaatagaaaatggttaaaaatattggaaaaattcaaatagccttaaattaaaataagtgcaaatttgtgcagctaaattcttcacgatccttcagtttacatctcgaagtacccttggaactgaatttaagcctgggacaacttgggacaaaaaagtactcggtgtattaactataagctcattcgatttttttaactgctttgtaaaaaaacatcataaaagccactattttgaagctttttcattatttttattgtttataggaagccttttttgtaagctttcaaatggtgtaaaaccattttacgtaagtattatagaaaaaaaagttatattcatttgagtaaaccatagtttttgttaataaaaacaagtttttctccataggctcatgtttacaatgaaatggcgaacaagaattgaaatttggggcacatcacttttttttttattattggccacctgataagccatagtgagatcatgtatcgccgctagcaagtagatttgtgggaagttatcaggccggtttcgtagacgggcgatcgataaaaaatcaaatctttatgttgcggcagatcctccaaaagtgtcgcgaatatcaagttcctacgaaccacctattcatctatttgaaagcggactatggacgagtacggttttcccagaaaactgaccagactgatcaaagcaacgatggatagtgtacagtgttgtgtgaagacattgtgtgcgttatcggactcgtttccaactcgcaaaagacttcaactaggcgatggtgtttactgcctccaatattgcgctagaagctggtatgtataacgagcgggcttcaacatgcgagacacgatcttcaataaatctagccagttcatctgtttcgcagacgacgtcaaggctggtagcgagtcactttttaatgaattggtcactttttttaaaccagtcaccttaaggtgattataaaacgaaaccaaattttgtattttcaagtgcacaggactggagaatctgacaacagttcacgttgaaaaccaattgaattgcttgtatgctggtggggatcaataggataaattttcaaggcgaagcgctgtttgcgttctcaagtcttgtgctcttgaaaatttgagatatggcttcgttctataatcaccttaaagtctcttttttgaagccatttcaactaaagttatttttatcgtcaaaaagtcactttttactattgtgagctaaattttcgagagaaaattacgaatcggccttctttcaatttaggctaagttttaatttaacttcatgtcagtatcaacactttggttcatggttttcttgtgaaaaaagttaatcttcaatagacttccacgtaatttgtaatagtatctaagctataataagtatggtgtaagttcattgttgtaaaactaaaggtttaaatatttagtattcttttggaaaatctcgtgcattctcattcaataggaatttttatatcttgtggtgtattattagatgtttattttctattgtcaaacactacttttaataaggtacagtgggggaagtgtatcagtggggtaagtggatcattcgtcaatattaagcataaatactcgaataaagtgaatgttttcgcaccattgcttcgttttaggttatattcttacatccacactgatactattgcaaaactggtactacacgtacactaaccaaagcaaacttgttagctgcaaaaattaattaattttaaaattgttttccatcaatcaagtatccattgtatctctgtctaaaatcgaatactattacttttttcgacacatggtgagcatttcagttctaatttaatgaattacaatgattttttttttaataaatacagatttattgtacatggtacacttacccctactttttaatggggtggggtaagtggatcaagtattcatcatttattggcagactggttatgagagttttaataagtttaaatatccgcaaatgttgttttcctttaattttttgcatttccagcttaaatttgtcaaattgactatagataatttgaattaatccacctaaaagttgttttaacctttctggtataaa

SEQ ID NO: 90 - DNA, 25476 bp, Aedes aegypti
ttacgagtgaaattgttgtgatgtttttaaaactagttaaatttttattgatttgtttctttaagctgaacgtaaaaaacaattcaatctgcttcatatttataatttgacttaaactttttattttatgaaaaataagcccatctttagtaaactatctgaagcttagcatttgtttactccagattttagcattttaggtgtactttgttgacaattcgcggaaaaatatggaacatatatgcttgaatatgtttggtgaattattcaaattacagctacgacatgtgcaaatgttccctaaacataccccatatgctttcaccatccttcgtggccatagtttatttcacaacgagtggctggcacatcgactgtttaataaatgattcatgtatgcaaaacttgatggaatttcaaattttgtccgcattaaattcatttggcagcccgtttcggaccaccgtagcttacccaccacatatcatatgctttctagtctgcataaatatacatgattttaataaaatttccacctttttttctcatctgcagggagacgccccggaaaccgcctccaccgacacacagatccagaccaagtgcgtctggtgccaacagattctggccacaaccgatcgcccgaagctgctcgaatgtctgcacgtggcgtgcgatccttgcgtgaaacagaagttctccgacctgccacacaacacaccggtcctgtactgtccggtgtgcaaaatggaatcccggatggagttcatcatcgacaatgtgttcctgagtgagaacacggccgacgataatcccggcagcgtcgagtcgaccaaggacatgatcaagtgcagtagttgctcggacgatgccatcgccacctcgtggtgcgtcgagtgtgcggaatttatctgtgatagctgtgtgcaggctcatcagcgactaaaaatcaccaaggagcacacgatcaaaccgaaggaagcggcctgcagtgaaacgcccggaagcagcggtctccccgggaagaacattatgtgtcacatacattcgcaggtaggtggtgtttgagaacgtgatttttcacgacttgagagcgaaatggaaatgaacacgtctaataaccgcgaccggacagggaaacgtgggtgcggataatgttgtttaattttgtgcttccacctcttcttggttcttgggccataacggggacaaggagaacgtgcctcttcgagtgggtcgtgtctgaaatcatgggggtgcgatggaacgtgtgattaggtttagattgaaacgctagtaggataacatcttttgagatttgcggaacgtgttcgtaattttgtagaaattgttcatctgacacgttttgatgttgctctctgcttgctatacacgtttgagtagtatgcattacttcatgtttagtatctaaatttaccgaactaatacatttacagcagcaaatcagaattaaaattaatgattttggtttcaaatggcgttaagtttatgttttatacgcctatgcatgatgatagacactcctatacatactccctccaggcgataactacaattcatgaacaagtttggatctcttctgagttctgatttcggtttcaaataaattttagtaataacttctatactatacgcataactttcccatgtatataaaaagtaccgcagaacatgggacaattagttgtggtttcgaactttgcttcaatcatttttttgcatttgttcagatatgtaatcaaaatcatatgcctgatacgaccctctataaatcgtttgcatgaagggcgatcataaaaattggactttatttccttcgtagtttgtatgcacaaactttttggtgtcttttttcataggaaagacattcttagcgagaaaacacaaatcatgcatttagcatctatgccgcaacgcaatgtatagtattatggcaccaccgttgtcggctaccgtggcatggaaggttatctccagacttttggagacattcctatgtcacatggacaaaaaaaaaaagttttgcttttttccaaagatttaacattatttagatcactttattttcactaaataatatttttgaaatagtcttttacgacgattaccagacagcattatattttccattatcattgctttgattggagaaaatccaagtaaatcttttattcaacttttgcatgtaatttttatttactcgagctatttcgatttgctgaccggcttgcgacgctgacggaaccagtcttctcactgtcacttggcgaagctatatttcatgtgctcaatccgtcatttcgcaataacggggctttcacgaaagcaattgtaatattgttttgcttttaaaatttctatctcattttggagaatttcgggaagcaaatgtatacgataagtcaaatggatatcctttcatgattccagtgatataaataacaatcatttttaatttttcatttatttagttaacatctaaacagataacactgaatcaacaatttcacaccacaatactcggttctgcccacgctcgccaaatcgatacgcacttgatcccccacctagctcgctgcactccacgccttcttgtaccaagcggatccgatgcgaacatcatctttgcagggttgctgtccggcattcttgcagcatgccctgcccatcgtatccttccagctttggccgccttctggatactgggttcgccgtagagttgggcgagctcgtggttcatccttcgccgacacactgttttcctgcacaccgccgaagatcgtcctaagcacccgacgttcgaagactcccaagtgcttgcaagtcctcctcgagcatcgtccacgtttcgtgcccgtagaggactaccggccttatgagcgttttgtacatggtacatttggtgcgagtgtgaatcttttttgaccgcagctttttctggaggccatagtaggcccgacttccactgatgatgcgcctccgtatttcacggctaacattattgtcagccgtcagcaagcatccaaggtagacaaactcgtcgaccacctcgtaacactgctacctaggcgagccctgtcgcgctcggccctaccagctagcatgtacttggtcttggtcgcattcaccaccagtccaatttttgctccctcgcgtttcaggcgcgtgtacaggtctgccaccttttcaaatgtcgacaatgtccatatcatccgcgaagccaacaaattgactggatctcgtaaaaatcgtacctcggctctccgcataacaccttctagcgcaataatgaacaacaggcacgaataaataacaatcataccagctaatgaactagaaattgtatagtttacaattccgttacaagccgtaacgacgtaaaaatgaaagaaaatttgagtgaaaatttctgtcattgtcttgccgtccgataacaatgagagaagcatctatgtacacgcaaataaaactgttcccaaaaataggcactatcagccacgaatcctgaaacaagcttattttcgatttacgaaaatacaacatgaacataaatcacagattcgggaacaaagttccacaaatcatccttaaagcctgctgaacagatcacagaccgctcaaagaaatcatagaaacgtgatatttgttctgacaaacaagaactctgtccacgaaaacaagaacaccgttctggatcgcgttcggcgctctgcgatcagtgaattttatgaccaattttgagttccctttcactgcccattttatggaagataattttaggacattttcttcaaactagcacaaaattttacattatggcacaatggttgtaaatgacttactttacttttgctggcgctacgtccttcaagacatgacctgcgccacaattttacgccaactaactcggtccatggctgctaacctccaattcctcgatcgccccacacttccaagatcctgctccacttggtcaaaccacctagctcgttgcgcttctcttcgttttgtaccggccggatttgagttgaacaccatttttgcgggattgttgtccggtattctcacaacgtgttccgcccatcgtacccttccagctttggcgactttcgtgatactgggttcaccgtagagttgcgcaagctcgtggttcattcttctcctccatacgccgttctcacatactccgccgaagatcgtcctaaacacacgtcgttcaaaaactcctagcgcttgcaggtcctcttagagcattgtccacgtctcatgcccgtagaggactaccggtcttattagcgtcttgtacatggtacacttagtacggaagtgaagtttaccaaccgcaaggtcttgtggagtccatagtaagcacgacttccggcgatgatacgtcttcgaatttctttgctgcagttgttattcgacgttatcaatgatccgaggtagacgaattcgtccaccacctcgaactcatccccgtcgatcgtcacgcgtctgcctatgcgagctctatcgcgctcggttcctccagccagcagatatttcgtcttcgacgtatttaccttcaatccaacccgatctgcttcacgtttcagcctggtatactgttcagcaaccacctggaacgttcttccgacaatgtccacgtcgtcagcgaaacaaatgaactggctggatttattgaagatcgtgccccgcatgttgaagcccgcccgtttcataacaccttctagcgcaatattgaacaggaggcaggaaagaccatcgccttgtcgaagtcctttgcgtgtttcaaacgggtccgataaagcacccgatatcttcacacagcactgtacactatccatcgtagctttgatcagtctagtcagtttcccgggaaaaccggtggttgtaaatgaacaggttgtgtaattttcaacagcccagaaaactgcataatttgaaggggtaggatcaaaaatgtacgtcgtttgtcccattgaacaggacgcaacgctctcgaaatgaaacgtttcagctacgaaatcgtttccattttagcagcaagcttcttttttagcaggaacaacatctggataagtcatatttaaataatattcctgccgaatctgaacatttaggtagctgaaataaagaaagtttctgccaaaaaaggaactgcagttttgcaattgggtctgtttggttgactactaggttcagcgcatgcgttattattattgacagcgcgcgtgaacaggtcttgggccctgttcacgcgcgctgagccttttttagaaacgttgctgttgagccctttttagcccgcccacgcaaactaacacttctatcagaaagattgatgctagctcttcctgatagtggtattggtgagcgtgattgaattgaatggggctcaacagcgtcttgcaaagccaatgtttaccaatatcgatatgcccttttgaaatgtttgtccagaaatattaatttttgggtttacgatatcgtgattttacaatcatggtgttgggagcgttacgaaacggagatgccagaatgcagacaagaagtttgttcccgaactagtgaaaacagttcatgaaaatcagatgtgctgaatcacgatgacaggatctaaatcacgaatctgcataaggtgtgcgttttgttttctatgattttttgttcacgaatatcagaacggatttttgacgtgtaaaagtcgcgtaacaccctatatttacattgacgcttttcagaactgatcgagctgcttgctcatttcgatgatattttcaacattatactcacagacaaacagacgtaacactattcaattttaacaattttctttaaaatccatcgcccactttactgcgtcatcatctggtgagcatgtttcacgaaatactgtttttggagaaatatttaaatatagacaattgaagaaaatttgtcactagtgccacctagcagataaattctcaatcagattcttcacagatagctcgtgatctgctgaacagctatttcgaagacactagccttctagctgataaggataatgagatacagatgattgaaaaaaatgtgtcactatctccgcctagtgcataaattctcaaccagatatttcatcgccaggtagcccttgatccactgagcaactttgccgaagacaccaaccttctagttcatttggattttgagatatccgtttgaggccaattttggacctttcgtgtcaacactttttcagttacctagaaaagggggtggggtcggggatgtctcacccgagatatacccaacacccaataagaccaacttaccgcatttacttcaagggattttcagggactactataagcaaaagaaaaacttttgaaaaattcatcgaaaattcagtggatgaattattatcgtactcctttccactgacagatcttgaatccagttaaccctctaatacccaaatttttattttcgatttaagtattatttttcgtaatctaaattcgttctacacacgtttcgggcaattatttatttttattcgcaaatttttaaattttggtttttgatttttataatttttatttttgaacatccctagcttttttcagtttttcttgaagccttttctagctgttgatttttggcaataataaaaatttaaatttttacggcacttttaaaaacatcattttttttattttttttttcggagcatattttattttccgtgtaactaacgggaaaacaggtttgaaattatattaataccaccaggctcttcttttgtgataggttgatcgtagaaaaaagtaccatttttatattacacgttaaatgaaccccaggcatttgtaggttatataagaatgcaatttttcaaacaatttctaaaaatacaaaaaagtttcaaaagtcatagaaaacttttctaatctgcctgttatgagtctaagtataatccaaaaataaaaacattttgatttccgagctacgaaaaaatatacaaaattccaaagtgtaccccgtctaaaggcggggttgggtattagagggttaaaccaaattagtagtatgtgttcaactcacgtataacttatgatctcaccctaaaagccaatggcaaccgattgtttagctcgttattattaagcaaataatggataaaggtaaaatcaacaaccactttaagattgaggggtatcttctcttcatcgtagcattgttaaataaggtgtaaatccattggtttgctcagtaacaattaccaatgggtttttgggcgagatcataaattatcgagaactaaaagatttcaaataaaatcttggattgaattggttataccattttcaaccgcaacaatagcttgaaacagaaacagcagctacataaaactttatgcagaacccaaatcgcaacgtgcaatccataactattcacgataaaggtacgcgagcgaaactttagtttagttattggttttcctttccatccaccgcttacagcattcgtccatcacatttccgtggtccctcagagaagagaaccaaatgacatcggttttcgtggttttccttcgagcgctgcggtgaaatctagcaaaccgcaccgcaaaaacctgtcacagtcgttggtttagttggtttcatttccacggtgcaacaatacctaagtcaaattgcaaatgtgtttcctaaaatgacataaactgttctctgtttcgcaggaaaaactgtcgctctactgcgagacgtgtgaccggctgacgtgtcgcgattgccaactggtggaccaccgggatcacaagtacaagttcgccaacgagattgccagtgaaacgcgcaactccctgcaggcactgctcagcgagatcggctacaagaaggtgctgctgtccagcgcgatgaaggtgatagacgaccggcaggcgctgataaccgagaagaagaaagaactatccaaagagattgccgacctggtggtgaagctgaccaacgccgtcaacatgcggggcaaacagttggtctatcggttgaatcaggtaggtttggtataggtgaaattgtaaagaatttactttagttaattacattcagttgactaatagttgcaaatgtgctctaggggcattaagagttagaaatctaaattttgatccattcctggttaatgaacaagtatatactgagtaaactgtggtatgttggccaaattttacccccgcagattttagaaattttgtatcacgttctgaaaaaataatctaaattaaatagcgaaagacgatctattttaataaaattgttcccttgtccactctaggtatgcgacacaaagttgcaggttttgaacgagaaaaaggaagctcttcagctgctgtccggacacacggatcactgtatagagtttgtgcagagtgccctagaaaagggcagcgacagcgcagtgctctacagtaaaaagacgttagcgaggcatttgcaaaaggtgaaatgccaacgagcggatatcccaaatccggagataccagttcgagtgcagttgttcctatccaatgttcctgagttacaaaatggtgagttttgggtgttgttttgcagttctacattttgagtaaaccaacatttctatcgacagtcatcgcccgcatcggcaccattctcgtcgatggaaaagtttacccgccgccacctggaccagcaggcgcaacgggcgttccacaggttccaggagcagtccaaaacagatccaaacaaccaagtccaaacatcacacctccattgcgaccgggaatgcccggcccaggtatgaccactttatcttccaacaattcgaacggtcctggtggcttccccaatgtgccacccatgtacaacggtaacggaggtgttccagtgggaggaccattcccaccgaatcatccattgggacgctctttcgcacaggaaaacggtcccgggggcggttttggccggtttccaatgggcccaccacacggaatgccaccccagcagcacgtcagttcctccacacatcctcagaatatgggtgagttggtcggatcctcagctaaccctcaggttaatggttgtggttctgtgttcatctctcatactcatctttttcggttgaggcctgtaaccatttcgttatcgtaacattgtttttgttcgtgttttcttttctccacctccaacccctactccttgctccacggtgtatatgctttcatatcgctaaacctctagatttacgtaatctcttgagtcatcaaaaatcgagtggacctaaccgcggttcgcccaacaatgctccgagttcggctggaaatgctaatgttaataatcaatttaacacagctaacttcatgggtagcgttccgcctggttcagcaggtccgcagcatcggatggccgcccaaatgggtggcgcacctcccggttatctatcagccggaggccatcaaaacttcaaccaaggtcaagctggcccaaacagcaacggtatgggtatggctggcaacaatccacgtttccagaacttccaaagattcactatgcctccggctgctatgcgacatatgatgggaaatgtaagtatcctaccacaaaagacatttcattctatatctccatatgaacgtgaaaactgaccgcttccttttaattgtaaccgaagaatacctctactctcctcacaccaaagcagcaagcagcaatgcgatatcctggtcagcagactccacctggatacaaccccaactccccacagcccggccaaatgcaaccccagcatccgagtgggactagtgcaggcggtggaggcggaggaggtggcgccaaatggcacattcctcagaacatgcagggacaacagaataatggttagtttcatcttcacttcaatacatccccataagattcttaatccagccttcgttcttacaggattcggtggcccttccggactgcatcttttcggaaacggaccgaacgagtcgttcaagatacccctgaaatcaccggacacgatgcgaaattcgatgatgatgaacggcggtaacgttggtccgggtggccccggaggtcccaatcaaatggcgcaccatcatcagcagcagcaacaacagcaacaacttcagcaacagcagcaacaacaagcgaatcatcacctccagcagctacagaatgctcttccgaatgttagttccaccaatccaaaaactccatctcccagtacgaatgaggtaagtttgcactctgttcccctattccgggctggtagcagaaatttggtcactattttaatgaaagctctccaaagtctatatttttaatggaaggtatccaaagtactttttcaatcaaatggtctctaaagtcattatttttcttttcctctcagtgaatactgattcgaaatacctaaccaaaaatttccacagatattactctgaaaaaatccaaaatactatttcaaaatttcctcgagagatttttcaaccaatttatctacaaacgtttccagtagttactttgtcagaccttccaaagatccctacagcagttctttcaagaaaatccacaaaggttctttcccgagatgttgaatgaattcgtcaattgggttttccatgtacccatctacacgactcacccaaagagttcctataccaattatttcagttatacctccagccatttccatatgaattccttcgtgaattcaccaacaatttatctccaaaatggtccctaaatttattttgagagtgctccgtgaagcccaagcaggatggatcgttgttgcgtcgacggataggttttgttctcggtttcgcgcgtgttttcgtcgtcggagaacttctttttttccctgttttcgcgcgtcttgctgggtagtgcttcgtgaaaacggtttgttttcgggacgccaagaagtttttctgttcgcactgtgttgcgaagagatatttgtgttcagtcgaggatggattatcaactggtgagttcgtttcatgcttatgataacacattttttcttgaaagtgtaacttttgtgtaatattaaaacaaactttgtttggttcgtcactataagtgtcggcattatgcttgttttacacaatttcaatatacatatatttttctcttttttacattattaaaaatatcttttgaaatgttcgacattgtgaatgttgacgtattttttaaaaattctaccatctcgagacaaaaatgcacagtaatactcatatgtaattttcaaacaaactatgtatggttcgtcactacaagtgtcggcattattgctgtttcatatgatttaaaatatataatgtaattctcagttttcgctattaataaaaacttcttttgaattgttcgatattatagatgttgacgtttttttttttgaatctactactaaaaacttctcgagacaaaaatacaaaactagttttaaatgtaagtcgtatatttcccccttgtccatggatcgcatcaccgaccaaaggtgactcccagatcttttcctcccccactaataaacacccttcccgtggtgattgtggagatgcagaggtattctcggtctctagaagcaacaatcattacaccctaacattccttccccatcccgactgactgtaaggacttggccggcgccgttattgatcaataatattagatctgctaaaattgcacttcgagagtaagcggaaactcccatcccttattcatttggatcccagtgcaattcttaccagttcagatcaatcacggagtagcaaccattgacatgtacagtcagtctatgctatgctaaaatggtccctaaatttattttgacccagggaatattccagaaaagaactctttcagtaatttctcaataaatttcaaaaggtgtttgtcgttaagttcctccataagtttatctagacattttatccatgaattactcctgcagttttttttttttttcaaacaattctcaagcaattcttcatgtgaaacatacatgaatcctccagaatttcattttaggtttcacaccaccaaatactacaacaattactccgaccattcctacacaagttagtttcttcaggaattctgtccaatgtttttcgaagaatgcgtttagaaaaccacgcagaatttggaacttccttggaaaacttctcaaaaatttacagatttacatttgaaaaatgaagaaatgcttccaatcaattactcagggtgtctacgacctgtaaaaacatgaaattatcagagaatttagttaaacctggaacaaaaaaacggaattctcagggaatttcgataacaatcatggtagaatattttcataacaaaggattttcacctcgaaaccccgcaaaaaatgtcggctgcgccctatcaaaacgcttctggagctgtttagtgaggatctttccgggtatgacattttatcgacttcgccagacatgatttaaatttaggtatactatttgatcatttatggattcacataccttaatacacggctttcaaaattatttggagtttgaaaaactggaaaacagatttttggaaagtaatttggcatcaaaacaattttcaacttaaaacgaggaacaatcaatttatcaattttaggactggtagcaggtctctttttagatactctattttaatagattcttgatgaaagatctctgaagtcttcattttttaaccaaactggtctcttttttccatatcttgcttgcagttaactccgatgcaaaatgttttgggctccagagaaatcttcagagactgtttcgagacttttcaactaattctttacaaatttcgtcttcaaactccaccttgtgtttcaatatggaaatcttttaggtttttttctagaaatttctcaaaaatttcatcgaggaattacaactgcagtgcttccaaacatttctcaaaaaatcccatggaacttacaaaagtttattgaatgtgccatactaaataatactgtagcattttgccagaaaatcctacacatttactttccttttttaaaacatcgaaacaatttaattagaaactcttctaaaaattcctcaagggtctatgagttcttcaagtaaccgttattcttcatggatgacttaaaaacatacagaagtttcatcagagattactctaaaatttgctttagaaatacctcacgattttttaaacattttctcaaattttttaaaaatttcttccatatttccatgaatacttggacaaatttttagagacttccttgagaaatcttaatccaaatccaaatcttgttccaaatccaaataaggtccaaatcttgaagaaaatgtgaaggacattttttaggaaatccctggaggcatctttggagaaacttctggttgaattttgcaagaagttcataacggaagtcttagaagatgtcctagaaacaatcgatggaaaaatcactggataaaatcctgaggatttagggctctcttgaaaaaaatatgtaaagaaatttctgacgatctctgagtcaatctctgtggttatattttgtaaaaaccaggttttgaaatatctaaaacaaaatttatgaattccttaggaaaattctcgaagggggatcccatgggaaataatcactgcatgaactcctgaaaaaattttagaggtgagctagtctcgggctgaaaatctcccaaataaagatatctatccatctatcctagccagagtaaattttcggagtaatatcggaatctttgggcaaatgcttgacataatttctgatgaaatttcttgagaaaataattgaaaaatttcgtaatgtctttcgacttgttaatttcatgttttatttttttcgaagaagtcttattatttcattagtgcagttgaaagagcattgaaaaatatgttgaaaactgaactcaactcaattttgccaaatatgcagatgggatgggactgacttgccatttatagcactacatctgtataaacagcattttagctgaacaaactgtttttcaactaccaatgttacttgggttgtggatgttctagatatgacgaaattgggggtcgtccattaattacgtaaggttttatggaatctctccagatttctagaggaattcgtcctgaaatctttttagtgatttctcgagggatgtttagatgaattcttccagaatttgctccaagaaatcttccatcaatccaaggttgtattggccattaatttcctcagggattcttaaaaaatattcaggttagaacacacgcctctcacgcagaagactatcgatgggatcgaatcccatccccaagaaagtcacttatgacacaaaagttatagtgacgacttccttcagaagggaagagaagccgttggtcccgagacaaactagcccagggctaaaaatctcgtaaataaggggatagagaaatcattgaatgcctaaatcttcctaaagtatttctaggacatcttccaaatatacctacattttttccggcataagccctcaaaagtttgttctaaggcgtaagaaatccgtttaggaattattcttaggaatcctacaaaaattcatcgcagaaatcgtgcggcattttttccagtaattcttctggttatttaaatatggaatctttcaggaattgctctatgaattctttctaggatttttctgcgaaatctattaggaactctccaatgaatttctcatcgaagtcgaacagtgtttcctagtggaatttcttaaggatttgcctctagaggtttctcaaaagctgtctctaggatttcatccagagattagttctttagtagcttcctttcagatttttccaatattttaattgagggtttcacatcagaaaatgcatgtctttcattcctgtaattccttcgattatggctacataaaaatcttcaaggtttttttcgtgggatttctctggagaattctgtaggatatcgtttcgtttggaaaccaggtctatttcacctggtggcacaaatctctggcgcttagaatggtctgatgcatccttgatcagtctagatccaccctgcctaagtcgttcttgaagaagaatttaggaacgaatcctatgatcaatgccggaagtgttgaggactgccttgtgaaatttcttgaagaattttatgcgaatttttaacgaatctctgaagaaatcgttcgggagaattgctggttaaaatgctgaaagtattctgaatgaaaatcttagaggaattgccagtgaaataatcactggtttgactcctgaaaattttttctgagtaatacctgaaggaaactttgaaaaaatacctgaataacattatgttgaaatttctagagaaaatgatgaaaatcagggtgatgatcagggtcattcgacatcagtacatctatcttatataaataacaatggaatggtgtttgtatgtcacgaaatggcttgagaacgggtcaaccgatttgaatgattatttttccgttttgttcgtcaagtgttccgacgtgtttgtgtataaaaatcccaggagatccgagaaagtcgaaaaaacgagcgtgaacggagctgtcattttgtatgggacaatccatagcgtttttcaacagcctacttgatggcaagacgaagtttgccgggctaactagtttgatataaaagacatttaaaataacggtcatttggcataatggtcaatttgacatcaagaacaggcatcttttgaattctagtaatgccaatttgaccgtaaagccaaatgaccatcatggtatacgatcttatgcctaataacccgctctcgaggctaattgcgtaatgagacagtgaattctcaaagaagtttactggcgaagtaggccgtgtcattgggatttgtacgcatccttaatgattgttgctaatttgtcccatggtttcgtattgatgaaaatcagttgattatgtactgacatggctgaaaaagtatcagtatactttcggcatgaaagtgcatctagtcatactttttcgattcaaaatgaaatataaggactgagttttattactttgtaattccatcatagctgccaaatcgaatgacgggctacttagtcttaataataacctcttatgtatatttgaattctctgatgaatctttaccacaatttagaactatttgcttgactaaatttggtcttctgttggttccttttctgtctctatttcccggcttaaagtttctaaaatttatttttaacacacttagtcgtcaccagccttgcccatttacccattgccataaataatctaaccctgattgttttccagcccggaaaggactttgccgaatcgatcgacaaaacgtgcgaagattcggtcaacgacctgatggcaaccattgccaagctggattccaacggagtgcaggtcctaccggagggtcaccggggtaaaactacctccccgcaggtgcacagttcgacggatctcaacaccagcggaatggtggccggtgccggcgccagtgtgctagtggacgacaaaagcctgcccaaggagctggacccaaacgaagactggtgtgcggtgtgtatggacggcggtgagctgatgtgctgtgataagtgtcccaaagtgtttcaccagacgtgtcacataccggtgatcgacagtctgccggacgagagcgaaacctggcagtgtttgctgtgctacaactttgccgatctgcccccaggtaggatactccctgattgaaacgctctttaagaaataatatttgaatgatttttttacagaaccaaccggtgaaaagcgaaacgtgggcatcacaccgctggaattgaagatcctgcagaggatcatactggaacttttctgccagtatgaaaccagtatgccgttccggcatttggagccagaaatcaacaaagcgtactatgacattgtgtgcaagtaagtttctacggcagttttggctttcataggtgcatatgttcaattgtcgaattccattttagccccatttcgctgacgatgattcgggacaaattggagatgaccaatccgggtcactacaccgatattgcatcgttcgttgccgacatccggcgattattcagcaatgtgtatctattctatcaggtaagttgatcgattttaaatgcttagatcaggtacattgaacgaaaagtataagttctatgctgataacgaaaggtcgtgtttagagtccttagctgcatttacaatttattctcagtttctgtaaaattaaaacaaggtgtgtatccatctggaacatctgagaacagcgggaaaattcgggaaattgtagaacacatcgataaatgcttcaatacaataaactagtgaaagtaaattaatgtcaactagtgctatatacagggtctcatacttaggacaagcggtaaatggcgccctaagcctgagtcattgtcagagatattattcggttccattaaacattttccatatttcaattttattcctgcaagaacaaatgtgttgtcttgcgtttagcttaataagctgagccgaaaatgtatttggcagatttcttttcaaatctaaatggtttcctgcagaaatcctggacagtttcattaaaaattattttgacagattgctggagatactgatggttattcttggagatacatgcaaagtctttatgagatccctggcaagattttgtatagatttcagcagatttatagcaaattatttgtattattccaaacattttcttcgatggattcaaaaattatacgtggttctttgactaaaaaatgaataaaaataatttcttatcttctcttgtttgttggaggtcattatcaataacattttcgctatatatgacaaaacaatcaaagttccgtaaataggaaatttttcctgagtaggacgaagtgttccctacttcaaaatacacttttctcgatgatataacaacggtagcttggaagccgctaacgtggggcaagtgaaaagttaattgttttgaacaatacattcaaaaactaacagttatattcactatttctattacctttaacatttgttaagatgtcccaatgaacaataacataagtaacaggtaaacaaagcatattttattcctgttacttgaattttcttctgttcagttatgtttgttgaaatgattcgacaacattataactgcaatattttcaatgttagttcttccctccccttggttatgcgaccttgccgcgatgggagggcataatccattagcccatatgatggaaaccaaaggcgtaacctgtagtggtggtatcacattttggcattttttgcttaaagccgcgtcataattcatatggcatagacgcaataatatctcggatgtgatccaacgaacattctgcgtcattgatagaattgatgcccatttcaaataattaatctattcgaagtggacattaatactattggtgacgttcagtttgccttttgctaaccagaatgatccgtagccactcttactattagctagctagatacattgttatcatatacgacgtatggaatacttaggaactcttacgaaaatgactagtagattcactgagtagaaatgagtggcgacaatcttattttaatatggtttttacattgccataataagaaatacctcttttgtaacagcggtataaataatctaattccagcttcattttcgcaaaatttacaagtagaaagtaggcgttgtgaagcattgcatttgccaccgaaaagtgaatcttgtaggagactgtaatagaagcctaaggtaactttactcttcaatatttactataaaaatgactatggaaagtaagacgctgagatcgatcattagggtacacttgctagtttcgaaaaattgttgaacagacaaggaaagcgacttttttctttaaggatatatgaacgtaatgaccaataaatatttttaacaacaaaaaatgaaattaactagaactacttctaaacagcctaattttgttaagacttgacgacacttgacatttaagactctaatcttacgtaaaagaatagtaatcagaatagcacttgaatgacaaattattcaaaaccatttcgactagacagtattagtaatgcactactatttcaaacaaattctacactactatttcaaacaaattctaatggagctgctgattttcataatgcttccttttctcagaagcaagggaatatgggtacttttcaaaaactaccacgtcacaatactaataaaaaacagtgttcatgtgggcgccattgcctagtccgtctgagtattggtcctggtagaggggaaacttggcaaaagccagaccgagggttcagccttgacaagttaagctgtcaggcagctccaactgaataccaaaaaaaaaaaaatatatatattttcaatgttagttcttacatcatgagacagcaattgcaaatcaaacggaatccttcaataaaatatttggaaacttttttatatggatagacctataccccatttttatgttttgaactagttttacatagacattccacgagatttccgtgcgttctcttatattgtaacttttcaatcaacgtcttccttttaatcggctgtcctaagtaaacatattaatatcgtaatatttggcaatcttattttagagaagttccatgatttggccatgataatagcttttaacgctttgagtatgtgtttcttgcattatcaacacgttctgtttttctatgataactgcgaaccttgtatatttatagctacctaaacggaaaacataaattcaatctctaatgagaaactttttacttgctccacgtgattagaaaatttactgtgtttaaatttatttatttttaggtctatgtcgaattaattctaaaacttttttattgcagtttaaaactgtcagaggggacaacttacaagtggtacaaaattattttccgctgaatatatttaaataagattgcacgccgtcaacttgttacggagtgatagttgacaggttaacaatcttttgctctattgtgcaataatggctgaaaaatttcagaaatcttttacctatcgtaatgtttgcaatggcctcaaaggtttacgcatgagtttaaaacgttaattcacattttcagtaaaatataccaattattttcacttaccccatttacccacttaccccgcggtaccttaattgtattcgggaaagtgttataggaccaacactgctacctaggcgagctctgtcgcgctcggcccacaagctaggatgtattttgtcttggtcgcattcaccatcagtccaacttttgctccctcgcggttctggtggatgtacagatctgccacgctcaaaacggcaagacaaatttatcgctaaatattgtaattgatgtttatagagcaatgtagactaaggtgttgacacgaatgcacttatagtgtaaagtgtcggtaataaaaaaaaaacaaaacaaaaccttttccactgttcgacaaatttattggatctcgcaaaaatcgttccccggctgtgaagcccggctctccgcataacaccttctagcgtcatattgaacaacaggcacgaatgtccaaacggacgaagtggaatgttcgcctgaaaccttcatacaattttgcacaccttccttcgttgttcttatcagtctcgtgagcttcctgggagggctgttctcgtccaagttttcgtccatgattttccatagctacgatagcggtcgatactatcgtatgccgccttgaaatcgatgaaaaggtgatgctttgggacctggtattcacgacatttttagaggatttgccgtacagtaaagatctggtccgttgtcgatcggtcgtcaacgaagccggctttataacttcccatgaactcgtttactataggtgacatacgacggaagatgatctgggaaaatactttgttggccgcatttagaatgatgatcgctcgaaagttttcacaatataacttgtcacctttcttgtagatggggcatattaccccttgcttagctgttcctccgatagctgttctgttttccagattgtgcctatcagccggtgcaaacaaatggccagcctctccgggctcatctttatgagttcagctccgataccgtccttaccagcagctttattgttcttgagctggtgaatggcattcttaagctccctcaaagtgggggctggtttgtttccatcgcccgctgcttccacctcacgttcgtccgtcaaaaagctcccttccttatccctgctcgcgacacgaagccgttgcggaatgcgttgatcttctgatacaacttacgcgtatcttgagaccggcataactgttccatctcctcgcactccgtctcctccaggcggcgttttttctcccgaaagaggcgggtccaggctttggaaaatttgatctttaaattgacacacgagcagtcttgggaactgtgaccacaattcaccacagttcatcgattctgccattccaccaaaacacaaagcagcagcagcatcaataccatcaggcgttgcgctgccaacggttcacacactgcttgactgtttttgtctctccactatgaccattttcgggcagccattccaagctgaatgattgaaaaaagtgttaaatcattcaatcgctaatatttcgcttgtgttttcaactaattgaaatctattagctctaacagaaagaccacaatcattccgttacgatacatataaacaatttcaatttcatactgcctttatcgagcaaaaatgcaaaaccccgaaaaccgcaaaaatcgtgtcaccactgtgctcgagtcatttcgcattcggggttgaaaaacgttaggaagaagaagattacattttttgaagagccgtgacattttttgttttgaaccgtcatggtttgctttgaattttgatggtcgtgtagaaagatgtaaatgtagaggcggtaaatgtttgctccagtacttttctcatccctgcacacgagccataatttcaactgatttatccgccttcattcatacaacacgcatgaaatttatcgttggtggaagataacgagccatgaacgataacaagacagacacacaccatccactgtttggtgctattcctgtgtgtcaccacttgtaatatttgctgacacactctcattctgatcaagaaacagaggcgaaaattttctattttatgtgctatgtgcacgaccaaaggggtttttgatagattataattaggttgttaaaggctgcattaccagaaaatatgaaaattattaccaattttattcaaaacataaatcacccgagggggggcacagatagccgtagcggtaaacgcgcagctattcagcatgaccatgctgagggttgtgggttcgaatcccgctggtcgaggatcttttcgtaaaggaaattttctcgatttccagggcatagagtatcttcgtacctgccacacgatatacatatgcaaaaatgatcaatcggcaaagaaagctctcagttaagaactgtggaagtgctcataagaaccctaatctgagaagcaggctttgtcccagtagggacgtaacgccagaaagaagaagaagaagaataagaagaaatcacccgaatggctcgatactgttgtagtatgtgagagttgctgctcttgaacgctctcgcgccacgtaccaaacgagagagtgaatgtttacattcatagggctctccgattgcgatgtgccacaaactgttatgattcacgaactattacactctctgaatacggttcgatcggcttattcggatcaaaatccaaacactgttgccgtttctgtctataacgttccacgttctgccaggtcccttgctgcagcatgaccgcccgcgctgcattcttctcctccataatctgcctacattcctcgtcgaaccaatcgtttcgtcgactcagtcccacgtatccgatgttgctctcagttgcatcgttgatggctaatttcactgttctctaacagtcctcaagaggggcttcatcgagacacgtatgttgtatcatccggttgcttaagccgctctagatcataacagggcggccgtcggtaccgtacattgttaacgacggagagttttgggcgtagtttcaccatcaccagatagaggtcagagtcaatgttagcgccacgatatgttctgacgtcgataatgtcggagaagtgccgtccatcaatcagaacgtggtcgatttgtgattctgtctgctgtggtgatcttcaggtgtatcggtatgggaggctgtgctggaagtaagtgctacaaatggccatattcttggaggcggcgaaatcaattagtcgtaagccgttttcgttcgtcagccggtgggcgctgaactttccaatcgtcggtctgaattcctcctcctggccaacctgagcgtttagatctcctatgatgatcttgacgtcgtagcttgggtgggcagctgtcgtacttgcgttcgagctgcgcataaaaagcgtctttagggcccattcacaaatttcataacgctgaagggggtgggtgggtgtcctcgtgctgttacggctcatacaaaatttgtaatatattcatacaaaaagcgttacgagggggtgggtgggtgtcgaaaatggccatttttagcgttatgaaatttgtgaacaaacccttatcatcatcagttctactggaatgtgagatgtacagtgtacattgtacacgtttattatgctaaagttgaagaaccggcctttgagcctcaacttgcacattctctcattgatcggccaccacccgattacgcgcctttgcatatcacccatcactataaaagctgtttccagctcatgtgttttgccgcagctctggtagatgatatggttacttctaaacgatcgcaccattgatcctttccaacacacttcctgcaacgctacgacgccgaatccgcggtcctctagcacatcggcaagtatgcgtgtgctcccgatggagttgagagatttacagttccacgtaccgagtttccaaccccctagatttccggaggaccattccccctaaatgttaggagggccatagttcgcagtttagcttagagtccttctctggcactcggacgatgatcagctgcccttgacatggggaacagacgctgatgtgagccgctcctatcatggagtacagacgctccaggtttgcagaagcaaccctctcctcctgccctgcagaatacgactaaagttcccaccggggttcgttacccgatcttccctaaggttgctcgtaccccggccagtaccacgaggaggtagaaaggagttgctgggcaagaggctaaggaccacataaaggggtctattttattcctgcaggtacgtgaggtatcaatggtacaccatgcacagccatttaccgagccactgaacacaataaagaagataaaatgttaagctagtcttctatgtctttctcggataatatctttcacgacctattcttaactacgagctattttttcttggacacggatcacttagttaagaaaacatgtatttccgttccattcgtaaacaaatataaattagtaacaataatcgagtatctcatattttgcttcacattctctcttacaggaggacagtatcaccttcaaaaacgcccacaagctggaaaaattcttcgagcagcaactggccaagtggttaccgaaatacctggagactgaacatttcgtcgacgactacctgcagaacccagccaagcgcatcaagagcctccaagaggattaacagtcaatgccgggcggtggcagtggcgttggaccgcaaccgttgccgcaccaccaatctcctcaacaacaaccacaactatcaccgtcacacccatcgcaacaaaatcagcggcagcatttttttcagcaccaaacggaacagaaatttccatcccctggatccagcgatggatccagggtcatcgacggtacaaccaccagctgcagtagtaccactgcagcaacagcagcttcaactacaacaaccgcaatcccaattggaggaccatcagcagcgacagactccggaggaagcacagacggacgagcccagcagcagcaagacgggaggcctcgttcaagggagaacaaaacgagtgcgcaagatgcgaatggaggtggactggacgctgctgctattgccaccgtcaccgaaaggccgccgcaagaagcggaaaccaggacctaaagctaagccgggtccagcggaacaggtgaagcagaagaaaaagaagagcgaacaaggaccgctgcctcaggaaga

SEQ ID NO: 91 - DNA, 52335 bp, Aedes aegypti
  misc_feature (1942)..(2315): n is a, c, g, or t
  misc_feature (42040)..(42170): n is a, c, g, or t
ttctaatcctgatctccattctattcttggttttttctccgcaaattgtgcattttttcatcaccgtgtacgtagaagcgtggttggtggtggtgttacgacccgttaacgatcgattagtatgcgttgatcctgtcttggaagtagagcggtgttttttgtcctcagacctcagagaactgctgatacagaacaaaactaactcaaaacaagcgagataaaaagtgtgctctttgtgatccttttcttgatgtgaaattcgaaaccctttttcgtatgtttcttttgtgccgtcgaagaaaaaactggttctgtaaaataatcgcttttatgttgtttcggtgaagatgagtctgaagtgatcgtttatttacgtccgattttcaactggttgaggatcgcctaggaaacataaaaatggctcctgcgatcctgtgattgatgttggcggaagatttattgaagaaacagcagtgcggtcggtaaatctagttatcctcgcggagtgtcaaggaagcaactggtgaaagtgatttgtttacggggtgcctgattggcgaagattaaaaaaaaaaagcggatcaaggacgaaacgatacgatggccaacaacaacaaggaaagcacccagccaaacacccaaacgggaacccagagcggactgtggagtcagatcgagagtcaaccggtggacagcatcgtctatggccggctttacgcgaagaatctaaagatcaaaagcctcggtactaaaaaagctcttccacttataccccgaaatgcatcctgcagctatggtacatgactaaaattgcaagttttaaggatatattttgattatagacatgcaccttgcagcaaactctaagtaccttcacgttgtccatgaccagggttggtagcaggtctctttttagttaagcagtgtgtttatatagtcatatgtataatcatattatctgctttaaagaacaaagtctcttaagcggcctctattttagtcaaaatgatatctaggatcacattttttctgattctcttacattattggacaaaacatttgcaaggctggtagcgagtcacttttttgaagcaatttcaactaaagtcgcattttccaagtacaggtcggactcgattatccgaaatttgttttttgatgttcttgtttttcaatttttatgcataaatttgagataatttggtattgcaatgtacgatatgaatggttttgcagttttgaacgtatttaagattggaaaagtgtttttttttgtgtatgttggtcaattttttttcttgacccctactattatcaggtatcagaaggccggctccaaaggcacgttccccaccagttgggagatttgtgccattgccatatttgagcctatttcatcatctaccagatgggagagtaaaggtaagggaaagataggaggaaataggagtggggtcccttgaagagggaaaatcgcataagcaaaatgagagcatgtagctccataccacaatgggttcgaaaagcgccctaaaaagggcactgcaaaacgcacgagcgtaaagagagcctatagctcattaccacagcgggttaagaataacagaatgtcctgaagattcaggcttctgaattcagtttcacttaataagtgtttaccaaataattggaatcgcatttgcgaaaaaactggacagttgcatatcaggtgatacgaacttccataatcggaatcacaactatcacacacaaatgagtcagcacgctgaatatttgccatgtgatagttgagtcggcagtggcctgtcaacgctctgaccaagagactgcaattctgctttgatagatttgttaatgttgagataacgaagttacctaagtagttcactatggatcgatgcacgagttcactatttgacgttgagcggtgccggatccaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagatgacgctgataagaagaagggacgtggagagctgtcaaccggcggatggcgaggaagttgatcctgaagctagtgagcgagcgctggcaacaatttgcttaacgctggagaagaataactacagtcttgtccaaaccgcgaccagtgctaaggacgcatgggagaaactccggaaggcatttcaagacgacgggctgattcgaagatttggattgctggaccgcttgacgtcggtgaagctggagaactacagtaccgtagaagactatgtcgataacttggtgtccacggctcacgatcttagtgagatcgggttcgaagtgaatgaccagtggctggtttcgttattgttgaaaggacttccagaatactatcatccaatggtaatgggattgcaagcgtccggcttggcgttgacagctgatatggtcaaggctaaaatccttcaagacgtcaagtggcctattacatcttccggaagagaaggcgcactttatacgaagcacaaccctcacaagtccagaagacccaagggcgcggtggaaaggaaggataaaacctgtttcacttgtaacaagcttggacatttcgcagcggagtgtcctcagcggcagaagcaaggtcagaattcaaaaccgaagagcaaggctttgtgtgcgatgatggctgttggcaagggcagcgcagaagaatggtatttcgactctgcagctagctccgatatgacgaaaagcgaagataatttcacgaagcaagaagtctttgcgcaccccatcgagacggcgaataaccagtgtatgatgtccttagcgaaaggagtggtgaaccttgaacttcaagaaggacccatcgaagtacaggaggttctacacgtcccagatttggcaacaaaccttctttcagtcagcaaaatctgtcggaagggtttgacggtgacgttcacttccgattcttgtaaagtctgtgatgaagatggagatgtgattgcttctgggaccgagatgaatggtttgtaccggctcaactgcaagaaaccggaaacatcgctgatgacaacggaaacgaagatctggcacaggaggctaggacacctgaatcaacagagcatgaagaaactcgaaaccatggcagatggaattgaactgcggacggagaagacattcgattgtgtgacctgtgctacaggaaaacaagctcgagatcctttccattcaagcacaacgagagcagaaggattgctggatttggtacacaccgatctttgtggaccaatagaagagccctcgtttggtggtagtcgttattttctaacattcgttgacgatgccagtcgcaaggtgtttgtctacttcttgatgtcgaagagcagcgttaaggatgtgtttatgaacttcaaatccatggcagagcggcagactggaagaaacttgaaagtcttgaggtcggacaatggctcagaatatgtcaactcggcgatggaagcgtgcatgggaagagacgttataatacatcaaacaacttgtccgtacacgcctcagcagaacggagttgccgagcgtatgaatcggacgctcatagaaaaagcaaggtgcatgctgaacgattcgaaactctccaagaagttctgggcagaggcagtctcgaccgcagcatatctcgtcaaccggagtccctcacgttcattggaatctataacgccagaaaaggcgtggagtggcagaaaaccagtgctgaaacatctcaagatttttggttcaaaggcgatgattcatgtacccaagcagaagagacagaagttcgacccgaaggccgttgagggaatctttgtcgggtatgcggagaagtcgaaaggataccgtattttcatgcccaacgacagcagcatcgtaacaagtcgtgacgtgaagattatcaatgagggagaatcttcggcgattgatgaagagtacataggtgaagtcgaattcatggagcttcattcgtggatcgagcagattgaacaaaccgaagtggttcctgctgtttctgttgtcgttcccgaggtcgttccacatgatgacgatgagatgtgtcccttgctctcggatgccgattccagtgaagacgagtttgccgatgctgagccgcacgttgcgctcccaccgcaatcaacaagactagctgatgagcagcaattgtcgaggcacagcggtcgggagcgccggttaccaggcaagtacaacgattatatttgttatagttcttttgctggccctgatgaattcccacagaaggagtcttccgatgttacgagtgacccgctgagctacaatgaggcgatcaacagaccggatcgtgaacgatggattgctgcaatggacaacgaactcaaggcgctagacagcaacaacacgtgggaactgaccgacttgcccgaaggaaggaaggccatacgcaacaagtggatattcaagacgaaacgaaatgcagatggtgaaatctcccggtacaaggccaggcttgtggtgaaaggctgctcacaacgtcctgggatagactatgaagaagtgtattctccagtggtgagatattcaaccatacgatacatgatggctcttgcagtgcagtatgacctggacgtggagcagatggacgctatcacagcgtttctgcagtcggacctaaaagaagaaaccatctttatggagcagccagaaggttacgagaaggatccaaccaaggtctgcaaattgaagaaagccttgtatggattgaaacagtcgagcagagtgtggaaccggcaactggacgaagcgatgcggcagttcggacttactcgttccagaatggatccatgtttgtacttcaaggtgcacaagaatgagatgatcttcgtgacgatttatgtggatgacctgctgatcattaccaacaacgcgtacttgaagaaaaggctgaaggagttcttgaacaatcgcttccaaatgaaggatcttggcacggcgcagttatgtttggggctacgaatcaatcgtgatcggaaaggaggcacactaaggctcgatcagcaacattacatcgaagaagtactgaagcgtttcaatttgaacaactgtagacctgtggcaaccccagcggatcccggtaacaagttggaagcttcaacatctgaagaaacggctgaggagattcaagaaatgcagaacgttccctacaaggaggcagtgggatgcttgacctacctggctcaaggcacgaggccggatattttgttagcagtaaacaaggtcagtcagttcagtagtaatccaacccgtcgccactgggaagctgtgaaacgaattatgcggtatctcaagggaaccatcgattattgcttggagtacagcagagaaggcgatccacaattcactggttatacagacgcggattggggaggagatccagccagcaggaagtcaacgacaggttacatcttcaagatgatgggaggagcagtttcctggaatgtaaaacgacaggcgtcagttgcgttatcatcatgcgaggcggaatttgtggcactttcccacacaacccaagaggccctatggtggaagcagctattacaggagatcggaaaccagcgttcgatttctattttctgcgataatcaatccgcgatatgtattgctcaaaacgaaggattcaaccccaagaccaagcatatttcgattagattccattttgtgaaggacactctggagagaggagatatcaagctgtattacatcccaacacaacagcaacccgcagatggcttcaccaaggttctaccgaagcagaagcatgaagtatttcgaagttatttaggaatagtaaactaaggaggagtgttgagataacgaagttacctaagtagttcactattcccggagttactatagtcaaccctagcaacctgattgtttagcaggtataagcagtttataataaattttcattccaccttcaagcttacaccaaaccagacgttctttcattaactctcaagtgttaaatacttcgccacccttggagatggctcagtaatgtacaattttgtttgacgacatgactccaaactattccaatattgcttgtgctgagttgccgcccaagagtttatctgaagcttcactcagcacttcgaaattggaatagccggctcagggctaatgaagtcatgcgatgctccatcgcgagctagctcatcagccaattcatttccaggtacccatacaaggtttacagagttgactgaattcagttcctcaatttgagttcgacatgcgataacaagcttcgaccttgagttggccgaagcgagagcttttatagcagcctgactatctgaacagaagtatatgactttacccattacgcgctgttgaagtgctgattgcactccacacataagagcaaatatttccgcctgaaaaatggtgcagtttctaccaagtgagtaaaactgattcagccttagctcacgagaatatactcctgcaccagctctaccttcaagaagggagccatcagtgtaacatactatattgtttgatatacttctttccaaatagccagacgtccactcttcccgtgaagggaattgtgtggtaaatgtcctgtaaggatagtgacaagcaattgtgagatcacttggagcaaggacaattttgtcctaattcaccaaaagtggaaacaacgaagtctgtgtagatctacgatacactggatttttctccagtagatccagtacccataaatggtaagagcaagaaagtgcttcttgtttaagatgtatgtgtagcggcgcaacgtcgaaaatggcctcaagcgctgctgtggaagttgtagagaacgcaccagacatcgccatcaagcacatcattttgattggattgttctcacttcgcccttttgccaccacacgagacatccatatgccaatattggttgaacaactgttgtgtaaatccatttgatatatttgggtttgaggccccaagttttaccaaaggttcgccggcattgaccgaaggccatgcaagcttttttgactctgaaatcaatgtgaggtgtccatgaaagtttggaatctagaatgactccgacatactttacttgatcagtcacattaatctcagtgccaaaaagacgtaaaggtcgaattccatcgcggtttcgtctttccgtaaaaagaacaatagatgttttattcgggttaaccgaaaggccatattggcgacaccaactctcgactacctgaagagcactttgcatcaggtcgaatagggtgcttatgcacatagatagatagatagagctagatagtcgtcggcaaatccataagttggaaaaccgcaattattgagttgcctcaatagcgtatctgctacgagattctacaagagtggtgacaagactcccccttgggggcatccgcaaacactcaattttcgaatcgctgcttgacgcaatgtcgagaagagatgtcggtttttgagcatttgatgaatccaattggtaatcattgtacgtagcccatggtttcgtgcggcttccaatatggcatcgaaagacacgttatcaaaggcaccctcaatatccaagaaaacacccaagcaggattgcttctgagcgaatgctttctcgatattgtatacaactttgtgtaaaagagtcacagtggactttccagattggtaagcatgttgattcacatgaagaggcatgtttgccaaataaacatcacggatgtgatgatcgataatgcgttccagacatttcagaagaaaagaggtcagactgattggtctaaaactcttcgcttcttcatacgacgcacgtcctcctttcgggataaactttacagtaatatcacgccaggatctgggaatgtacccggtagcaaaactgcttacaagtagctttttcaaaacatgtttgataaactcaaatcccttttggagcagaacaggataaatcccatctgctcctggagatttgaaaggagcaaaactattaagtgcccattgaatcgattcagtagttacgatactgcgagccgaggccagagactcgtagctacatgaaaagacatttggttcatccgtagatgctatgtccacacatccggggaaggtgggtattgaataaacattctaaaacttcttcatcggaagaagtaaagtcaccattaggtaagcgaatttctttcacttggaaatccttagattttgcaaggattttgttcagccgactgacttcactcaaactggaaacatttgtacaaaggtttttccagccggatcgttcagcagaacgaagagccttcttgtaagccttgcgggccgacttgaacgactctgatccagctgaacggcgtctgttccaactccttctacattgtttcctgagtctagtcagatcggaattccaccatggggtccctcttgtagtctttacagaccgcagatgacatgcttcttcaaaggcttccataatgtaggatgttgtagtatcaacggcatcatccagatcacttggattttcaatggacggagaatatccatgaaatttggtcgcaaccaattcaatatagagttcccagtttgttgaccggggattcctaaaacgcaaagtctgcgcagttacatttgcagccattccatgaaaaaccgatctagtgggtctccgaattccgtgcaaatttgctattttgctccttatccgaaataaggatacacgtatttttggattttttgattagggtgaccatttccgaaacaaggtgactagaaaaatcgcgattttgcaaaatttttatttaaaaaaaaaatataacttttgaaccgtttgaccgattttcaatctttttggacgaaatggaggctaaagattttgacttttcgggaaaaatataaaatttcacaaaaattgtgttttttcgtgttttgaaggcctcgggaccaaaggggctattgttgctctcattttttattaaaagttcagaaaattttacgtaaactgtcaaattttcagcgatgtatgtgttttagttatgagatatatttttttgaaaataaaaaaacagtcatttttcatcggcacacactgtagatctcagcgcattagatttgtattgtttaaaaaaaatcataacttttgaacagctcaaccgatttccaattttttttttggaatgaaagcttgaaattaatataaattaaatgtcgacatattcataaccccacccttattaagcctcagtatagagactgaagaaggacagccgattatctcggagaaacacgaggtcacctgcaccatttctccgggtagcacaggaaggactcaatactgtggaaggcgcccacaggctccgtttgcggttaggttttatttagacccccctaaccattcattcctaggcacggtacgcatcacaccataaattaggggtcacctgtgagatggacttttaccaccggaacaggcagtccgtagtgttaattcttagccagttgaaacaaccgctaccgacactacgcggctatctaggctgctcgggaaaaggaggctaatattgatgattaactcctgacgcgcccaagattattggacaaaacatttgcaaggctggtagcgagtcacttttttgagggtctaccccgtttggcataatgccgtttggcatacagtcgtttggcataatagctgtttggcataatgccatttggcataacggtcgtttggcataatcgccatttggcataatagtcgtttggcataattgtgaaaaacattgaatttgatcaaattccttccattaagcaaaggggtgtgtataaactgctcacgatcgtacattccgttgtcagttagtgataggacatacttcaggacatcatcatttttcaaggaaaccaacatccaatagagctcttttgaaattgcatcatacatgacttccgggattattaagtccgggatattatggcgcatttttaaggtgaagatgaatcaaagccaaacttcaaattttcaagagcacggatctgaagaaccgaacatccgttcaggctgaaaacttaatcgattgatcactagctggtggtgaccaattgattaagttttcagctcaaatgagtgttcagttctctagatccgtgctcttgaaaatttgaagtttggctttgattcatcttcaccttaacaaaaatatatccaacgcctaagttattccatgtcatttgaaaaaaaaaggaacatggaatttgatgacgcatcttatggtacggcatattactgtaccactgcagtatcttcctttttcaaattatgccaaacgaccattatgccaaatgactattatgccaaacgactgttatgccaaacgactattatgccaaacgactttatgccaaacgactgtatgccaaacggcattatgccaaatggcattatgccaaacggggtagacccctcttttgaagccatttcaactaaagtcgcattttccaagtacaggtcggactcgattatccgaaatttgttttttgatgttcttgtttttcaatttttatgcataaatatgagataatttggtattgcaatatacgatatgaatggttttgcagttttgaacgtatttaagattggaaaagtgtttttttgtgtatgctagtcaatttttttcttgacccctactaactgttcctagaaaaaatttctggctacgccactgcatcatataaataaaacaacaacagaaaagataatatttaagttattttatcgaagatttcaatttttttcttagtgattcgattatccggagtgaaaaaaatcgatactccagacctgggagggagaaaccaatacaaaatttctatacgtcatagtgagccgggattccgctgtcacgaactgtcactgtgagcccagatctcaaacattggactaacatggaaaaagcgcgtaactgattaaaacacatttttgcatttcatcaaaagtgacaaaaattgaatgaaaatcaattcatgcacataatgcaagtaatgtcacgtgagtacctttcaactgattgaatataaagcattgaaaaacgcatcgttttactttttccaatgaaaactaatatttggtgcatagaaaactgtggccctttttctatgtttgtcaggaaagatcgaaagtacacaacaaaagaaaactggcggttttccccaagcctgccttgattgttgttggcaagctggagttatcttgcagttcaaacaaacattgttctatatttcgtgtgtagtatcggtgcctccctcccagctccagacaatcgagtccgacctgtatttcgaactaaattttcgggagaaaattatgaatcggcctttttcaatttagggtaagttttaagttaggacatcaccagatcatcttcatgttaatagagccgtagcgttacctcatggcgaacttggcgaacccccatttgtgcgccctctagacaaagttaaagcttattttcgtttttttattgaactaacatcttaccaaaaacatgaaaaggattgtttttgaagttctacacgcttaaattattttaccgtaatccgtaaatttcaccgtaatcgacagctgaaaagttcgatgaaataaattaacgaaatacggtaaatttttacagttttcattaaaatttaaccagaatccgttgaatttcaacggaattacggtgttttattttaccgaactgttcagctgttgagattacggtgatatttacggattacggtaaaatatagtaaatttgtatagctccccaatgctcaaaattattatgataaagctcaagaatcatctaaaaatttgaatattttaaactcttggttaactattaagaaatcttgtttgaaaactgtctaaatattataaacgttttcttgggagacgttagctatctaactatccatctagcattcattgctccatgctccctcttacttcgagcaaaataggccgataagcccgtaaacaaattaaataccgtcaaacggggtaacttgcaacacttcgacatgtaaccgaattgacgtttcgtttagcatttagtcaaattattgttattcatttcaccgtttattgacttaaggcttaaaacagtagattttgtagagggtttgagtattgtttcttttttatttggtttgctggaggtaaaaatcgtattacacgttgtattgtatgaaattaatgctgaaaatcgttcctcgtacaacacaaacggtaaaaatgagtcattcagggcatttgctatcagttacagttcataatagtgtactaattgtcaataaaaagttttgataatttgatgcttgaacactataaaaattcaaaaacgtttttgactgcccttgtggggtaacttgcaacagcaattttaatctcaattgttcgatatttcttgccggttgttattaaaaatacatgaaaaagcaaaattgaacatatatttgttcagtaacattaaaattgttgtacatcaatcagttctataagcatttggtactgaatattagaaaatttacataaatcgcaatacaattagaattagttttatttccttcatgaaaatagtaaaaacttttcaaaatccgttttaaaattatcttgcagaactgtcattggaaactttctgcatgatgatacagtcatctctccgatattgaagggaccatcgagttagggaggtatcgagatgcagaacacatatttttcaaattttaaacttttcattattttgacaacatacattcaaaactgtgattatcaatatgagatacgtcgcttcggttgaaatatataaataaaagttatgtgaagtataacctataatactattacatttgttgataaattgtgttgaaacgttttaatggcttttcaataatagtgaagacttatgatatgctagaatttccccgtgtggacaccctatgcaataccaatgtagttttcaatggaactggtttaatgctcataattcaatcaaaaataattagttttctgagagtaaagtatcctgtttctgattattgttatgcttttactgcagaaatttagtaaatgatcataataacacgatataggttaagtttttaatgatgaaatttaagttgcactatgtgttgcatgttacctcacatcaggggtagcatgaaaaatgtatacttttcatctctcctgagcccagaaaaccaaatactgttaaaattattatcgtgtggtattatttacgtggcgattaggctaccagatggtttttatctcatctgaatccttaaatttttcttccatatagctttgaagttgaaatgtgttgcaagttaccccgtttgacggtaccgtccgacggggctacttttgattccgggggctactttggatactcacgttttggatttatttccagcataaattttaatctgagccattttgtgtcttgaacacttttgttaatacactgtccataactgcataaggggtcgtccataaatgacgtagctttttaggggggaggggggtcttcacgaatttgcgacgaagtgtgaccagggggagggaggggtcctagctagtggacgtagcattttgaatcaagtccgtaaaaactcaaacttctttttttttatttataaacttgggttatgaaattatgattaagcttcaaaacattcatatgacaagattgaaaaaatatctatgaatctttagattttcttgataaatacaatcaaacagatgttttgaagctttaaataattatgtgaatattatattatattcgtgtctaaatttataaatttataaaaaaaaaacaaaataaaagtttaataaattgattaaaaacaaggttttaactacttggagtatattgttttgccatttgttaacatgacatcacagtcagccgttttagttttatccatattttctgttggggctttattttttcaagaaaataaaatatgcttttcttgacaaatattacttcaatgttgcaggagatctccaccagatcaacccatcatttgttttgatatatcaatgctcttgatggataatagtgtcgagtgttatcaaaattgccctatcagtcaattttctttataactcggtaatttgaagaatatttatcatttaactatttcattataggttgtgtaagattatttcagtatggaaacaataatgaagtttaactagaatattaatagagataattgtatttgtaaaataatctaaccattccaaatatttcaagtgttatcttttatgtatctggccactgtttgctaaaaggatttgaaattggataatataaacgatgattcatttcaaattaatatatttttttgattatcttcattgaaatctatttccttcctaacaacgaataattaaacaaacaatcctataatataacgaaatttttgttcaatatattataaaatatattgcaccctaactcgacagtaacgagcttctatagtaaacttgtttttcatggtaacaacagcaaaagaaatataatttagcctatatgaaactggaaaccaaaatcaaggataatgtttatttaaaactgttttccaaattacttttgagcgctaatgtatataaaactgttagattagatgatccttacatttcagtcagttattattatcaaactttgtattgagcttctcaattccaatattttgttgcaacccagtcattacggaaaacaaataaaaaaatattgaggggggggggtgcttgatatgctacggagtaccagcatttgtgacgaaatgctacgaggggggagggggtataaaaaatctgtgaaaaaatacgtcatttatggacagcccctaacagtcacattcgacatttttgacaaattggagttaataccatgtcatgcggaagtcgtgcctactatgggctccagaagaaactgcggtcaagaaagattcacccccgcaccaaatgcacgatgtacaaaacgctcataagaccggtagtcctctatgggcatgaggcgtggactatgctcgaggaggacttgcaagctcttggggttttcgaacgccgagtgctaaggacgatcttcggcggcgtgcaggagaacggcgtgtggcggcgaaggatgaaccacgagctcgctcaactctacggcgaacccagtatcgtgaaggtagctaaagctggaaggatacgctgagcagggcatgttgcaagaatgccggacaacaaccctgtaaagatggtgttcgccacgaatccggtcggaacaagaaggcgtggggcgcagcgagctaggtggatggaccaggtacaccaggacctggagagcgtgggtcacagtcgaggatggagagaagcggccatgaatcgagggaattggcgaaatattgttggcgaggctttatcaagataattgacgtaaagccaaataagagccaagagagaccatgtcatcaaatgataaatactttcgatcaacttacttaaatctgtgagtttgttccagaggcgtcgcgtggctctttcagccacatgtgcaccaaccactcaaagatgcagttttcaaaaaaaaaaaaataacaagtaaacaacacaattttgatagagatttttttccaagaaaactaaaaacgacttaattgatttattttactttatttaaacagttcgtatacatttcacgtaagggtcttatctagacttatttatacattagagcaattctcctgtcacttcttttagcaaatttgtcaataatctcatcataaaagcatactcgtttttgcatatcttgcaataacttttgctcaacgcacattatcattagccattttagtcgctcctcattcattgtgcttctcaaatatgatttgaccctcctcaagaccgaaaagcttctttccacggacacagtagtgcttggaagacacaaaatttgctttccaagattaaatacttctgaaagcacatcttctagtcctgtctcatgaatgtacgaaacgatttccgtaacacttttacctttaaattcgtttttgacatacaaaactttcagttcatttgttagctttattctgtcatgcgatttaaatcgatcacagaagttgtcaaccaaatatttgggaaatgcttcatcatatgcttcaaactttgattgatctagcaacgcagagtactgaaaattatggaggtctttgaaacgaacgtcgatttgatgcaatatgcgatcaatcaaagtacaataaactttgtaatattttgaatattcatgtcgacgatcatttgagacacccgctgtctcaaagcacgatgagaatatctcattaaaccttgattcacatcgcaatttagtaacattctctttcgtctcgtttacgcttttcatacttgcaacaaaatctaactccttagactccaatgtaaggtacaaaatatcggtaaaacaaattatcgtagaaaatactttgagataaaatattgtgtcaaaatctaacaaaaatccatgaagacccctagtcatcaagcaagtttcgccatcccaaacacattctccgagatacatttcacctaaacatgagacgatgtccgaataatgactctcgacgacgttaaccatacgcgaattgtaagcccatttcactttgcatacgttgggtatctttttctgtatgaacttattcaactcgctttggactttgcgaaaaaaaggacgccaaagatgacagcgttgaaaaaaactttcttgtttgaggatgattactgcatgcatggagaaggacaagattaagtacatgtgcttggcaatgaatatagtgggcgtttggaaagtgctcccttactagcgcttgagtgccaccaacatcaccggacataacccttgcaccgtcatatgtttgtgctataagcttttctgcaccaatcttaaacttgttcagggtttccatgacatgctcagctatagatgctgctgatttatcatcactcacgtcttcgatatgtaccaaacgttcaacggctctccctgaaaaggttaacatgttgtcatttaatatgcctacatttgttcagattccttaccatttttcaagcaataccgaagtgtcgtggcaagctgggattttctggaattgtcagtcgtttcatccaccatcactgctgcacattttgcttcctgtacttctccaatcatttcgtcgatcatcgttttgcctatgatcataatcagctcgttttgtgtagtagcggaagctcccgagaacacattacttttgctgacaaattcgttgaaatttatgtcgtgatgcgcgaggaaagcacagagatctcggtaattcccacggtttgaagattgctcactctcgtcatgaccacgaaaacttaaaccatgtgtcgccaagtagcatacgatttcaattaaattggtcaatccttcgcgatttttcttcactaacatattatgattgttccgttgaacttccctgccatgatcaatcgcttcgtcgatccgtacttttccaaacgtatggtatgccatcgcactgtcgatgtgatcgcgcgacgcaacgtgaactttgatagcagtgccaagatggttcaaatcgttatacccggttccgttccacattcccttttgacccgtttttttaaataataaacagggccaacagaacaaacgatctaaattttcggatccgcataaccatttcgtttcatacaaattcgtattgaattttcttgagcggtttttcctttcctcacgcaagtggtaatcatgtttgccattttcggtcggggtgtatttattttcactaactgcatcttctcttcaattgaccggccggaaaagggtcggtttagcacatcctctacgacatcaaacttattttcctccaacaatgccatcgtttttccacgcactacggactgaaaaccgtttttattcacaaatcgtcattgacaaacaagcgcctgattcccgatcgctctacagttaatcggtgcggccatagtaacgcgtctgcgtccgcgaacgcgatgcgatcaaaggatttcctgttgttgatattctgctttgcgggctcgcacacgcggacgcgtcgctcgacgcgtttactatggcagcgcccaatgagagcaaaactgtgtagcgcgagagagagagagagcgaaatactagactagagtggtggaatttgcgaaaaagctttcggtgcactgaagctatgacacgcgttggctacctatacacataatgtttcactcagtaaaaactaacactatcggtgaggccatagtaacggtgcggccatagtaacgcgtccgcgtccgcgaacgcgatgcgatcaaaggatttcctgttgttgatattctgctttgcgggctcgcacacgcgcacgcatcgctcgacgcgtttactatggcagcgccctaacgcgtctgcgtccgcgaacgcgatgcgatcaaaggatttcctgttgttgatattctgctttgcgggctcgcacacgcggacgcgtcgctcgacgcgtttactatggcagcgccctatcacacgaccacgcaaatgtgcaacagtgccagagcgtttctgatcgaggtttccatgttgctgttggcggccaagcgatatgagcaccgggtgcactgcagagatgcgacgctttggctacctatactttatcaacttctatcgcctgaagactaccacactgaaatcgctcctttaatagcatgcacttgcaaagcgttcccggttctgatttgcgtgttgctagctgtttcattgatacgcatattttcaacaaactttttgcacgcaagttttggcgtgcgcgtttgaatatatattatttaatgaagatacatatatttagaattcgtaaaagcgctaattaagcattcatctagtaaaatgtgaatttgcttcataatgaattttagaccacctgtgcagtgcacatgttgcacaggtggacgcgacgcctctggtttgttctaaaaaaatcgaaaaaaaaaacaagttgttttgtcacattggtaattataaccgcataacagtcacattgagattataaatgagcctcgtaatgtaatagcaatgaaatttctatatgagttgtacaaaatatcagcctcaaataagtacttttgagttcctggtaatttttagaaatattagtttcctcccatactgccataaaatgcacacttagtattccatttactcaatgcctacttttgtcgaatgttacaaatatgcagttatgcgcagtacagtagggacccgattttgtcagcccctcaatgattttaggctgacaaaatgagaaacctgacaaaatcggatcattttttgtttttgtttttcaaatttataacgtttataacctacatagacttttaagggggtgacggatatgggcatagccatgttttttgtttatcagggtgaaaagagcggccctcagaattttattctcaaatttcgtgccgaaacactgcctctgcaccctttttgcatgaatcataaaattatggaggatatacaccctactttttctcagtaagcaaagaaaggtcctaaacgcatcttgagtaacgtcttggaagcaaccgtcgtgcggggtgacattgggtctgatttgtaagaatgcaataaaactaatctatgatcatctattggctatttataacatattcttgaagcttgacacattgtttccattattcttgcattagcatgttgtaaaaatattgacctaaagtcacccttgtggcccaatgtcaccccacacaacggtaattctcaaaaaaaaaaaaatctggagattgagtgcatgccatcgaacatcatcatcagtattaatgtacacgtggtaaaacatgacgaagacttttttttgaaatattcaaaataggctgacaaaattgggtcaaaaagctgacaaaatcgggtcagtactgtatatgctctacgacaagacatcaatattttttggaagaacttcaacaataacaggataaccaatatatatcaaaaaaatccatacaaatattcacaagctacaaaacattcggtatgtaaacattgtttgaattttccacataacgtggacggtgttgggaacaccataaaactattaaatcatgtcatgtttcgaagaaatttgtgattgttttatgctgaaagttgtagttttataaaaataaatgatcaaatgccttcattttacgactcgttaaagtgttggtttctatattctacaacacaataaaaaaatgataaataaaagtgaataattataaaacatttataattcaaatcttataaacagtaaactcacaacataatattttaaaaaatattttgtggtgatattttacctgaatctgctgaacgaagcaatggcatccttcaactgctaaaataaactactcttacaccatctcaaagctatcgggaaccaaaatgcatctaacaaaagtaaacttttaattgtttatgatcttatgaatcattatcattatacttcttctacatatcgttcatataacattaagaatcaaaacgaatgtttctgtacaaagctaattattcatcgcagtacttggtagttacaccatgcgtttctatcaatttcaatatgttcagggcattaaacctctaatacccaaccccgcctttagacgggctacactttggaattttgtgtattttttcgtagctcggaaatcaaaattattttatttttggcttaaaccttgactcataacacgcatgtaagaaaagttttttatgatttttgaaacttttttgtatttttgaaaattgtttgaaaaattgtattcttatataacctataaatatccggggttaatttaacgtgtaatataaaaaatcataccttttatatttttctacgatcgacctattacaaaagaagagcctggtggtatcaaaataatttcaaacctgtttttccgttagttacacggaaaataaaatacgctccgaaaaaaaattgaaaatttaatatttttaaaagtaccgcaaaaatttaaatttttattattgccaaaaatcaacaaccagaaatggcttcaagaaaaaatgaaaaaagctagggatgttcaaaaataaaaattataaaaatcaaaaaccaaaattcaaaaatacacgaataaaaaaaaataattgcccagaacgtgttaagaacgattttagataacgaaaaataatatttaaatcgaaaataaaaatttgggtattagagggttaacataaatacaagaatctgtctaaagtagccccttttttgtcttgaaggacacctttttccgttattcgagcaactttttttatttgacgtttgacggaaaaagatttttgtatagacatttatgaaaaagaactgataatatgactagaaaaaaaaacatcccaaaggaaacgctcaagtcattgttgctttattttttggaaattttcactaggacttttcgtccaatattttgaaacaaatgacctgttgatcttttcaatacaattcttagcagaaaaaaaagtttaataaaaaagaggtctttatatttttttgatttttttaagtacataattataatttataatgtacagttttgttcaaattcataagatgaatttacatataaacatgcattcataatacaaataaattattgaagtagacttaaagatttgtataaaaaaaacagacaaaatctaattatcaatccaaaatgacggtaagatcaagtgtttttacatcaatgtaatttttttaaatttaagttatttattttacaaaattatttgagagtcatgattaggattatgtgagaattgtattgaggatttcaccagaactttgattgagatatttgaaaattctgtgttgaacctaatgagtaccatattttttgaagaatcttgctcagatttatttctagttttatatcacaatgacatcaagaatcgtacgaaaatcctgttcaagatttcgttgctgttgagcccttttaagcccgcccacgcaaactaaccccactatcagaagggtcggtgttagctcttcctgatagtggtattggtgtgcgtaatcgagttgaattgggatcaacagcggcttgcaaagccaatgtttaccaatgtcgatggacccttttgaaatgtttgtccagaattatgtttgagtactgcttaagaattgaaaacaactacagtaatacctcggtataacgtaactcgatttttattttcgttacgttatatcgaggttacgttatatcgaagcaaaatattttttttccacaatttcgttcaacatgtattgtttgatgagaaaatgagtcttacattgatattattgaagtagcaggcattttcagtttatcttccatattttttcaatatatttccgtatttttttataattttctcttttttagctctctattgcagtaatccttaaaaatgttttcaggaaaaatattttgaggaatctttgaacacgcggagaaactatacaagaaattcatacatgaaatctttcagaaatctttgaaaaagttaatgttgagcagtccattgacagttctagcaggcaattatggatcttcaagatttttttatgaggaattcgtggtaaaactcctaaagcaaatcttttgtaaattcttgacagaattttagtatgaatgtcccaagaattctttaaaaaatgtttttttttttgaatttatgaagaaatcactagaaatctccatttaaaacaataaatatctttgaggaattttccatgcataaatttccgaacgaatacgtggtggaattattggcagtattctaggagaattttctgggagatctggggaacttcctcagtttttggacgaatccctgagtatatttttgtaataaaaaaaatccatagaaaaatttctagacttatcgttttcaagaatcacttgaagaacccaatgaaaacgaatcattgagaactttcttaacaaattcctgatggaatcaatgaaggatttcgtttcacatagaatccttgaagaaatttaagtagtacatagaatggtttttgaataaatatttggaaaaagctctgcaaaaaaatcgtaatgaaattgctggagaaatgccaagaaaattgtttttcaggtttttggacgaatacctgtacgattttttggaataacactgttcgacaaaaaaagtcgatctgaatgcacagagaccagacaacccgggcttgaaagtataaaaataaacaaaaataatggcgttttcagaatgttcgtgtctgccccaggtcatttttaaaatatacttgaactttttgcattttttatttaaaaatctaatctaatcaataaaccgacacagtgttttatattcaggacagcggaattcatgtgccatataatgtttaaaacgttaagtccaatatgaagagttgtaataagatttgcaggaagccctcccccttttttgcacccacccaatttttaaagtatcgcaaatgatggaatatttgatatacagggggttgtcaaaataactgggacaggcaaaaattgggccaactttggaatgctgtaactttgacaaaaattgaccgatttcaattctttaagaagtaatggacgggtcaactaatttagttttgaggtgaatccacggagatgaactatgaccaccggataccggtgataatccggatttccggaagcatgtcttatgcagtaaaattatgacatgtttttagtaaaggtctcggctaaaaattcaaaattttactacacatggagatagaagatcaaattctgaagcgattggtgcgccaagtattaagatcgatccagaaacaaccaagatatggccatttccccggaatcggtgccggtagtggatccgaattgggatcaaacaatttattcactcaaaatatgtcgcgcaatattgttttctccctagcttatcataaaatatcctattataaattaaaaaagagtcttgtacagatttggccactcatggcgccgccaagtgccccgagggaaccttgcataggggacatttcgattttgacaccaaagcatattatgcgacggctcattcttcatgtcttgtcgtaaatagggcaactgtagactcaaaacggatagttgactacagtgactacttccgggatcaccggaaggttccagagggaacctgtaattagggacaattgaaattgaactccaatacatatcgtgcgatggttcatttttcatgtcttgtgctaaatagggctattgtagaccttaagtggatatttgactacagtggccacttttgtgtctcgtgcattcagatcgactttttttgtcaaacagtgtaatttgtaaagcattccaagaatcgtaatttgattgttctctaaaaggaccgctggaagaattcatgaaaaattgcagaaataatttatgaatgaccccaaaaataaaaaaaaatccactttatatcctggagaaattacttggtgtaatttttgtacaaaggcagtagaattcatagatatatttaaattcctgaatattgaaaccatttcttgcgaaatttctaatgaaattcaacaaggaattcttaagacggcaatccgttaagtcaaaattgattaaatgttcctagaaactcttagaggaatctctgaaatcgccttaaaaattctggtagaatccctggcatcatttctgatgaaaatcttagaagtttttacacatgaatatcgggagggttaactagtggtatttctggaatatgcctgtcggaataggctaatattttcaaagctgaacggtcacttcgacatctggtggctagtaggagaaccgtcataaaaaacgtagggttgagaatgcaccgtgtgcagtataggaaggagcatatatatttttcttggaatagttatgttgtagacaatcggagagcattgaaaaacatgataaactttttttccttcgaaaatgtacatatccggtcagtgctcatgtacgattagtgggattaaattggaaaattggtgtttggctacataggttataaacttccgggttctttgttggtggttaaatttgttgtgaaatcacgcgtatcgcaagaataaagggtcaaaacgattatgccattggaaaatggaaaatagtttaataatgaattgattatgagctaatttttgggtcgaaaaattgaattttggacgtaaacaaacattttcaatgacatttctctccttcttccatagcgacctctatgatcaataattattaaagttttcatagaaaattgaagtgagtagcaggcttggttccagagcataaatgcaacaaaaatgaagaagaatgatgtatacaaatatacagcaatgataaaattatggttttaacattagcttatagctcactcgatatcgatttatgactgtattcagttataataaaagcttgtattgctttgatttagtattggttggtgttttaactttgaaaaatgtttattgcagttcataaactatgtttttaataaaaattggaaaaataaatgggagccaaaaaaagttacgttatatcgaggtaaaaattacgttatatcgagttacgttataaagaggttacgttatatcgaggttacgttatatcgaggttacgttatatcgaggtatgactgtatatcaaaattactatgagattcttttccataaatcagtttgaatcgtttccaagaaagtattcacaggattataagaaaatattgatcgggattttgctataatgtatagcctggtgctcaaataagttgtgcttgacaaattagattttaatgcagcaacttttcttcaagttcagttagaaaatagtttggtctgccaaatagtcaaaaaggcattgaagtggtagctttttaatcctattcaagcggattcttgttaatcctgagttagtaatctaagaaaaaatattcttcattttctcaaattattttttgagcacttccaacggatattgcagcattaaagaagttttcgtagagtctatacccaagtgaccatgctgctcaaactgcaatgtatgcatctaaacggtgtatgtaaagctagcattgctgtatatgtacaattaaagttgatttaaagtgggaaagggcccccattagagccatattgaagttatagctcataacattaaatcgacatttgtggagccctttcctactttaaatcaactttaattgtacacatacagtaatgctagctttatatacaccgtttatatgcataaattacagcttgaacagcatggttacttgggtagctgcttaaagaactcgtttcaaaatcataaccaaaaaataaataattttataagaattaaaagcaatatcaagaatcactataggggaaaagcaccaatttttggcccatctatacgattttggcatactttgtatggaaatccaaaaattggcacagaattcttgtaggtcttttctagttagtaaggtagtcgtttgaagaccttgactaaactttcgcttggttggtattttagagataatgagttaactgcattggatttattttcgggaactcatttacatttccaaatgtatttaaacggttaaagaaaacttctgtagtcagccagttttttttttgcttatcaatattatgaataattgtttaatgataagtcaaatatgttctctgaggagtcttctttactatcccagcaatctcctgagacatttccagcataaattgctaaaagcgatcatttttggttttctttctacttattactaacaaaattattaaaaaaaatccaacatctgaaaatggtacttgctttagtttctgagatatacagtattaaagtcaaaaatggatgcaaaatttacgctttcaggcgaaaaaagcctctttttcaagttcatcaaacaattaaatacgttcatataaaggttttaagctgtactattaaaataatatcactaagctgagaagcaggctctgtcccagtgggggcgtaacgccagaaagcagaagaagaagagtatccaaaacggaactcctgcagcaattcctcagcaagttcggggaaatcactaaatgaactcttgtagaaatcagaaacacactttgggcaaatacctaaataaatttatggagaaactattgaaaaaataaaatacatacagcaatacgagcagtcataattgctgtaatgccatgttgaatacgcaaaaaacatattcttagagaaatgcttagttagattctatgagggatgaaagtcgcatctcctggttcctgtaaggcagtgtttcccaaactttttcgactttcgccccctcgaggccaatattttttggaatcgcccccctgatgaatggttcatatacaatttcatatatttgaattaatctatatactgtactaaacatttgatcaatattatagaaaattatcaagtttactcgtatattactacaaaagtgttaaaaatatcaaacatatttgctttggaaaaaatatacactccacaaaatggctttaattcatcgttaattgtcagccaaattttcagagattttttaattgaaatatttgtaccataagaagtaagtatggtaagaaaaagtgcaacctaaataacaaaaaaaagggtacaacatatttttctctgtgaaaaactggatgctaacaatagaaatattaaaaaaatctttatgaaatactagtgatcctggaaaacttcgtcttgccatcaagtcataaaatttccttaacaaatttacatattagttttcttacgttttccgactattctagagattttatctaactttttcttcggacgattactttaaagtccagaacaaatgcaacagtgaaagtgtttcgaatccattgatccgttctcaagccaactcatggcatacaaaactttttcactttttaatacagattgagtattgtgggctttgtttccagtggatagtatcgtcaagcagtgatcgcatcgtgtcatggggtgtgggttcgattcccacttcagccattgacattattcgccaaaaatgtttcgcggctgtgccactggagcatgcttgtccgttgtctagtgttaagttacagtttgtgcagctaaatgtctggagacggtgtcaatgtgtgttatcaatgctctccgtatcttgaaatcattctgatcttgagaaaacctaaaattcttaaaactcatatgatatgaaaaaaatctgaatgcataacacaaatattttcttttgacaatcatcaagtgttatctagaataaattaaaatggccatgcttagatcagaggtatattcgatcaaaggtgaaactagaaatagtttagaatgaaattgattgtccttcagaagcattagcataaatttctatcaaatcgtatgtcctccgaacgttatgagtcatttttcaatctctcccatactagacttttcgccccctctactggatttttcgccccccaaattctgttttgaaaattttcgcccccttcgtcccaaaaatcgccccccagggggcgaactcgcccactttgggaatcactgctgtaaggtatcttatttttattcccatttggtccctctttggtctcttcttgagtcctatacggtctcttatttcaggcaaacattcctcaaagtttcgctcccaaagtttgctaccagccatgcatgccgactgttaagaactgacttgcattaaaaattcgatgttcaattagctgtcgcactaaacaaagtcttcttcctcttgttgcagatctgtccgttccagagtttttagccggaaggaacacaaccaaccacctgtgcattggcaaggaccatttgccggacaaaattctcagcagaatctcgaactaccacttttgcatcaccaaggatatggaggatttgaacagtcccacgttcatagaggtaagtgctatactgtcccatataaaagcgaaaatcatcatatcacgttcatgggtgttggttaatgttttgttgctccaaagattgtttccagcaaatatatatatatgaaaattgcctatgatgaagtgcaaaatattttatcaaatatcattcagtttcgttaagaatctgcaacggatctgcctcgttatgaagttccttaaagttctattatgaatcccgccatctcttgcttaatgcatttagggtttttactttaattttttttttctcaaaatggtttacctcagttttttaaggaatttatccaataattattccatatttttcttcaggaaatacttcgaatttctttcaagagtcattagtgattcctttacatattttctcaagaattatttcagaaaatcttccatgaattaccgcaagaatttttacgttattcttaaaacaatctatatgctttttcatttaggcatttttgagtttattttgctcacaacacaagaaaacaccatttcatgaatatctccagaatttttggccaagaacacagggtttgacggtgccaaagtagaaggtgcatcataataatacccgtctgtgaaacatatcaccttcccaatactttggcacgcctctaacggttcatgatttatcatgaaacggctgcattcaggcggaggatctgttaatatgtttcggcatattatcagatcctcttcgaacggagggaccgccagggctcattagttacttataaaccagtgctggttgttgatggttcaattcgtttacacgagctgtacaatcctttgtactaattagtaatggtggttaagtgtcgaagccaacgtgtgttcaattgttttataatgcaacataagaatgtgtgtttagtaaaactctgcgttacactcgtcgttatagaattagtgattgtgagggtactaatgacgatgtttgaaataatgcattgtgatgaaaatttgaaaatggcattataagtgattgtggtagttttattaaatatacaaataataactatatgaaccctactagtttaacaatggtcataatacattttgcaatgatttctctgaagataaacactatggcctagttcttcacacatgtatgataaaagtgtttataatgacagtgagtgcaaaagtgaatgaatcgaagtgatgtttttttctgtaactaccacttcagaatgcagaccaatgtggggaatggggaggaaatgatgctgcacttatactggcccactgtagaccgtggagtccgactgcatctacgccagttcatgcggaagtttatagattgagggaaaggcatggcagagaggtttgtttttgtggttagcagactgcctcaggcgtgaggaaaggcatgcgcgtggaagaatggaagcgttagggaaacggtttcacgtccgtctctggttctagagtttgctatgaacgaattgtttgagtgtaatagattaagaatggaagatagaaccaagggagacatttacaactacaaagtacgaggaaagagacgggcctggaattgaacccatgaccttctgcttatggagcagaagcggtagccattagaccaccaaccatgtctcgtagtttcgtaatttatgttgctgtagaaaaataataaaaaaattaaattgaatatcttttaattacttagtaatgataacagatggtaaatgataataacaatgaatttatatgaaaatggtgtgatgtaattttgatgaaaatttgtagttgtgatagtgaaatgtgctatacccaatggataatatatctgaagtgttttcgattttgactgatgaaggggcgcgcctgcggagagtgtaaccaccaaactcttcgaagggtttaaaaagcggaacctagttaggaatcaagttaggaatgacaactgtaaaaaaaaaaacgaatactttatcacttatcaatagtgacaaattagcacgacatgcactatactatatactgggatatactataatagatcatatattggtcgcagtggtttatgttccgaacagaaaaaaaaacatttcgattatcacttaaccctctaatacccaaccccgcctttagacggggtacactttggaattttgtgtattttttcgtagctcggaaattaaaatgattttatttttggcttaaacctgcatataagaaaagttttttatgatttttgaaacttttttgtatttttgaaaattgtttgaaaaattgtattcttatataaccttcaaatgcctgggattcatttaacgtgtattataaaaaatcgtaccctttatatttttctacgatcaacctatcacagaagaaaaacctgatggtattaaaatgatttcaaatctgtttttctgttagttacacggaaaataaaaaatgttccagaaaaaaattgaaaaaatcatattttcaaaagtatagtaaaaactctaatttttattattgtcaaaaatcagtaaccagaaaaggcttcaagaaaaaattgaaaaggatagggatgttcaaaaataaaaataataaaaatcaaaaaccaaaattcatgaatttgcgaagaaaaataaatcattggccaaaccgtgtttagaatgattttagataacgaaagattagatcgaaaacaaaaatttgggtattagagggttaagaaaatatcatagaacaacatatacagtaatggcccgattttgtcagcccccgattttatctacccccgattttagcaccctttttgacccaatgttgtctatcagcctaaaaacattatttattataatcagagtaaacacgtctatacttgcaatattggatgcataaaggcagttataatcttcgctacgtctatacaatcatctaaagaccgaaattttgaaatttgaaaattttaataattagccaataaactcaccttggattacagtacatagaaaatagaagtaaaaaaaaatgttttgtttattttaataaaatcataaaactaagtccttgagttaaaataaaacttgaaacctgtcgaaattttttcccgattttgtcaaccctaaatgcagcatagggctgacaaaatcgggacatcactgtatcgctaagagagataaattgtaattcgcacaaacttacaggatccacgccattcaatcaaactgttcaacaacttgggtgggtctagtctcataaataattgagttcacgatgttttgcttctcatttaacacatatcaaatatatgtaaacaaagtagcatacttgatttggtgcaataaaatagttgattttttcacttttgtccaaggaacgctgcactgtgcaccgaagggatggggcaagagttcgaatctagtgtgggtcaaaagttcactgaccgaagcacaaaatatcgacttttatgacagacatatttcatacccagccataaacttatgtttgtcacactcaattattatcaaaaaaaaaaaatgcccaaaacaggtttatttgtaatataccaaaagggcattttattttgtctttctacaaataagaaagttagttgcaccatttctatgaaaatatagaccacccttattttcaataatatcatacaaaggaccagggcattcaagcctaatgtaataaatatgtaaaatgtctctatcccctcattaatagaaaatcaaaactttgtcttaagaacaagcttttgatattcaaacaaattttcagaccagtcatgttgtacgctgtaccaatatggactagctgttgtaataccaggaaaaaagctctgcagagaatttatgaatcagctgacttcaaaagacaaaattattatcaaacttgtcacaaaacatcacagaattatgtttactgataagaaactatgtgtaaaaataattctgtgatgttttgtgacaagtttgatagtaattttatcttttgaaatcagctgattcataaattgttggtgattcaactgcgtggggtcactgtagatttctgcaattttaagcattgtattcgacattttcaaacaatagcactaaggataaagctaataaaacatcaaggtttgtaaatttcattgtcatttagcagacaaaaatgggtggaaaaattggtgtggagcgaaaacagttcatgtgtcagttactacaatgcagtatcacaaaaagggcattttacccttgtttccagctccaacactgctattttttgcagtaatatgtgacacattgttaactttcgccaaatcatgcaatacagatgcaacttatacaatttttaatttttatgcaatcctatgtaaatattacactcaaaacagtttactaaccgaagttccaatttgaaacgatttaattcgtgcttttgaattacaattttacgttttgcatgtcgttttattgaattttataggttggactccacactatttgatccataactgtggggtcatggtatgtttaggttaagttaggttaagtaaattgtaagcgttattttttttcttataagcaggtgaaatcaactcacctgtaaaaaatctgaactgctacggcaaatgaaatgtaatatgttgttaacaaaatgttgataaaatcttaaatttgttttaccaaattaggatgatagtgttgtctaataacacagatcagctagatataataaatgaatgtaatgtttgaaatgatactaataaaaaaataaaaaaaatcatacaaagggcctaactaatacaaacaattttgtggaaaaccgttttcgtctatttttttcattcttaagcgcaaaatgcatctttccgcgtaaaactgttttctgcacttaacactggatccgtgggcagtgattcgagaagcccaagcaaaagtattcttattttttttctcgtatcgtcggttcccttctttttccgtttgcgcgattcgggaagcccaagcaaaagaggtcgtttttttttctccgtttgcacactgcagccgtcgctgaaaaaacgtgatcgaaattgttttgaccttgaaaacatgattttagtactatagtgtcttcgggaaagtttttccataaaataatcgctattttatgaaagtgtcaatttggtgattaatccacctataagtgaattttatttttcgtatttatgaatttaaaaataaactttattcggaaaagttgtaggtaatattagaagaaacaacttcgctgaagacaccgtatgcatattttttgattttcatgtacatttgtggagttttttgtggaacacccctaaaaatcacttttttcatcataacttggttggatgattttgtacaattttcaattgttctagtgttatttgttacttgcaaaaacgcataactttctccaaaagagcatatttttatctctcatactctatacggtttatttattaaaatttgcttgactatttcaccaatttacatcgaactgcattatattaacaagattgaatagtgttacaaacttttattttgaacttttatcaatatcgatttggtattttcaaacaaactatgtatggctcgtcactttatgtgtcggcatataccttttagagatggtcgggtctcgggttttcaaacccgaaacccgacccgaacccgaacccgacgggttcgggtcgggttcgggtttgaaaatttttattttttcgggttcgggttcgggtcgggtttgaaggttaaaaaaatatcgggtgcgggtcgggttcgggcttgaaaaaagtcgggtttagccgggtttaggtcgggtttggggataattgttcacaaagtaacaaccggaaagcttccctatgcatcagaaacgatgaatttatcatcttttcgaactcgggttctattcgggtttttcttagaaaactttctcgggtttcgggtcgggttcgggtttgaacagcgaaaatttttcgggttcgggtcgggtccgggtttgcttttaaatttttgtctcgggttcgggtcgggtccgggtttgaaggaataaaataagtcgggtacgggtcgggttcgggtttgaaaaatgtgaaacccgaccatctctaatacctttattcttatttagttcaattttattataaatagcatttttttcttgtcattactaaaaatatcctttgaatagttcgacattttgaatgtcgacgtattttcttaattttctatccttacatatcttttcaccatgaggcaaaatgcaaaaatagttttaggtaaaagtcgtatttttcctccttatccatggatcgcatcactgaccaaaggtgactcctagatctgtttccttcctcactaataaacacccttcccgtggtgattgtggagatgtacaaatactgaaatctttctcaaaaagtcataaaatctgttcatgttttctatacacattacaaaataaacaatcttaatcctctaatacccaaatttttgttttcgatttaagtattatttttcgttatctaaaatcgttctaaacacgttttgggcatttatttatttttattcgcaaatattaaattttggttttgatatttataatttttatttttgaacatccctagcttttttcattttttcttgaagcctattttagttgttgatttttggcaataataaaaatttaaattgttacggtatttttaaaaataataaatttttatttttttttatcggagcgtattttattttccgtgtaactaacggaaaaacaggtttaaaatgattttaataccaccaggctcttcgtttgtgataggttaatcgtagatataaaaggtacgattttttatattacatgttaaatgaagtccaggcatttgtaggttatataagaatgcaatttttcaaacaatttctaaaaatacaaaaaagtttcaaaagtcataaaaaacttttcttatatgcgtgttatgagtcaaggtataagccaaaaataaaatcattttgattcccgagctacgaaaaaaatacacaaaattccaaagtgtaccccgtctaaaggcggggttgggtattaaagggttaacaataaaaggctcaaacggcattgatccatagcagagccaaatccttaaccctctaatacccaaatttttgttttcgatctaaatatcatttttagttatctaaaatcgttcttaacacgttttgggcaatgatttatttttattcactcttctagttactgatttttggcaacaataaaaagttttcacggtacttttaaaaataataaatttcaaatctttttctgaatatattttgttttccgtgtaattaacggaaacacaggtttggaattattttaataccaccaagcccttcttctgttataggttaatagtagaaaaatataaaaggtacgatttttttatattacacgttaaataaaccccaggcatttgtaggttatataagaatacaatttttcaaacaattttcaaaaatacaaaaaagtttcaaaagtcataaaaaacttttcacatatgcgtgttatgagtcaaggtttaagccaaaaataaatcattttgatttccgagctacgaaaaaatacacaaaattccaaagtgtaccccgtctaaaggcggggttgggtattagagggttaaagcaaaaacaaatagtgtttatcggcctcgtgaagctttttgggcgtttgggccttccaaataaattaaattgaaaaaaagtttgcaccgccagcaccatcatgaatagtaggaaaggaggttaaccagtatttagctgaaaatatcttgaataaagacagttctttgccatatgattactaacggaaaatcacaaacagacgtcacactccaatcattgtccatcgatcatctttttttaacggtagattcaaatttacggtaggtggtctattctagaaatcctttataagagagattcgcggaagctgacagttctgtcaaagtgtgagccaatcgagcagcgagagctgtcaaagtgtgagccaaacgaacatgcgttatgtttgttttgaacttttcttgaggagtaatgtaatccgcttgaaattatttcggtaaaagtaattttgcatgaagcaaaaaaatgaaatgttttactgtgttgaatttttgtcaatgcgatttttagtttttgtttttttcggctgtttattagttttgatacgtagcgcaaagatctatatcgaaacaaaatacactttatagcaatgaggaagtcatgtccgtgttacaatattattctcgacgccgagcaaaatcagcactgctggtctgttgccaaatctttccattttactttcgcttatctctctataaaggatcactagtctattcgacacgcgcagcgctcgcttggttttggttcacgtttgacgtttacacactatcgccatctgttggtccatcggctaaacacaccgattttaacattgggcgtacatgtcctcgtgactatgattttgatcgcgattacgtgtgttacttctgtttgtgtgtgggaaaatgttagcttccgaagatgattaatatctaaagtcttgcagctactgaataacgtactgacacttcaatttcaatggtcagcacactaatttttgatcttttttcaaatcctaaatacaaaatggcggcagcaataaaatatggttatttggcaaaattacaagtttcaaactacaatcgtaatttgttaaaatgaaaatcaagcatgaaaatattgacgcagttttttttttggttttaaaatatactgacttagaaacaaacaaccagactgattgattcaattcaaatgaggattgttgcttctaatcggtgggttcttagattcaacttgacaatattattctgcgtgaagaagttgaaacattcacaaagagttagtggtttgattaaaacacatgttaaatcaacgcaaataacagttttaattacaacctatttcacgtcaatgcttttcaggacaaatctcgcaacggaacgtttgtcaacggtcacctgattggaacgaacaagaaaatgatcctcaagaacgacgacatcatagcgctatcccacccgagctacaaagccttggtgttcaaagatctgactcccagtgaggccaaaggtctcccgaaggaggtcaaagacacgtactatgtgggacggaagcttggttctggcgcgtgtggagttgtccacctgatttacgacaccaaaacctgcacgccctacgccatgaagcatgtggtgaagaacctcctaggcgagtacagtaagccgaaaattctgaacgatccccagcgggtgatgaacgaagtcaacatcatgaaaagtctggaacacgtgagtatttgattgcttgggaaacttgcattggtatggtatgtaataacggctgtcctcattttagccatgtgtaataaaaatgcacgacatcgtcaacaaagcagattccgtgttcatggtgctcgagtacatgaagggcggcgatctgctgaatcgcatcatccaaaacaagtacctgccggagcagaatgccaaactgttcttcctacagatgtgccacgcagtaaagtatttgcacgccaaaggtaagatatttttatgggatcgaattcgttacgtagagcacggaagatgaacgcaggtagacggttgctagaaattatgcaaatgaggccaagttttgctgttaatgtaagtcagtttagttgtttctagtttttgtcaacatctttgatgtatcgtttcttggtagagagaggtggcgaatcatttgtcgcggagttcacgatggcttttggcactgatgtgtgctttcaattaaaaaacctttgaatgctattttatgatttcgtcatttacttagttactgttattgttacttgttactgttcggtgagaacatgagagctgtaaatttgacctagatacactgtttagccgtttgaaaccttttaattctattcttcttcgtatttctaaattcaagtggcttctctttcaaaagtagggagacgaggcaagatggtcacccgaggcaagattagcacactcagttttgagactatttgaatgaattttattaaaataatgtcatacacttttgaattaaagttcatccaactgcctaaaattattaaacataataagaatttgaaaatatgggtaaattatcataatttgtgaaaatattgaattttcttataacaaatggtcagaacacaatacgatttttgtcgtctaaaaatattttgaccaaatttctgattctcagccaacatgtcaaaccttttgaagagtcttttagtatataaagaaaaaaataataaaatttttgttacattgctttacttggtttaaattatttttataaatcggggcaagatgagcactagggcagttcaaatttaaaaaaaagtttaaaaatacgatctcccatatcttctttaccatctttaccataaacaaaagtgttctgtaaaattggtggtgatttaaaggtggcccaaagacgatttaagtttatatggtttatatggagattactatggagaaattttgaaaaatgttccaaacacgttggcattataatgtaagtacgaagttatcaccccatagtgaaaaatcattattcgttactttcatattttctggtaatgcagccttcaacaaactaattataatctattggaccattaaacacccctttggttgcaattatagcacagataataaaaaaaatccgcttctgtttcttgatcagaatgagagtgggtcatgcgaatgttaaaagtgttgacacatagtaatcggcgccaaaaagtgtcaattttgtctgaatatttgaaattttaagctttcattccatacaaaaagattggaaatcggttaggctgttcaaaagttataattttttttaaacattacaaatctaatgcgctgagacctacagtgtgtgccgataaaaaatgaatgattttttattttcaaaaaaatatatctcaaaaactaaaaaacatacatcgccgaaaatttgacagtatacgtaaaattttctgaactttcaagaaaaaagaacagcgatagcccctttggtcccgaggccttcaaaacacgaaaaaacggaaactattgagttttttcatgtaaaaaacacaatttttgtgaaattttatatttttcctgaaaagtatactaaacgtctatcatgtttcacggtttttaactgaaagctttataatctgtcaaatttttcattttaagattcgaatttatatcgtatgaatagggtgacttctgtcaagggtggaaccgcaaggggtcgtaatgttatttgggttatttgttaataacaacttgtttgtcacattaagccgttcggcataaccaatcaaatggtcaagtgatatttgacaaaatacttaatttcaattacaataatgaccatttagcatgccctggccacgatcacagggtttgacggtgccaaagtagaaggtgcaccataataatacccgtctgtgaaacatatcaccttcccaatactttggcacacctccaacggttcatgatttatcatgaaacggctgcattcaggtggaggatctgttaatatgtttcggcatattatcaggtcctcttcgaacggagggaccgccagggctcattagttacttataaaccagtgctggttgtttgatgtttcaattcgtttacacgagctgtggcatcctttgaactaatcagcaatggtggttaagtttcgaagccaacgtgtgatcaatcgttttataatgcaacataagaatgggtgtttggtggaactgtgcgttacactcgtcgttattaaatttagtgattgtgaaggtgctaatagtgattttataattaaatctatagtgatgaaaatttgaaaattaagtggaagtgattctgatagttttgttaaaattataataataatgatgtgaactctactaatttaataatggtcataatacattgtgcaatcattttttctccctgcccttaggtgatgggattgacggtgatttatcaagtgattgcatattgttgatattgtgaaaaattactctaatactaatatattgatcgcgaaaataatcgaaattataacttataaaatgtaagctagtctaatagttttaaattaaataatgacatgtgtttcaatgcttaaatatattttacacttgatttatcacaccttcagcatgagtttagttactgtcgcatgatctaacaccagataactacgcgtaatgctggagggaccggcagggctcattaccagtctctactaacactcaaatcactaacaagactgggaaaccaacgatcaccttcatcagtagcactatttctaatagtagtattagttcaatatacataaatctttttcagtagaccacgaggcgcaagagtgggtgcgggtggtctctgcgtctcacaggtcattgaaaatagacatttatgttaggtttactaacaatgtagtaattattaccttagtaataccgtaaggtgccgtaattcgcctaaatccgcatattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcatttacgtcttgcgtttttagtaatgtaggttgtagcggtgtagagatagtttagtaatgttactgatatatgtatataatagaaaactgatggcactgttgttactgaaatgtttcattttgaaatatctttcataatataatataatattgttgaacaaaatgctgtaattaataacttatttaatcctctacgcatttttgcactactttgcatctatcacaccaacactggcgacaatagcgttctttgggtagtatttctgttatgtagtagtaacctctatcgtttttattctaacgatcataacataattatcgtgagcgtagtagtggaaataacatagaagtagcttttgtatttgtaattaaggtatcatggtattagttccctgtcctttggttcagaaaggggtatgggcgcgttctgccaactcggtcgaggcagatttcttgtgtgaacaagttacaacatggacgttctaaaattccagaatgaagtgttgtgcatttgaagatgggatggattcgcgttcgtgctttacttctgcttatctataaagttatatgcaataaccgacccttagcttaactatttaaattaacagttgcaaatataataatcgttttgagtttactaacatctcgtcgcgttaattttatcataatgatcttttatcgaaccattctgaatggccgttgtgagaatatcaccaagaacttctcacatgcaataaagctggattgtcatacattgaaacatcaaggttctcgctcttttggattcattttttcattagtttcagggattgtttcgtgggaatccaaagagcgaattttgtatgacttcaatgtacgccaatactgccagaaagcatgtaataatcactaacattccttctctctttatccttgttttcatatctaacccgcttcgaggaataattcatcgaagaggaaaggcatctcttatcatggcagcgtaatggccgagaaaacgtcggtttgcggtcgcatctctccatcctcggttctgcccacgttcaccaaatcgatacgcacttgatccgcccatctagcttgctgcactccacgcctttgttaagtataaagtttctgtaatcattgaatactaattgaaaggtaaatcaaatgaacttattatttaactaataacaaatttgttccacagagctttaatgtttcacttggtgtttgtagattcactcttagttttaactttcgggatataaagggaaaacgaaactacgtgtggtttctaccagatcacagaatcttctgctgctggatatattttcgattcgttcttagcctactcaaaaatcgatcggcttttcggccgtataacgacaggggttggatcattttaccgaacgcgctagattagatttgtacgcggtacgctacagtccttccttctcaagaaccttgctatatctaattcttcttaaaatataatttgaacttaggtttaaatagtacaattcagatcgtatttcaataaaattcattaatttaaatcgaatgcactacgcgcaaatttttcctcaaaaccagaccggtcaaactttatctttcatttctcgagcgcgactcctggtcatcatcaggctaccgctcgttttctgacgtcttgctctcttaggaatcggttcactcaatacgtccggaaaccctaggaatggttcttcctcggcatcggatccggcacaaccttggtactcgtctgactccgcgcgcccgcgcttccgattcatttccggaagtagcaacttggatctcgcctctatccaccgttgaggatcagttttcttgtaatttttatagtaaattatatctccttccactaatttatcaaaaggatccggtttaggaggagttattacaggaatgtccacgggaacaggttcttttaaaaattgtttgtaacccttttttggatttatcaaatcaagtagtatttttggtttgtacgataaaactttgtgtgacggtgggactccttctttgctagcaatttgattacgatagttaatgagaaaaaaattgattttagaagttaaatctaaatctcgtaactgaggatccaacaggtactttttgaacacatcttttactaccctgactaaacgttcagcttggccgttgctgcttggattatatggagggcttttcattactctcactccatgtttttctaagaacgctacaaactcctttgaattgaaaggcggacctccatccgttaccatcacatcaggaagcccatacctggcaaaaactgtgatgagagagtttatcacacgttttgcttctgttccatgtaacatgacctctacctccacccactttgagtgactatcaacgatgagcagaaatgttttacgttcaaaatagaagaaatctgcatgtaacctactaaaaggccgcgatgttggtatccaattactatgaggaggtttggcaggtaccgtgcccattttgatacaggcttcacatctttttacaaaattttcgatgtctaaattaatacctgaccaaaaaactttttgacgtgctaattgtttcatcttaacgatgccgatatggtttgcatgtaatagtttaaggacatctgcctgtaggactgcaggtataataactctgtcttgatagagaaggcacttctggaccacctcaagatccgttctaattgaatacaagtccttaagcgaacgttgaacattattaggccactcactttctacaaattgcaacacctctgccaagcaagagtctttttcagtttctctagcaatcaaattgtaatccaacggaaacacatccgaaaagttcaagctattgatattacctatatcaagactcttgggaatatactgctccagtggaaaacgcgagcaaaaatcagcgtttcccatgtttgttgatgctctgtatgcaatttcgaaatcataaatggataattccattgtatatctctggagtctagttacatataacgaattgttaccggatttgccgaaaattcctaccaaaggtttgtggtcagtataaaccttaaacttttggccaaaaagaaatttgtggaatttcttcacggtacaaactaacgccaatgcttctaaatgaaggattgggtatcgtttttgtgcagaattcagcgaaaacgatgtaaaacatatgggtttttctaatccattgatttcatgggctagaacaccacccaatccgtatgaactagcatccgagacaactattagaggtttcttaggatcgtagaattccagcaaatcagccttcaacagagcttccttgctgaactggaaagcttcttcacaatcatttgtccattcaaaaattgcatcgtttgctagcagggcgtacaaactccttagtttggaagacagattgggaacgaacttattgtaaaaattaatcaaaccaagaaatgctctaagttctgttacgtttgtcggcgctttagcttgacttatcgtcgaaactttttcaggagatggcgatagtcccttgtcagtaatgagatgtcctaaataaggcaattgtgaaacaaaaaacttacacttcttgaagtttactttaatattagcatttgaaagtcgtacaagaaccgaatccaatatttcaacacatttttcaaatgtttcagctgcaataaggacatcatctaagtatacactaacaccctctagcccatgtaggacctggtccataatttgttgaaaaattgccgcagaacttgaagctccttgcggaagtcggttgtaggtgaataatcctttcatggtgttgattacagtgaactttttggaccgcttagacagaggaacctgcgtgtacgcccccgctaaatcaagacaacagaataccctacagcctgctagtgatgcaaaaatgtcctgtgctagtggtagtggataagtatttggaactattgctttattgattgatgctttgcaatctattaccaatcgtatatcttgatcttttttaactaccactatcacaggcgatgcccactcactagcctttatgggtgtgattaccttctgctgctccagcatttccaaatgttccgctagtttatcctttagcttgtagggtaccgtatacgccttcttgaaaatgggctgctcgtttttcaggatcagttccccctcatagcctacgataggttctgaaaaatctttatcaaaaattttcttgtacttttgtttcatactgtcaacaatgtcgtcaatacctttctgctcatttagattattcaccaaagtagtattcgtaaatccagatcgccatccagggaagaaacagtcaagccatgatcttccaatcaaaggaacaaaactgttattgcatttaagcactactaactttagttgtgcaatcaagccattcaactctacttgcacagaaatttcgcctaaaatcctcagccgcgcaccatcaacaacaataagctgtctattggtgttacgcatcggaattgccttgaaaaatttcctacaatcggcctcactgatcacagaaacagctgatcctgaatcaatttccattttcagccaacagttttgcacctttgcttcaatcatgcatggttcatttagtttgttaatcgcagaaatcattaaacactccattccatctgtttcttcgtctgaattatcatgtccacctgaccgcttgaaatcgtagctcgtgtctttttcacccttttcaacatgatgcactgagtttcgatttttcaagctataacagtctcttctcaaatgacctcgttttttgcagtaattacatatcgcattagcatatgcaccacgatttctagcttcagacggtgatctaccacgaaagctaacacgcctatcgtaccgattcacgttcctgcctctgtatgacctgtctaatctgtcacgtccatagtctcgactactttcaccaaccttttgacctaatctactcttcactgaatgcacttcatctcttcttgtatcgctacacatcgctttagtttgtctgttggctacctcactgctaagcaatttcttttctattgcgtccagtgtcagtgtctccgacattagcaaagacttttgcagctcccgatcatgaagtcccattatcaaacgatccctgattgcagtttctttaaactgctgaaaattgcacaattctgcctgaagcttcaccgacaaaatgaaactttcagctgattcatctgctttttgaaaacgattataaaaatagaaccgttgcatcatgtcgggatctaccttgtcaaacctttccttcaactttttcaccatatcagcgtaattcaatgttgctaattcaacagtgggaaatataagtttcagctcatcatacacaaccgggccggttagagcaatcagcaccgatttcttgttttcttccgtccaattattgaaagaactaagatgctccaaacgttccatataatttgtgaaggacgtacccttcacataatggtctaacgttccaaacgaaggcatggtgcaatagcaacaatcagcagaaatagaaaaaaaaatccacttacttgatgcactttttctcaccactggtgcaactgttgataacactgttgtttacgtctgtatgagacacagtcagttgagtcttctcactactcacaaccgctcacaaccagagaactctcaccagtcagcacagtgacaagttctcccaatgcgacagtactccctctctctcgcaaagtgctctaccacacgatcgctcacacgctcaccactcttgctcgtcgttagtgagtgggtcggtagaatgggtggcacgccgactttctgattgctgatgctgaggcaaacaatggttccgcggtagaacaaaaatgaccaaatcggtgggagcggggtggagtactgtgaataatggagaaataaaatggtgaaaagttgcacaaaatgaaatttttggtttcacaatataaatacgctattacaaatgcttgagacacatgaatttacacgccgaacgaagcgctaaatgttttgttcctcaacaatggctctgacttgaacaaggcgttttgacctcttcaaaactgacacaagcacactgtcttcgcacaagttttctagagcttaccaccctctgcaaaaactctgccttctacttacacggctcactctggaatttccttgctacaggagttattccgtatgaggcacaatatcactgtttttcctcgtcgccagctttaatgtttcacttggtgtttgtagattcactcttagttttaactttcgggatataaagggaaaacgaaactacgtgtggtttctaccagatcacagaatcttctgctgctggatatattttcgattcgttcttagcctactcaaaaatcgatcggcttttcggccgtataacgacaggggttggatcattttaccgaacgcgctagattagatttgtacgcggtacgctacaagagcgatttacaaaacaccacacaaaatccctcctttcacatatccttaggcaaaacacttcactaccgttatatgtatgactgattcatgttctttcgaccttgcatcattcatacgtgtaggggaagtctagagtaaaagcaaaacttaaagaaccttctggtcaaagatgttgcgttgcctacttcccaaactccaaaacccccggtgtattatggaaggtgtgagtttttaaacttatgctggagacttggcccctgacccccttgtacatcaataaaataaaataaaataaaataatacattgtgcaatcattttttctgaatataaacttaattgcctagttctttaaacgtgcatgataaaagtgttaatgacagcgagtgcaaaagaatggattgaagtgattttgtttaatgtaactttcttgatcatagtgctaaatcgtagtttgaatagtaatgactctgcagcaacaaaaataatgatacatttaaattgaatatcttttaattacttagtaatgctaacagatggtaatgctaacagatttatatgaaaatggtgtgatgtgaaaagtgatataatagaaagtatatctgaagtgtattacgaaagttgatgagtgataatcggtgatatacgtgatagtgtcaaaaataaaagtgacgatagtgagtgatgaaatgaaatggggaatgaggaccttttgataaaactatttcgttcttcactttaaccactctagtagcatttcaggccttatcatagtttgatagtagtctgaactactagactgcaaaactacggcaagggctgattgctgctagcgtacacagtgaccatttgagcaacattgcttaggaacgtctgtgtgatgaacgcaatagaggcttataaaagcaaatgctgggaaggagcttagggcagattaagagtgccagtactacccctatcgctaccgacaaaaaaaaaaaaaaaaaaaaaaaaaaatgaccatttagcataacataaaatacaacttatagaaagaaggaacatgactactgccagctcttctacaactgccgcataggtgtcgtccattaattacgaaagggtttaaggggagaggggggaatttatatttcttacgcgctatacaaattatttctatttttcatacaaaaaatcttaccatggggagagtggggatcaaaaaatcatcaaaattatcttacgttattaatggacagacccatatgacacagttatgtgaccaacggcagttgcacaaacaaacttataccaagtagccaatcagtgtttaatatggtttggttatgccaaatggccagtacgccaatcattgtgctggtatctcagaccattgtcactgaactaaccttgaactcttttccagatatcacccaccgggatttaaaaccggacaacatcctgctgcaaaacgacgacgaagaaaccttgttgaaggtttccgactttggtttgagcaaatttgtgcagaaagactcggtactgcgaaccctatgtggcactccactgtacgttgccccagaagtgctccttactggtggtcgaggctcctacacacgaaaagtggacatttggagtttgggagtggtcctatacactatgctcagcggaacattacccttctcggatgaatacgggagccctgccaccgagcaaatcaaacgtggcaagttctccttccgacatcgttcctggaagtcggtttcccctcaggccaagaagctcatctacgagatcctaaccatcgacccgaatactcgaccatcaatcgacgacatcctcaacagctcatggatgcgcgatccggaagtcattcggaaggcggaaaagctgatgaatgtgcggcttaccggtaccaaaaaggcatccacatctgacatagagaacaacaacgacaagatctttgtggaaccgcccaaaaagcgacagcgcaccaaatgactagattcaggagaaagaccacccaatgaggcaactgcaaatgtcgacgaggaagagacaccggttcgtatacagtttaggaaatgggtgaagctgaaagtgaggtttcgttaaaatcccctgcaatcgacgtcatcagcaatgagaaaaaaacagtaagtagcaagtgggcagcgaacaacattgataaggatttttttgattgatacttattcggaactgataatgtagccttttacgttcccttgccgacaggcgactcggatcaagtacgatgctctctctcgtttgttatatatttcataaacgcattttgtatagcatttaaacatgttttcgtttcgatcggtagttgctagtggaagttaaactttgctcagtggctcggcctttgatgcgagtcatgaatgagctggccaagtgcatttcccaacgagaaactgttgttggtactagtattttaatgcatggtaaggaaaacgtttaacattcattgagtttgcatagacgtagacactattttaaacatgtaaatattcaaaataagtgcactacatgtcctagaaaacgtcagcttctaaaaaacatgacatagaattaatcaatccaaaccaagagcggaaacatgtttaacagatgctcccctgactactccataattccttttctaccatcataaaccatcgttctttaaacttcatgctatgttctttttttgtaagcgctacaaatcgtaatggaataaatatctttcagtttgtattgaacattatccaaaaataatttgcaagaacaccccgaagagttcgcatgtaatgagcacacaaacatacgtaaaacagggttcattaaattaagtacaaacttattacttattaccgagcaaagtgaagttgactaaaacccatgccataatgtgcctaaagtgcaaaatttccaatataaaccatcgcgtggtcgctctgagtattaaatgcttagataagagaaaggaatctaggtgtatagttgttgtagttttacttacgttttgaggaaggaaaataaagtacattttttgttttatcttaaacatagtattttgtgctattgatgctcacgatgacagccatgttaatgtagctttgattttatagacccaatattttttccccctgattcagtcagatattctgaatacaattcagaataagaggtgtaagaagcaacaatgaaaacgttgtaatgttgtctattgactttaacaaacatgactgaactgtagaaaatttaattgacaaaaataaaatgttcatcgtttacatgttattatttattgggactccttaaccaatggtaaagttattataaaatataaatctaactgatagtattgtaatcttcttcttcttggtactaacgtccccactgggacagagccggcttctcagcttagtgttcctatgagaacttccacagttattaaccgagagagctttctttgccagagttgccattttcgcattcgtatatcctgtggcaagtacgattatactctatgctcagggaattcaagaaaatttccataacgaaaagattctagaccgaccgggaatcaaacccagacaccttcagcatggctgtgctttgtagccgcggactctaaccactcggctaaggaaagcccctc

SEQ ID NO: 92 - DNA, 3133 bp, Aedes aegypti
ccctccttctgttgttacataggacacatagacgaggggggggggggtgacggcgtggcattgaataaaatcaaattgttgttgttcgtgagagactttaacccgaaggtcattcgtctcttcttcaaatgaataaaaacaaagcacagctggtgcctgcgattatcacaccgcaacaaaatgagcagttcaacttgaatgttgaagcagttcaacgcacgtggatacaaaatgaaatgaagcatgattgttgtgtgctcaaatcaaaataaccggtgttactataactgaaacaaaatgacagaaatgaatgtccaatgtaacaattgttgaaacagaacgacctatgtgatttatcctatgtacatatttttggtcaaaacgtcctatctgatgtttttatagatttcagtgtaatttccaaataaattgacaaaatttcatttcatacgttgaactctattacactgcttccctctacaagcaacacagtggggaaaaattgtttcattttgatacagtttcaatatatatttttacaaccttcatgctcgatttactcgaaatgtgtgaattgttagattggccgttttgaaaagttacgcgagaattgtcggcgctatccgtcaaattcgctcaccaaagccattttagtggatttaccatcacagctaggattgatcgattattggtgcgttgctgaaggaactgagcacccctaaatacgtcaaaaacttgtaaacgtaaacaaatggaatcgtcatcggcagatctcgactagaatttgcacaatttttttttgtaaatctctcctacccaaattaaccgggatggacgttctggatacctattataacaaggaagaatacgttgaaacggcttccggcaacaaggtcagcaggcagacaattttgtgcggttcacagaacatagttctccatggcaaagtgatagtgcagagtggggccatcatccggggcgatttggccgccgtgcgaactggccgatattgtgttatctcgaagggttccgttgtccgaccgccctataagcagttcagcaagggagtggcctttttcccgctacaaatcggcgaccatgtgttcatcggagaaggagcgattgtgtcagcggcttcaatcggttcctatgtctacattggcaaaaatgctgtggtcgtaagttttattgtaacgtttctcctattatatggctagtaggtctctattgtaattcaagtgttcatttttaacagaaggtctcaaaattcacattttcctttatcctgctgccaaattctaaaaggtccagagaaatccccacgtactattgatgtgtatcgtagattcctacttcagaaaagcttctagtgatttttacaaagatttcttctggcatactttagggatcgctccagagatccctttagtaagtggtctcgtgggatctttgcactatgtcctccaaattcttccagtgatattttgatgaaaatcctagtgcactcccaacacttatacttacatcctgtaatttccacatgacaaactgatatttttttacagaaactattttagaaattgctccaaattttgtatgattcattctctcattgattttttcagctgttactataggggataatccaaagattttcacaatatttcgtccaacaaaattcaattataattattccagactttttggagaaattttctaacggatttttccaggaaaatcagcaagaatttctccagttgtcctctcatgaatttttatatgggctccttcaaaaaatcatcttcatttactctcaagaattgctttgccgttcgaggatctgttttgagtcgaaaaaaatcttgatttccatagcataaagtatattcttgcttgccacacgatagttcgacaattgtaagatttcagaatgtcaaacagatttcttaccatttcattcgataggacgcaatgataagaaatacaaaaagcttacgatgaaaatacaatacttagtaaattgcttacttaactgcgatgtcagaatatgtctagccagaatttatagaaaaatcttataaaattttgaatttcctcattcctgctaagattttttttgggtcctgtaaggtttctttttagttcttacatatatttaaagcgatcagtcgttaccagccctgcttagaatatgaatcttctaaccatctgttatcgcttccagggacgtaggtgcgtcttgaaagacaactgcatcatcgaagatggtgcaattcttcctcccgagactacggttgcaagctacatgagatatacagttgatggcagaatagaaggcggacagggcaatccggactttgttccgcacgctatgcaggacctgatggtggaatataccaagtcttactacgagcactttattccggcaagtggagcttaaaatgtcgtctgcccgtcccttagatctattacaatatattccttatttattatgtttctcgtcattgcttgaataaaacattaacacatcatatcttgtacaattttattacgggttggtattcatagagtacattaaatataaaaaccgaagaatttagatgatcatcgcggatggcgaaaattagtcgaaggaaaaggtagagaatcttaggtgataggctttacttgttcagtatccggcaatattatttcttccccgactttttgattcctccggtaaccagcggaccgcctttagctgccttctgtttcgcagcttccatcgctttctgctgttctttctgtttctgcttgaaggccatgtcttcttcgtccatctctttgccgtccttctttggctgtttcagtggcttctttttgcctccttcgcgacccgtcatttttcgttactggaagtcagttgttaagttagctattaatgtcctgcaagagtattcattaatcttaccttaaatttgctgaaatagaatattcacaatgtggaatcgagagaatttagtgctttttagatgctcaagacgagatgactgtgaccgtgactagggttgtcgcaaattaatcgattatttcgattaatcgattaatcgactcactaatcgattaatttttcatcgatagctgactcacttaa

SEQ ID NO: 93 - DNA, 51326 bp, Aedes aegypti
  misc_feature (24392)..(24491): n is a, c, g, or t
tgatgcacctcaatatgacgcatattgtggccaaatatgagcttcgtagctttcgaaaaaccccactgccgaagtgaatcaaaagaaccaagaataggatccggctccctatttcgactgaaataaattgagttcaatctgttcattcatgcaaccgttactacacaacacataaaaattgaagccgtttttcgaatataaaccaaatctttttacaaatttctggactaaaagcttaaaattcctttgggttttcattggtaatcgatcgattagactatgtgcaagcatattaaataagcagtatcttgggctttgtctcaaattgaatgtaaatgtattggggtgtccaaaacaataaaaaaatgctcaacagctgaattgttttcacatgacacatgaccatgtgaacatttttatctggtagaggaagttttcatcaacattttgacatgctcgtagatttagtgacgctgtgaaatcaataaattgggacaaaacccaaaaatcacttcctcaaagggtccaaaatacgactgttaccctatttctgcagtttaactcatttatccccatttttattttatttacagattcacaatgctaccaagatcgtttcattcgatcctcctagcttgcttactactagcacctgcgcttagtatagaaggtgccaagcgacgatcccgacttgatctcccgatctcgaaaccagcggatgccccgctagaggacaacattgccaccgcatcgggttcggaccccacatacgaacgggcggatccggtggccgttgttgctacgaatgccgctccgacggcaacttccaccgagaccgaagccggagccaacagttccggcagtggaagttcggaaaacagctcgcagatgattgacgagtacactgacgaggattgtgatccagattttgtggcgtttgagctggtgacggggtaagtcgatctttactgctatgtattttaataacaagtttgttattgcaattgaagagattcccctgtcattattgctgaaaccttgccaccatgcttaaggtagcaaggtagatagccctattcttcaatcaactcgaggaaacaaccatcgattgaaagcttgttacttttttgtccaaaaacgaacaaatctaagttaaaattgcgaaaagaaacaacgtcctccggtgaggttcgaacccacgaaccccctattcactagaatgacgcttcgacctacaggctggaatagaaaactaggaaatttaaatgtgcaatgtttgcattgattgcattcgccatagaaggggggtttgtaatttctcatgtaccctatcaatttatgtttggcttaccaagggacgagggaggcttaaaaatcatcaaaatagtctatcaaaattaatgaacagccctctatacgttaatcgtagagcactttttttgatcaattggttctgaagcgctgttcaaattcaagaaaaaatattgtgtggcaggcaattttttcacggcaattaagccgtgcgttaaaatcaatgaaaataagagattggaagtctatgcttgcttctgtgatagtcctctagatagtcatagtcttctagatagttcatagtctagattctatgagatttgtgctcaggattccgccagaatccagctcaggaatcttttaaaaactctgcccagaaacctgtaagtatgttgttcagaatccttaatgagattataacaaagggtcaagaaagtttctgacagaattcttaaaaagatttttataagaatttcgtcaaaaaaaaatgttaaaatttatataaataggtcagaatttgttatacgattgaatcaaaaactcatctactattatttagaaaatcttgcacaggcctaggctagcgttttctagcgttcccagattctgcgaaaatcctgcgtagaattcagttgaaattgtcgttaagacagtcgttcagacagaacctcatcaagactaattttaaaatcgttttctgtaatctggaaaagtctgtcctgctcaaaattttgcaaaaaaaaaaacactaggaattttgtgaaaacctttctcaagatcaggcttgataatacccctgaacatcatcagagtacggtaacatactctaaagcagcatgctgcctttgcctctttgcgagggggtgaaaaaatgctaagcagagaggcaacgaaaaatgagcgaggaagatgcagcacaaaacgcaacagaaacaaattccatcaaaaaggtgtgccatcacaactccccgaggactgtcttgttcgggcagcacactcaagccgtgttgccaaccttccagatttgtctgaaatattccagatttttgaggctccatttttcaaaattctggaagatccagatatttttttaatgaatttgtaaagttttgtaaataacttgtaaggttctctatttacgacataggagatccagacctttccagacaagttttcaaaatatttctaatttatggaaaaaaaaaacacttggcatccctgcactcaagagtttttttttttttttttttttgatgtttgaataaaggtgagcatcgcaacaagaaagagagagagtacctgaaaaaatcctcgacttgttttgcaccctcactcgaattgcttgaggatctgtgttgaaaattttgagttcagtttttactcctcataaaaacggcaaaatcacctcatctttgcatcgtagaggagttgtttctatcaagcctggtcaagataaagtcccagattcggtgatggctagggttttgcataatcttactaagtattgtgtgacaaacttgcccaacattttgtggtgatgttccatatgttccgtgaaatttatgtaagaatcctgtctaaaattgtattattctgcttcaaaatctgcctatcactggttataatcttacacaggtatatcatttatgcaccgaagtctgtgagaatctacccttttattcagtgacattgtaaccaatttttgaattcgaatatgattgaaaaataatgcaaatcttcaaaataacgtcattctaccaagcatttaaaacacgtgaaccatattgtgattaatgtagagtaattgtcagaaaactattaaaacacttccttcaaatagctcattgctcactggaatgtgttccaaatgagctgtatatacttgaattgttctcaataaacgaaaagacgaggaggttttgtgcctgttggaggaagcagctttaaaaaagttcacctccaatgggtttttctctgctccaccttaaaaaaaaaaaaaaaaaaaacaaaacaaaacaaaatttcaaactgaataatatagagttgtaaccttgggttgttacagcacaaaatgaatgtttaaatttcacttcattggataaatactattgctcatctaatctatctctacaagatattttatttataccggaaaaaaattcagaaaaatgaaaatatttggtaggtttttgtacaggaaattccaaagctatctctgttgaaagtcctcgaaaaaaaacttgatgaactcctatataagggaactcattaaatgatccccgtcaaacttctggacacttgagaaagtcttcagggattttctagattaattgctgggattactaggaaaaatggcgtaggaaaatgtagaaatattgtaatgaatgcagtggttagaacacacgcctctcacgccgaggacctgacatcgaatcccatccccgaaatggtcacttatgatgttgaagttatagtgacaacttctttcggaatgtaattcgcgtccgcgaacgcgatgcgatcaaaggatttcctgttgttgatattctgctttgcgggctcgcacacgcgcacgcatcgctcgacgcgtttactatggcagcgccctaaggcggaagatggacgggatcattccacggaagattgcgtagtgcaaacctaatgaatctcctttgtacacgttcaattttgagaaccagcgtagaataataaggacaccatacgggagcagcgtattcaagtatactacgtactagtgagcagtagagaaaatttcagtgaataaatgtctgtgaaatctgcagcatgccgacgaataaatccaagagcggaaaaggctttggccacggtaacccctatgtgttcgttgaattttagcttttcgtcgatgataacgcccaagtcgcagatagacgtcaccctttgcagaagaaccgaatcgattgagtattcaaaaacggttttgtcactgcatctactgaaggaaataaccttacacttggtaccctttgacgcgcattccgttatcaccgcaccatatcagcagcgtattaacatcctcttgaataataggataataggaaaaagaataataggattatttgaaaaaaatcttcgcacctaaaactatatgaaaaattacggaatgttttgaatcgtaaaaaaaaatctgtagcactctattgaaaaaaaaatgcaaggatctacagcagagtattgaaaataaagcctatatacagttgtggtaaaaagtttagcgccaggtggtatcgctcaaaataatagtagttgttctttcatatatttttgttcagtaacaattttgtaaaaaaataacttgtttaatcatttatagcttgagtggaaatttctaaataaaatcaaaaacttaaaacacaccagatatttaaattattaaaactactattattttgagcgatgtcacatggtgctaattttttaaaccagtagtgtgaaaaatttcatgttttggcattataaaattgagtatattagtggttccctgccaaaatttcgtacagattgctcatacagaaacaaaattacagcatgtcaaatttgagcattttttatgaaaatcggcttactactattattctgaacacaactgtataatgctagagaccctatagatactatcctagagtagatacaataccagaatcacataacaagattattacacattattaacaacacctgtcattaataacagaagttgatatatattattttgtagtcaagcttgcgttgttcccaactcgttacatttttgtaacagatttataacaaaattggttatatttttgacattgcattgtattgtttattgtaaattacattcaaagttatgagcagtatatacttacagtacatgttttataacaactatcagaaaaaaagaaaactagataggtgtacaagtgtacaaacaaaaaaatccactcagttttcgatgagcgttgaaagttttagtatctgtttttctttcactcagacctgtacaggttaggagttgtgtttgatccttcgaccttgactcttgctcctgcggggggtgggcgatgagggcaggatcaaacatgtcgcgcgttgttcgcgtagtgaaatgaaaaagcaccgcagatcgttagtaatgtttgatctaaagatcgcgtcgcttgctcctgcgtgggcgagtgaagaacacttgttcggcgatgcgataataaaattatttcgcgattccgattaggcgtaattatatcatggatcacatcaccaactattggtgactctaagatctttaccttatcccaatatcctttttttatttatttattttccatgacaactgtggagatgcagaggtatactcggtctctagtaacaacggttgtctaactaatattccttcccttacccgaactgtaaggacgtggccggcgccgttattgacttttgaaatgtgagctcttgatttgtgcacattgaagaatggtaagctaatcgcaagccccattcattaattccctgtgcaacttcgattgttttggtcaatcacggagtagcaactacgaattgaacggtcatctatgctcatgctcatgctcactcagacctatacaagctataattattatatccaataaactattcatttttctcttatatttacattgcagatacgtattctcggcaccgaacaaactgcttgactccattcccggaactctgatgttgaccgactgtctggaagcttgtcaaaacaatgattcatgttcctccgtcaactacgaaactggactctgtgtgctgttctcgtccaattctgacaaattgccaggtaattttcttctctactgctccttttgataataatgtccataagaagtaaaagtccaatcatcaatcagtccagccaccagagtgtaagaagttccatttaaagcagcgtcagtactgaccactactgctgctacttttcattggcgttacaaaaaatgaaaagcccgacctatttcaaaagaactaacacccataacctaacacgtttctatcaaagccacaagtaggagaatctacttcattatcattgttcaatcatcgttatttcctgcaaatgtttgacgattcgttcaacttcagcatcgaccacagtcgaacatggctaggtgattgatttacattttatgcgattcgattagccctattttttaatacgagtaacgaagtgttcccttcaacataaagtattagacaattgatcgcaccatccattggaagccgtcctgctgtgtggggtcttcggttttcttaggttgtcgccgccacaccgtgcaagtcaaaggcgaatgttagaaatcgataatgagaatgaatgatgtcaagtgacagggttaaagatttagtttttttctctttcaactttgttcatttaatcgtcggtcgccggattgtctgctttagggaatgaagtcaatcctattgattttatagcttttttctcaaagaaagtaggaaaaacaagaatagcaataagttttaaagtaaactctgtctatgccaatgcattgcaaaataattaggaatacatcaaacgaactttcgaaagtaaaatgttcctttcaagtcttgtgccagcttatcctcattaaacagcattaaaatacatctaatcaaacgattactacttgttcaactgggtcaaatattacatactggctgtaaaggtgacattatgccaaaaaagtgattatcgacagatccgacaattttaaattaaactatatgcaacagattatgaaatgcaatgttcaaatgccataaaataagcctgcttctctgcttagtgttcttatgagcactttcacatttgttaacagagagctttttttgccaacgttgccattttcgcatgtggcaggtacgattatactctatacccagggaagtcaaggaaatttccattacgaaaagatcctggatcaaccgggaatcgaatccagacaccttcagcatggttgtgcttcgtagccgcggactctaaccactcggctaaggaaggccctatttaacttaatttttggaatagtcaagacctgtccagatgtttgaagtagttgttcagtaaatttcaacccttatgatagaaattgaattaggtcaaaatttcagccatttcaaggtgaccttgagactttgatggttcatatgaagatttatatgaagaaactaaaatattacctccaataccggtacaactatcatccatgcacattctcttaacaatgattgaaacctttcgctcaatgattaatgaagtttgcttaagaaacacatgttttcaaagttaattttggttggaactcttgtagaagtttacgggactacaatcaaagcgaataatagcaaataaattaatagatatgttctacccatccgtctgaaaaatgaaaaatgagttttgactttgagatgatatgtttaaactaacactaaagtattgaggtgttgagaataatcttaaaaaaatcaccacagtaatttctacgtaacatacatcgtctttttaccccctttaaatctccatagaaaatttcactgattcatattgttattataaggattattagaaagatattggagattggattgttataagcggtttattgaacaccgctcaagccttgaacctagtttaagtataaggctaaacgtgctttacagcttaagaaagggtgaataaaacggctcttaaacttttttatcgcaattgagcaattctagctgaaaccaggccgccatcggcacacattgttagaattccatttttatgtcactgattggtatatactaaaactaaaaggtggttgtttcggttttctcaaattggcggacctctcgtacgccagccagcttaacagtttgcgaaaaagatcatttttgatacattctaggtttcagacatgtcagaaacacacaaaaactatcaaaaaagtaacatacaaaatagttaaaagcctctttttataactaattaagcttagaagcaagctctgtttcagtaaagacataacccttggaaaagaagaacaagaacaaggagggggaactattttcaaaaaatcaagatctcaaatttgtacaatggcggtagtttgaaaccaatattataatattctgtatctgaaaatcatgatgaacaagaaggacatcgactgagatccaggagatatcataagcttctgtatttgcatattagatacaaggatgttctgtggcaaagttatccagctttaaaaaaatactagctaatgaatagattatttcgggttaaatgcatatcgtttctactatttagtgctattcttctaaatggcaaaccagtatcttgagatttaatagattgactataaattagaattataagaataattgtgaatacgctcacgcttatgccgttaaaaattacacaatcataaaacccatcggaaatctgtcaaaacccaatattttcattatcacctgtcgtatgaccgggacaaaaatacgaaaatgcttgttccagattattcaattttcagtatttaaaaaaatcagaaaaaaatgtctacttcgctcaacgatgaatgcatgtttgtttaagtttaattaagttttaaattaattaagtttaagcttattgagctcatatttgtccacattatgcatcgaattgaagtgcatcttattgcaaaatttcagacaatttaatcgaaagaaagccccatgccaaaattattcatgaaagtgatcatgtaatgctttaccgtgatgaatcaatacccagacgcttaacccgtataggcctgagtgaatgcaaaaatactaaaacatttaccactcagcgaatacttaacggattcaaataattttttgtcaatatactggcccacatatctagtttcaagaaatggcagaaggaactcggaaatactcctgtagccggagttattgtggtgggtcactgggtcaagtcgggtagaaaaatgcgattttttggaacatgccaagtaatatttaattatttccaatggcattcattttattttgcataaatcattaagatctgatattcaacattataaattaatagttttgcaccgtttagagtgtaccatatgcggccaatcgggcttaatgtactgaagaaccagctctagatttgataggtatttaaccatttcaaaactataaaagtatagatcgaacataatagtttactaaaatgcgctcccataagcttgacacagacgttaagatacaaatgtgtcactttatcatgaatttgaggcatcccggtgacccgtaaatggtcatttgtaggatcaatcaaatacagttgacataattattcaatttaatcgattatcagaaggtttacgctgatgcgtttttcttaaaactctttgatatagtggctacattatagccgattctggaaattatctgtgacttgaaatttgtctacctcctggggcacagaagcacgaaacccttgccccccgacctgacccagtgatccaccgtaataacttcggccacatgatcattcccgaaattctttgatcctttttagaaactagatatgtgtacgagtatactgacaaaaaaataattgaaatccgttaagtattcgctgagtggtgagagttttagtaatttttctttcactcaggcctatacgggttaagacgatacacatgttgaaactcttatttcaatatgttttgttgcagtattcttgaaatatcgttgtttaaaacattgttacaagccagatagtcataaaaatgatgaaatatccggtcataaccacgatttaaaaaaaaaaatactaaaatatgagtgctgtctttgtgtttaaatccgaacaccggatgcaaaagatgttttttaaatccggacactgttggatcgaaatccggacatctgtgttaaaacatgatttatttgaatttagcttatgaaaatcatgtcaaactctataaaatattacgcttcgaccgaatcgatctaaatacttcctttacaattttgcacgtaagtaatattaatgttttagttacttgaactggagcgcatgcagctcgaactaaagtacatgcggcttgagtgtccatcactaaaggtttacagatttttcttacatataatcatatgctaataactcacaccacttttcatacattttttctttacaatgcttcactaattttccaaaataaaccatttctactagttaaaatcaggtattccaaatgatgtccggattaaagaccactgactcgtaatctcggacagtctctcaacacattgtaaaatctatatttgcatcacaatcttcaacaaaggtgtactccaacattcaaaaatgcttcatgttaacaattatgttcaaaacactgcataagaaatgtttcacatactttttctttaacaaaactttgttcgtgctttgacttgtgcgtccatagattttcaaacttgaatttacatgaaccgcgatgaaatgacgttaaacaggaactactcatctgttattatgtttatcaattatttgccagtggtaactagatttaaaatgatagtacaacgatcttcaatgttaaaagtaaagaatttgaataaaattcaaacatattagcatgcaaatctagctaaaattattgaatattaccagagcgtccggatattggtaccgtccgaattttaattcatcacggtacactactcacggcatttctgaatgaattgtcgcacggaaaatatctagtccatggtcgagcagccgtcgatgaaaccgtaatgattcattgcacaacacaaaaagcgaggatatcagaaattatatcggaatgcattcaccattacttttcaatttctgaaaaattgttgtgttatgatttattacgcaactcaaaacagttgtgtaatgaggaagcgatgcgtaatgaatcattacagcactggtttcagttgcgtaatgactattcccgcactgcatacttcagtgcaggaaggtaggccgtttcatgacagattggcgtgatgaaaaacagcctattacgatgagaaattgcaaaaacaatcttatgacactgcacaattcagtgctggaaagtaggtcgtttcatggcaaaacattatgatgaaaaacaacctattacgattcgaaattgctaactaagacctctaaaatactacttcctctccatcccgccattatcctaatcgcatcaagaaacacaagcgattatcgattaccgaaaataaaacatgaaaagctgtcagccgactcccaagcaccatatcctaatgtctgctgttcataactactgctggtatgacctcgtgagccgcattctctctggtcgactaataaatatgggaaagttggaggtcgtgatgcgcttgagatatggcacagttttacaccaacgaagccaccttgcaactaccatccagattcctgaacatgggcttataattcattcacgtgctacacgatggattgccgttcgttggcttgacttgccaccaacgccgctataaaccacacgttagctaaacaagtgtctagctattattgtacccgatacgttttatttattaatcgacatgcctgctgatatgattcgttccggggccattgcttttcccggtatccacgctgtgcaatactaggacggaaaaataacctcctatcagcctcataaatttaccattatattttgatcgtccattcttgactcgataccatacgagtaatggaaaataaagaaggcataagtttggtagcaccccactgtattctcctttgaacttgcccagcatggtagaacatccttccgaatggttgttgaacgagttacctagatcgagatctctcaactactggctctgcgccgacggcagctacacccattaaaaaggaccgaacagaaaatgttatgcggcaacaactatgatatgaagattttaggcttccggagacgacccgcaaaactacacctacatcgtagacatgctgggcagatcacgcgagcaacatatgaaaaggcggtaaacaaacagtcataataaaattgtatctacaacacacaaaaaccatcgttcagcaaaaacaaacgctctaagcatcgatatatctcaacgccggcattgcgggactgccggacttgacctgtgcggtacggcagcagctggtcccgatcgaggaggcaatatagaacataaatatcaattcagctttggcttgacttgatctttctgaactacagtcaactaccattactcgatattgggtatgtcgaaatcgagttagagaaccatagtaaaagttgggtttcatggctacctcgatggcccatttcgcatttgcacctgagacgagactcgcgaagacggtcttctttttctgtgattgctgagtttttttcttattccactttgtgtttatatcaattatgcgcatgctgttcaaatcctcacatgaacttctcagcaaaaaatgattgagtttgcatcacatcgaatcatagatagccgtttgagtgaaatttcatgccagcaaacgtagcagacattagaaataattaatcttctgcttagatttatcagcaactttggaaaaaactgctccgccgactgaggtttttaataacagtttactttgaacacaatacttttcactttttcagccataaaaacggtgggctgcatttgacgtttcgtgagaggggaaactgggctgcatatgacgttgatatttttcctcttcgcgagtctctctcagatttgcactagttgtgtgctctataactcgatcgatatttcggggcaaatgtgctacatatttgatatactaaaattgttagagttgaattatgcaactgtaaacgacatcaacaaaagcataatgggggaagagcaccaattttccagctatcactaattttcgacccattcatacgattttgacctacctgtggtctacctgtatggaaatacgaaaattggtacagatttcttgcaggtcaaaaattggtcctttttcctgctaaaccaaaatgaggcacccgtagtgatttctgacgtgtagaaggggctggcatttttgctcactaagtgatttttaaactggcttacccagcgtggctagccacgctctaacaaaatttgaaagtggaaagctgtgcataatctatcaaagattaataatgttttatgtttaacagcaaaataactacatggactaatacatttctctgttcataactgtgaaactgctctgaaaataataagctgtgaagcatactccgtcccagtagaggtgtaacgttaaaagaagataataatgataaattttatcaacatgacccgacatcgacacgcatgattctaatggttaatgctgttgtaatgctctactctggaataattacagccataatgctgttgtagtgtttcttcagccgtgaaacatttcgaaaataccagaacattctatgaattagagagaataacattctcgaatattcaactgaatagttgttgcagtgttccataatttattgttgttgatatagctttcaaaatcacagttgtaatgatgcatggaaacatcgactcatagaacaggaatgctttaaagagctgttgtgggggaccatcatagtaataatgaaattttgtttttagtatatttctagtttccctgtagatatgtatgtatgtatgtatgtaggtaaccaccatcctagcttgagtcttgctctgcatgcggttccactttacagtaaaaacaaccttcattatcaaactgaattcaacatactattgtttgaagggccaaaagggggtgtggcggacccgtaagtaaaggcacttacgcgaaacccgcgggaaatagagaatctccttccaataatatgatctaacagaaagtataatgaaatttgcaatatctgtcaagttatccacgggatggtttgttataagaagggcgcgtcaaatccattacaactgttgggatagaagaacccatctacaaggatgttacggttacttcaacccttgactccggctgacactccacaccattgtccggctgtaacttcaatgatgccctgatgcaccctaccaatatcacccatgatatatgattcaattaaatgattattatgtaataaaattaaatatagtaatcaaaaatatttaaaatatagggaaagtgtaccagttatggacatagtggttccctatttggccataagcgaaattcgggtagcttttacatttttaatctttttgaatgttttaacatcaagatacatcctatatcttactgctaaaacacaaaaaatcttttcaaaatgttgagacattcaaattaccacgtatggcgaaatagggaaccactatggccataactggtacacctaccctataataaatcatgcaaaactcgatgatttgacctagaattgttacatgaaagatgattgatattaaatacataataacagattgttccaactagcctgaaaaaaaaaatacaatgacaatatttatactaaatgtttacgacggcttcctgcaataatatattgttgatatatcctgaaaaaaaaatgaattaaaaacatcgttgtcaggtccttttcgaagatcataggaaatgtttcaggaaacctgtaatcaatttttgaattaatggttaaaattagcaacttagccaatgactgtcattttcacaatatcacaaaatcacaatatcaaaggaacaaatttatgtatttccaatacatatatgatcacttctgtaaggaagcaatattattttgttgatagtattttataaactattatttaacaacttttttcaaaatgctcgaaaaatcacgatatttttaccgccaatattttattcttatttttgaactgttattacaacttgtaagtatttattcacctccaaacaagtattagaccaagttttccacacaagaatgtttttaaaaaatatatcgagctatggagagaaatttacctctcgcgtgacatcgactattggagatatcgagttacagagagcatgatgtatggaaatttgaagggaccgaaaaatccatcgagttctagagtatatcgagttataaaatatcgagttgtggagagtcgactgtaattatgatgtgccatcgaactataaaattaataaagtgtgaactcgattttggcagcccatttttgtttatactgtatactcccaattcccaatatattacaaacgagataaatataatgaaaaatactaaaatgggaatcatggttatatgtatatggttgataaagatgttcacaattatttaatttgatttcgagctcttttagtacactccaaaataagacgatattcatttggtagagacgaacggtaaactgaaagatgaagagcattgattaagttagtatctctgatatttatactccatgctgcttctgaaagtttaaccaataaaatgacataaagttacttactaacttacatgcccaaaaaacaataattaaataaaatgattattatggctgcgttttttaaaataaattatttgtacctaaacgtgatttaatacgttatataatatggataaaacaatatattaatatgacattttgaatacaaatacgcatacatataaatcaattaatttgacaacatttaaacactgcgaccatgtgcgctaagatgaaataactctacagtagttctactgaaataataattctttagattttgtaaagcaaaataatcatttgattggttttatgaagaaaacgacagccttattactaaagaaggtaaataaaaacgtcaatgaaacagtttgttgtttttttataacaacctaattttaagaactgttagaattttttaggcgtgccaaataatgtcatgaagccatctcgtggcaaatagcagggattttacaagctaaccaaagagtttttttaaccgtttgattttcaccgtttgaactttttgcaatacaaaagctccataatttaatttatgatggtggtggaattcaatattgaatattacattgtgtccactaaaaccacttattctttaaacttttcgacatgtagtgaaatattaatcacaaatatcatggaaccatgcaatcgaatattaaatattattggaataggatatttagctatcatcgtgattttgtctaggtgaagttgtagaaaaccccgttcgttgccaacaccacggctgccacactcacactcacacacagtgattttttttcatttcttcgccaagcttttttttcggataactttttggcttcgtttcacttcagtatcacttttatttccctaaatgagtataaaactaatagttctacataaaactttaaaactgtcctagaccacgagatgaatatcatttatcaagggaaatatctcatttaaactgcgtaatttcgctacaatcaatgcacgccaaacgagctttaatcgaagacatgtgaacgcaacaaaagcacaagccgaactgcgtatttctagtttccctgtagataaaataaaaaaaatcgatttgacggacaataatctgatccatgtgtatattactattccacatgtcaaactcgtgtttagatgttggaactgctgaaaccccttttgaatcacatatttaattcgaacccaatccaagtttgaccgaactataatttgcttgaagttggtttattttcgatttgatcaccggacaacacgtttaattgaagtcactcaaaattgagaacgattcaaacaaaatggagtgcttcaaccaacacattatgtgtgtaatatcaacacattttgaaaaactgctctaatgttgatatcttttgctttgcaatataaagattctcaatgtaacatgattttttttttaaataaacacaaaactgattttgcagcatgagtgaaaattacacatagatatattggtaaaaagggccttccttagccgagtggttagagtccgctacaaagctacaaagtcatgctgaaggtttctggattctattctcgatcagtccaggatcttttcgtaatggaaatttccttgacttcccttggcataaagtaccaccgtacctgccacacgatatacgaatgctaaaatggcaacttagacaaagaaagctctcagttaataactgtggaaatgctagtaagaattctgagctgagagcaggctctgtcccagtgaggacgtgatgccaattttgtttaactttatttaaggagaagttcccaaaaatgaatacgacaacgatgaaaaattctagaacattctacgaatgaggaagaaacatggtccataaaactctagaatattctttcaaataactgttgtcactacaaattctaaaattgctgttgtagcgctcagtgaaacttttcggtgaaatatttcaaagcgttacttacagacagacaactctgggattttatatataggtatatatttaacacttacatttttttgcgtgttatgtactttttacttattcacatcaaattcgtacagttatttggtgcttatattgtgtaatactatacatatccgccgttaccattgttaatacatttatgatacggattggagacaaaaataacaagttcagttagtcgaattgactagtaaaaagtaccgcatgtgttaaaccttgttataaaacatccccttatgacggtaaaccttaaaatgtatgtttatttacccattagcctctgctttgtaagtaatataaaaagaaaaacaaatcctttcacttggacctttatgttcatttggtggtagtctttcccagtatgggtggcacacttgcccatcgtgctgtaaaacacagtattttggacaattttactgtttattatttcgataaattatagcaatttctgacaacttttgttcgagcacttttatcaattaaaactttagaaaaattgtgggatggaagggaaagaacttattcttcttattttttctggcgtaacgttccaattaggacagagcctgatcctcagttattaactaagagttttctatgtcctggggaatctagaatttttttaacctgaatgaatcttcggccgttttcgaacccacgaccattactttggtcttgctaaatagctgcaccctccacagctatctaggcctctaaggcgttaagttgattttacccaaatattaatcagctaatgggtgtgccaaacgtgtaaattcatacctcattgaatttctctatcaattcctataccttttctagcaacagaaaagtaaacttttgctgtctatacctacttcgcgttcggtttttgtatgccacaggaatcttcaacatttttttttagtttttacgcgatcgcactaagcaatgggtgcgcgcgcagctcactagaagggaacacatgggttttcggtgccactactacctgcagtgagttgaaaaaagttacgtgaaaatcgaatacactgaatcgagtgtccattatttatgtacccctttcaacatcctaatgatttatcgatgtcgtatatgtgaaatgaacttccccttgtaacggattgaactaaatgatcagaaagggagttgtatttcggtcattagtaagcttgcatgttgctggaatcactttcattgataaatgcgtgtagtttagtaatacagtcatcgcctaaataattatacttataaatcatcattattttaactgttttgggctttttcgctattagttaatgatattttgttttcgttttcaatgccaaaatcaacgttttcgataatttataaaattatcttggggctagggtccatttgtgagattgtactttccaaattttctatttctgaattcaaaataactttctttaatttctttatgcagatttaccgcaatttcataccaggatcgcgagtacgtcgaaatttccttctactcacgttattaaaacgaaccaagatcgtcgcctgaatttattttcacactttggttttgccattccccttgccgcaacaataaaattcgttaaactgagcaatgtcaatatcggtgtatgttctatttgcattcttatcagctcttcgataatttgaagtgaaactagagcattgcttcattggaaaatagaaaagtaacaggaacatgaatcaaagtcagcatgcgtaaccagttggcttaaaactacagtcaggtctcctattagatgctgccacccactttacgctcaccgcattttctcagctatcatccaattgattctggcactcgacttttatttcgggtttttttgtccctaaaccagacgaagtagagatgggttttgtcgtaacagatagaaaagccaagtgggcagttttgaaagtatatttaccaaactgtgttgcaaacaaggctgcacatatacagatttttctgtattacacagattttttatgcaaacacagattcaatttgtatggaacacagattttctatcaacaatttttgaacggacacagatttatttgtatgagacacaaattgtttaacaaggtggatacagattttctttcaaataatctggaagctctgatttcaaccgaaataccaaaagttccaaaaattttggtttcaagaacaaagtttatgtttctacgcttatgaatttagacagcaactagtaatagcgtatatttacgatatacgtaggctccaggcttcagtagtaactaaaacctgttcgttatcaagtaactgttaaaaattgaacagctcgctatctttaccattcaaagaacgaacattgcaattaaaaaaatttcaaaaattatttgaattcattcgtgaaaaagtgatttaatcacaattttgttagtaaatctcatgtcaaattgcttcaggaatagtaacgattttgaaaattgcataatgtcctgataagaaatcaaaatcagcggctgacatgttaccataagttgaattctttcaaactgatggagatagaatacacagcgtgacttgctaaagttttgagtattgattgcagactaactaattttgtgtttgactcgataactattgttgtttttagaaactttactcgactttttttcagccattttgtttttctaactggcaaatgtggatttcaaaccagcattttcaaaaactaattaaaatttagacacgtttatgcggcattatttgaaattatacacttgtcatcaaataaaacaagacatccacgcgattccattgaagctcaaaattgtcaaattgccaatattgataatgttacgaagaaaatagctaaataatacagatacgggtttaaatgaattaattgatcaatatgcattgatgatgtcatcttcagacaaacgatgaaatttaaaaatctataagcactttaatttgcagcacaaagacaaataaacagctacatcgaaatccacttctaatcttcgcattctcaacattttatcaaagaaaatgccattcttcagtgcgggaaagtggaattgcatctaccgcaatcagtagattaattggtgaaaacaccaccattaatgaatcatcagaaacgctctttgcgacaatgtaaggagctcgctgcatgtccggaaaaattctcccttctcatgtccatttgttggtgtctgctatagtgatcatcaaagcagctaccactctccacggaataccatattggtgagaacactgctcagttgactgcgggtaaaaacctagttcccactgggtgaccatggatgattggatgcatgaattctcctttcacattcattgggggttcgtcaatcatcaataaattttatcaaaaaataaatttagttcaataattagttttcaattttagactcatcagttgatttgctgaccaccataaaacttagagcagagtgaactacctactcaaaatattctgaaggtgaacaatttctaccgacgactactgtctatgtcaaacgtccaagatggcgagctaggaaaatagtagcgctcggagatcttgggaaaacacgattttatcattatctttgtgtctctcccgcggttggaattttagctagctctccacttttggacgagatgtgcgcagacggcggaatgtcggtttggtctcgccgtcatttcgtcttcgtcgtcgtgagagtcacacaagagcaaacagggccattcagaatgctgtacctcctccgagcgcattcccctcacaaatccctagcggggcagttgccgagcgaaatcccaacggatacaacttcttcgtggagagcattaaccctcgtgtgacattcaacgttacactcagcccactaaacatagacgaacttagcgcaggaaactgctgcaaagctgaattgaaatgttattcctattttactgtcatgtatctcgatcgcctcaataggagctcacggaagattctttgtcgttaaattttcaaactcgtgatacaaaagcagatgtatataaataaaaattggagtacctcctttcacactcactatgccacccctcgtcttggacaaactggtcgtgattgtgcatatatagcgaactcccatcagtttacaattgaccgcgaatggagcactacattcaccacctccaccatttagcaaacgatgaatgatgagaagattcgcaatttggtactccattcgtgattcaccactgcatgtcccacgcgcaagaactttttttataatgtttgttttcgctgcactttttgccaatgacgcgacaaaggctttacgcgaaacgctctagtttcaaattattccactgcacaaagttcactaactgatttatgacaaggtgggaattactttcaatacccatttacagtatggcagtaagatctacctgttgttaacattgtacagcatgaattattaatttcctggcactcaccatcaagccttggtattgcagcgacagtatttacattaccaccagagaggccgggctaaatcgtggacccctccagggctgcaaataatcatcatcacgacatgaccgcagccgcctagatctacggaaccgcatttcttcctctgttgttggttgcactaaatcaaacagcaataacagcaaatggctatttctaccgattgatagtccggccaattggttatgactttcacgttctaccttcacggtaaacataaccaacacaatttcctctaggaataaatattgtgtgggagtttcttggcgatatctcaattatttccagcgagatgccgatcggtaatcaacactgtacgccgtagtccacggtacacggaataccccattatatgcagagaagatacatcgcactgccggaggtgtcgattcgaaggcatcgattgatttattgaaacttgaaaaataacttcattatagtatatttccgttccaaagaacagccatacaggcgttgttggacgttgaagagtagtagagcactcgaaaaaatacattaaattcaaattcgtaaaaatcatgactagtttttttttatttctttcttgtttaaaaaacaagttctttcatatgctttagtgatgggatattgcccataaagtctttttgtttgagtttaacccgtaggctaagaggccaagatgaatagtttcaaattgttcgtatttgagcataggtcaatcaggtacagtgaagctctatggatcataagatgcatatgctgtaaatcatgcccgtttattttttattttttggtgattctggtattacgataattattttgtgaaccctaaagcaattctgagaatccgatagccattctggactttctgtaagcattttgggattcccgttggaatctatgggactgtagttataaaatttttagaatcctgtaggaatctttgtgatactgatcagaacctttggaattttgttaagaatctttttgatttcggtataatcattcacgattcccatacaggtttcaaattccatgcaaagaccccaaaatcgttaaacacagtgatgacgacaatgacggaaaaccaactttaattgacagttctggggtaaacgtaggggaattaggttaaaatgcgccaccgggttaaaacgcaccaccgcaatatctcaaagataaaaggtattctagtcaagtccgaccatttcatgcgatttcttaatcaattttatcggaaaaccaatttccacagaaaaaaatataaaattcaaaaacggtgttggcaactatgtgagtaactgacgtggggtgaaatgcgccactaccaatggttgatcagaaatagggctgtgcacgatgaggattttctggtataggcaatatcatatggatccaatatcgaaatcggcggtatatcggatttgatatcatcgatatcgaaccgatattcgataattttcaaaagagatattacaaagcaaaaccgacaattgggtctcaatgttttgataaaattctggacaaacatttcaaaagggcacatcgacattggtaaacaatggctttgcaagacgctgtggggctcaattcaactcgatcacactcaccaataccactatcaggaagagctaacactaatcttcttgacagtggtgttagtttacgtgggcgggctaaaatgggctcaacagcaacgtttccgaaaaaaggctgtttgtccaagcttgtcattttattaaataacacgacagagcgtatccttgttactactttggcaaattttctcgctcaaataacacttttatcataataaatcttcgagctgttcagtagaatacctataagtagatgaaaaaaccgaatttagtactatacctagatgaaaaaaccgaatttagtactataccatttaattccattagagtttgtatcctttgacagaaacgcggccttacagttgatgtcgaaatacgcgtatctgtcaaaggatacaaactctagtggaattaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtactaaattcgttttttttcagctttatcatatttaaactttaaattttgaaatttgttcaaatactacaaccttgacacttttgatcatgtttgacgttcacttcgccgacaaatttccactggatttttgcttttcaaaaatatgacatttcaggagaaacacggaaaacaaaatacatccaaaatttgagtttaaaccaaggggtgtgacaaaatctcaaaaaccagaaaaaaatttttggggctaaaccaacgtaaaacacaaaattaaataaacatatgtttgtggtctaaacttaagcgatcggtactcaaattgaaacagggctttaggaccctctattcgacaccaacaattgcataatggaatccattacttgaattttggaataatattatgccatacccagcaagcattcaaaatttcattgaatcagcttcgtttatgtaattgaactaatcaatgttcctctgaatctctgactttttatcggactaattattgtattatcgatataggataatatcgggcctagaaatatcgtattgatcaaattgacccgataatatcgctatttgcgcagccctacaaccctcggtgaaattcaaattatgctgcaaaaacctacactcaaacgagacatagaatgcattagaatttggaaaatagctggattttgtcacaacaaaatcattttaaactagggtggggcataatgccccagctgttttaaaaattgttgattttggttccatttgtttttaatagaatttcttagaaaagattacctcaatccaatgacgatttttactaattgcgagcttatttatgcaacttttttgtatacctaatcagaataacgtttttgacgaaattatttttgagtacatttaattgttggtgtcagtcgaaataaggccctaaagctctgttccagttttagtagagtagatatattggatggtttgaataaaaaacggtttacttgacagatgatggccagcttcaatgaattttaaggtgaaacatctcggaatccaaagatggcggtcacaatggccgagttgtggccctactcgagttttcaaaggaactaaactggagaaatagtagacaaacgttcctgatctttttattttaagttttctacttgtgtacaaagtcaaaataaaaagttcactgttgcataggttgtagcttgaaatcttgaatcctggtggggatcttaagtgtatatacattcttgagattccagtaagagtattatgattttagtgaaattacggtattatttcaaaatcgcattgttcggacattacactctaaaacaaagttacacaaaatcgagttcttgtgggccaacacactatgtgtgtgttatttttttttacaaatagattttgtgctgatttctgcttaattttctaaaacttcacgtcgcacaaagatacttagtattgcggagcttctttgtgtgtcatataatttacacaaaaaaagcagaagaaatcataccaggagaacattttagcatgacccataacgcgggtagaacaccttttcgtggtgcgttatggggtaaagatctaccagtgaaccctagtcctgactgcttcaaacgaagagaacaggatattaaagtaatcaaaggaacatttttagtccttgttacatttttaaaccttgttgaaagtgacaagtctcggttttcctagtggccgagaatgattttgagacaaggaaaaaaatgagtcaaatacaacaatttgttttctaatcttttatttatttagttctctagtttgaagcagtaaggactaggattctgatgcatggtcaatatcggtgtaatttcttggctttatcaagggatccgattttgactgataaaggggcgcgcctgtggagagtgtacccaccacattcttcaaagggtctaaatagcggaaccttttaattagaatccattcctacgatcaagttaggaattacaactgtaagaaaaccgaatactttatcacttctcaatagtgataaagtaacacgacatgcactaaacgaaggacctgggatatactacaatagatcaagtattggtcgcagtggtttatgttccgaacagaaaaaaaaaaattttagcatgtgttaaaattacacacctgatgctttgatctagaagagctcgattttgaatgactcgtactaaattttgtgtaacgttgtttaaacgtgtatgggatttctaaacatgttcaattcctagaattgaaaatcatcttagtaactgagatttgtgattggaaattagatatattggtattttttattctagtagaccctattgatttctggtggatatcttctagtccttgatattttaggatttcagtgataacctagttattccgctgagaatcgttgaaatttattgagagtccgctctggaacctcaccaaaatcccaaaacttcatattaatatttcaaaggtgcacaaaccagataaatcctgccggtatcacataaaaatctcaaacagtcaacgaaatcccaaaaaatgtcataaaaatttaaaaaatggcattacaatttctaagcatccaccaaaatctcaaacatcgccaacgaaattcaaaatattatggtaggaaccacaaagattctcacagaaccaaaaaaaaaacagtcccatatcttctcactgaaattgacaagatccatggtatgcagaatgtttgtagctatttccggaattcttaagaaaaactcagaatgcatatcggaatcttagaatgcttaaagaaatttcgaaaatccaacaaaactccgaaatttcaaaatgtttataaaaaattcggaaatcctagcgaaatctcaatataccgacaaatattacaaaataactataataatgccaaaagttccacggaaattcatatattctcattagagtctcaaatttttctctggcatctcagaatattgttgggttttcttagcttttaacctcgcttcagtcaactgttaaatctgctaaataaactgcaaccatttggaaattaatattattaaaacaatactttcttattttttgcaggtgctttgaccaagtcccaattcccggttttcaccatctacgctcagaagtcttgcctaaagctgcgtccatgtgaacgagcctggtgcatcgacagggtgcaaggatataagctcaatggccacgttaagcgtaccgcccaggttgtctcccgccgcgactgtctcgagatgtgtttgggtgaaaacgaattcacatgccggtaagtatgaatcatagttactatccagtttaacccttccaatcaccaatcgctagaatgtggaccgacagatatgtaataaatcgttgcggttagatatcactatcagggctgatgtaacgagagagtgtcgtgagacttttacatagatgcttccctcactgtcatcggatggcgagacaatgacagagatttttttacaaattctctttcattttccgccgctacggcttgtgacggaatcataaacttgataatttttagctcattatctgttatgattgttattcatatcgctggaatcatgaaaggatatccacttaacttatcaaacaaatttactttacgaaaatctccaaaattagttagacgttttaatagcaaaacaacattaaaatttctctcgtgagatctccgtcattgcgacgttacgaactgagcacatgaaatatagcttcatttagtgacagttagaaggctatagcaaaagttttgaaaatcatgtcagataatttctattaagttgttgtgattcacgaaccagaataataattgacatatccaagcgaaattactggcgataactttacaagaaaaatccgctcaataatttactggtaagattttaacatcttaaagccagagaaccattaatattcgtttcggtgacggaagatccattaaagttttttttaatgagcatgataaacccatgaatatgtatgaagctatggtagcaaatcatattcgctagttttaaaataaacaactattaggattaaattatcgttattattgtcttaattatagtggctttccgcctttgacgaattcgccactaaaaacaaatttaagctgttatataaattaaatagctttctccgttttaatgatataaaatctgagatgttttccgttaagtttaccacctttcacgaccagcctattgtgacattgactccttccgattacactgttgaccccaagcaatattatgttgtctgctgctttgttgcaatactccacgttctgtcgcccgtgaaggcgctgaatgtatattaaaaccaatgagtgagcaaatgtgagtctttcttagttcagctggtaaacgtgcaactttaaagtgagcccatattgaaagcggctggatgagaatcctggctcaattgagaatctttcggatgggaacttttctcgacttcaaagttctctgttaatagctgtgcgagagatcgtagtacactaagccaagaagcaggctttgtctcagatggaaaattgtcacgaaaaagatcaagtagaagactgaatgagcaaataatgacaataatcaatattccaatggtttgtcttttcccatgacggttgccgccatctaaaccgcaaatagcgttgtggtatcaacgacaacgaaatgatgcagaacgttccgatggtttgatttgaaatttgattctctggcgattgggttcgatagatcaaacagatttcaaggattagccttagaaatgaaattcacacgtgctcaaggtcgaccaagagaacagaagctgagtcaaatcttcaagtcatgctttcaactattaactaaatacccaaatcgacacataattggaatcgattgtatcacataatagtatgaattcaaagtagccagaaccgtgaaagtgaattgagtgactggcaattctgaaatataatattgcgcattgcgttcatcactgaactatcgcaatggttcatatgaccatgcgaataaaagtgcgcgtttgcatcaaatcgagtcggtgcattcatagaacacattctttgaaaatcgaagaacgaaacatcgcataggatctaatattttaggttttctgcgccaggttcgctttgtttcgctaacgagcgtgtattgttctgttctttgttcatccctttaatttcgttttattatgattatcttacagtagctacaataatcaatacaaaattatactttttttgaacctaagacacagatcaaagtttcattcttaacatctccgacttttaatggcctataaagagtgtcagtaattgttgtgcaccttaacacccatgtcataatctcatcctagtttgtggtgatgtgtagtctaagagctatttaaagtagagcgtttccagaaagttcttcttgcggcaatcaacattaaacgcacaggaagttcttttctagatgcagtcacattgatcgtttagaatcttcgtgatctcactttcgccacggtgtgtaccaaaagcagcagctgtcaatgaaattgatggcataatctcggttgagggcttataacgccaagggtactttgtcggtcatttataatgatgattaaactagaaccttgagataaagattgttagggccaacagccgggtcacctttctccgagcgtaaactaacttaaggccattttttcatgaattaagtctggattactctgcaattgcccaataaacgtgcacgtttccatcgcatttccagcgaaagatatcaatccgcaaacacacactgttagattttttttatcctacggataaagtgcacagttgcaaagccacactttgtttcaaccatcaatatgcacctccgttcacgagaaaataaggttgttgcagggtagttgatgatgatggtgattggcagaagaattactcgctgcgaattcttggccgggttccaccgatcacgtcacgaaaccccagcactctctattgattggttattaatacgacgagccctttggaaaagaaatgaagccttcaacatcgtcagccagctaagagatctattcatgaagtgttacaataattgcaccaggcccgctgcactctaagtgagaaacccattgaagaccttgatgggtttacgtcttataattatcttcgtagtattatggtaatgtaatgaccgcatctcctcgccaaggataatccataagggctgaatgatgacgatgacaatgacaatgacgatcacgacggcggtagcgacaaagtcataatatttattccttttgattttaccgccatcttcgtggcccgctatccccgtcctgaggaaccaattacgtttccagagcttttctttattcaagtgcattgcatcactagaaatctaaaaaatataaagtcatctgaacattttagatacagaagtagtaaaaaccaatgaataataatggagatgtttttaacagctctctctgatctgccaccttcatctctgatgagtaatgctttgtagtagaacttaaaaaagactatcttgtggctaccctgccagcctagctgatcgagtaaaaaggcggtaattaaaaattatgaaccatactcatttacaatatcacgatgataaaagacaagaagtggtgatcacttcctttccaagttgaagcttaacatctgtaacataagagcagtggcgcctgcagctaccatcactaccaggtcgtatgcctactgtacgaggcgaccacttgtaggttaaaagataaattgcatggacctgaatcgtcaaataaaagcctgtttttttttgttaatatggttgcagagatcaagtatgacaagaggacaacttattgtcgattctccattccattggtgataggaattcgatgcatgttatgaaccctagtaagaaaactgaaaagtcaaaactccctttccgtatgaaatacctttagggcaatcgacgtaggaactcctggagtaattcttgcatccctcaacaaaaaaaactctggaataaactttcgaggactttctcggaagaaatctttgaaagatttcttagagcaacaactggagaaatcgttggaagagtttgtggaaaatctccgggttagtaacttcgcagtgattaaggattttctagagcatattatggagcaatttctataataatcctttgaaatatcgctggaggaatttctggacggattcctgaaagagtccttcatcaaatctttcctgaaagagtccttcaacaaatccttcaggaatccgtccagaaatccctccagcgatttttcaaaggatttttatagaaattgctccataatatgctctagaaaatccttaatccataaatctagaggaatttatggagtgattcctggagcagtatttggaactattcctgaaaaaaatcaggtaaaatcactcgaaggattgctgcaactttttctcgcggaactggagcaaaaagtcaggaataacctgtggtagaaaaactaatgaagtaactttagagaccattttgcttgaaaaaacaaattagaaaaccatcaaattaaaatagagaatttttaaatattctcgtaactgccacgataaacgaatgaataataaaatgaaaaatgtgacaaagaaagccctcagtaaataactgtgaaagtgcttaacactgacaacttaactgaaaaactactcctgtgttacttattgaacagtagttgaagttttgcataaccctctctttcccatgatagctccattgattttcgaagaacttgcgacaaaccgaatcagtatacagtagctagaagaatatgattccatactccatactcggatcaatcaaagcgtcaactatctgtccaaatagttgataaacaatgaattcactattgaaaaataaccattttttgcaactggttttgaaaaattaacattgttgttcaggcactttatataaaaacgtttttagcgttaaaaaagtcgaacaaagtcgttggcaagaaatggttcgagatgctcaaaaataaacccaattggttcatgttcataaaaatattgcataatctttcgcggaatttttcatgcattgaaatgtgacatctttgtttcaaagatcattacagtcaggtttcctgttagacgttgtcaaccactttacgcctacagcaatttatgagcagtttctaatgcaatgtagaagatttttcgttcgatgctaacacataaccacaacttggttcattgagatctactgtacgaaggagaaagggtggtggactgcaaaatacttaagttttacatgacgtgctaaatagttgttctcttagtgtatttgtttatgttttaacatcattttagtcgaagatgaattcgaaaaatcatgtgtcgacacattttgcttgtcattatcgatcgtgtacaagaagtttttaagagttcctcgatttatttaagtcttttcttcatcaacattacatttttttcctcccggatcactgcacccatccaattcactcgtacctgaatgtaaacgactcttttatagcaactgcatgacttctggaaaatgtcgtcaagactcccccagaagtacaaaaaagcactttccttgtccagccatctaaccgcaaacacgaaaaacgaaatttcctttgaaaataaaagtaaatctttccaatgaacatgttggggagcagtttgtggtcctccttgcgctctggcgctaccttcctttccatccgagaatatcccagaactagtaaaccagactagaaagtcaaagaaggagacgaaatagaacaaagaaccacatccggacttcacgttgctaaacgacaacgaatatgtaacatgcagtgaatttattgttatgattacaacccaaacaactcaaccgtttgcattaacaacatcggatattgcaaccatcaatgaggagcactgtccgaccgccagcttccctcctttcgtctttaccgacaatgacgcgaacgacaaaccaagccattggacgaacagaacggtgtttaaagttgttccgtaatggatctacatgcgcgcggattgtgtcgttctggtctccttcgagttcacgaatagccaacctcgagaacatacggcagcacattacagcactctgaatagaactgccgcgtaccacattcgtgttctttttcttggcattacgtccccattggttcagagcctgcttctgagcttagtgttgtgccaatttgtcatttccgcatttgtatattatgtagcaggtacgatgatcttgctcaagaaagtcaaagaaattttcattaggaaaaggtcctggatcaaccgggaatcgaacccagacaccttcaacatgggtttgctttgtagccgcggacgttattactaggttaaggaaggccccacatccgtaccgtagtctattcaaactcactgtaatgcagtgtcagtgtttaccgaaaagaacatttatgtagtgcgcacgtgaatggtgaacatcgcggaaaggtggtttgcgcctttttttttcttagaaaatgtcacttggtcaatggtagaggatttgctttggacatttgttttgtgtaaaaattcagattttgaaataaattgtatgtttctataattttatcagaaatgtcttgattttatcacgtatttgttgaatttatgagggtatccagtaaattccaacagaattgtaacaaattttgttacaaagttaacactttttctaacaaaatatttcatagttttggctcgttaatgattaaaccacatatttttccaaactaatgcgcacaaatgtagggtagaagcaccggttttagccatacgtcagttgtagccataggggattatacaccgttttacaaagccaatcagcatgaaaccttttgtgttcagtagatcacattcacatgatagagctacattcatttactcgtccaaattgattcaaaacataagaaaaagaattcattttccttataattttaacccccatacacctaatttggccagggcactcctaatttggccactctcattagaaatcaatgcaattggccaattaaggaaccgaagttaaatctctggccgaaactggttccgttggcctatattgaccaacgggattttcaaagcgaaaaaatggaaatatctcagctttgatattttgcacacataatgtggattgaaagcttgcatttgacttatttgttatataaatacggcttccaatataatttttatttacattttctcttaggctggccaaaaccggggcttttaccctatttgaattcttcgtgaaaggaacctatgcccaaacttcagcagtcaccttatagcgcgaatgtttaaaaacaagtgcactgagcttaaaaggttgcttccaagaaaatagtgctagcacacttttacgatatgcacctttttccgtaatcaactgtcaactctattaccttcccactttcaatacaaataccaatcgttaaagcttgcgcagaacagtacaataaatttcaaagctattgaccaaaggcttccccactgtttgctctgaaccgaaaagtcccattacactgttgcgactttcaacaagtcatccgtttaccttgctatcgtcgtgcgcagttaagagttccataaacacataacagcacccaactattaccgtagtggtttagctatttgtggaacaagtagaacaaatcaaaactcatcaacggctaccggtgctggtttcgctgctgtttgctaaaacttatttgccttcagcatcggtagccacggatggagtcgtgccgattggattggaatacaactatgaggctggaggcggccacgaaacaaaaaaatattgagtttagtgacgaagagtgatttaagaacgacaaggatttcagaaaaaatggctgtagatatatgtataacaataaagtgtgttttacctacagatactagagccaaacatcatgtcaaattgaaaatacgatagatcacagcagatggaaatattcgttaacccttatcattttggaacaacacttgaaagattaaaataatttgattaaatttggttaacaattttgggagaaaagccacggaacaagcatggaaaacctctgttaccgaatacgaactcaaaaatgacaaattcagcaaatgcagctctcagctaacaactgtggaaatgtacttagaatactatgctgagaagcaggttctgtctcaatagggttgtaatgccaagaaggagaagtggctattgaataggttctgaacgtctataaattccagaggaaataaataataagcagttactaatcaatagatttcagttgccatcttggaatcaccatcgaattctcagaaccatttcaatttagggattttcacaaaaatcatttagttggctccttatatttgcagggatttcctctaaaaaatgatagaaacgaactacttataacatgtataaattcgcattccagaaactccagaacaatttgaagtgtttgtgtcgagataattggagaaactttttgcaaaagatttttttgttggtaaattataaagggttaatacatacaacatttctgggataattgatagacaattccttgcagaaatcgaagaatatgtggcagaacttgtcaaagatttttcaatgagatgcctggccgagtttcacaagaggttaatgattgtactcgtggcaaaatcctgaataattggaacaaataataagaattgaattcatgaaaaatgggttaaatgcttacttaaaagttaaaaaaattcgtcaggaaaaaattctagtgtaggtcacgattttttttttaaataaagattctgatagaatctctgatttatatgcaacagaatcttaagtgtaaatttcttaagcgtcttgaagaagttttcgacaaagtttaaaaaacaatatttctttgcaaaatttccttcagaggttcaaaaatcaataccaatgttccgcttaatacatcttggttttcctctaacaattgagttgttcagtgataaaaaagttatatttattgtttcttgatcaaatgagcacattttccggaattaatttcatttatttagttaacatctaaacagataacactgaatcaacaatttcacgccacaatactcggttcgtggccgtatttttccatcctcggttctgccccacgctcgcctaatcgatgcgcacttgatccgcccacctaactcgctgcgctccacgccttcttgtaccaactggatccgaagtgaacacatctttgcagggttgctgtccggcattcttgcagcatgccctgctcatcgtatccttctagctttggccaccttctggatactgggttcaccgtagagttgggcgagctcgtggttcatccatcgccgccacacaccgccaaagattgtcctaagcaccctagcatgtaatttgtctaggccgcattcaccaccagtccaactttcgctgcctcgcggttcaagcgggtatacaggtctgccactttttcaaatattcagccgacaatgtccatatcatctgcgaagcaaacaaattgactgaatctagtaaaaatcttcccgggaaagctgttctcgtccattttcctaaatataacctaatattattactcgtcaatatcttaatttataatggcttatttaaacatttgtagcttgggtagaaattattaaaagccatggataaagaaaattttaatactcaaagtacagaatatatttaaattattaaagctactattattaatctgatctgactattctgaagacaactgtattcaacgatttacagtctcaaaaacattttaattcaaataatgacagctcgttccgtagaagaaatttgccaagaatgattaaacgaaaaaaaaaagtgatttccatattaatttcaaacatgttccaaaaacagttttggggcacggaaaattttaaaactttgggttctgattcaatttttaatatagagccagaatatgtaaagatctggataccactgaacttctcaattctctcagaaaaacttccaatattttttccacatatcacccaagagaaatgatataatccaccggaaatttcggcacaatttccacctgaatatctacaaaaatatcgcttgaagtccttcaatttaccccataacacactttaggtccagttcttatatttatgtttctctccaggtaaaaaaaaacacttaaatctgcaaatcaagtactgtattgttaccaaaaatctagacattacatatgcttttcaatttgatttaatggactaaataaagtgaaattttgcgaaaaagttacaccgattctcggtgagaaatgtagtcacgactttcaattcactagacaagcgtgttacgaactacgccacgagaggagccatgaacgcaaaaggcaacctgatttagatttcaactgaatatctggtttttattttgtaaagcgaacttctttctgaagaattaaatgtatatccaacacatgctaggcacgtataagtaacatcaataccaggctctttgcaatattatgctgaggattaataacaatgtaactgcttctagaacactgaaggactcaagaaatatctcaagtaaaatcgagtaatcggagtatgagaagctaaagataaaaaaattcataaattttgcaacaaattaatatattttttccacgagagtttatttcataataaaaaaaaatttcgaccaaaaaactcccatggtttttcaaacaaattattcaattattatggttttattatccaattcgcaattgaacattattacaacagatcggtgataaatgcttatgaatagaattaatatgcacagaaaagctaaatccaatcacaacaataaaaataactttaacaggaaaataatttaggctagagaaattaagttttccatgtcgatttccagtcatcgaaaaacggctacgactcgcctgcatcaacttaactagaacgaggccactgtgtctcgaattccaatcttggcactgccgataggttatcttatgtaagatctgtttcagggctaataatcctgactaatttagtcggtaccagaaggccgcttctctaccaaataactgggcttatctgcaacggccagcagacgccaagctattctagtacatgataccatttagagagaatgctcccctcgccgaaaacctcgcctaatcaattgaactggtttctgaaattgagctcatttactcaatttcaaaagctgcaagacttgaaagcttcgatgtgaacccacatctgcggtcgatttctatggtatctttctatcgtagtcagacttcacaaaatcgctattcccggcacgaaagatgcacaggcgattccggctcttgatacgatccttctaagtggagacctgcacaagcataccaccgtaactgtaaacggcgatatctgcttaccttcctcccgtgcatagagaagcgcacaagctgatccacttgttaaatatttatttaagcaatcaatttaaattacctttctcggggttcttccgtagtccagatcagatcatctagtctagtccaaaccacttcgcgtttcttgcttccttcgctcacccacaacattcctcaaaaatggcattgaagcgtatcttgaacgattcgcgaagctcattctaaccgcagatgtggttctaccaaacttgtgtaaatttatctgaaacttatcttctagcgtcgccttttcgatgccatttgcgggccaactagttccaacgagagaaaatcagcacctttttctactgcgccgacagacacatgcaggtttaatctaatttattagcttaagccatatgtgcaagtgctctcggcaagaaagaaagggggaaacgatagatttctcttccagaagtttgcgctcacgtatggactaatcaataaaattaacattctatcaatgggtgctcaattttacggagaattgcgcactcccccgtctgcgctctgttccattcatataggagtctcgcgctcttttcatttccatctataaaaagaagatttaatttgtcagactgactgggtccaataggtagggaaactcctgattagcatttgtgattcagttccaggaaaaaggaatcagacaacgcggccgaacatttgaaccggaaaatttagtgctgctggaattgcaaaattaacatacaatgttaatgttatgataataccgaccgtcgcctcatccgacagaccccgtctcaatagcgaacgggtctgggaaacacggccaacgactttgttgtagctcgactttgatttaaggagaggcgtcaatttgtcctggtacaaacttccagtgcggacagtgcaacagctttccttaatgagattcaactcctatgtcgcatcatgtcatgtttgcaatggagggacacttgagttccagagcactttatttatcgcgctgcagtaagagagaatccaaagcaaaaaacagcatttgctaacgatgatgtttgcgcatatttatgaacgaatcttttttattatttccgagcacctgtcggaacaagggcacacccgagctgtgagcttcactttaaattgctctcgaaaacttatttcaaacagcaaacatgcaatgggagaagtttagttcacaaagaaagtacatgtgatttctctttccattaatttctcaatgttagatttgctttcaaattattgctttgttcatctgtttcatttctacaatttgtttgaagaattatcagcaagactgacacttctttcgactacatttattatcataagccgaactattgtttagatttacttatttaaaataaatgcgtggtcaggtagcgttctaaccctcgactctactagcatacaaagacgagtacaacaacaaaatctatactattcgatatacctactggttcacgatttttaatttcttttgaaacattctatcaaaacaagttgacattcagttcagtaaaatttcgattcgtcccaacaaaatattgagcccatctctgcaaagcagcaactcttaatgaagtctttagtgatttaaacaagcgacagaccgcgaaccgacatgttgcttcacagtaactgcaacaatctacgtcgcgatctgctatgtgttgcaaagctaccgcaattcctcttgaggtaaccaccatgccagcgccccggatggtaaattaatttgcaacaatttaaaatttatatctcattaacaaatggagccttcgtgtagttccgctgctgcttttatacaccatctacacatggttctactaggaaggcgcgtggtatttagtatagcagtttctcagcacagcatccctctatcttcgttgagctgttacagctcaaacaagtggaacgagcgaaataagaggaaatgaactgattgcctctttagcttctactgtgagttgtaaatctgtagcggctcgtagcacttattacacaaattgtaataaagtggacttactaaagacagctgcttcctaatccaacaaaaagctttctattgcattgactggttctttaagctggtcaacctagtgagtgacatacatttgatctgtagcactaacagtaaaaactaagcgaatctaagcaaatataattgagtaatcaaggtctctggggcgcatgacagcttgagcggctgttcagaaaccaatctgtgaactggaaagagaattgagtcaatcagatgtgattggaggtgtttaacaagataagatgcacactacagaaaataagcaattatgtgttttaaaaaacagctcctagctaactattcgtggtgatcgaactgagtagcattaaacagagttaattactatcctaaggagtaaccgcaagcagtttacggtatggttccagtcgaagccatgccgcgaggcgcctctactctgtacaatttgtacacgcctgtcagaacatagtgccgttgacgaggggaatgtatgttgacaaccgtaaaataaaggatccctatggtggttttgctgtcgcacatgtacgtcgaaaagacgtccatcctttctcggatggtatcatcagaacaaataatatgacagctcttatgataacagtgggagcgcaaaaatcgcatcttcaagcgcctttggccaaatcggtttgccgacgtcaatgccgataaccggcggcgttctccgatgggacctttacacacattcgttgatggacgttctgcaaaaggaaagagagaattatcacttgttcaaatctcatgatccttaccgtagtgctgtacactgcactgtcacttaatatcgcatactttttattgcaattataaatagcagtgacgaagcaaagtgggagatcttcagtttttccccataaatggaaattatttttaattggactttctttatcgcccattgcgaatagcgtacaaacttactcccgagggagcacttgatggctagtcagcttagtttgagttggacacacggacagaaattaattacatacactacttttgctcgggtgtaccagtagatgaagagtggaggcagcaatggcaactccggacagcggttaattgacgatctattttgaaggaaaaacggaggcaccgttaccaatggacgtgaccggtagtgcatggtactggcttataagcacatgatgcagatgatagaaatacttacaccatcgtcgggcggtttgtatgatagattgccggcattgatcgcgatgcaggcggcatgaagtcacctacggaggacgatgacgactgacccaaattgaatcgcatccattggaatctttctacgcgtcgtgtagtgcgtgggcgcatcattattactatccatagagaagcgtgggaatcatacgacacttttcgatcaaagcatacactacccaccataagtatggaatcgggtactgtaacacgtaaaaagtttggcaccacctgaaattaatgttatttcgtaattttgaggtttcagatcaatatttctgggattatcttttgattactatggtcggtgttcccttagtagacagtcctctatagtcgcactagtggctttttacggccgttttggtataaatcgtttcaaaatattttttgacatgaaggtcagaagatatttgtctaagtaccattgatgcacagcatgattttgttcaaaaaatgatcgaaataattagttttgcttaaaatttgagctcccttgcgcctatagtaaacctattgttcctatagtagcactgcttaaagtaactattttttatttaacgaaactattgataaattaagaactttctttaagtcaagcgaaagtgtttgatccacacttttaaggaaaaatagaaaagttttgtaaaaatacggttctcatttgtattttgccaactgtggtgctagtgctactataggaattagaaatagtgctactataggcacatattttcctatagtggcacaagcgataatgaatacaaacatatgagttttcgttgttttcatatttttcctacaaaacctagataaaaagctttcagatgatgtatgaataatgacgctagcgttattttcgattttatatgaatatttgtttttagctatgcggctattggtacatcgaccctactatgatttttttattttgattccaaaaaactttaatctatgcttatcttgaaggtgctgcattactcagtattgcaacgatttcatgctttcggtgggtaatgtagatgaatcccaaaacatgtgaatgtgtgtctgatgagtcggcaactatcatcgtatacgatatacattgtacaatgtacaaagcttcgaaacccaccgatcgaggatctttttgtaagggaaattttttcgactttccagtgcatatcttcgcatctgccacacgatatacaagtaaaaatgatcaatcggcaaagaaagctctcagtaattatcccagctcccagttattatcagcatattttctactagactattctctacaatttattataaaaaaaactgacatttttgtatttctatcagtgacctactcatgtattattcagcagagtcagctctcggtaatgagcgaacgaatcacgattcatttctaaagagtgacaatttgtgaacatgtccacacagagcattttacaagtgatcctatctaccgttttgactcatatttcgaacacctaaggccaacagagatttcaaatgcatctatgggcataaattagctgatatttctaaaaattttgatttctgttgggtgtcttactgttagttgttgggtgtgccgataaaaataattattgaaatttgtttagtattattttaatacaaagttatggaacaacattttgattcaaatgccaaacactgtgttcaatctgtctcatattccgaacactttgtttcaaattgcgaataacacgaataaatcatattcaaataaattatttcgcaaataaattcatctaagctaattctactaacctcaagcttgagtctcatcattactctggaggtgtaaaatatattagaaggcccttaaattgaattgcaattaactgccattttctggtaatttgataacatatttcaacgaaagatttcaaccaaatcgccatacaaaattcgagagttcgggatataagtctgttcggaatttgagacaaaacggaattttgttaatgagtcgcctgagtaaaagaaaaaaaactaaaactcttattgctcagtgaatacttaacggatttcaaaatatatttttgtcagtatactggtcagtgctgtaaacatttgaccctttgcgcgaccttcgtttcgttggcatggtcaacagtcattttatttttctgcattcaccacacaacatcaaagatagaatgcacatcgaaaaacacaaaaaactgtcaattgaatgtcgtctgacacgatgacatttgcttaaatcataaattttgctcagaattcaaacatattgaatcataaacagcatgcatagtttggtcttgcttgttatgtcgaatgtaacacacttgaacatagctttgattacctcttaactaaattttttttccaagttcgttaagctttgcgttaaaccgtaaattgtatacaccacgctattcagagccccagcataagaggtgcacaatctcaaatcaaaagctacgattcattcaagtgctatcctttgcaaatctcataaataaagcaccactggccacccacatagagagccggacggatgcattgtaaacacttactcacagcaaggtcatgaacttgtgaactaacgcgacctgcagcgcattatgctcttcagaaattgcataagatcccctcatgtagtttgttctgcgtcggcgggaacatgcagtgattgcatcatttccttgacttgctccgcaaaacaagcgaaccatcgtttgaagataacaatgatcctggtattatttgcaattctttattattggaaatgttcaattaagtgcaattcagttgccctattatgccggatgaggtaaacaatttagtgcgttttgaggcccctagcaggaagatgatcaatcaattatctaataattatattttacattcatttgaaactaatcgtaaaaatcaaaagtagacgcaaacagttaaatgacaattaaaaaattatcaaacttgttgtaaacaatcggaatgattcagtatgccattttttatacatctttgaaatactttaatcgattaaaacaaaatttaaacaagcattttttcatccgatttttatattgaataatatatactcaattattattatatttattatattattttatttttattttatattattttattatatattatttgaaagaagtttaggcaaagctagaaccaatggatgagttaaaaaatatctctctgaatcctatttataatcaaaattcagaaaagtcgcccgccaagcggctctgttcgtgttgcaacacataattgctgctgcgccaccaccgtcgatggaacacatatgggcattcatcgctggcatcacgatacgcccatctccgctagtacaataggaattcaagcggtctcaaaggtcgggtcatggtatgtttactcacattttcccgttccatcttgttagctaatgataaagatgggcttgggctccagagactaacagatagctatcaagaacagctaagacccaggtctcctctgctatctagcggtacacgctacagtcatcgctatcgctgtttcaataaaaggaatggggtaaaaatattccaattaccaaccccaatcatcccgcaagtcggatcagacgactaacgttggactcaatagcaaaatatctttttgcgatttggttctcttattagcctaaaatggatcacatacaggcacaccgctgctggtcggtcagatctaggcagctctaatcggcacgcccgatagcatgcactcagtttagttttccgtcactccatttttgacgagggtagaagaagatgttcccatggaacacatgacaagaaaatgtttatgatatgtatgcactcttttccgtagggttttggatatagagagtcctagaaagagtaaatatgaacaatttagaaaatgaaaagattgttgatataggtacttacttatttttaacaagtaaatgacaatttttaaatctcttaaattgatttaacatacttttcagttaatgtcatagtagcaataattgggttaattctacgagtggcgtgaggtgacaattaggcccagatagccgtagcggtaaacgcgcagctattcagcatgaccatgctgagggtcgtgggttcgaatcccaccggtcgaggatcttttcgggttggaaattttctcgacttcccagggcatagagtatcttcgtacctgccacacgatatacgcatgcaaaaatggtcattggcatagtaagctctcagttaataactgtggaagagctcataagaacactaagctgagaagcaggctctgtcccagtggggacgtaacgccagaaagaagaagaagaggtgacaattgtcggtgtcgtatttgatttgcacggcgagtcacttcactcgagtcgagaattgtcacctcgctatacgacaccgacaattgtcacctcacgccactcgtagaataaacccaaatatctaaaaatattacgccttgtgctctgatatatcggtaacacctcccccatctatttggcgttatgacctaactgtgacagagccgactactcagcttgagcacttccacattatctgagagctttctttatcaattgatcattatatcatgtgtaccgtggcaaatacggagatactccgtgtcatcgaaagtctacccgtgggatttaaacctacggtcctcagcttgatcttgctgaatagctacctgtttaccactgtggctttttgggtcccatatccattacgttctgccataaataacctttgctccaacatcaacgtaattcatatgaagcagtgtgtacgtacgtatgtatgtacgggtatgtaaattacaatcacatttgtttttgtatagcccttatacgcatcaaagaaagcgtagaatgcgcaattttgaagcccagatgtttgtaacgatgaatgctattatgttgcagtaaaataagcatctagttatttattctatcaaatgtatgcatgttacaaagtaacatgtaacatataggttcaattttgtcgttcgaataaatttcttgttattttcaattacaaacggagcctctaatttgcgaatactaaaaggccaaatattagttagatttgaatgttcaataaaacaaagcaaccaatatacgcgttgtgcataatactcctgttgaagaatagaaagattttgataagtaatcattgcccttaaatcttcgaatccgacgatcatgactttgtagcaaaggtttcatcatgcctaattcatcaaatgcaattggaggacttattgtcctacttttttgtcaaactaacctaagaaataatagcaacacaatgaaaatctaagctgaaaaagcgacaagtagatccaatctgcgggatttgaataacatacattcaacagcgccatgtgtgatacgaaatattgtattaggaagagttgacccttttccctgtctttctgcctgattcgcataagcgctggttgaaatttgctatcgatattggtcactactgtcaccaccagttagggtagaagcaccggttttggccatacgccagttgtagccatagtggattatacaccgttttacatagccaatcaacatgaaaccttttgtgtgcagtaggtcacattcatatgatagagctacattcatttacttgtccaaattgattcaaaacataagaaaaacaataaattttccttataattttagctcccatacacctaatttggccagggcactcctaatttggccactctcatgagaaatcaatgcaattggccaatttaggaacggaagttaaatctctggccgaaactggttccgttggcctatattgaccaacgggattatcaaagcgaaaaaatggttttggctcagttttgatattttacacatataatatggattgaaagcttgcatttgacatatttgttgtaaaaatacggcttcccattcagtttttattgacattttctcttaggctggccaaaatcggtgcttttaccctagtgctgtagttgggagacaaaaaaaaaacaaaatccatgaccgccacaaagcgacacacggtgaccgacgcggaagtacaatttgttgcaatttttatgattcattgttagctatcggaaggtcagcatctctggacacgagccaccaagcatgctgttacatgctgcacattggacatcacactaagccactctaattaaccatgtattgttttctcttatttttcgcaggtctgccaacttttaccagtctaccatgacttgtgaattgtccgatatggaccgcataacgctagccggatccagtgcattccaagttgctgagacatctgactacctggaaaacaactgtgccgaggagccaacaaaactgtgcgaattcaaacgtatgtccggtcgtatcctaaagacagttgattccgtttaccaggacgttgccagcgttgatgaatgccgtgaactatgcctgagctcaccatatcgttgccactcgtacgactacggagataccggagatatggtctgccgtctgtctcaccacagccgtgccacacttgccgacattcaggatccttacctagatgtgccagaagctgccacctatgaactttcctcgtgctacaatgtttcgatcgaatgccgcgcaggagatatgattgccaaaatccgaacttccaaattatttgacggaaaagtgtacgccaagggtgctcccaactcctgctctgtcgatgtcaaaaactcgcttgaatttgagttgcgcatggcttatcaggacattgactgtaacgttcgccaaaacggtcttggtcgctacctcaatgacgtcgttattcagcatcatgataccatcgtcacatcttccgatttgggacttgccgttacttgccaatacgatcttaccaacaagacagtttccaatgatgtggatctggatgtcaccggagatattgagccagcattgtccgaagaagtggttgtcgattcacctaacgttgttatgaagatcacttctcgcgatggatctgacatgatgcgcacagccgaagtcggagatccccttgctctgcgattcgaaattttggacccacaatcgccatatgaaatctttgtccgcgaactggttgctatggatggagttgatagcagcgaaatcactcttattgatgcccgtggatgcccgaccgatcatttcattatgggaccaatctacaagagtgcaaactctggaaagatcttgttatctcatttcgatgcattcaagttcccatcctcggaaatggttcagttccgtgctttagtcaccccatgtatgccaacatgtgaacctgtacaatgcgaccaagacgactttgctgccggagaactgcgctcaattgtatcctacggacgcaaacgtcgctccatcaacgccaccacagaagaacatagcttccgtcgcgaacgtcgcgaaactactcatcaggctcctcaagatgacatgctgcttgtccaatctatccagattactgataaatttgggtttgaaaaacaacaacaagctaaacctaaaatcagcaacagtgaaacagtgttcgttgcctcatccgattctcaaggaatttgcgttaatggacttggtaagctaattattacgcgtgcaatgttttcgtcattattaatcatgtctcatgttaatataggtctcattgttgccggagccgttttccttttgggacaacttgccattattgccatttggacctttatgtggcagcgtcgcaggaagcaacgtcagttcgagagtgcatcgatgggatcgtcagttatgcccagccccgcaatggttgccagccgaggggattccatgtgcaaactttacgacagtggctacgccggaaggcacttctaagacatctttttcctcctgctatacatacaacacatataccacataaggctgatctattcctacatccccataaactgcagattaatgcccttcatgtcgaaacacttcattgcacaaaaacatcatcacatatttctagattccttagagcacatccacttgttttaggattagcatatgttttttccttatccagctctagtagagctgcatggaagaaagtcgagcaacggacatgccattcaatggttcacttaattatgtaatgttcttcctagaactccatctgctacggaaaaatgttttgacaactagtattgttgtatgagagacgatattggaagatggatagtactagaccagtattcgaaactctcacatccgcgcgccttcagttttccttaaacgctaacttttgcacctcttcggtaactctccaacataaaatgcaggaatcagtactctatgtagacggcacttcttgaagatctactaataattcaattatccaactaaaccttatgttttacattcccaaaagggagaataggacgactggagtatataaatgaaattcgcatggaacgaatgattgagagtggagtgttttaaaccgatatagtattctagcaaaaaaacgagttagcgagatataattgtgtgtttgaatttgttgttgtgtgagtgtgaattaggtttaactaatttgtcttgattgagggaaaaatcgaactctaacaaaattatctttttagcacaatcgatttatacccttttgtccttttctcccgagtactaagcatagagaattggcgattttttgctaaaggcacctgtagctcagagttcaaacaaacgcgaacattttggtttatttgagctccatgcacacaaaaatacggaccagaagcgaaaaatctctctctcttagctcaattttaagcatttatcataatttattttttttattcaataacaccctacatttagaacctctcagtgcagttaaacaacactagctaaaaatgtttcccactctgctttgtaatttattttagaact

SEQ ID NO: 94 - DNA, 3489 bp, Aedes aegypti
agcagatctacgtccacgtcgtaatcgcaagcctcgatgcaccaggtcattccgccgacgattttgtcgaagatggacaaaccctggatatgcgcccggtagtacccggcccccaccaggatgtcgatgatttcctgctccttgcgcttctgttcctcatcttcgcgacgttccacctgattatgaggtacggaaacataagaaaagtggagagatctttgggggatttggggaacttacctgaatctcattgccatcagcgtcgaaacgagtggccagtttgatgtttggaaggtgcttactgaaaagattcttcgaacccattttcctcacattctacgttgattacaatcacttttttatgaaaaattaaaattacaaatttccgatgcaatttattttgtgataacaaaaatgcacttttatgttgtcagttgaaaacagctgattttgacaaactcaatgcaactgcactggagtggtatcagctcccgggattttgagcacgtttcgagtagttttgacatgtctgcagctgtaactgtatgtttccgaagggcttcaatctaaagttggcgcgcaacgatcaagcgatacaaacaaaaacttcaagttccaacgctcttcaaaagttaataatttttgtgattattcagtgatttccgcctgaaaacctcgttcaaaatggctctctgggttgaccgttaccgcccgcgtgaactctcgaaactagactaccacaaaacgcaagccacgcacctcacgaacctttgcgcccagggagactttccgcatttgatgttctacggcccgtctggcgcaggaaagaagacccggatcatgtgcctcctgcgggaactgtacggctcgggagtggagcgtctccggaacgaagtgatgaactttaccaccccctcgaatcgcaaggtggaaatcatgaccgtcagcagcaactatcacatcgaagtgaatccatcggatgccggaatctatgatcgggttgtcatcaccgatatgatcaagcagattgcccaaacgcaacagatcgatcccagtgggcagcgcgagttcaaaacgatcgtgctctcggaagtggacgagctgaccaaagacgctcagcacgccctaagaagaaccatggagaaatacgtggccacctgccggttggtgctttgcgtcaattccacttcgcgagtcattccggcggtgaagagtcgttgcttggggattcgagtgtcggctccgaccaacgaggagatcgtcagtattctgaacgtgagtatttccaggcattttcattattaagacagggtatcgtaacgttaataaattacaattacaattacaattaagagactatcacacaaaccttaatcccttcacagaacatctgcaaaaaggaaggtcttcacatcccctcggagctggccacaagaatcaccgagaaatcggaacgtaatcttcgtcgggcgattcttatgctggaagcctgcaaggtccaacaatatccgtttacggtcaaccaagaagtgccggaaatcgattggcaggtgttcctccgggaaaccgccaaccagatcgtccaggagcaatcaccccaaaagttggaagccgtccgggagcgtctatatgagcttctttcgcagggcgtcccatccgatatcatcttccgagggttggtggagaatctagtcaaaaattgcgacatgagcctgaagacgcaaacgcttaactttgccggaacttacgaacatcggatgcagcagggaagcaagcacatcttccacctggaagcattcgtggcgcaattcatggcactgtataaaaagttcttgaatcaggcctccgcgatggacatggatgacttctaggctgcccggaaatctcgaaattgcttttctttctttaataaaaactaacttccgtcacttacacaataatgtttattaaactttcaatagttctgataatgtttcacccggaagagcgaaaccacaccctcccggctaccgatggccaagaaaccaccccctggggagaacgctacacgtgttacgcttcccagccccgctttaatcatggggaaattccggaacaccgttccactcttcatgtgtaccaactttaccgcatccggcacttccgctgaagcaatggccaacagctcagaagttacgttgaatgccatcgatcccaccgaagtggtcaaattggacacggttttctccgggctaggatatttctccttgaggaccttttccagcaaatagatgttgacgattccctggcgatttccggtagctaggtaacggttatttgggcaaacggttataaatgatccgtttacacagccctcgtctacgaagacattgacgaaacgacgtttctccaagtggtatatcgaaacttcgttatccgtgctgtgagcaataaggtacttcgaatccggagtaaaacataaagacggacaagcgtttttctgttggatggtggttagaagctccttgctcctagcgtccagcaaatgaatctccccgaaacccccagtgacggccaaatacttgccacagttcgacagctcgaagttcttcatggtccaagcgccatctcctctcaactgcaacgtgtcgctctggccagatatcaaattatacacatgatagaacttccggaaactcccaaacaacacctcgtttccatccggggtcatccgacagcaagcgatcttaaacctcttcagcccaatcgtgtgcagcttttcgttcttcgtgccatccaccgccacaatcgaggctaatccatttaacccagccatgaccgcaaccatcgaagtgggatggaagttaatcgccgtaatttgtccttcgtttttggtttctcgattcagattcttcaatcgcttcaactcaatgttccccttgggcaaatccaccgttgatcctttcactacatgtccgaccgttttcaaaatctcatcatctgaatcaatctcccgctcacggtccaaatcggcccacttcggttggccaacgatcttctcgaagttcttcctccgccgattgaccgtcgctcgcatttccaccttcctttccttcttgggaaaatcatcatctctctcatcgtccgaatcttcccaggccgcggaacgttttcgcttcttcgtctccccgtcatctgactcttccccgaaatcctcgacggaagccttcatcaaattggacacgagttccgcgcgtcctccgaataccagcgacattagttccttctccttgttggttttgggcttatcgataagctgctcgtccaactgatccaacacatcctcctcccgattctccgcttcatcttcactgtccccatcctctttttgcttcttgatcaacttgccttgttccctatcatcatcctcgtcctcttccgccttaacatccggcgcttccgcatcggatccctcctcgccggattcatcactcaattcgccctgaccgg

SEQ ID NO: 95 - DNA, 65084 bp, Aedes aegypti
  misc_feature (5512)..(5974): n is a, c, g, or t
  misc_feature (27506)..(27897): n is a, c, g, or t
  misc_feature (30764)..(30863): n is a, c, g, or t
  misc_feature (36130)..(36320): n is a, c, g, or t
  misc_feature (41690)..(42324): n is a, c, g, or t
tttatcaaaaattttaggacccaattgccggtgcgagcgctaagttaaccccctaaaaggtagtttttaccgcacaatttttttagaaagctcagaagaaagctaacctggtatttaaaacaccttgatctatcggtcttctgtcaaaaaactgagctttccggagatgacataaaaagctccgcttcattcgcatacccgcgagcgcgagctgaccgaaccgagtatccttttgcttgaatcaacgtgaaaactgtgttcgaaattttgctcgtcggaaaatcccgaaattaggcgtaaaaatcaactgattccgtggtaaagtagtgaattaatgtgctgcgcatcgttccgcgtcgaaataaggtgaaagtccatcatttgaagagtgatttcatgtggaaaaagtgattggaatcgatcgaatcggtgtctgcctcttcttcttggtgtttgttgactctcgttccgttgaggtgaggttatgttcgcgcgttttcattattgacagtttcgcgagagaaagtggcgacggagcaaaaatcaaaacaaaagtgatatcgattcggaagttttgaagcgaattttcggaaattaaccatgtttggccccaagcagggaggattcggccaaacgagtgctgccgggggatttgggagcacattcggaagcaccacagccacggccagtccattcgggcagacgagtacctttgggaagcctgcgacgactggggccttcggggctacgcccgcttttggccaacaggcgacgccttcgctcttcggacaaacgcaacccgccgcaggtggactgttcggggcgagtaccacggcggcaccggctttcggcgctccggcaactacccaatccggattcggaggtgagtgacgtcactgattctatattttactgcgacgcaatttggtcgttcccagggctggtagcaggtttctaaagtatcttttttatcattatcgaactcgccaaaaacgaaaagccactcaaataaagataaataataataaccagtaatcttcaaaaattctagcagtgatttctctagcctccatgaattctttttgaaactttccaggaaaatttaaaaaatatccagattatctttggagaatctcctgaaaaaatccaggaagtatttctaaaagaaagcagaaactttttgtaaaaatttaaattaaaaatagaagaatcaatgtagatttaaaaaaaatcgtagaatgttaggaagaactacagaagtaatccttaggtgaaattatttaaaaattggagcaattttgggaagaatcatatcaggaatacccggttgatgttatgaaaagtacaaaacctataagtcctatgaaaattcctaaaggattatttgcagtaatttatggaagaaagtgcagatgaattcaagaaaaaataagtagaaaaaacagcgtagaaactccaggaactcctggaggaaatctcataggtcagaaaattttgaaatccataaaataatatctggaataaacttatcaggattttcttagatgaagttcggtaggaagatctgctagagatatcgatagaacagtcgaagtaaaataactctattttgtatggagaaaagtcatctaattaaacatttctctagaatgaaagatttggtcgaaaatttgaccaaaaaatcctccggagatttgtttttcaagaactcttccgggatttttttttggggctccaccgggaattccttcggattttctccataattcgtcctgattttttttttcgaaataactccagaactttccagagttcctcgagtacaggcaaacctccatgaatcgattactgaagttcccatcgactcatagaacagaaatgctttggaaagttgattgagaggaccatcatagtaaacatgaaatggaattcttctgaagttgcttcgaataattcactacattccctccggaagtttgtccagagttcctcagaaaatttctcgaaaagtttctccggaaatttctctagacttctactgggaactcctctaaaaattattccggatttccatcggcaattcttctagatatcatccagtaattcctcggaacgtcctccggattccaccggaaattctcctaggtttcttccaaaaattcatacagcgattcatttggatttctagaaagttcctccttaatttctttccaactgtgggaagcaattactccggtgtttctctagaaacgcttccggacttcctccagtaacacttccggagtttctccaggaacgcctcctaagtttctccaggaatcgcttcgtagttactccaggatttcctttggagattttctagggttttgtctaaaattcctacaggaatttctttagagttccttcggaggttcaccggtgattcctcctgagttgctccagaaattccactggagttctttcagcaattcttttggattttatccagcatatgcttcgaagtttcttcaaagcttcaggaaaaactccggagaaatttctgaaggaacgccggaggaattgtcagagcaccaacagaggaattcatgggggaaactcggaaaattccttgaggaatacccgaaagaactacgcaacaattccaaaggagttaagaaggaaatccaaagttcttcccggtggaactttggaggaacttcggaggatatgctggatttgatccagaagaattgttgaaagaactcctaaagaatttctgaaacaactcagtaggaatgaacggtgaagcactgaaggaatacccagagaactttaaaagaaggaaatccccggattatttcttggagggaattctcggaaaagttcttggaagaaatccccgggggcatttttgaagaaaatcctctaagaaattccatgaaaaaatcttcggaaaaaatcttgcaaatttcccaagaactacctggagaaaatttccagaaaaattcgctgaaaaaatcccagaaagaatttctgaagaaaatccccggagaaatttccttatgatttttttgggtgaaatacccagaagaaattctggacgaaatcccctgaaggaattgctattggaaatccccttggtgattcctagagcaaatctccagggaagtttctggaggaaatgctcaggggaattcctggaccaatctccggaggtgcttctggaggaaattcccgaagcaattgctggaggaaagcacaaaataatttctggacgaaatccccgtaggaattgttattagaagtcccttggggaattcctggagaatatttccaatagaggtcttgacgaacatccccgaaggaattgctatttgatattctcgaagaaattcctggagtgaatccccagaggaattctataaaacaatctccggaggaatttattaagaaaatcctcggagaactttcttgatgaaatccccggagaaatttcttgttgcaaatcccagaaggaattgctattggagatctcctgaagaattttgaagaaaatccccggaggagttcttgggggaattctccggaagaaatgcctggagcatatcgtcaaagaagtttctggaggaattcctggaggaatttttggacgaaattctcagaagaattcctggaggatatcccagaagaagtttcgggaaaaaaaaatcccagaaaaaatttttgaagaaaatcctcagatgaatttctggataaaatcccaagagaaaatcctggacgaaatctccggaggaattgctattggaaattccctgaggaattcctggagaaaatcccatgaggaattactattgtaaatcccctgagaaattcctggcgaaaattctcagaggagttcttggggatattggcagagtaatccttgaaatccccggaggaattcctggagaaaatccccacagaaattcctggttgaaatcataagagaaattcctaattcaaatcacaagagaaattcctgatggaaatctccggaaaaattctctgaaaaaaatatccctgacagattttttgaagaaaatcctggacgaaatccctggaggaattccttgctggaaaaaatctccaaggaggtctaggaataccctcagagagaatccttgaaattctcggagaaattcctggagtgaattcccagaggaattctggggggaaatctccagaggaattctatgaaataatctccgaaggaatttctagagaaaatcgccgtaggaagtcctggacgaaatccccagaagaatttctggaagaaattctcggaggttcttggggaaatacccggagcaattcttggtgaaaatctcagaaagaatttctagactaaattccccgaaaaattgctggacgaaatccacagagtaatagctattgaaaatcttctgggaaattcttggagaaaactcgcgaaatcatcaaagaaatttcttaagaaaatcccaagaggaatttctggacgaaatccacggataaatttctgaaggaaatacatacccgacgggatacctggagcgagtccccggagaaattcttgcagcaaatccccgtatgaatgcctgaaagatattccctgaggaattcctgaaaaaaatccctgagtaaatgttgggggatatccctggaggattccttgaaaaccccgggggacatttctggagaaattcctgctgcaaatccacagctagtttaaattctctgaaaagtccccgaaataatttctggagaaaatccaaataagaatttctttatgaatttctggatgaaatcctggatgaagaggaattggaaatgccattggaagtcccatgagaaattcctgaagtaaataccggaggagttcttcggagaaatcttcgggggaattcttgaaaagaatgtcccgatgtaatttctgggcggctctaccggtaattcttttcgagctacactgggaactcctccgaaaatttcttcggagttttatttggattttcgagatagttcctccaataatttaatcggagtttctccaggaatgctccagtaattcctaggaaatcctccgaagctccattaggaatccttctggagttattccgagaattcccctagatatcctccgggaaatcctgcagagtttctccaatacatcctcaaaaaaaaaacggaacaataaaaataccgacgaaacacgaaactgcacgtcactttgttttaaagaatagcaacggttgaatcggttggatagcgttgccaaatatacaaacgcactgttaaccgacaggataggttgctgtttctcatacgtgtttagcaacgaccggtgcaatgtcgcgttatgatggtcgttagcaatttgtgtttatttacgctgcggtgggcatcgtgatctctttccggtctcattttggttcctgttttcaagcatgcggtctctaaagttcccgatttaagaacactcagtactaacagctttggacttggtcactttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattttcaaaattttattttgaattctctgcagagctttcttcctggtattacaacagctagtccatattggtacagcatacaacatggctggcctgaaaatttgtttgaatatcaaaagcttgttcttaagacaaagttttgattttctattaataaggggatagagacattttacatatttgttacatttggcttgaatgccctcaatgtgatttttgaaagttaaattcttatctagcatgagtcctagatacttaacttcatctgaccaatttattggaacccctctcatcgtgacaacatgtctacttgaaggtttcaaataaagagcttttggtttatgtgggaatattattagttgagttttggaagcattaggagaaatcttccatttttgcaagtatgaagaaaaaatatccaaacttttttgcaatcgactacagatgacacgcaggcttcgtcctttggcggagaggcctgtgtcatccgcaaacaaagatttttgacatccctgaggtaactcaggtaagtcagatgtgaaaatattgtataatattggtcccaaaatgctgccttggggaacaccagctcttacaggaagtctttcagatctggagttctgataattaacctgaagtgtacgatttgacagataactttgaattattctaacaatgtatgttggaaaattaaaatttttcaattttacaatcaaaccttcatgccaaacactgtcgaatgctttttctatgtctagaagagcaagaccagtagagtagccttcagatttgttggaacggatcaaatttgttacacgtaaaagttgatgagtggtcgaatgtccatggcggaatccgaactgttcattggcaaaaattgaattctcgttgatgtgggccatcattctgttcaaaatgaccttttcaaaaagtttactgatggaggaaagcaaactgattggacgatagctagaagcttctgcaggatttttgtctggttttaaaattggaacaaccttagcatttttccatttgtcaggaaaaatatgctaattgaaaacatttgttaaatatatcaactaaaaaatgataagctactttctggaagtttcttgatgagggatgtagaaaaattccatccatcgccaggagcttttcatattttttgaattttttaataatagttcttacttctttcaaaatcaatcttccaggccattttccaaaaacttctcttgattgagaatattttcgaactcctgagtaacttcattttcaattggactagtaagtcctaaattaaaattgtgagcactttcaaactgcatagcaagtttttgagctttttcgcaattagttagtaataatttgttttcctctttcaatgccggtataggcttctgaggttttttcaagattttagataatttccaaaagggcttagagccggggtccaattgagaaattttattttcaaaatttttgtttcttaaatctgcaaaacgtttcttgatttctttctgcaaatcctgccatataattttcatagcaggatcacgagtgcgttgaaattgccttctcctcacgtttttaagacggatcaagagtttaagatcatcgtctataatcacggattcaaattttacttcacattttggaattgcaatgttcctggcttcaacaatggaatttgttaaagtttcaagagcattgtcaatatcaattttagtttctaaagaaatgttaacatcaagattagagtcaacatacgttttatatatattccagtcggctcgtaaataattgaaagtggagctgataggattgagaatcgcttcttgggatatttgaaatgtaacggggacatgatcagaatcaaaatcagcatgagtaatcagttggctacaaagatgactagagtcggttaagaccaaatcaatcgtagatggatttctagaagaggaaaaacatgtggggctatcagggtattgaattgagaaatatcctgaagagcactcatcaaataaaattctgccgttggaattactttgagaattattccatgaccgatgtttggcattaaagtcaccaatgacaaaaaattttgacttattgcgagtcaattttcgcaagtcagtttgaagccaattaacttgctgtccagagcattgaaaaggcaaataggcagctatgaaagtatatttaccaaactgtgtttcaacagaaacacctaaagtttcaaaaactttagtttcaaatgacgaaaacagttgatgttttatacgcctatgaatgatgatgcactcccccacatgccccatcaagtcgatcattacgataaacaaaaaagttaggatcttttttaaatttggatccaggttttaaataagtttcggtaataactgctatatgcacgttattagctgtaagaaaattaaacagctcgtcctctttaccattgagagaacgagcattccaatttaaaatatttaaattattatttggatccattagaaaaacgtaatccaataacaattttatttgtaaattttacacctacttggactgcttcagtcatagtggtggctttgaacattgcatcaatcattagattcaattgttcagttagaaaattaaaatcagaggcagacatatcatctgatgatttcccattggaattttcggtagacgaagaagcggggtaggagttacctgtggcggtagggttttttccatttgatttgaaacaagtagaatgggtactcatggaacgaacaggggaagagttcaaattacctgctacgatatcggcaaaggatttaccgtgggtagatacattcgaaattgaaagattcgaacggctacccgacggattaaaatttgtttgtgaatgagcatgattatgatcttcctggtgggtatgattcctaatcaagcgatcgttaactgaaaaatgagcattgttcgatactctaccaggcaaattccggaaacgaccgttatcgtaacggatattatccttcatctgcttggcacgagcctcaacgactcttttgcgtgaaatgcattcccaaaagttagctttgtgagggcctttgcaattggcgcattgaaattttctggtatcttctttcacaggacagtcgtccttagcgtgagaagaacctccgcaaatcatgcatttagcatccatgcgacaattttttgtaccatgaccccacttttggcaccgacggcactgagtggggttctggtaatttcctccaggtttctggaaatgttcccacgtcacacggacatcgaacataagtttagctttttctaaagctttaatattatttagttcttttttgttaaagtgaactaaataatattcttgagaaagccctttccgaacaatgccagattgggttctctttttcataatgattacttggactggggaaaatccaagtaaatcatttattccatttttgatctcttcaggtgacttatagtcacttgagagacctttcaagacgactttgaacaaacgttcagttttgtcgtcataagtaaaaaatttgtgcttcttctcttcaagatatctgagaagaagttcgcgatctttaagagtttccggcaaaacgcgacagtctcctttctttgcgatttggaaggaaaccttgattcccctaatggagttcaagatctcctgcctaaatcccccaaattcggaacaactgaccacgataggcggcactctttgcttcctcacttgaatcaaagagcctgggctagaggctgcttcgatttggtgttcggaaaatttgtctagagcatcgaactgattgctcatttcaatacaattattcatttcacccttggaagaaacttcgcattccggggaagcgtcctttcttccattcttgccacgtgtagtgacagttttaaaacccacttttttggaaggaagtagtgaattcagagattcacccttccttttgttagttgttgataccatgtttagttaatgaacgagaaagacgtgaccttcgagaggttttttccctagacggtgtccaagaaggattaccaccgctagctttcgccaacgggtccaacgaaaaatcgaaggcacgggtccaaacaaggatcgtaaagggatcaatagtagaaaaaatagtactgaaaagttttaatcaagtagcactgaaaagtaccgtttttaattttagcactgaaaagtactgttttattgctttaggtagtttttaagaaaacttacaagagcagagagaattcgtgtacgcacagcacgaaggtacgatgcgcactgatcatttattccatttttgatctcttcaggtgacttatagtcacttgagagacctttcaagacaactttgaacaaacgttcagttttgtcgtcataagtaaaaaaattgtgcttcttctcttcaagatgtctgaaaagaagttcgcgatccttaagagtttccggcaaaacgcgacagtctcctttctttgcgatttgattcccctaatggagttcaagatctcctgcctaaatcccccaaattcggaacaactgaccacgataggcggcactctttgcttcttcatttgaatcaaagagcctgggctagaggctgcttcaatttggtgttcggaaaatttatctagagcatcgaactgattgctcatttcgatacaattattcatttcacccttggaagaaagttcgcatttcggggaaacgtcctttcttccattcttgccacgtgtagtgacagttttaaaactcacttttttggaaggaagttgtgaattcagagattcacccttccttttgtttgttgttgataccatgtttagttaataaacgaaagaagacgtgaccttcgagaggttttttcccaagacggtgtccaagaaggattaccaccgctagctttcgccaacgggtccaacgaaaaatcgaggcacgggtccaaacaaggatcgtaaagggatcaatagtagaaaaaatagtactgaaaagtactgtttaagtagcactgaaaagtaccgtttttaattttagcactgaaaagtactgtttgtgtagcactgaaaagtactgttttattgctttaggtagtttttaagaaaacttccaagagcagagagaattcgtgtacgcacagcacgaaggtacgatgcgcactggacttggtcactattttaatgcatgtctcaatagaaggtctctatagtctcttttaggcccaaccaaaatggtctctggagtaactttttccttctcctgctctaaatgaatcctggtgtagaattccaaagctttcagtgaaaccttcagagttctttattcgactatgaaattccttcacaattcttttcatacccctcaagaaaaagcctcaaaaattcttctagtggtttcttcagccatttttcgctaaactttgctaaaagagctatatgtaaaaatgagagattctttcctttctcgctcaatttcgattataacagtaaaaactaagtcttttggagagacgaaccagcctcgggctaaaagtctctctaataaagaaaaaaaatcttctgggacgtttttcactatagatcgatagattattatttattatttatttatttaacaaaaatttggaagagggaaaacccctttgagtgatttttatagaaatctttctcaaaaaggcacaaaacctcttcatcttttccaaaacgttataatatgaatatataatctataggctccaacggacataaaccataacagggccaagcgcttgaattttcagggtaaaataaacaaaaaaaaatgcacgagtatcaaacaatatatgaaatttcattcaaaaagtcaaataataatttcaaaatagaaggacatttgctaccaagtatatcacgaacagatccaggaatacaattcataatattttttaagcgattctcaaattcaattctaggtaggacatatttcgaacatacaaatacaatatgatcaatatcttcataaaaatcaccgcaatcacataaatttgaatatttttaaaccagggagaataatttactacaggacaaaaagaatgacaccaacgacctttgtcgcttgaattccaagaattctgccattcattcaaacaaaatgatttaagtttagaatagaattcggaagcaaaaatattacgattataaattataccacgagcaacacccagttttgctaaacaatcagcttgttcatccagctttttacgagcgctaatggccgcctcaaaaagctcactttctagtagggactaggcgatctgacatttggcttgggtcgtttgataccaaatcgataagatcaatcaaaaacttctcgattagctgtcaaacgacacaacccaaatgtcagatcgcctagtccctactagaaagtgagcttttttgaggcggccattagcgctcgtaaaaagcaggattgccatatttattacaatgaccaggtacccaaacaaatttaatcaaaaatcctcgggaaaataagtcaaataacgtttttttgagtgctaaaaatatgtagggtcgatgtaccaatagccgcatagctaagaacaaatattcgtataaaatcgaaaaataacgctagcgtcattatttttacatcatctgaaagctttttatcttggttttgtgggaaaaatatgaatactacgaaaactcatatgtttgtatttattatcgcttgtgccactataggaatacatgtgcctatagtagcactatttctaatttctgttcctatagtagcactagcatcacggcgttggcaaaatacgtatcaaaaccgtatttttacaaaacttttatatttttcctgcaaaatgtggatcataagctttcgtttgatgtaaaaaaagttcttgattcattaattatttcgtataataaaaaatagtttctctcagtagtgctactataggaacaatatgtttactataggcgcaagggagctcaaagtttaagcaaaactaattatttcgatcattttttgcgcaaaatcaaactgtgtatcaatggtacttagataaatagctcctgaccttcatgtcaaaaaatattttgaaaaggtttatagcaaaccggccgtaaaaagccactagtgcgactataggggactgtccactaagggaacaccgaccctaatgtgatttgaaattaaaattaatggaattcaatgcatgtagacaactcatgctgttagaacatactataaataaattttgttcacaatcattaattaagttacatgcatagtataaagcaactaatttagctataaaaattgaacaaggattttgtagtttcaaaaaatgacctaacacagtattataaactccaaaacctgcaacattttgaataagagaaccacctgtgaaataaaactgattacgattaatgccttcaaatttcctttcaaataataaattagctaaacgagaatgtttttgttttggaatttgtttcaactctttatatatagaaaaatcaattataagcggtttcttcacctccgcttaggcactaaacctattttaaccatatgggtaaacgtggtttacagcttaagcgaaggtgaggaaatcggcccttagtggttgaaatgtatgaacatttatattgtaattatgaaaaccaatagaattatcatgatttatatttaacaaggaggaacaataaatataagaacctaatattttacttgtgggattaatttcatataaagtttgcaaggtattaattattggatgattgtatgaaatgcattgaatcaaaaatttacaatttaatttgtgaaaacgaatttcaagaggttcaatgccagctaagacttcgacggattgagtatgagttgaactcattaattttaaacaaattcgtaaacatcgaaattgaatcttctctagttttgaaaaatgagtttgaatagcactaccaaatgtgaaacatccccattactgaacgaatagttgttttataaaggattatcatatcagaagggtgagcaccccaccaagtaccagtaatagtacggagaaaatttattcttttcgaacatactttctgaatatatgaaatgtgattcttccaatttaattttgaatcaaaccatataccaagatatttataatcaaaaacttgttcaatttcatagccgtttagatataaacaaatattagtgattgaatgttttctagaaaatattatatattttgtttttgaaatagaaaatgtgaaaccattattatgtgcccaggtatcaatgttatctaaggaaagttgcataaaatgtcgtatgatttctctgtttttgccactaatagataaaacattatcatctgcaaattgtaataaataacaaacattgagaataatagaagccatatctgaagtaaataaattatataaaaatggactcaaacaagatccttgtggtagtccaaaacaactataacgaatagttcttgaagatccgttatgggaaaactgcttaattattaaagaaaataaattgtaaatgaaatttgaaattatgttaggaatttttaaattattcattttatcgaaaagcaaatcaatcaaaacagaatcatatgcaccagaaacatcaagaaaagtagaaacaacatcttgtttcttgttaaacgaaagttgtatttgagaagctaggagcgcagtacaatcacgagtaccacgaccttttcgaaatccaaattgagaagaagaaaatattttattactctcagcccacagttccaaacgatttaataacatacgttccataagcttacgtaaacataaaagtaagcttataggtcttcgactatcaactaaagatggatccttaccaggttttgaaatacttactactttaacaaaacgccactcagaaggaataatattttgagaaataaatgaattatatatcgaaagtaaatattcttttccatcatctggtaaattttgaagaacaatgaattttatattatcaatacctggagcagtattattggttagtgataaggccaaattcatctccgctaaagaaaatggaatacacaaatcaggaaaatgattcacacatcttgttttgtaatttacaacattgggaacgaaacttaggcatattttggatgcaaattgatcaattcactcttctgaatattctaacacatttggaaaagtataatcataattcctcatatttctagctacggaccataattttgtaagtgaagtatctttttcgagactttctacaaatgttttccaatagtttcttttcttgaatttagtaattctagtgaataatgcttcagatttccgatatgaaaaataatgtttcctacaaccagatttacgaaatagtttaaatgcagcagatttattttttaaagcaatagtatacactcattattccaccaaaaagaagggcgctttttcttaaaaacacctggaacaatttttattttctgtgctttatataaacaatcagttaaaagatttgaaaaatgattgtacttctctatcacagaaaatgagttaccatcattatacaaagaaaatgatacataatcggcaaatttaatccaatccacattattacatagatcaggaacatgtacttcttgtggcgttttgttgtgcataggattttgaaattcaattgaaataggtaaatgatcactattattcggatcatcaatagttttccaagacgacatcatggataaactattagaacaaagagataaatcaatacatgatgaatcagaaggaggtactgcaattctggttaaagatccatcttttaaaatatttaaatttaactcatcaatcaattccaatatcaaagaacctcttccatcagagctatgactaccccacgctatattatgggcattgaaatcacccaatatataaaaaggagaaggaatttcctttaaaatacatttaatttgggataaagaaaaacttacgttgggaggtaaatagaaacaaacaatagaaaattcaaaaccatcttttctaattgaaacggcaatatattcaatttgtgattgtattgatatatccaaatatttaaattcaatattatttcgtattccaatcagaactcctccatatgaatcacaatgatcttttctaaaaattttgaattgtgggacatgtaaaaaattagattctgttagccaagtttcatttaaacaaaaaatatcggtatttaagagccagttcgcgagaaccgcaaccccctttccaagggaagttgtattgatgttctccgatcaggctgaaattttcagagattgttcttctatataaaagatgatgttttgaaaaatattagatttttatattagggggaagtgggacaaaatgacccccaatgatttcatgtcactaaacatgcaaaatcacaaaaactgatataactatagtaaaagtgcacggattatgttgaaatttggcatgaatactctacgttatatgaactttgagattggcatggtatatggattttgaatgtacttaaaatcgagaaaaatgagtttttcataaaaaaattagtgattttcaaatcgatttttttcttaccaaccgaactaggtcaaaaaactaaatatgacgttttgtagggtaactcatgagctttcatttgaggtgtaatctagatatgccgtttcaaaaattttcgaaaaaaaattttttttctgtgtagtgtttgaacttgagccattttgcgagtaccgcaaccgccttgtctagagaggatgttttgatgttctcagatcgagctgaaatttacaggaaatgctttcctatataaaaaaagatatttcgcaaaattacagatttttatattagggagaagtggtacaaaataaccactaatgatttaatatataaaaaatacaaaattaattaaactgctataatagcgatagtaggggcccagatagccgtagcggtaaacgcgcagctattcagcaagaccaagctgagggtcgtgggttcgaatcccaccggtcgaggatcttttcgggttggaaattctctcgacatcccagggcatagagtatcttcgtacctgccacacgatatacatatgcaaaaatggtcaatcggcatagaaagctcttagttaataactgtggaagtgctaataagaacactaagctgagaagcaggttttgtcccagttgggacgtaacgccagaaagaagaagaagaatagcgataggaaaaatgcacgaaattgtatgaaatttggcatgtttactttacgttatatgaatgatcattttggataaaaaaatgtttcaaatcgagaaaaacctgttattttgtaaaattagtttttttttaaatcgatttatttttggtcaaccgaactaggttgaagttttgtaggacaactcaagggctttcattcgcggtgtaccgtggtaaatcaaaatccgggcggtatgagcagcgtatggaggcctcttgtcggtagttgtaataccgattatatcataccgtgttgccgctgccatatctgaaagaaatgtcactttcttgtgaaagtgatgataacaataagtcattgcaccaatgttttcgttaacagcttcggcggttcagtagtaagcgttgtttattctcacgctgtttggatgggaatcaactaccgcatttttttgatttggataatgtttgatgggtttgattatgagggtcacatgtatgtgtgtatgatggtatgtttgctagagatcaatttgtaaataattgagtttaacttagtttaggctgactgcacatatggctgctatgagacactgtactgtttatatcttgagtggaattttgacttttactagccttgatgtttgcaaatttctcgaaagagtaaaagagagacgaagattgttaaaaattgcatatttacacggaaaattgtgtgtattttacaaaaaaaaaacattttttagtgcaatccgtttaaacggttcagtagttcttgtgatttttagtgttttctgacacaaaaatattgggggtcattttgacccacttttcccttataaaaagtgtagttctgccaaatgggtttctttttgaatagtaatgaacacatattgtgtaagcaatgtttgtgatttagttgtttggacagacatgttggtggtttaaactgcattcatcactgattggttcaatgaacgacgcacagtagtgttcttattacatatttttcatgttttgatgatgttcaaagtattattccagttttatttgaaaattgtgtacttacggcatcgaaacatataattccaatacaatgtccggattcaaaaacattgggctccaattccggacagcctctttttacttttttaaaccatatttacagcatattttttcaatgtggtgtcactaaacttttaaactataactttgtgtattattatgttacaatcactactgctgcgacgattgcctccatctaagcgcccctcgaacgcatgggggaaatgtcaagtgggggaatgagaattgaaaaaaatacctactcattgttgattgatcgatgtgaatgcaaaatcgtttgttaagtgaattataatttatatattattactatatgcttattaaaatcgaataattacagatagcgacctgaattaccctatattgaatttaaaaatttgaatttgtttgcctagtaagagaccaaatgtaagtaataaaaatatgctatacgattatctctaaccaataaatttatacctttgagctgatctcatcgggtacattgatgagtttgttgaacagacctccgaaaggccaatacgtcataataactactaaaacagctattttttcattcaatatagttgaataaatgttgtcaatttagcattttattggtaaatattatcagagtgtccggatattggtaccgtccgaattttgattcactacggaacaccgcgaatgaaagctcctgagtttccctacaaaacttcatatttagttgtttgaactagttcggttgacaaaaatatgagtcgatttgaaaaacaactaattttatttaaaaaaaataaacagatttttttatcaatttgaaacatttttctaatccaaataccatgttcattttgaagttcatataacgttaattaaacatgccaaatttcatgcaaattcgtttattttttctatcgctattatagcactttaattgattttgtatgtttttatatattaaatcattagtggttattttgtaccacttctccctaatataaaaatctgaaattttgcggaatatattttttatataggaaaacaactcctgtaaatttcagctcgatcggagaacagcaatacaacctctctagacaaggcggttgcggtactcgcaaaatggctcaagatcaaacactaccccgaaaaaaaatttttttcaaaaatttttgaaacggcatatctggattacacctcaaatgaaaactcatgagttaccctacaaaacgtcatatttagttttttgacctagttcggttggtaagaaaaaaatcgatttgaaaatcactaatttttttatgaaaaactcatttttctcgatttgaagtacattcaaaatccatataccatgccaatctcaaagttcatataacgtagagtattcatgccaaatttcaacataatccgtgcacttttactatagttatatcagtttttgtgattttgcatgtttagtgacatgaaatcattgggggtcattttgtcccacttccccctaatataaaaatctaaaatttcgcaaaacatcttcttttatatagaagaacaattcctgaaaatttcagcctgatcggagaacatcaatacaagaaggggttgcggctctcgcgaactggctcttaagctatttatcaatgctttcaacctatcgagtttgttaatgatgctgcgacaattccattgtaaaatattcaaactatttgtattttttgaagccattaggatgaaaacaaagatgcaatgagtggtccaaaattattcaatttatccaaaatagaagccacaaaaggtaagataaatttaatattttttttccaaaaatcactaagacctaaaaatttaactaattcttctaaaattttcaaaatggaattatcgctacctgcattttttctatctcctgatgtattattagtgtttgaatcaacattgtttgaggagttatcaactttttgaaaaccaggaatgattttggggtggggtattggaagcattgagtgaaggaaaatgtgtcttataagaagtagatggttgaggttcaaaagtaggaatagatttgcttgatgagttattataagttcgttttcttttgttcggaggattgtaaagaaaattatgttgtttgtcacaaatggttttcatcgacatctggtaataatgcaaatgaatttgaagtactaatattatcagaagatttcattatatcagcatatgataaaagatttttgtttttaatttttttttttcaattttgattgatgctcaatatatacagaacattctctcaaactagtatgtttttgtctacaataaatacaaacatcagaatttttcttacaatcttccgatgaatgaagatctccacatttggagcatttcaatttatttgaacaaaaattagatgtgtggccaaaaagaagacaacgctcacagtgcatgagcttagggtagtaaagtctaacatggaatatgacgttatcaatcataacataatctgggagaacagatccagaaaatgttatttttatacaatttggattatttggaaatatttggattcattaccactaaacattaattttgataaacgattacaatctaaaatactaacaggggcaatggatttgtttttaaacataccagtaccattaatcctaatgtcgtcacaatttaaatcttcatcgtatataactccattaatttcacaagaatcacatggagcatacacacgataagaatttacaaataattttgattctaaaagagagttggcatcctctcgagatgcaaaaactactcttaatttatcgagagaaattttcttgatttcttttactggtttaatttttttgtaaacctcagcagaaatcaacaaaacattaataggtctctccttttttctgaaataaactacatatggattcggaaaagtggatggataaattgttatgcggaaaggtttaactgaaggggtttctatagaatgatcattttcatttgaatctccttcacctgaatcagtttccataattgtagataaattcaaaacaataactaaatgtaagataggaataaagaaaaagaaacttatactttactataataatataataatgatacttatcgagctttcaacaaagaaaatgtgtagttggaaccaccaaattgaagatccaggaatcttataaaatccaaaaatcttgccgccactcgaacagcaatacatttgtcaatacgccaatcaaacttgaaagcaatcgccaaatcaacgcacaaacaaacgtcccaggaacgtagtcttcaaatcttccgagaatcagatcccaaacgcacgcaagtcccaagattgcacaaccactctttaacaagtccaaacgatccaaatacggtccttgaaacacctccttacacgtgaatcctcacaatcggaaatttttgagaaaatcgtttctgaaaaatggagaaaaaatgacaatctagatcgatagagaacttctcaatgttcttcttcttctttctggcgttacgtccccactgggacaaagcctgcttctcagtttagtgttcttatgagcacttccacagttattcactgagagcttactatgccaatgaccatatttgcatgtgtatatcgtgtggcaggtacgaagatactctatgccctgggaagtcgagaaaatttccaacccgaaaagatcctcgaccgatgggattcgaacccacgaccctcagcttggtcatgctgaatagctgcgcgtttaccgctacggctatctgggcccctaacttttctccctgtagtgaatccttggggaaattcttgagattccagatccataaatgagtactctctgcattttaccaaaagcttcatcaatgtttactgctgaatttcttctagtaaaatctcaagaaccaattcccgcacttccaataaattctgaaaaattccgtttgaatctttggaggaatctctggagtattttctgacgaagtcctttgaaaaacaactgaaattcataatgaattctgtagcttggaggaaatcctatgatgaattacgggagcggagggctgagaaattccttgaaaaaaatctgaaggaattctgaattattctgaagaaattttcggagaaatctccttactaatttctggaggataaaatactgatttcaatttttgaaggtaatccgaaagatttttttttggtagataaactcctgaacaaaaagggtgaataatcttgggaaactttacctttattaaatttatagaaatttctgaaatccgatcggtatttatatcttggcctttttctttcccagcattcggtcagccgcagcagcaaaccacttctctgttcgggacgcagaataatacggccccgagtacgtccctgttcggcactaataacaacaactcggcattcggagcggccaaaccggccggattcggaggtttcggacaacccgcggcgcagacttcgcttttcggccaggcaagcaccagtcaaaccacgaccggaggattcttcggccaaacggcacagagtgggggactgttcggagcgcagaagccagcttttggaggagtagctccgattggcgccggaaatggaacggcggtggccaaatatcagcaaacggcatcgacggacacgttggtcaagaatggtcaaacgaccaccgttcagaccaagcagcactgcatcactttcatgaaggagtatgagaataagtcggttgaggagctgaggattgaggattaccaagcaaaccggaagggacctcaagcaggggcagccggaggattcttcggagcacaaccggcgcccacaccatttggggcacaagcgacacaaccccagtcactattcggacagactacgacgtctcagccgagcacgggccttttcggaagcaccaccaatacctttggacagactacggcaccggccttcggagcgacccaagcaactgcatttgggaagtcttttggggctacggccacaaccaccagcttcggattcggccagaccaacaccagcactttgggaggcctgacagctaacaagccagccttcggaacgtccaccacagggctttttggccaaacggcaactccggctacgaacacctttggacagtccactttcggcggattcggagcccagagtcaaccccagcctgccggaggattgttctcaggaaccaccacaagcactgctggaggaaccgcctttggaggcttgggaacgcaaaccacccagaccggattcgggttcggatctaccacggcaaccaacaccaccggaggcggtctattcggtgccaagcccgcgagcacctttggagccatccaaagtcccttcggacaaactcccgcctcaacggcgccaactttcggaggcttcggaacggccaccaacaccggaggttccctattcggaagtaccttcaacaaacagccagctccagcgttcggactgaacacggccacctcaacgggtaccttcggaggcggcttgaacttcggcaccggttccggatccctgttcggaaacacagcgaacaaacctggcggtcttggcactggaaccggcctgtttggtaatacttccactctcggcgcaggaactggcggctttggaacccttggaggcggaggattcggcgcagggcttggaaccaacaccggaatgggaatggctggccagccaacccaagccgcagttcccatccaccagcagatcctcgccatggtcacttccccgtacggcgacaatcccatcttcaaagacatcaaacccttgaccggagccacggccgaatcccttaaaccgaccaaccctacagcccagaaagccatccttgagggcgccaaccagcagttcaaggtctcgcccaaagtcgccggaagtggcgttcgggtgaaacccgtcggagccgccaccctctccaagaaatctctcttcgaaggcctcgaagagtacgacagcaccctggaggaatccttctccctcaaaccaaacgccaagcgactcatcatcaaaccaaaggtgtccaccccaaccatcacgattcagaaccgagcagcccctcagcaaacatccggtaacgattccaccgccaaggacgatccagtcgccaaagagtccttccacaaccagatcccgctgaacccgatcgaggtcccatcctcagctcaagacaccagccgtcgcgtttcctggctccagtcgaacgccctggacaaagtccggcagagcaatcgcctctcggagtcggtgctggacaccacaatcaaggaattcgccccatcatcggccgcccaatccgcggcgtcgtcctctgccgccaaggatcccaacatctcgctggactccagttcttcaccaacgggttccaccggttcccaacctgccgggaaaccggacacgaccgggcgagtggctagcagtggaagttcgccgatcaacatgaacgattcgctgctgtcgtcgagtaataggtcgttcctgaatgacaccacagccaatgccaccggcatgggggatctgtcgctgatgtccaacagcatccaggaggaggcggaaccgcacccgaccgggatcgtgctacggcgaccggggtgagtacctacaagttttctgttccgttggcaatgaaggagagttggaaaatacgttttgggctataactttagtgtttcttgatatccttcaacttaaagtttgtacaaaaagcagtttcatttaaagatttgttcgaaattttggtctctgaagttatatcggaattcacatagatgttgcaatacaactaaattcaaaaaaagaagatttttaatataataatcgttgattttttactttaccttattatcgataaagtaagtttgttcacttttctgaattgagcctatttgaataagttctcgagaaatgttgatccaaaaattccgttcaggaataaatccctccaaagacataatgaataattttgcaaaggattactactgcaatcccttcagcaatcactacagaatacatttggtcgaaggaattccttaaggaatttctgacaaatttaaccctagtaaagctcgcggtaaacttccagtagaaaggggcccctcaagctgggtctcaaggccggcttactaccgggcaatcggaggggcttcgcgaccaacgtgcagatactgtcaccttacttggattatgtaaaaagtgtaattcaaaatgaaaaataatgggaaatttattgaaaaactattgcttatgtggtgtgggttgactttattgaatttactattgtgattgtgggtgtagagcgggtaattgattgaaaacttagggacttaccggtactgtttatgctgcttagcctggtgtctccatgccgatggacgagcgcttgctgacgatgtttctgcggccggctggatgggcctccggtggatttccccgcagggtggtggtggtagtcgaaaaattaacttgatggatcgctagtagatcgacttgacgaaaaggtgtgatctacttgtctccctggcgtcttgcctctttggcttacatcgacagagcccaggacaaggccggagtgactctgccgagaggggtcctccttgacgtttagggcgcccttaggacccgaggaatcgctccttaacggttatggcctcgcaagaccagagcggcactaatctgtttctaataggcgtaatggccaactagggaccactaggccgaaccgtgtgcttcgccaactttagttggcatacaaattggtggagtaccgtaaggtaccacaaaaagtcctgtgagggcaacggggaagggttatagaatatctaactacacgcaactagttattagatttacagtagaattaagttaggtataaggaacggtagatttaagttaggtctaggcatatctgaatgaactatcttcacttcacccgataaattttaccactcacttcaacttttacttgtgacttgtaaaggacattttaagtttttaacgatcccgaagcacacgaacgccagaactttagtgaaggatggcggattttctttgcgcctatatcctttcaatgttttaagagacggctatagttaccaccccttttgtatgttgcgttctacgcctgccgagtatgcctctcattgtacccactacccagtgaaccacgtatcgtataagaatgtgcatccaaaatcacatattcgtgcgttaaaaatcaaaatcgcacaacatgccaaataaggcgttatcaaggtcaacacaagttgtatataaatccccaatgcgattcataaacgacaatctatgttgacagcaaaacatgtcgtatatagtgcaaattagaatcgcgtgaagttgtataaactgacagatcatatatcaatctagaaagcatcatatgaaatcgcaataacttagcaaaaattgccacccaaacttggtatctgctgacgatgggcctcaaagaacaacaaagcaaatgtcgctgtgcatgaaacatgcattaatattggcatataatcactcttcaaatataaatcccctgatggtacagtggtaaggtgtccgattccaaatccaaagatcccgtgttcgaggcttgttgagattttttttttaattttcatccaaattttatggcatcgtatatctggtcgcagaaagtctgaaaaagtcgtgccaagtacgtatatagcctccactttggtaggtacagtgctgttctgaataatagcagcgcatgtcgattttcatacaaaatgctcaactttaacatgctgtagttttgttccctttcaagcaatcgagttgaaattttctccacagaactacaaatatgcccaattttgtaaacacaaaatttcaaaattttctaagcccctgccggaaagtgagatactaggtgacattgatcgaaaaaatagcagttttaaacatttgaatttcggcttgacattatagttttaaattgtatatcacttaccattggaacaatctcctcctacatatcaaacctacaccaaaaccgaaaatgtttaaaatatttgtgggagaaaagttttaaaatgaaaaactggtatgtttttgaaaaatttcacctagtgacttacttttcggcagggactcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggcggttcttgcgagttttacagtcctcacgcagttgttggacaacatgtgtatagccaagaatgtccaaataccttttttcttttgattgcttatcgctcttccttattcaccatactgccactgaaaactattatggcgcctatttgaactgctccacttttcggggaaacgggtcattcggggaaatgacattcggggaaacgggtcattcggggaactggcgttcggggaaccgacattcggggaaacgacattcggggaaaagtagcacaatcaatgttgactgggtagtttatgcaacatgtcttccaatagtacccactctacttcgtactgttctaacaatttttaatttgaaacgactaaccctactaaccaacatacaatttttatcagtttacatttaaccctctaatacccaaccccgcctttagacggggtacactttggaattttgtgtattttttcgtagctcggaaaacaaaatgattttatttttggcttaaaccttgaccacacgcatataagaaaagtttttatgagttttgaaacttttttgtattcttgaaaattgtttgaaaaattgtattcttatataatctacaaatgcccgggattaatttaacgtgtattataaaaaaaaatgtactttttatatttttctacaatcaacctatcacataagaagagcttggtgatattaaaataatttcaaacctgtttttccgtttattacacggaaaataaaaatatttccagaaaaataataaaaatttaatatttttaaagtaccgtaaaaacttgaatttttattatagccaaaaatcagtaactagaaaaggcttcaagaaaaaatgaaaaaggttagggatgttcaaaaataaaaattataaaaatcaaaaaccaaaattcatagatttgcaaataaaaataaatcattgcccaaaacgaatttagaacgattttagataactgaaaatgatatttggatcgaaaattaaaatttgggtattagagggttaactaaccctactaacccaacacctactaaccaaagaaacgtaacagtaacaaaacatttaaagcacaccttaaaaatctaaaaatcatgtaacactcggttacataaatttctggtggaaatcttgggaggattatttagaaaatcttggaaagttgagaaaagcgaatcagaatctgcttgcacagcttgaaccaaagatggaaacacttttgaacagtgacgactcgcaacctcacttttcacctgtccaacgactctaaaaacgacaatatcatcatatttagaatataaaacatactgtatataattggaatagtcatttatagcacttctgtacttgacagaggtaaatttgctcctgcaattcatgaatttctaatcattgaacagttcgatttgaggttagggaatcgttactacgtttgaagattcagaaaattataaaacggtgggctactcaaactcaaccataatccaattgattagacctgaattcatcctacattcttgggatctaaaatgggtttgttcccagtatttttttgtgctataattcgtctttatgaaagacattccttggcctgcattatggtatttgacggtctgtgaagcaccttctaatactttggcacgcatcttaccgtgcatgttttatgtgtttggattacactttgcagcattcatcgcattactgtgtcaagtttactctcgagacaaaaatacaaaactagctttaagtataagtagtatttttcctccttgtctatggatcgcatcaccgaccaaaggtgacttccagatcttttcctccctcactaataaaccccctccccgtggtgattgtggagatgcagaagtgttctcggtctctagaagcaacaatcattacagcctaacattccttccccatcccaactgactgtaaggacttggccggcgccgttattgatcaataatattagatctgctaaaattgcacttcgagagtaagcggaaactcccatcccttattcatttggatcgtagtgcaattcttaccagttccgatcaatcacggagtagcaaccattgacatgaacagtcagtctatgttatgctatgcttcatcgcattactgtgtcaagtttacaccaaatttctttgggaaaacttgacacagtaactatctcgcaaaggtggacgctgaggaaggtgatatttatgatagaaaaatttcacacgatgatttatttaatttagtacgtcaaagttctcttcacggttgactaaatggacgatgattacattccataattcctaaagtttccttgcaagcgtggtgactcatgtccaaacattactcgttagatgcacatttgcaaacacgatacgacaattgagttgccttgagatactttccggattattattttggcccacgttctccagatcttgttgcacctgatcaagccacctcgctcgctatgctccccgccttcttgtgccaaccggattcgacgcgaacaccatctttgcaggattgttgtccggtagtcttgcaacatgccctgcccagcgcacccttccggctttcacaaccttctggatactgggttcgccgtagagcctagcgagctcgtggttcattatccgccgccacacaccgttctcctgcactccaccaaagatcgtcctaagcacccttcgttcgaacactccaagtgcttgcaggtcctcttccaccatggtccatgcttcatgttcatagaggaccaccggtcttatcaacgttttgtacatggtacatttggtgcgagggtgaatctttctcgatcgcagcttcttctggagcccatagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactttcactaatgatgcgtctccttatttcacgagtaacgtcgttatcagccattaacaaggatctgaagtagacgaaaccacctcaaaagtatccccgtctatcgtaacactgcttcccaggcgggctctgtcgcgctcggttccgcctatcagcatgtactttgtttttgacgcattcaccaccaggccgacttttgtcgcttcacgtttcaggcgggtgtacaggtctgccgacaatatccatatcatccacgaagcaaacaaattggctggatcttgtaaaaatcgtacctcggttattgaacccgtctctccgcatgacacctgctagcgcgatgttgaacagcaggcacgaaagtccatcaccctgtcgaagtccccggcgggattcgaacgaactggaatgttcacccgaaatcttcacgctattctgcacaccgtccatcgttgctcgtataagcctgtgccataggggcaagtgtgccacccctgatttttataaagactacaaactatattttttatttgagcttaacgttcaacgctccgtaatttggtttcgattatcagtgactgatatgttgttgtattggtatgtctgaagaaaatcagtgcaagtgtgtatgtgaaagaggagtagaaaaatcacgtgctttacttttcgcagaacggggaccgcttggaaagtattgaaatttcaaattcattatgttactcgtttttcgcaattaaaaaaatatttctggctctgctttccaaatgacagatttttctttcaccaaatttctgcaatggcaccagcaaattttattttgttgaaaatttgacatattgtgtattataattatgctatctcactaactaaacaattgaaaaataagctcactcatgataaaattaaagctagatgcctttacccatacaaaataaaatgatatttagtattttagtatcaattgtgaacataggcaaagccgataattctctagcataaaaggatggttatgaaatcttatgaaatcgatatcgattagacgatctcttgcagtggaaaaaaatcgtaatgcagtagtgaaaaaaaatattggatgctatattctgcaagtgtctacttttggtcaactcaattaatatgctgataattattgaactttccagacaaggaagatgtacagttatttgattccactgtctcttccgtctctgcttagttattcggcttaattttagaattctccccgatagattcaaacaggatcacatccacatcatttcaaacactacgcgtgaatttattcactttgattctgtgacattctgaagcatctattccataacattattttgctcattagaaaaagtcatgcttaatcttacaaaaagtttgtttacaaacggtgggagaaaatggggaggcatcaggataacagctgacgagcaaggatgccagctggtaggatgatgatcatttgtaattaatgaacttagcagtaaaccataataagcgcaagatttcttcctgccaattacattgaaaagatcatcatgtatacactaatgatttgcaaactaaaccatgttataattttatagttttctataactttgtgagttggaatctcggcttttctagcaaaaataagtaaatgatgttggcaaccatcgattgatgatgttaccccgatttgtttgctttggtgtgtgtacggtcaactgtgcggtttttattgcgacgcatttcggagttggaatgcgatagtttttcctggcaatttctacttgatgcgtaggtttcgtagtgagttgcgatattttttgcttgagcaatatcaacatcaagttcgccccagagtttcgtgtttcaaaaagtagtttacgaagttgaaagagttaagaagtgagaaatgttagtgtagtttggaagaaatatatatcttacaggagctgaacagtttttcaagacgtgaaaagtttgaaaaaggtgggaaattccgattgaagaattcgacttgccgatttttgtgcatgtagctgttgaagcaagtacgtatagtcatggtgttagtgaagactatcaatgatagcgaggactgaaaataagcagatttcagtgatataaagcaattctatgcgaaaaactgcactgtaatgcaattattgattttcccataaccctgtgaacataatcaatcgcaggtaagtcgtgatttacaataaaaacctaaaaagggaaaatagtcagtgttcacaaacaccaatgcaaatcatcatcgacattacaaggattcatgacggatcctgcccccttaacaaaatgtttccttatagttcataatacaattgacaaaatatgaaaaaaattattctatttttcacgtatttacatcggcttttgtgaaaatcatcaaatttcagtgattttttataagatttcgttgtttcttaaaagcatggtgagaggtaaacaaatgtaaagctatacaaatgtgtaattaattgtggcatttgaacgaaaaaaatattgagttttacatacgaaatccattttggttgaaatctatactatttgaggcaagtatgccccaataggtgtattgggtaaacaaaaatggttggagtgaaattcataaaaatgtaaacatcatcaacaaaatcatactaatgaaccaaaatgcggcaccagtagtggtttctgaagtgtagaaggggaatagcgaacatttttgctcccgcaatgattttttcttcaaatattcgataataacatcccgaccagccggaagaaacaagattataacataatgtgttgccctgatatgattttttatatcaccaattgttctaaatcatgtaccgttagtagttaaaataacaaaaaatctaacagaaattgcagcaaattaaccctttggggcctgattttttccaagaactattcatcagttttttgaacgcctttcaatagttttggtgctcaaaatgctaaatataacaagaaatgatgacaaatattttttgggaggtgctaggtcttccaaactgctcttgagttcataacttgaagtctatgcttgtaataacaaccttgttcatcatacaaggtgatgaactgtaatctaccgtatattctgaaccttctgagtgttcagcaaatattatcagatcatttcgaatgttctagattatctaacttgtcaggatttagtggtaataaattaataaccacgaaacaaagcacttccgaaacatggtgtgttcgataaagtttccagtcataattagcgacatctattgggaagcatccataaattatgtcacgtaaaaatatactattttcaacccccctgcttttcaccttttgtttgcgaacaatttgtgaaaacatcagtagagtctaaatgcgtaaacgagtagaaacacgttttgaatatatgtgtttgtcgacgaatcttcttcttttttcttggcatatcgttcccactgggaggaagctggcttctcagcttagtgttagtttagcacttccacatttattacctgagatctttctcagctaatgacctttttgcatggatatatcgtgtggcaggcatgcgcccatactctgtgcccaaggaagtcaagactctttcctttacgaaaagatccggtaatcgtcatacaaatctcgagctctacttcttttttgcaatcgtgcaacacgactatccgtgtagaggcgtcactactgtactgtcacagacaaacagacataacactcttgagaagctcatggtacatccgaacgggaatcgaacccggaaccctcagcatggtcatgatgaatacccgcgtctttacagcttcggctatgggggcgctataaaacctggtagaatatataactgaactccatttagcgaaaaaaaacactgccacaagggcagatttgaagttctgagctccaggatagtttggaaaagcttttgagattctcagaggtcaatagattccgtttgagttgaaaatattattatttgcagcgttgccagatttacggaaatttccgtagatctaggaattgagcactttctacggatccgtaagataattctacggaaaatgtatattttctacagaaagctacggaaattctcattaaagactgttcattttataaagtggacactttggacatgcaatatctttttaatttatcaatgaaatcgaaatcggttttctgtacatcgttcaactaatattgtacaatgctgtggtaataaaaaagttaccaaaataatatgatttcacactaataaggcacaacgtttagaacggtcgatttttggaggttatcaaaatcaaggataattaaaaatcggcaggaaaattcgacaatttatattttttattttcaaaaaatggttgtacttagaaagcatcatcaattagaagcttgctaaaaaatatcaagttatttttggagaagcaattttgcagatatcataaaatcattttttatcaattttttttaaagaaaaatatcttaaatttaaatggaactgatatgagtagaattttaaggtttaaagtacgtccagacggaagtaataatatagtatttataataaaaataacttacgccttcatagagttgctgatttagtccccacgtcatattttaggcacaatagaaaaacaaataatttattttcagaagaccactcaaagcacaatgacaatcatcaagattgggaacactgcttgaattaaatcaaatttattttgcatgtattattttcagaatgtgttattctgagactacctatcaaaatattttgagaaaaacgcttacagtttgctttagatcgataaacatgcgtatataattttaaaagtatgggatttttcaataaaacgaccataaagagtaaatttggtacctaagaatgcggttaacactcaagattttgctttttttatatatagtttctttagtaatctaaaccagttttgaacacgcttattactttactttttgctggtagtaaaaagatggtgtatcaacaaatttgaccataaggaatagatcactaaagtgactcagcgtcaggaactgatggaatataattgatgtttttaaaagctctaccttgagttgaatagtaaaggataccaacatacaatttattcattaaatttaggatttttttcatgcgaaaaataatgcttaaacttgacgaacaatttttcttaggagtttttgcaaaaactatttagttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcccgcttatcacttttcgtctacggaatgatttccaaagaagtctggcatcgctgattatctctagcgcaagcaactactgctttaaatttcgagaattgagcttcgggatagtctgaacgtcgtagaatatcccaggacatgaaaaggcatgtgaagcagcgtttttcttgacataataggtatgtattaccaagtacgaacatcaattgtgtttacaaaaggcattttaagctacttttatactaattattctatttgtcagacttctgcatgttcaggatgttctaggttgccaagtaggacattaaggcatacacctaaaatttttcactgaccgggaagtatatttgcaaggacttttccgaagacagtaaattttattcattggttctttttatacagccattttccgactgcggtcataaatgaccgtgccggccccaaagggaaaactttgatcattttagcgagaaaagttactggcaaaagggtaaacctgaagttctgaactccagggtaaattggagggcctggaatatcaccaacgttccttgaaatagccaattggtctgtgagaaggttcagtgaacatggtagattatataacttcactcagtttagaaggaaatattactgaaaaaatagtagacctgaagttctgaagtcctggggaaattttgaaggatctgcaatacctcaatcgttccttgaaacagcatattgatccatgagaaggttcagtaacatagtagattatatactttcactcagtttagaaagaaaaattactggaacaagggaagacctgtagttctgaactccagggtaatttggagggcctagaataccctaaacgttccttgaattagcctattgatccgtgacaaggttcagtaaacttggtaagttataaatctttactcagtttagcaagaaaaaatactggaataagtgtagacctgaagttctgaactccagggtaatttggagcacctataatatcccaaacgttccttgaacagcctattgatgcatgagaaggtttagtgaacaggaaagattttataaattcactcagtttagcgagataaatttctggaataagtgtagccctgaagttctgaactccagggtaatttggagggcctggaatactccaaaagttctttaaaacatcctattgatacgtgcgaaagttcagtgaacatggtagattatataacttcacccagtttagcaagaaatactactggaataaatgtagacatgaaattcagatttccagggtaatttggagggcctggaatacctcaaacgtttcttgaagtagctttttgatccgtgacaaggttcagtaaacattgtagattatataacttcactcagtttagcgagaataactactggaacaagtgtagacctgaagttctgaactccagggtaatttggagggcctggaatattccaaacgttccttgaaatagctcttgagattctcagaggttggtagattctatttgaatttgtaatgttattgtttttaacccaaacaattactgttacggttgtagattccaaagagtgtgcttcaggatagtttggacgtcctagaacatcccaggacatagcaaagcaagtgaaatagtgttttcgttaaaagagtagttctgtattatctagcctgaacatcatttatgttcacaaacaacatttcacgcttcgtatgtacttatagttcaattttccaaacttcaggatgttcaggatgttctaggttgtcaattaggtcataaaggcatatacttcatatttttctctgataaaagagtatatttgggacaactttgccgaagacagtatatacatttgttcattggttctttttttacagccttttttgtactgcggacatatatgaccgcgccggccccaaagggttaaactaaaatataacaaatccagttacaactatatcaacattattacagaatgtgttgcaaggattttacaaaataacaaaattatagcaaattatgttactgtttatgacatcggatgatatttgcaacaaactcataaatgcgatgtcaaaaatataacaaatgttgttataaatgtgttacttaaaatataacagattaagaacaaagccatcttgataacaaaattttatcaacttctgttatttttaactgctgtgttacaatcttgttatgtgcttctggtcgggatggtttatgttttatattttacttattttcatcaatattctaccgctatttagtgctgatctagtgtaatattatacagatcccccgtaatgaaagactaattcatatgtcgtattgaatgcagacaaaaataacgattttagttattcgaattgactagtagagagttctgcatgtgatgaaccttgttataaagcatcccgtcatgacggtaaactttaaaatatttttaaaattatcaattagactctgctctgttagcaatattaacagaaaataaagaaaatttcattacaactgccccatagtgttgaaaatcaggttattttggatgatatttgaggagctcgaaaactaacactttttgaatttattttctttttaaatggtacagtacttatgaaaagatttctttgattattgatgatactgattattggtgaatagactggcccagctcagtatgggagaaaaataaagttgtataattccacggggcacccctcaggattattccttaggattagaggaagacttcctgaaaatttcagctcatttggtcggtccatgagctggcgcaattgaattgaagttaatatgggaatttcagctcgaacatatgggaaatagaacatcatctcctgttcgggtcaggaaaattgttgatcgcgttcaattgaactcagaatgtcaaaaacactacttgataccatagtgaacaatattgtagaaggttgtatgatgattaacattgagaaagttggtgttttagccatctgaagtagatttgcaattctgcttagtatttctgcatcatagctgggtggcagagccgtagcgtggcttcatggcgcccttggcgaacctccatttcagcgccccttaataaagctcagcaaaaaaaaaaaatctgagcgatttctacgagaatttttatgaaaatcctcaaaagtgtcataaaaggtcatattatttccttgagatcagaacatattaaattattgactaaatttcctgcaagaaaaaatgagtattcttttattttttaatgaaaattttctgagtacttttaaataatatcagaaagatggattgacaaattccttcgacaaattccgaagaaatatagagttcatacagctaagaacaaatgtacagtttctactagatgtttcaaacaaaatttgtaaattttggtgaaatgcaaatttttaaaaaaattctcctgtacatgccggaccatttgctttcaagcagagttttaaaacttttcgctctgaataactggaaagaaatttggagcttaagccagaaatacaactcgaaagccatagcaatcctttacaaaattatgattcttaaacaaagactaacctcataatagtaatagaaaaattgttatattttctgagatatgataggatggtttagattctttggacatttatagaaatatcatttttcaggaaattcatagagaaagcaaagaaaattctctaggatttaaaagcaaatatttttatttgaaattttgcgtagatttagtcaagacattatttaaaagttttattgcaaaactgctgtttgtaaatcaataaaaaaaatatttgaaacatttcgaagagttttcaatttactttcaaggaattgctattaccattgaaattgaaagcattcttcacagtgagatatcgaaaaatgtaaatattcgcaaaaaatctgttttttgttacaagaacttttacggtggaagagaaggtgaacatggaaaatgtcaatcatgcatacttcttgaaaggtgatcaaatattaacaataatgtcaatgaagaagtctaaatagttacattcaacttttccaccgcattttttttaaaccaaacgagtttcagctagtgtagaacatgtttcaggttatctatataaataaaaatgaaatgatgtttgtatgtcacgaaatggcttgcgaacgggtcaacggatttgaatgattttttctctgttttgttcgtcaagggttccaacgagtttgtgtgtataaaaatcccaggatattcaccgggaacgttgaaaaaacgagagtgcacggaactgtcattttgtatgggacgatccatagcgtttttcaacacttgatggcaagacgaagtttgctgggaacactagttaaaaatatattacaaattctagaattatgtctggtgtgagaattttcgtctaggtatcaaaatcagtttacaaaataattagagttatgaaaaaattacgcaacattatatcagaatgacgcctagaattatatgaaagaccgatcaagataaagcaagagcctgctgcttagaatcttgtatttgattctgtgagaatcttgcccaattttctgttgaaaatctgcccataattacgtggatcccactcaggataatcttagattcatgttcagtattctgtgaaatatttctcgaaattttactaaaaaaacgagtgatcgaaacatacagtctaactttcagtatacatacacatctgaatgatacaaatctttgtttcttctcattaacaaactaaatttatgtgtatttattagaacttcaaacttttaaaatatatataggaatgaacaatatcttttgaaatacttattgcatattttgttaatccctctaccggcagtttcattttttaccccaaaaaaacatattcaaatcgcgataacttttttgtttcttggtatttttgcaccagtttttcacaagctctcaaaaatctcttctagttttagaatatgtgtcgatattgattatcggtcatctggaatcggagatattccaaaattccttgggggaccgacgcctagccataacccacgtgaatatctaaggctacagaatttttatcgcattcgggtattcacttcatgggacaatacattaatgtgagtatgttgtgaaaaaatgaagcaatttggtgaagccctctttgagtaatgagcatttatgtttctggtaccacgctggccaaatgaagatcttgaaaacttcaaaaaacctcataccgtaattttcatatttctccaagaatactgaccgatttgcatgattttttcagagtagcttcttattagctgacaatgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaacgaaacagtgacatagagtcaatttccaatatatttgaaacgtatattccatacaaacttcgaattgaatgtgccagctgggggagcaaccaaatgagttgaaattttgagagagaattttttttaccctaaagcacatatctagggggtgccccgttgagttttacaacttttttgtttaagggccagcagtgttgtgaaaaactcaatttctcacaactcacgcttgagatttttcatgcgtgagttgtcaatcacgcaactcagcagtcaaaaaatcgcggatgagttggctcacctttttgactcattgtctcgtatttccacagtttactcacacacggcaacaatttcttgttagtctggtaaaattatagtaatcctttctaacgtaaacaacaatattcgggtttcacgagttttggccgggttttgcgacagaatcattttttacggtttgagttgattgagttgattttgcatcaaaatctcaagcgtgagatttgcgaagcagatctctaatgaatttgctctctcgggagagcgtattgattgacatttgagtgcgagtctatcaacactgagggccagcctattggtgaaggcttatctcgattgctgattggagtagttcttgatctataataccagtcttatgaggcccctgaagagattttgaatgggattcttcatatttagggtagtcggggcggtttgagcaatggggtggagagcaccctttgaaaactacatatttttttgaaatttcatctgaaataacatgcaaccctaaagctgataaggaaatgaagcaataggtatattataagtcagtgttttaaacttaaagaaaaataaataaatgatgttcgaaaaaactgcccatattgccccgaatggctcttccgaatttcatcatttcatttaccaccaaaaatagggtgctcatatcaccccatcggtacaaaatcgactcaaaaaatgataaattttgacaaatcattcattcgttcgtgaactttataagacaacagaaatgatgcggatctaatgtattcatctaaaaattgttggaaatcatgcaaaaatccgaagattccataatgttttcagcactattatcgatttttccttaaggtggtcaaactgccccactttcccctacagcgatttcttcttattataccgaagacattttttctaatttttattttatgaattcatgataagctctttggtggtggttggtccctagtgataaatcctacctccgttctggtcacgatcttcagattatcgtgattcgtcaacattcttattgataaagtggggggacaggcttgaaatggggtttgaaagaaaagaatgtcagaacaggtatccaccggcgacgccaaacggaccaacgtaatgtggtgtaatctgggatttgtggattgaatactgatattttttgccaagcatcaatatgggtgacttccgaggatagcgaaacgtaagaggggttattacaaggttgtgggtaaatccatcacattggggttgtgactctgtgtcttgtcaggaatagggtctgattggtattgtagtatgcaatagatttcggaattgatagacagactttgaggaaagaagttttgaacgtaaggcagcagcaccttggatcttggagggcgttggtctggagagttgggcagctgtttatgctgggttacattacgtagaaagtggaatctgttttgcttcgaataaattatgggaagtatttgaaaatggtttcttgttcagattgtgtaacgcaagaaagaatctttagctcggcgttatattaggaggttattatagtgcagggtcgaagagaggatgaatatttgatcacttaaactttacgctgcaagatattcgtagtcgtttttcgttttttttttctgatgtacaggtatatttagcctaaataatgaacaatcatacgcgtagagcctacgggtcatgaagttaggattgaaatcaaaataatattgcgcatttctttcacaccacaggattatcgcagaagtttttacatgtgcggaggtgccggtagaggtgcgcgattgcgtcgagtcgggtcggtgttttcagcggactcatatttcgcaaatcgaagaatgagtgctctgagggcatcaacatgattcgatgcggtctcacacttttatttgtgcttttgcacttgtcttattaaataggaatactttgtgttagggaaagtggaggagaataaattatgatttattagaattttctaatagaggcagagttcacatgttacttaggtatttgaaagcaaatgagaaccacattaaataatagataaacactaatgctcatgtttttatatttttatatttttcatttcatcacggtcctcattgcccgagcggagtcgacaaaactcgaggtggatagaatcgacggaactacgatacggaaaagaaacagatgagaaactatcgatacatttattcaactataaaaatcacgttttaacgtaataactttatttctttcttctcgttccagcaatccaacagccaaaccatttctactatcttttcatttcctcttcgttacatttatagtccctctggtactgaatcgaatggcgcattccgcttttattagcgctgtctttgctgtacgttgagcatggtgtcggaggtggtgtgctctgtagaacatctgatgtgctacacggcacgccacttccgacattttgtttggtgtgcgggatgggcagtgctggtgatgaggtggagggcgctattcggtttagtggcagagggactatatctatttaatgtatctgaaacttgtgggaccgctttaattccggcgcctgcttgtggaagaacccggtgtgctaaacggtataggacatgttaacgggggaggcttggtaggtcctcacccagcccgtgtctagattggcggataattgtctgccagggtgtggattgagcaattacaattacaattacaatgaattcatgataagctctttgatcgataaataaatagcgaggtcctttatgtattcttacccagatatttgatccacgcgattcttgaaagttgcaattttgggttaaggtcaaaagtgttagccaacttcatagcaggggatcaaaaaaaaaatgtattagggaatatcgtttttgttaatctctgcttggattcaacaagtgtagatacacagagcaaatatttgttcatataattccaaatcctctctgaactttctatgagttctcgttggcggacgatcttagtttatatctttctgtccaaaacgatttcaaaatttgaaccgtttgatgcttatagcattttataaatataaataaaaattgttcataaataagttagttaaagacatcctaaatgtgtatgagattgaaaaactaaaatattaagtccaaagatcattttgtcatcaattgtcaatattttggccaaccgggaaaaatccgggaattggaaaattggttttggatggacaccctggtcttactttccatagtcattattatagtgaatatttaagggtaaagttacctttggcttctattatggaccaatgcacgagttcactaatttgacgtttgagcggtgccaaattcactcgttaccatggtcacgtaaataacacggcaccgctcaaacgtcaacgagtgacgtgcattggtccatagtctcctacaagattcacttttcggtggcaaatgcaatgcttcacaacgcctacttacttgtaaattttgcggaaatgaagctataattagattttttataccactttaacacttcagtcgtcgcgctgttgtattttgtacaacaggggtgaaaaaccctcgcttatcgtacacaacatcagcggggtggttctgacggcggcaaaccgcgcgacgactgaaaggttaacaaaagaggtgttccttattatggaaatgcagaaaccatattacaataagattgtcgccacttatttctactcagtgaatctactattcattttcctcagagtaatattccctacgtcgtacatgataacgatgtgtctagctagctaatagtaagagtggctacggatcattctggttagcaaaaggtaaactgatcgtcaccaatagtattaatgtccacttcgaatagattaattatttgaaatgggcatcaattctatcaatgacgcagaatgtccgttggatcacatccgagatattagtgcgtctatgccatatgaattatgacgctgctttaagcaaaaaatgccataatgtgataccaccactacaggttacgcctttggtttccatcatatgggctaatggattatcgcagcaaggtcgcataaccaaggggagggattgtagggtgactagaagttaaaattaaaaatgaacctcgatggtttgcatgaggtatcgttcaaattagcgggggtgcacggtacataaatgtagcgttacactcaaaataatccaaacgtcattgttacgtgaaaacatacgtgatttttttccatcgcacttttcgcgtagctcttacgtgaatcataggtagcccagaatgaacgcatgaactttggaagttcgtccattccatcgtcgttaaacgtaagagctacgtggattttctggtagcctttacgaagcgtttcaataggacctagatggttttgcattaaatttaactgtaataaagaccaatcttatttctaataggctttggaaaaaaaacgaattcccaattggaaaatgtaaacaaacttaaaagattgtgtttttttattgtcaatctgagcattttgaatcatgtttccccaattttgtgagtttggtctgtcttgtagccttcgcgtgctataattgaaagaggttataaatcaggtataaaatatgaagtaatgcagggattcttcggtattcaaatcatatttaccttgaaatcaatcttacacagggtttaaagcaacagcagcttctgaagttcttctaaaatcaagcgggcgccatcttagcatttgagctcaacaccgaatgtacgtacaatatgcagatgtcaaaatgaacttaggcacctacgtgaatttcacttaagtgcgataggtagcctcagtaaaaattaccgagttactatttggtggttatgaatggtttagtgatctttatcttagtcaggtgaagtgggggtaaaatgaatttggaatgatctacgtgatttttcacgttgcaatgacgtttggatttttttgagtgtaccacgatataaatgtgtgttattacaagaattaaacgagctcaccagttggtaatccatcttcgactgaacaacgcaaacaagttgtagccaataattctttttttttccaactcttttgtacaatgttagtcgtaataaaatattgaaactctttgtccttccagctactacaccatcccgacgttggacgaaatcctgcagctgatggacgcggacggccgttgcgtcgtgccgaacttcaccatcggacggaaaggctacggcaacgtgtacttcaacgaaccgatcgatgtggccaacctgaacctggacgaaattgtccacttccgccacaaggaggtgatcatctatccggacgacgagaacaagcccccggtgggacagggcctgaaccggaaggcacagattacgctggaccaggtttggccacacgacaaggcactgcatgaaccgatcaaggattcgcaccggctggcgctgatggattacgaagggaagctgcggagggtgtgcgataagcacgatacccggttcctggagtatcgaccggacacgggaagctgggtgttcaaggttgagcacttctccaagtatgggttgagcgacagtgatgaggatgaggtgccggtcgatccgaaaaaggcgaaaatgacaggagaggataagctcggcaaagagaaaggagctattccgaagaaaccgttgatgagtagagagaaagtcatgggtcaagaagatcttagcttctcgatgatgacgcacgaaagcctggcgccaactagtccgaccgccgctttggcccttggcatgggaaccgattcgcacaaactgcaactgatgaaggcttccttcttcgtggatgacgatttcgacaggagatccatcatatcggacatgaccgacggcgggagggacagtcccgaccagatggttcccaacaagccgtattttggtcttggcaggaccctcacaagcagtttgtatatgcgaggtgaatcacccaaagtggtggaagcggaatccatgcagatggatgacttcggagctcctccgaccctgttcaccacctcaacgagtaagaatttccaggatcaacagaaactcaaacatgggctcatcacggaaatccctcgtcccattggaccaaagtcacttcccctgatcctgaagcccaaggtggaactggtccactcgaataacatcgtaatccctcttcacaaatccgtactagcccgcttcctgaacaacaaatccgacctggcctacttccacggccgcaagttcaaggtcggctggagcttcccatcttcgctggtccagttgaacacggtcgaaaattgcaccaccctgaagaaggacgaagtgatgcccattggtgatttgcaccgattcttcgcaggccgcacaggcaaagacttctccccggcagcactacagatgcttcgcatcaggtcgtcggcggagattcccgagtttgccaaaaccgtcgaggatcacctgaggatccagctgaagtacgacgatgtacgaaaggttcctggaagcgattgtccccattatgtggctggggggaaacatgccgcactcgcggatcacctggagatggcccggttgattgccaccggaggagacttcgaatctctgtgcgttgaagtatggtcgctctgtgccgctctgtggggagcccgcgaagagctggaggacgtcgaagaaaccgcccacatgagcatcatgttccgacgcgatctcttctccgagtggatcgaagaagtcgttacggatctttccgccaaggaagtgacagctgccctcaaaggcaagaagcaggaatatctcgatcaacttcttgaactgatctgcacccacaaggtcctggatgcctgcgagttggctttcgaaaacaacgacatcaacctttcgatgctgttggcgcagatctccggaggcccaaccgttcgacagctggtccagcaccagttgagctcttggcaagacgtagaggcggacaaattcatcgacccccgtcgactgaagatgttcatgttgatcgcgggaatccctcttctgtcctctacccacggagcgatcaacatcttcgaaaagcttggctggctaaaatcgctcgcccttcatctatggtacctttgttccccaaccgcttctattaccgatgcccttatcaactacgaaaaatccttcgaatccagtgaattcttcgcccttccgccatccccagcctacacctcccgcgttaaactcgacagctccaaacccatccaggacatccggttccacctgctgaaactctactccaagcgttcccacccgttggaatccctcttgaaccccgccactcacacaccagatcccctagatttccgtctatcgtggttcctgctccagatcctggaaacgctcggctaccgccactgttcggaactgtcccgcagtcaactgcacgtctcgttcgccagccagctagagaaccacggcctgtggcactggtcaatctacgttctgctccacctgaatgaccagtcgcggcgcgagctggccatccaggatctgctctaccgctacatccagctaacgtccgcaaccctgggcgacgacgaacaggacgaggagtacctccagcgggaacggttcgtcgtcaacgagctgggcatcccggagagttggatcttctgggccaaggccgtccgggcgggggcgcagttcgactaccaccagcaggcgcgcttcctgctgaaggccaaacagtggtcccaggcgcacgaggtcatcatggagcacatcgcggcggactgcgtcattaatggtgagtattctgaaagcttatcaaattgattagattttagatatttaaaatttaaggcggcaggatccgtcattgatttcggaactctcaaaagcattgttttccttcaaaatcaacaaaatttacaggaaaatgtgttcactgtattctgttctccaaccaaacacagtgaacacattttcatcgaataattcttagttttgaacagaaaaactgcttttgaagtttcgataatgacgataattacgatgacggagcgttgattgttaagtacgttctaagcggtatttttagatgaatttggagattttaacttgagacgatagtgcatccaattaagagctgaagttagatgaatcggactgaacatcaatgtcccgtcccgtaaaaccgtgtcaggccttagaggacgttccaaatccgtcgcctggttgttccaattgggcgggactaggctcagatgccattaccggacttgcgccgatccggctttgaacatagtaccccataaaggaatatgttaggaatatggcctccctgcttgcatagataaccatgggatcacaaaggtgactattccagcgaagataagagatgatccatcgaaacaaaaaattagcggaatgtgaagaagcttctgggacccatcagtaaccggctaaggttcccaccaaggaaggaggcgaccaacatcaacttaagtgagaacagtgtaggcaaaagcctagacactgtgacgacggcaggcactggccgctcctgtgaaacatgtgaggtgtccgatggcccgggactaatcgaggccatggatcacaagtacctccctaaaatgcaggtagctgttcagcaacttgatgtcatcatcgagtttgttaagagcaaaagcaatatcagcaaagacttgaaaagaagtctactgaaattgcgacaatcagtcctagctgcaaagcaggactacgagaaagccaaggaacaacttggcgaggtagaaggcaaaagagacactaagtcgtgtcagaccgaagtgttttccttcacaggcaacgcaaatatatctgatgatattattcgatacgcgatgcggacgaggggacgttccggggatgaatacgtggcgaaaagacgtatggttgctaagggaaaagtgacctacgcggccgtcttccagagcggaaaagctggcactagccaagccccgcgatcaagaggatctggtaacaaaggagaggccaacacctagcctaaggccaagaaagccaagaaaaaggagccacggaataacccgaaccaggcagtgtatccacgggaaccacggggcaaggcaacagcaatccgtggatacgagttggaaataagaaaaaaaaaacagaggaaaccgaaaacggagcccaaggagagcgctaaaccgaaaacagcgaaacgtagtaatttaggcgaagccctcgttatcaaaacggaggaagcgaaatacgccgaggttctgaaggcgatgcggtgcacggagaatttatcgccattgggcgcagatgtgcgaagcataaggcggactatgattggtgaaatgatcctagtcttaaagaaggacaccaaagagaagggtgcagtctataagcaactggcacaagaagtacttggcgatgaggttgatgtaagatcccttactgctgaagtagtaagagagtcgtctccagtgtaaaaatctggatgaggtcaccgatgcagcggaggtctcagctgctctcaaagagcagtgtgacatcgacgtagccaataaggccatccaacttaaaaagggcacgcaaggcacccagatggcggcgatcaagctgccggtcgccgaggccaacaaagcgaagaacttgggcatactcaaggtaggctggtcggtttgccggctgagcatataatagcctcctgaagtttgcttcaagtgtttcgggaagggccataagttgtggaattacaatggtcccgacagaagtaagatgtgcagaaaatgcggcaccgaaggccatagggtaagcgattgtaagccaatcgctaagtgcctaatatgtggcgacagagcagacaacggacacttaacgggcggacccagcagctgctttggcagtcagtctcgggaaccaagactgacgtggtattactatcggacccttaccgcataccagccaacaacgggaactgggtagcgaataggtcccaacagctagcagctatagggacgacaggacgatacccaatccaagaagtagtctctagctcaaatgacggttttgcgatagcaaaaatcaacggcgtgttctattgcagttattacgcgcccccaagatggtcgattgaggaattttcccacatggtcgacagaatgatagccgaactagctaatcggcagccactggtgatagttggcgactttaatgcaaggccgctgcaccaatcaaagaggtcagctattgttggaatccctggccgcattaaatgtagagctggcaaatgtgggtacagtgagtaccttccgcagaaatggtgcagaatcgattatcgacgtgacgttttgtagtcccaatcttttcggtactatgaactggcgcgttgatgacggttatactcgtagcgatcatcaatcgattcgctatagtataataccaggcgggcggaaggcagcgcgatgtaactcgacccaagcccgaggatggaaaacagcgcgcttcgacggcgaagtattcactgaagccctgaggcgcactctggaacactctggacagggtgtcgactacctgaaaaaacctggaaagtcagggaatgtcagggaattcgatttttgacctggaaagtcagggaaagtcagggaatttcactagaggtcagtgaaaaatattcaataccacaacttcaaaaaagttgattgagaaaaaacttttatgaatatgaaagtaagttgtactttactacctatacttattcttagaatccaaaattttctgaaatgacaagcatcaacagtgctctctgaacaatgtcttcaaagttggcgtagtttgctttattaatatttagttctaaagtttcctagatcaaattttgatttaataattgtcttctcttcaaaatcttgaggaaaaaatggaatccacttcatcgaatcatgtcaatctttacaagtttgcccaaaatatccaagttaaattgataaaacgaaatatagagaaccaatgaagattctcgtatttagataaagatgaaaaccgtatctcaaaattttaaatgcataaatctgcaaagcatgatatttcctgaattttttatcatgtcgtttctggaaacaataaagataataccgcaaagggttctgatatttatatttatccattttgctatctatttcaattttgatttttcaattgaaattttcctgagtttaatgaaatatcgttaattccaagcgttactacaggatcttattcaggagcttacttacagatatgtccagtttgttttttgttctcagaatatacagggaattctccacaaaatatgaagatcattatctaagatatttgaatgaatccataaaatacatggaagcagacatttctggaattaaatttgaaggatgctcgataatcctttaatagtttgtgagattacttggaaggtactcggacatcgtcccgtagttaattcctttttgtttgtaagaacaatatgtgttatgtcccttctcgtgtcgtgttctgtgagtgtacatgaagttcttacgttcgcacaaacccccgaaaaaagtacttggaagatactcattgaatactcattcttggtggagttaaatcgaggattgttggaggcacgacacattaaaacgaacatctgaaaacttattattagcgcgtttttcaattccaaaactcattccgttaaaaatatttagaaaaatttctcggggagaacggttgcttgaattaaaaaatcacatctgaattctaaaaattaactaaaataaattacctgtaaagaatcatggtgaagagttttaagaaaaaatgaatacattttggaaaaggtgtctatgtgatccctaaacatttttttgaagtatttctgtaatattcctatgaattttaaatttatttaaaggaagaaaatcatgactggaagaaattcttcaatattttatagaaattcctttatgtgaacaatttattcaaagagaagaaattttcttccattattcaccagcaagattttttttttcttcaaagaaaatacgcgccggaattcgcgaactatagaaatcttaaactagttaacattctttggactaatttatggaggaacaatgtaagacttcttaaaacataattctttgtgatattaaagtcatatatttggataaaacatttaaggaggttccgggtgaaatattagaggagttcctggagaaagaagtattggaggaatacttggaaaaatacattttagaattcaaattggaatttcttagaattttttgttgaattccttgatctatttttcaaagaaagttgtaaaagaattgtaacagaagtagccaaatttcaggaagaaagtccttccaataaaaaaaagcatagtaatgatcttaatagagtgacgtcttatgtatgaaaaattgtgtaatccggttgaaaggtgtccaaaattgtcctttatgcttgaaacttgtgaaattatatctgaagtagttcaatatccgaatacattgtttactacaattttaaaagtaacttttgcgcttaaagatttcaatatgatcagtagatgactcagaatttacttagcttctactcagcttttacctttcattaatacgaattatcaagtttgaaaagtgcatacccaactggtcagttttatcatatcaacttgaagaaaattatcgtaaacactattgctcaatttattcatacgacctaatacataaattctaccaaacaaacaaaacaatatggtctggattttttctggaaaacgactggaaggtcagggaaagtcagggaattttattttcaaatttgggtcgacaccctgctggacctaaacggtgaagagctagttgctgtgatatcacgagcgtgtgatgcttccatgccgagaaaaaaggccgccggtgtactggtggtgcgaatcaattgtaaatcttcgagcaatctgccttcgggctagacgaagaatacaacgcgcacgcacagaagcacaaagagaggaacgcggtgcagcattcagagaggcaaagttggctctcaaaaaggaaatcaagagtcgaaaacgggcatgctttgaaagtctatgcgagagtgccaattctagtccatggggtgacgcctacagagtggtaatggctaagaccaaaggtgccatagcgccccaagaaaagtcgcccgagttgctgcgatcgataatcgatgtactcttcccgcaccatcccataagcccatggcagatgaaggaaaagaagtggcgagagtgacgaatgaagagctacagaagtcttgaaatcattcgcgtcaaacaaggcaccggggtccgatggtatccccaatgttgccttaaaagcggcagtgaacgcgaatccggacatgttcagaaccacgatgcaacgctgctatgatcaaggaatcttcccggatgtatggaagcgacagaaattggtgctactaccgatggcggggaaatcatcacgtgacccgtcggcgtatagacctatctgtctactagatacagcgggcaagttattggagaggttgattctcaacaggcttgtaccgtatacggagagcgcggacggcctgtccaacaaccaatttggattcagaaaaggtaaatctactctggacgccatctagtcggtcgttcagacagctgaggtggcaatcgagcataaaaggagcggcatccgttactgcgtggttgtcactctgtatgtgaagaatgcgttcaacagcgcaagctgggatgcaatagcacacgcgcttcatcgcctcaaggtaccggtgcagttgtgtaagcttctagaaagctattttgatggtaggattctactgtatgacacagaggaggggcagaaaagcgttagaattaccgcgggagtccctcaaggttcaaccctgggcccgctgttatcgaaagcgatgtacgatgacgtactgaggctgccccttccgacgggtgttaagattgttggcttcgccgacgatatcaccctagtggtctatggtgaatcgatggaggaagtagagttgacagcagtgcactctattttcatagttgaggaatggatgaagtctaggaaactaggtcacaagactgaggtagtggtggtcaacaacaagtccgagcaacgggcgcttatcacggtaggtgactgcaccatagagtccaagcgatcccttaggcatcttggggtaatgatcgatgacaagctcagcttcgctagccacgttgaatatgcctgtaaaagggcatcaacggctttagcggcgctctcgaggactgtgtctaactgctattggcaagcgtggcgctgtccatactaaggtatggaggatcaatctggtcaaaagcgcttagaaagagcagaaacccaacctaatctaatcatgtgcttaagagtagccagtgcatatcagacagtatctaaagaggccgtgtgcatcatagccgggatgacgtccatcgggctcattatctaggaagatgttcaatgcttcacccaaaggggtaccagaggagtccgcgacacgtgtaaacgctcagaatctggcagcaggaatgggataactccactaagggtagatggacccatcggctaataccaaatgtgccagattggtagaaagaaaccatggtgaagggaacttccacctgacgcagtttctgtcaggacatggttgctatagacagtacctgtaggttcgggcactcagaatctcctgcgtccaagggtaatgtcgatgcacttcaaaaagaattgctcaagtacaaaaaaggcgacatacgatagtatcaaccgcgtagagctatggaaaatcattgacgagaacagatttcccgagaagctcacaagtctttattagagcaacaataaagggtgcgcaaaattgtgtgaagatttcaggcgaacattcctagttcgtttgaatctcgcccaggactacgactagatgatggattatcatgcttgttgttcaatatcgcgctagaacgtgttgcggagagtcgggcttaagcaaacaatttgcggattacacagcgtaacaaaaatgacatgtttacgtgtctcaaggatcaaatcatgtgtctctagtagatttggagttgctaaatctgatgccatcctccgaaatgttccagcacgtcacaatgtttagctacaggtcgccaaagttgtataaaacactggttttattgatgtttacatgaagtttaaagtacaatttatcttggtggttggaaataaccggaacagaattttaagagcagaaagtaattttatttaactagcttgagtgaagtcttgaacaggaatgaaaaaaattgcacaattgtttattaaagaaaatttcggttgctagggagaccatcggtctccaaggaggtcatcagcacactgcgttaccgatttactccaacaccccctctgaatcggtaagtcctaggagggtcctcagttcgcggaaacgtccatgttccagggccttggtgaacgtgtccgctatctggtttgcggtaccaattgcttcgatttgaagtcgtccttgagccacatgatcgcgtagaaaatggtgtttcacatcaatgtgcttcacacgcttgctttcagtgtttgtggccatcgcaatacacccaaggttgtcttcgaacaacttgaatgccgtgcctggtcggacttgcttcaggtcttcgaggattccatgcagccatagcccttcggaggccgcggcgcttaaagctgcatactcagcttcgcatgacgacagtgcaacggtttgttgcttgcggctggcccaggacacggtgttcccaaaaaccttgaagatgtagccgctaacggattttctatcctcagcatccgatgcccagtcggcgtccgcataaccgaccagtgcctcatcgtcgtcgttcaacttgtatttgagcttcagcttcttcgtaccctgcatgtaacggactactctttccagcgcttgcctatgggcttcaccaggttgaacttggaaacgacccaggtatccaaccgcataacatatgtcgggtcggacacacagcatcgtgtacatgaggctgcccagcaattaacgatagggatgcgacacaggattcgcagctcgtacgggcagtaagcagcctttctccatcggggtcttggcgggattgctggtttgcatcccaaacttcgtcagaacacggtccacagcagcttcttgtgtcaggtacatacacccagtagcgtgatcgtatcggatcttgcttccgagaaaatgattaacaacgccgcaatccgtcatctgaagcttcttggaaagagcacgcttgatctcctttagcaggtcacgccgatcgctagcgatgagcaatcgtctacgtagatgatgatgtatacccccccctcgatcgttgatcctggtatacagacagtagtcatgccgggaacgggtaaaaccgaaattcagcagaaggtcgttcagcttattgttccaacagcaagggcctttcttaagtccatacagtgatcgctccagcttgcagaggagattcggaggggccgtgactccttcgggtacggccatgtagacatcttcttcaagctcaccgtacaggaatgcggtcttcacatcgagttggtgaacgtgcatccttcggtgggttgctacagcaagaacgacacgtatcgtggccaacttcgctacgggggaatacgtttcgttgtagtcgactccgggcttctgctggaaccccttcgctaccaagcgcgccttgtaacgaactggttcgccatgctcgtccggcttgattcggaagacccatttcgatttaagcggaaccacaccagcaggacatcttaccagtcgccaaacatggttgtccgctagcgactgcagttcttcaccgaccgcttgttgccaaagggcttcgtcgacccgtccagcgatctccttgtacgcctcaggcacatcgaagataaaacgctcggcctcatcttgtcccacagaaccgtcgaaggtttcggactttatctgtagaatggctttatctgtagaatgggactgcgcggcagtgaaaatttttccaaccagaaattctttcaacttaccggggagtctacactcccgttcgctgcgcctcggggtttccatttcgaggtttgaaccacggtctatttgcgaagggagcgctccggtcgcttttactccgtcgtcttcaacctcgctttcttcatcgtcagtcaggatgtcattatattgagccaccagcggtccatcggattggacggactgttcagagggttgcacgcattccacatcattttgatcctcgaaatcgtacggagccacaaccaaaaaaatttagtcacgcatctcagtggcaaacggaaaattgctctcatcaaacttgacatctctggccaagaataacttcttttctttgtcccacaggcgataggcctattcacatgacgtctcgaatcagctgatcgggaagcactttgacagttcttctatgaaaatgacaggcccgtgttagcaccggtcctccaccgatgtaaataaatgcatagacggatctgtcacatgaaaaggcctataggcgttcggcgcatagccgatcatcactgcaggcttactcttcgggtccagtttgcctctctttgccgtggacacccaagcaaacgctttacagccgaaaacacgtaatttgctcacgtccggcttgtgaccagtccacatttccgcaggagtcttccaacatgataccgcgttcgttggactcctgtttgtcaggtataccgccgctaagaccgcttcgttccacaaatttttcggaactttggcttcaatcagcatcgcacgcaccttctcgacaattgtccgattgaaccgttcggataccccgttttgctgtggagtgtacgctgcggttggctcgacttggatccccttggaaacgtagaaatcccgttgagcgttggagcaatactcgcgcccttgatcgactctactctcggaactctggaacacctcggacttcttcttgatgggatatgctactgcgaagttcgtgtaatcatccagtgttgatagactcacactcaaaatctcaatcaatacgctctcccgtgagagcaaactcatttgagatctgcttcgcaaatctcacgcatgagattttgatgcaaaatcaactcaatcaactcaaaccgtaaaaaatgattcagtcgcaaaacccggcaaaaactcgtgaaacccgaatgttgttgtttacgttagaagggattactataattttaccagactaacaagaaattattgtcgtgtgtgagtaaactgtggaaatacaagacaatgagtcaaaaaggtgagccaactcacccatgattttttgactgctgagttgcatgattgacaactcacgcatgaaaaatctcaagcgtgagttgtgagaaattgagtatttcacaatgcgtgtaatcatcaataaaggtgacaaagtaccgagaaccatcccaagccgctggtgtgattggaccgcacacatcggagtgcactcgttctagaggtcttgcagcacgcactctagtacccgtgaatggttctcggcactgctttccgagaacacaaacatcgcaaaaatcaaatttacctggatcctcaggaatacctgttaccatgtcatgcttgacgagtgcgtgcaagttcttgctccccaaatgggccagtcgacgatgccacagattaccgttcacagctccacacatgttggccgccacagtattgacgcggagatcgagctcgtagaagtctccccgcataggacatctcgcaatcagatcacgaccgtgcttgaggattgctttctttttcgtgaatgtgacatccagatccgcttttgccatcttctttacagatatcaggatcgctcgaagatcaggtacgaaaaggacatcgttcaggctgatatagttaccttccctgttgacgcagtggaagcgtgctgggcccataacctcttgatggttggaaataaccagaacaaaattttaagagcagaaaggaattttatttaactagcttgagtgaagtcttgaacaggaatgaaaaaaattgcaccgttgtttattaaagaaaacttcggttgctagggagaccatcggtctccaaggaggtcactgttcccggtaaattcgcataaaaaactgatagtagaaaagatgttgtcaatctcggtgcatgaaattcccaatgttgtcagtataggcgtgatctggtagttaaaaattatgcctataagtacgatgaggctcctgatagagtctggggccaatggtaaaaacagtaaattgaagcgctaaccgaaaaaaaaacagacatgaggtactagcgaaactagccctgactggttataaagtttgtcactgagttcagttgtgattttggggttttaggctctcatcggacaagcctcgacctgagagagactcgcgaagaggaaaaatatcaacgtcatatgcagcccagattcccgtctcacgaaacgtcaaatgcagcccaccgtttttatggctgaaaaagtgaaaagtattgtgttcaaagtaaactgttattaaatacctcagtcggcggagcagttttttccaaagttgctgataaatctaagcagaagattaattatttctaatgtctgctacgtttgctggcatgaaatttcactcaaacggctatttatgattcgatgtgatgcaaactcaatcattttttgctgagaggttcatgtgaggatttgaacagcatgcgcataattggtataaacacaaagtggaataagaaaaaaactcagcaatcacagaaaaagaagaccgtcttcgcgagtctcgtctcaggcctcgaccaatcttaatgggactattatgatagggtgcagagctacttgggcacttccatgattcactttggcatggggggttttctcggccgaattgtctgaaactttgcgataagaagcaattaaatacgacgcatattgtggccaaaaatgagctcagtagctttcaaaagaccccactgccgaagtgaatcaaaagtgccaagaataggatccggctccctatctttggcttttgaatgccagtaacatccattgggtgttctctttaagaaaaaaatacatcatatttatttaaaaccaaataaagtttcgcattataaaatactccaccagctttccagcagtggacattttcacctgcagataactgctgacagttttcaagctttccgaccacggaatgaaacgataatcgtacggttgctatgcctactaggtacccatatttgcaaaacggaaggagttgatatttttctagatcattgatgcattatttccacgaaatggttggagcaaatcaaagcaatgttgggttgggaaaagaggagtgtgcattttccttctccctgatttattgatcaaagcaacgctatgcaaaggagattttgaagactgcgtgtaaccactttgcatcaaccatcgtattatattcaatttccttctcagatccccatctgattatgctcataattcctcacaaatcgccttaaaatcgactttttaatgggaaggcatgcaggattccagttggggcgtacgagggttcgggttgtcccttatcctcatatcgctttaaaatcccctggtttatttgccgccttttgtttttcctgcttgtgatatttttgggcttgttgaaattccgccttctgccttaaccttctggacgcgagcgtcatttgcaagataaacaaattgactggatcgtgcaaaacttgtatatcgatattctgttcaaacatgtatctcttcttcttccagacgacatcccctatctgaagtctctgctgaacgacttcgaggacgttaaacaaatctccaactggtccatcaagggtcaaatcctgaaagacttcatcgagttgaacgaaaaggtaagtacaatgcaaaaatgaacgccttgcgatcaatgacctatatgacaatgcctccttttcgcagttcgacctgatccgggacgcgatcgacgacgaggtggccgaggcgcggctcgaggagctcaagcccaaactgtccgacctgtgctcggtgatcaaaatgttcccctgcccgacgccgaagcatcgcctctgccagagcgaaatcgcccaacggctagcgtacctgataaggtccttcttcgcgcaggatccccgcatcaacagctgtgcgctgatgaggagcgcgctggagaagcttccgctgccgcaggagtacgccaaggaggaactgcggcacatgttgagcgcgtttctggtggaggacctccggaagcagcagtaaccgaaccggcagggaggaattttaatcctaggaatcacatcgactatcgtgaaagaagacaactaaattatgcaagagtttaatagaacagagtattttctagcaacacctataatcttattcatttgttgagcaacaatatagataactacaactacactacagctatgcaactggttattgatttacaagcacgtttataactttaacagaaaacgggacagtccaactatgtattatctaataatttcttcctaaacgtacaacagttgaagacgatttaaagtttagcagtttcattatgaaaaaaaggttatcagttcgtttgtgttatgtctgcgagatatcctatctttggaaagcaagaaagtacttcgagagtgtgtaaacaacagcaagttatagttgatttttttgagtttttagctttaagcctaagcgttaagagaatttggagctatgaaatccaaactaaaatctatacaaccaagaaaagcggtctctatttagtgttcatgatgaccagccctgttgttatgcattagggtacgagataggggtcccaaagcctacactttcacagcgaatggtcattagttcgattaccagccccttccacagcaaacttcgaacagccaccgaaagacgccacacggaggacttttattaaagtgaatttagagcgaaggcatatcttgaattttcaagaggacaaatttgaagagacagtgaaatttgacaaatttgaagagacagtgaaacccactcgctgatggattcatcttttctttgagaagcacatcaaatcatccgtcagtattggatagtgactgagacttagttttttgatatatgagaagaagtgagttgaatagatacgtacacataataagtatcgctttctcatacacgtcacagcatgatcagtcgactctgctgtgctagatagtatagtagccatgatttgattaccgtcttccacagcttatcgacatttagctgtcaaat

SEQ ID NO: 96 - DNA, 2554 bp, Aedes aegypti
taaatatttaaacggcatttgcaaagaaaatggcagcactgaatatcccaccttgtagtgatttattccaaagaatacgcatttttttctcagacttccaacgcctttccttagagcaaaatcctaatcaaagcaaccattgacaagtgacaaattgccttgctagaactaccatcgaccgcgcgcgcctacttcgtccacccccacgtggacgtttccgatgcggtgaccgagacataagactcttaacgtggattatagagtccgtcccattgtcgaaccatctccaatgcgaagaaaattctttttcatctccttcaacgcacgcaaacggaatcaattgttgaaaagttaatacccctcacatggactacggacatcggtgcaagacaatttcccaccgcagatggatcccgctttctggatggcaggctctggtgtgtcattgttgggcctaattgagatgtcaccacatattgattgtgaacacgtaatcaactgtgaagttcgcacacattcgaaccacttagaaacggtagctgttggttgtcgttgaagacggccatccagttcagtggtgaaacagcctactaagtattcgtttgttgatccggggtttgtcagtagaattcgatcgttttggggtgatttttggtcggatttgtggatcaactgaatgaagtgaacctcgtataaaacagtaagctccgaaaagaatgtggaatatttttaaattatttggaagatgtttaagcactgtttcaaatgatttccaagcacagacacaagatttcaacagctattcactagtcgtttgtagtgttccgtattgttgttctttgaaaagaaatcaaccattatcttttatttttggacaaaatataaacaattcagaggtaccacatcacatggattccccttacaaattatgattctcctaatttcataccaaaacagcagaccgttgctatgtttcgttcatacctagtctttcaataaaaggagtgaatagctttggaattctccagtcgagtcaaaaacagaagtggaattgcaatgaaacagtgcttactaagttatctttctaccaaaatattcaaaaaatgttttttcgcattatcacaggcatgccatggagaatgcctgccggcatactgttgctacagttgctaatgtccctttcgggcatttcttatggacgcgcactgaactacctaaacaataggcagccgaaggaatgtgtacagttgccggcgccagtactgtccaatatcctagggccggcgtacaattcgcgctacatgagcatcgacaagccccccgttatggacgaagtgccggcccacggcgaaatggacggaaagcgacgtgccggaattgggctgtttcccactttctacgttgaagacgacttttcggaggaactcggaaatagtccggcctgggccgtagaccacgtccaagatacggccaatcaggttctcaaagcgcccttcaacaagcgggaagccttcgactcaattctccacgaaatggacacaaaaacccgttccgctcggaatgctcgccgtggacagaacggtgacggaacttctcgtccgtgggaatgcgacgccaagatacgctggattgacctgggagatgagtactaccctcgcttcctgcgcaccgtggaatgtgccaagactcgctgctggtatggccattaccagtgtacaccgagatccttcacggtcaaaatgctgcgcaaacgtaccggacagtgcgttccggctgaccaattgcacaaggttggcgtcgatggactccccggagagctgagcgaactttgggtctgggaggaacgggccgtcaacttttgctgcgactgctcgccccggttctgatccccccgctaattttaactcgtgaacattgatgacgaaatattttaataaaccatttagaacatgtcattccccttgttttcctggtaaaaaatcaatcacagtaggccccttacatcggtatcggtgagcgaagcgtcgcctgccacgatttgcataaatattgaaacaattttccacaagtgggccctccggcgatcggaccaagtgggagaaggtgtttcatattcataaggctaatcggaatatttttcggcgggtgaagtggtttaactaagtttgtcaaccccggcgtgcgggcgcaaatattatgtcgcctataatggtaattgtcgtgtaatggcttaatcatagtaatcgacagtagcagtcactgttagcgagattggactaaggaagggtgtgaagtggttttgcatagaaattggctgtttaagggaactacttaggaatttatagaatttggtggaaaggggacggaccttttaaataattttaaattttattattatcgatttttataaattccatccatgccctgaatgaccttatattagttaaagggtatggctaaataataaaaacaattataaattccattcgagaatctcttatcaatgaaagttcggaatttatttagaaaactttgaattacaggaactgaatta

SEQ ID NO: 97 - DNA, 104369 bp, Aedes aegypti
  misc_feature (49529)..(51608): n is a, c, g, or t
  misc_feature (59935)..(60417): n is a, c, g, or t
  misc_feature (65590)..(72091): n is a, c, g, or t
  misc_feature (86862)..(87108): n is a, c, g, or t
tgagctcaacaaagtgaaggccgtcgttcatgttatccagtcagtgccgcaataaatgttcaactccagtggaaaacgatgcgcttattctcatcacacgcgtcgaattttcccatcgcttcgagccgaacgcggagactggagatgttccattaagcacttgaaaaagtgttcttgagtgattcctctcctatagatagcgagtggaagtgtggaagaatattttaaactgctgctcgcggagattttcgctttttatgaaggtaataaatgtcaaagcgaaccgcttgaagtgagcaaacaagcgcgggagcgcggagaacggggttggttgggtacatcttaacatcacttcaatcgcgatgcacacaccttggaagttttatttgcggcgtagtcgtcacgaacgatgactacattatgccattatgtaacgctttacagctaacaaggctgtggaaagtgaacaactcgtcgccagaataattctcaacggctatgacgaacactgcgctggaactagcttctctcaaatctaagtggggggaggttgggaagttcctagtcagcgttccattttcatgtttcacatctcgttagatgaaaactgtgaaacagcggcaaacactatcgtttgttcagtaagttgacgcatatgctcttagttctaccacagacaaacagacgtaacacttaaaacgatttcctttgaaatcgatcgttcatataagatggcgctagtgtgaaatgtcaaacacgaagaaaaacgacgtgcgcgcctctagttgtgagtgatagtgataggaattttgaaataatcgtttctagtgtggtcgatggaaatttccttaatgttacgtctgtttctctgtagttctgcccttttccttcactgctcgctagcattgtaagtttgatcggttgggcattgtgcaactttgttcatgttcttcgtaaagaaaggaaaaatggttactttctgatagcggggctggaagtatgccaaacgcaaagcctactttgtcatttgttggagaattttttttcaggcgaatagcgttgacacatattctccgtttatgttcggatcgtagcagacattgtggctgcagcaagcagaagcccctagcagaacatatattatttgtgagtcttaagtgaaatgagagtccgtgattatagatgatgattttaaattcttgattcgtcttaaaaacgtgaggagatggcaatgtcaaccttcaatcgagagcaagttttcctaaactggggaactgatttggaagaagtaggaaatattattgaaacaatcaagaatatgattttttacatcctcatcaagaatcccggtggaactacacgcaaacgggagatctgttcaaacgtttgccttcctcgatggagggtccgactcaacgttggtagagaagtcgctggtcgaacagctaggcgtacagggacctgtatcaccactgtgcatgcagtggaccaatgggatcaaaagattggaagaagattcgaggaaggtgtgcatcaagatttcctgtgtgggccaacgtaagcagttccagttgagaggtgttcagaccgtggacagtttggaccttccgcgacagtcagttcgcttcaaggaactagaagatcgtttcgcttacctacgagggctacctgttatgagctacgatgacgtcattcccggtgttttgatcgggcttgataacaccagtgtgaaaaactccttcaaataacgcgaagggatggccgatgaaccagtagccgccaaaaccaggctaggatgggttgtgtatggccgcactggatgcaaggatcaagcagtgtctcgttgaatattccacgtttgcatccgtgcccatgacaacgatctggatgaatcgatcaagcagttcttttcgacggaaagtgttggcgtgtctgtagcgaaagctgtggaatcggcagatgatcaacgggcacgagaaatactccaagcgacgactgtacgaactcctgccggtagataccaaacaggtctgctttggaagaacgacgaattcgaatttccgaacagttttccgatggctgaacggcgcctcaaatgtctcgaacgccgtctgtccaaatccccggagctttacgccaagatgagacaccaggtagcagagtaccagacaaaaggatacgcccatgtagctacactacgagaactggagaaatcgaaccctaaacgcgtctggtatctgccgttgggatgcggatggtctgggatgctgcagcagttgtacaaggagtgtcgttcaactcggtcctactgacaggtcagacctattggtgccccttcaagcggtgctaagtcgctacagacaaagaaattgccattagcgccgatatcatggaaatgttccaccaggtggagatcaggccagaggaccgacaagctcagaggtttctatggcggaataatccaggagatccaattcaagttttcgttatggatgtggccatattcggttcgacttgctcaccgtgctctacgcagtttgctaagaacctcaatgcagatgaacattcggcggaatttccagaggcagctgtggcgataaaagagaaccactacgtcgacgattatctggatagcgtcgacagcatcgacgaagcagttcaactagcgacagacgtgaaaacggtacacagtcgaggaggcttccagataagacattggatgtcaaactctcccgaagtattgaggcgcatcggagaacaaaattcgctaacagtgaagagcttcgtgatggacaaggacagccagcaagaacgcattctaggtatagtctggttacccagcgaggacatgttctcctacaaaacaagcttccgccgcgacttgcgattgctcgaagcttctgtcgttccgacaaaacttgaggtgttgagactggtaatgagcctattcgacccattagggctcatcgcatcctatatcatcgaaggaaaggtcatcatccaggagatatggaggtctaaagtcggctgggatgagcaaattcctgtcaaactacttcaacgctgggaacaatgattggagatactccgggcgctggacaaagtgaaaatcccgcggagttatttcccaacctacagcaaggaagcctttgaatctctggagttgcatgtcttcgtagacgccagcgaaagcgcgtttgctgccgccgcttatttcagagttgtggacaacgggaggattcggtgctgcttggttagtgcaaagaccaaagtagctccaggcagctatgattggaacgcgactaatgaagaccatcacagacaaccacaccattcctatcaaacggagggtaatgtggagcgattcacgaaccgttctcacctggctccgatccgaccataggagatatcggcagttcgttacattccggattacggagatcctcgaggagacggacgttgttgattggagatgggtgccgactaagttgaacgtggcggacgaagccacaaaatggggaaagggtcccaactaccacgagaactgcaggtggtttgacggtccggcattcctttacaaggacgaatcgaagtggccagaggaagacactacacaagagaaatttgcggacgaagagttgcaaaacgtccgtattcatgtgcaacgaacggctgaacttatcttggatttccaacggttctctaaatgggaacggctcgtaagaacagttgcgtatgtacgccgttcctatcggaattgccaacacaaaaggactggctcagcgaccattatgggagtcctttcatgtgaagaactgaaggcagcgcagaattcggtctggaagctagtgcaggaggaagccttcccagcagagtttgcagttctacgaagcaaccagcaggtgccttcggagcaacggaaaacggaggaaaagagcagttgtgtctacaagctggcgcctttcctggacgaggaaggagtaatgttacgtgtcatacgaaacggaattcccgatcatcgtacctaaacagcatcacgttacacatctcctggtcgactggtatcaccggcaataccgtggtgaacgaaatccggcaaaagtacgtcataccggagcttcgggttgctgtaaggaagattgcgaaacgctgtatttggtgttcggtgtatcgagctgtaccacaggttccgaaaatgggtcctcttcacgttcgttggcatagtttatttcggaccacttactgttcgcgtcggacgggctagtgttaagcggtgggtagccctattcacttgcctgactatactagagcaatacacttggaagttgcggcgtcgctatctaccgactcctgtaaacaggcgatccgcaggttcattgcccgcagaggggcccctctggagatgtactccgatcagggaacgaattttcaaggtgtaagcagtgaactggacaggaaaatacgggccatcaacggagcgctggcagatactatcaccaaccacagaacacaatggaagttcaatccaccgcacgcccctcacatgggggcgtttgggagagacttgtaccacataacatatgtggaactccgaagtgaaagcgagttgaaaagttgtacccacttccagctgctggtaagtggtatatctagtatagaagacatcgaactgccattaccaggagtaaacaaaaaaacatatgattcgatcagtagaccagttgttgcaaagattacagacattaagatcgggggacgatcgataacgttggaaagcaatgtctgaagataaaacatatttatattttcataaaatgtaattttttttctgctatactatttaatattcatgtttcataaccacagaatgtgatcgtttcgaaaatattatttcctatcaaaaaacttcctgtttcataacgtcaaaaagcttttgctttcgaaaatcattccattcgttcacctaaagaatataattctagcataacaacatagatatcaaatacattgaataaattatctcgaatacgagtagtgtaaatctcattctaaagttgaaccataaatagttattttcattctttttgttgccactctagatatatgttatctttgattcatttcaatacaatgccacattgggccagaccgcaaaattagatgaaaaaaaaaaatattttgattatgaagatgattttctagaacacttaggcaaaaatgttacatatgatgaggactacattttggcattaagtgacattagggtggtccgacaaaacacggaaatatttttgcaacttttatgctttgcaatttaacgcttctataaagttgatctttgtttaattttgaacaactttgccaaagacgctaatttttttttttttttttttttttttttttttttttttttttttttttttattagtatcattccaaatattacattcatttcttatatctaggtgttctgtgttatttgacaacactatcatcctaatttgctaaaacaaatttaagatttaattaacattttgttaacaacatattacatttcatttgccgtagcagttcagttttttttacaggtaagttgatttcacctgcttataagagaaaaaaaaaacgtttttaatatacttaacctaacgtaacctaaacatataacgcattaatcgtggcaatagaagattgtaacgatttttgcctgaaattattaatgattgtatttgacatttgttccaatgtttcaacattggatattctatgtaactcattggtactataccagggaggaagcttcagaatcattttcaaaattttattttggattctctgcagagctttcttcctggtattacaacagctagtccatattggtacagcatacaacatggctggcctgaaaatttgtttgaatatcaaaagcttgttcttaagacaaagttttgattttctattaataaggggatagagacattttacatatttattacatttggcttgaatgccctcaatgtgatttttgaaagttaaattcttatctagcatgagccctagatacttaacttcatctgaccaatttattggaacccctctcatcgtgacaacatgtctacttgaaggtttcaaataaagagcttttggtttatgtgggaatattgttagttgagttttggaagcattaggagaaatcttccatttttgcaagtatgaagaaaaaatatccaaacttttttgcaatcgactacagatgacacgcaggcttcgtcctttggcggagaggcctgtgtcatccgcaaacaaagatttttgacatccctgaggtagctcaggtaagtcagatgtgaaaatattgtataatattggtcccaaaatgctgccttgaggaacaccagctcttacaggaagtctttcagatctggagttctgataattaacctgaagtgtacgatttgacagataactttgaattattctaacaatgtatgttggaaaattaaagtttttcaattttacaatcaaaccttcatgccaaacactgtcgaatgctttttctatgtctagaagagcaagaccagtagaatagccttcagatttgttggaacggatcaaatttgttacacgtaaaagttgatgagtggtcgaatgtccatggcggaatccgaactgttcattggcaaaaattgaattttcgttgatgtgggccatcattctgttcaaaataaccttttcaaaaagtttactgatggaggaaagcaaactgattggacgatagctagaagcttctgcaggatttttgtctggttttaaaattggaacaaccttagcatttttccatttgtcaggaaaatatgctaattgaaaacatttgttaaatatatcaactaaaaatgataagctactttctggaagtttcttgatgaggatgtagaaaattccatcatcgccaggagctttcatatttttgaattttttaataatagttctcacttcttccaaatcagtctcccaggcattttcaaaaacgttctcttgattgagaatattttcgaactcctgagtaacttcattttcaattggactagtaagtcctaaattaaaattgtgcgcactttcaaactgcatagcaagtttttgagctttttcgcaattagttagtaataatttgtttacctctttcaatgctggtattggcttctgaggttttttcaagattttcgataatttccaaaagggctttgagccagggtccaattgagaaattttattttcaaaatttttgtttcttaattgagcaaaacgtttcttgatttctttctgcaaatcctgccatataattttcatagcaggatcgcgagtgcgttgaaattgccttctcctcacgtttttaagacggatcaagagtttaagatcatcgtctataatcacggattcaaattttacttcacattttggaattgcaatgctccgggcttcaaaaatggaatttgttaaagtttcaagagcattgtcaatatcaagtttagtttctaaagaaatgtgaccatcaagattggagtcaacatacgttttatatatattccagtcggctcgtaaataattgaaagtggagctgataggattgagaatcgcttgttgggatattttaaatgtaacagggacatgatcagaatcaaaatcagcatgagtaatcagttggctacaaagatgactagagtcggttaagaccaaatcaatcgtagatggatttctagaagaggaaaaacatgtagggctatcagggtattgaattgagaaatatcctgaagagcactcatcaaataaaattctgccgttggaattactttgagaattattccatgaccgatgtttggcattaaagtcaccaatgacaaaaaattttgacttattgcgagtcaatttacgcaagtcagtttggagcaaattaacttgctgcccagagcattgaaaaggcaaataggcagctatgaatagtagtttacggaacaagttgcagaatgatgatttttacagcacgagtcgtaaatttatcctacgaggcttgccgagtaggataattacgacgagtgctgcaaaaatcgagttctgcaacgagttacgtacaactttttttgcaatttcgtagaagaccacttgagggtatcagaaattatatcagaatgcattcaccattattttacaatttctgaaaaaaatgttgggtaatgattcattacgcaactcaaaacagttgcgtaatgagaatgcgttgcgtaatgaatcattacagcactggtttcagttaggtaatgactattcccgcactccatacttcagtgcaggaaagtaggccgtttcatgacagattggcgtgatgaaaaacagcctattacgatgagaaattgcaaaaagtatatttaccaaactgtgtttcaacagaaacacctaaagtttcaaaaactttagtttcaaatgatgaaaacagttgatgttttatacgcctatgaatgatgattgcaactcccccacatgccccatcaagtcgatcattacgataaacaaaaaagttaggatctcttttgagtttagatccaggttttaaattcgtttcggtaataactgctatatgcacgttattaaccgtaagaaaattaaacagctcgtcctctttaccattcagagaacgatcaatcatcaatcaatcattagattcaattgttcagttagaaaattaaaatcagaggcagacatgtcatgtgatttcccattggaatttccggtagacgaagaagcggagttacctgtggcggtagggttttttccatttgatttgaatttaaagtgaactaaataaaattcttgagaaagccctttccgaacaatgccagattgggttctctttttcataatgattacttgcactggggaaaatccaagtaaatcatttattccatttttgatctcttcaggtgatttatagtcacttgagagacctttcaagacaactttgaacaaacgttcagttttgtcgtcataagtaaaaaatttgtgcttcttctcttcaagatgtttgagaagaagctcacgatctttaagagtttccggcaaaacgcgacagtctcctttctttgcgatttggaaggaaaccttgattcccctaatggagttcaagatctcctgcctaaatcccccaaattcggaacaaatgaccacgataggcggcactctttgcttcctcacttgaatcaaagagcctgggctagaggctgcttcgatttggtgttcggaatatttgtctagagcatcgaactgattgctcatttcgaaacaattattcatttcacccttggaagaaagttcgcattccagggaagcgtcctttcttccattcttgccacgtgtagtgacagttttaaaacccacttttttggaaggaagtagtgaattcagagattcacccttccttttgtttgttgttgataccatgtttaattaataaacgaaagaagacgtgaccttcgaaaggttttttcccaagacggtgtccaagaaggattaccaccgctagctttcgccaacgggtccaacgaaaaatcgaagacacgggtccaaacaaggatcgtaaagggatcaatagtagaaaaaatagtactgaaaagtactgttttagtagcactgaaaagtaccgtttttaattttagcactgaaaagtactgtttttgtagcactgaaaagtactgttttattgctttaggtagtttttaagaaaacttccaagagcagagagaattcgtgtacgcacagcacgaaggtacgatgcgcactgccgaagacgctaatcttgtaagtctactgtagccgttgctatggagttttcaattatgcagggtagggtggtccatgaaaaattgatattttgcccataactattttttattttaaattctatcaaaattatggtgtattttggtgaaataattaagtgattaaattcattcgtttatgagatatgaccatttttattcaatagagttttgtgtgaaatagacattgcaatatgcacaaaaaaccgcagcaacaaaacaaatccagtgaaaactatcgacatttcaatcaacaatcttcaattattgcctacttagactaaataataaaattgatagccaagaaatgtcaaagccaaatcaccccccgttgttttatagcgtaaaaagctggattgttctgataaaattcattgttatttccacatttttttcattacaacaaatcgaaaacacttattgataacaacaaaaatatttattattttgaatagctgtcaattctccgcgtgttgaagtttactgcaaagttttgaacctaatttggttgaaaactttcaaactgaaatttttttagcatattatactaatctatataatgtttagattcatattctgaacacttgcggcttaggctgacttgaaatgcaactaataggcgaaaatcagcctccttttattgtatttttttcttaaaagtattgaataatattttgtttccattgtcaatcactgtgatttgctgccacatattccgaacagtacgaataaatcctattcatataaataattcagcatacaaattaatcgaagttggttcatctgacatcgagctagaaagtcattactactcccagggtataaaataggttcaaagacaataaatttgagttgcaattgaattccacttcctgggaattggatgacatatatcagtgaaatatttcaaccaacacgccatacaaaatctgcgtgttcggaataagatcccttattttaatcatcaatgaaaatgttttgattcgttgtacgtttccaatgaataggctgtgtatggttgaaagcgatcaagtttaattcaaaaaaaaaaaatactgtgaaattgcaatgctttttgattttgtataaaaaatactttgcaattgataagcattgatgcttgagtttggatcagtttacattacaaagaacaaacgttcagcttcattgaacaacatgtgtaaatgcttgtaaaagccatttcatagtatgtcgttatgtcaaagatatgtactctgattatttcacttattccatttaatacatttcatacatattattactgatccattgaaacaattgtcgtaaatacaaaggtgcattcgatctctattacaaaaggtttgtatttataaaagaaaaagttcaacatatataatcgattgacaagatttctgatggttttgactttgtttttgtcagcactcaacaatatttcagctaaaatcatgaactttctgtaaaatatgttcgttttttcatcaaaattgagttctatttgatccttcgatcttgacgcttgtccctgcgggggcgagcgatgagggcaggatcaaacagcgcgatcagtcgagtagtgaaatgataaagcgttgcggattgttaagagtgtttgatctattgatcgtgtcgcttgctcttgcgtggacgagtgatgaacacttggtcggcgtacaatgcgtttatcgaattatatcgcgaatccgattacgcgtgtttatatcatggatcgcattaccaacaattgtgactcccagatctttaccttatcccactaacccaatatcctttccatgacagctgtggagatgtagaggtatactcggtcttcagtaacaacggttgtctaactaacataccttcccttccccgatgatcgtaaggatgtacccggcgccgttattaactttttaaatttgagttctcgatttgtgcacattgaagaatggtagccccattcattaactctttgtgtaacttcgattgctctggtcaatcgaggagtagcaactacgaattgtacggttatctatgctcatgctcatgctcaatatgttcgttttctcatcaaaattatacggtaaatcctccaatattctccagtgatacaatataccatttgaacctctaagttatacctttcagatcctgtgcaaattggatccccgttgttgttgatattgacgattgaaaaatatgaatttttgtataaaactggtcatatgtcataaacgaatgaatagaatcacttaactctttcaccaaaatgcgcgtttctaactaactatttcttaaactttgtagaagacgtgattttgatagaatttgatgtaaaaaagttatgggcaaaatatcaatttttcatggactaccctaccctgcaacattggaaacgccgtagcaagggctatagtagacttacaaggttggcgtcttgagcaaagttgttcaaaatttattagagtacaactttattgaacagttcaaagcgctagctttaaaagcataaaagttggaaaaaatatttccgtgttttgttggaccaccctaatgccactgaatgtcaaaatgtagtcctcatcatatgtaacatttttgccgaagacagttttgttctaaaaaatcagcttcataatcaatctttttttctcctaattttgcggtctggcctaatgtgcaatgtcgattgatgtattggtggtataacacttttgacatttcgatgtccttataccagcatgcaaatattaaactgggtgctactttttgagctcgagttccacttatgttatgtgcttgtacgctccgtgaagcacggtctcagctgtctactaagtgataggaatccaaacgacgagactttggcaacagcagttacggaggtggtcaattcgcgtccgctgacctatcttcctctggagagtgaaaagactgaagccttgacgcccaatcattttctgctcctgagctctagcggcgtagttcaaccacctacgaagatgacggatgaagcttaagccctgcataccaactggggaatgatcaaggtaatgctcgacaacttctggaagcgtgcggaatgtccaggtcggcgatctggtggtgttggcaaatgaaaaggacaggaacagctggacacgaggacgagttctccaggtctatccaggcagggacgggcgagttcgtcgagtcgacgtgcagactacagcgggtatccttcaacgacctgtgtccaagttagcggtacttaacgtcgctgaagatcttgatatggctgaaggttctggcagcaatacggtcaaaggattgtcctacccacgattcaacaaaacaaaacacaagatcagcagaaatacgatcaacgtcgtaaggtttttcattgtattctcatagtatgacatggtttgtacatgaccccaaaaagttctgactcgtgagaagaacgattgagaatatctgtaatgaaaatcatggggaactaacatatcttaacttaactgtaataattactacaagaaacattaaattagaaaaacaaatggatccgtcttcgatggaatttctgaattaatcaataaatggtttcttcgacatatctacagccaacggctgtatatgttctgggacaaattttcaagagcatttctggaaatagttcttgagaagtttttggaacatccatagataattatcagaagattattgaagaatctttggatgaagttatgggttagtctaaaaccagtcacatcgtgttataaacagcacgagtgtgatggtgctcagcgatttctgaaagtgcgatctctcttgacataatctatcaaagcattgctgaatctcttgacgattttcatagaaattccgatagaactcacacagcacactatctagaagttcttggttaatttagaattgccgtagaaatttctggaagtaattcttaattaactactttaatattatttgatcaaattcttactgatattttgtggcatctttcatagaaatatttaaagcagattatggcgatttttcaagagattttttgcagaattgctcaagaaattccagcgaaatatttgtaggtgtttctgcgcgaagaagcatttttcaagcatcttcagtttctcctgaaaactcctgaaaagccgggcctcccaaattcccggaatttttgctgttcatccgttagttgtctagaaataaatgagaaaattagagcaaccacactggtagttaaggcaagaagtctctacttttaacggaagatctttagggtatatatatatcaaccaaaatggtctctatagcctttctttcttcttattctgctagcctttaatcctaacgcagaattgtacagaccccaaagaaactttcagagactataattcccgagattagatttcccgagaaaaagcttcaggaactaaagcatagtcatcatagtgattttatttaaaattctttcagggtcttccacagggttctcttaagaagtttttctagaggtttctctacaaattctccccaaaaatctttcagcgatttttcaaaggatacttagaagaatttctctagaaattacttcaggaaatccttgagaactccaaagctactacctacagtaatttcctcaggtattactttgattttttttttcaaaactaccctaacatttcctccaaatatttttcactaatctctcaaccgaattatccacttgttagtcttcaagaaatcctgcaagaatttctccatctgttcatgtggattccttcaagaattcatccatgtttgcttcctcaaatccaaaattcctttgaggctttcttcgaaaaaatctttttttttctaggattttttccagcatttcatccaagtattacccctacagtttaccaaacattccttaaaaaagtttctcaaaatttcccatgcagtcatttaagtctcacatcctatttatactacagcaattttttacaataattcctccgattattccacaaatttctatatagcttctgtctgtccaatgcttttccagaaatttctttaaagaatcctaggaaacgctatcccgagattcaattgattttttattatctcagtaaattatctgggaaattttctaaaatttctttaagagcccaggagttatttcagagatccttgttcattaagggtgacttcaaaacttacacaagttttggcagaggttactatatgagtttttttttagaaatacctcactgatttattattcagaaaaatttccttgaagacattcctggaagaattcctgaagaaaactttcattttgaccgggaatcttggtggatgtcccagggaaatcgatggatggatcactggataaaatcttggatttgaaattctcgaagaattcaggtggttcctaaaatatttttttaaagaaattacatatctattccaaaatccaggttattagagaaatgtctactctgatgctatgaagagttaacttttcagagtcaaactcttatctcccacctattagatttcattttgtgttctgggttcctgtttggtttcttcgtggttccttttatatctcttttttatatctatagaggtcttttcttcctatttttaaggcactaagtcgctaacagctcgacaaaaaacttgtttagtcttgtggtaaatgctggcattaaattgagaggttagaagcaaagggatgtgactataacctaattttgtgataatctacttaaaagtttattcagcaatttttcattctataaaaattgtataggggtcaaaaaaaaaaagccttttctatttttaagttgagcggaaaagtcacctgaaaatatcgttcgaacgcttgtaaacagaacttttcaaagcacaatgaaaatcatcaaaattggcaacactgccgtaatgaaattgattttatttttcatgtattattttcataatatgttattctgagataaccaattggaacatttggaggaaaacgtttataattttgttgtagattgataaatatgcgtacatgattttaaaagtaagagattattttagtgaaccgaccataaagagtaaaatttatagctaggaatgtggttgaaacacactcttttatacaaacaacagttgaacgatgcacagaaaaccgattacgattttatcaaaaaataaaaaaatatatagcataaccaatatgtccactttataaaatgaacagtccttaaggagctactctgaaaaatatttaaaaactgtcaagtattattggagttatctgaatattgcgatacggtgttttttgaagttttctagatctttttttggccagcgtggttccagacacataaatgcacatgagaatgagcatgagcatgattgaccgctcgcagttgctactccgttattgccagaacagctgtacttacacagggaaccaacagacgctactcaggatcagtagcatcctcaatgtgtaagaactggtgctctcatttttataacaaacaataccggcgccagctgcgtccgaatgcaggtcaatttgggaatgggagggaaatgttgacgtgttgttacttgctttatgaaagccgaggagccctctgcacttccacaagaaaacactgggagtttggatatgggaaaagattcgttttggtaaacgacaacaatataattttaaatgaatgcgtgaacatatacacggatgattgataacgatagtgcggatcaaacaaaactgacgcgtcattcctttttccactcgcacactttgttttcgttttttcttcagcaaaacgcgaaccggacacaattgatccggaatacgtcgctcgcccacaaaggagcatgcaacagattcaacggatcaaacaaaactgacgcgtcgttgcttttttaactcgcacactttgttttcgttttttcttcagcaaaacgcgaaccggacacaattgatccaaattccgtcgctcgcccgcaaaggagcatcggttccattcacataaatgctcattactcaaaaacgactgcatcgaaatgttttattttttcacaacatactctaattaatttactgttttgaagagtgaacttttcgaatacggtaaaaaatctgtagcctgagatatttacgttggttatggctacgcgtcggacctccaaggagtttcggaatatttccggatccaggtatcaatttcgacccagattcacaaaacacagaagtgtttttttgagaaattgtgaaaaatggtgcaaaaatatcgagaaacaaaaaagttatcgctatttgaatatttttttgacggtgaaaaatgaagctgccggtagaggggtttattattaatcgtaaagaaagcagaatcatttcaaggtggattattcaggattcactgccatgacaaggaaaacaatttctatacaattcaaaaactccactgcattgtgtacaaatattttccttcgtatcaggattacattcccgttgctattgttctttcgttccaacctggttcggagctttcaattaactccaagagcgacagaaaatttaattgaaattttctcctatttagtcggaaggtagaaacgatttctcctctgccttggttttgcgtcatcgtcaaggcaaagcatccgggaggtgggtaaccatgccaatctcgcaccggcatcatcatcatccggagaatcatcgtttgtgtagagctcaaggacgaagttttaaggcgaatattcagggtgaattggaattcaactttaacattgcatcgaagcttcgaaagaataattttcatgaagcaagcctaaagcctcagaagaagatcactattcgttcagtatagtttcaccttaaccacccattgatgcctgcctggaacggagtaatggacggtgtgtgcaattataatgtcagtttgtctgtcggattgtcgatccgagactgcctcacgcctgccttcctccctctatcgttcatattcttcaagtgaacgattgtggcaagcaaatttagcaaattcgttacgtcatctccacatctgggaccgtgaccgatatgcgatgcgggtggattacttcagtggtttggattttttcgtagagtcactacagtattagaaacaataaattccaatgtaaagacaaaaggtctgatttcgtcaaatgcttaggccagtgattttcaaaatgggcgaaatcgcctcggcgattttcaataatagggagacaatattgtattatgaacagcttttggtttatgcacaaatattatgagttgatttatggaagcatcaggagaatatttttcctttcttgcaagtatgaagaaaaatatcaaaacaaatataaatatataaataatcatctgcaattattgctctgaaaatttctaatggagtttacttagtgattattttcgaattaatttcaccacgaattttcctagggattttctcgaagaattgcatttagaataccttaagaatacaacctggatttttctgaagagaatcacagaaatggaaattctttaaatattgtttcagatatcatctgcattcctccaaaaattctttaagaaattcttcaagaaaattctatcacctccaagattttatccagtgatacatccatcaatttctttgggacatcctccaatattcccgttcaaaacgtcttctaaaattcaatcagtaatttcacaagaaatttttaggcatttcctttaaaattgttttttgagatttatataagatttcaactaaggatttctctgaagataccttcagcaatcgctccagatatcccatcttagatttctacaggaattcctccagtaattcaagtaaacactggtttgctgttgagtattcgcttatctcgaagcgtagaaaatttgcttccagaaatgttaaataaaatcatatttatttgatctcagtacgcagtagatagtagtagatatagtagatatgccatttcatatgagactccctgtaggacattttttgaccaattcagtcaatggacttcttgactgccttcttgatcctgaacaactttttggcagcatttgcaggacatggtgatcttgtttgatggaaagtggtgagtatatcacccgattgcaaaacagccagaaagtaggcaacagttgagccacggcttgtgtacaagtgttgaagcttgcaactattcctgatagatggcgcttcgagagaaaaaaatcaaaaaacgttggtcagaaacgctatacaaatttgcgtaggaacaatcgaagaaaatattggaaaaatgctgtagtagaaacaaatgagaaaacttaaataaacttttgactattgcatgggaggtttttgataaacttttcaataaatgcttggtaaaactggttgtttgaagaatgcctcaaggaattttcggtttctaacagaaaacgtggatgaattcttctaggaatccacatgaataggcggaggaattcttgcagggtttcttataaaaaaaccttgattgaaccattgttttcacatgctctggactaaacccttatgaatttcctcgaaagaaattctgtagaaatctatggaagatctccaaatggagaattcggtagaattagtgaaaatatctggagattctaggagttttaaaaaaaatcaatttaatacctgaggtaattaataaaggtagctcctttggagttctcattgaccaaattatagagaaattcttcttagcatccttcgaaaaataactgcaagaatgtctgggagaatcggtagagaaatttctagaagtatttctggaaatatccctgtaggagaccccgaaagtattccaaataaaatcactataataattcctgatctgagtgtcctgatcactataataattgctgaatctgagacgaaattcttaaagagcctgttgaacacgttagagtccccgaaggcttcttggagcctgaacaattttgcatcaggattcaatgcgtgcagaataaggcaaaagatacattagggaccattttggttaaaatttggataaatagagaccttccattgaaaaatggagactttttggaaacttgcattgaaatagagaccaagtctctaaaaagaaacctaataccagtctttctttgggcttattcattggatctacttttgttattttcggttccccaaggaatttcggaatatctccggattcaaatgaccaatgatcaatatcaaaacagaatctaaaactagaagttttttttaaaacttgtgtaaacaagtttgaatcagcacaaccatccacgacaaaatcctttattaaactgatttctagagttctcgacctgtgatggaaagtgacgaatatgtctgctgaaccggaacaaaaacaaaacaataagctcgcgagcatcagagtgctgttttactcccatctttcgtgctcgcgagtaaacgaagctaatcactcgtgaacctgttcggagctgttcagagtcaaataatgcgctttcggaaagaaaactgtttccctccgagatttctggctttaaagggtttgttactactatctagcagtttactgtcgatttgatggatgtacaattgatttgtctgtcaaaaccgtaataaatcacacctagttgggttactcacttcgtgatgcaaacatttccaccactgttctcgaccacgcgatgaagctcaaatcgttcttcgtactcattttctttcgaactgtcaaccaaagcacgctcaaaagattcaaatcaaatatatttgacactgacaacaaatcctacacactgaaataaatacatgaaataatattttttctccacaaacataaattcttaacatatcaactctacaaccagtgcggttgttcttatttcctcatctatttcgagataataaatgaatgaacgccaaacattctgtgaatttgtgtagttttttttctcattgcaccgaaagtgactcggctaatcgcaaaactttcaggagaagctgaagatgctagaaacatgtttcatcgcgcggaaactctatcaaatacctcatagtgataataaatcttcgagctgtttagtagaatacctataagtagatgaaaaaccgaattcagtactataccatttaattccactagagtttgtattctttgacagatacgcgtatttcgacctcaactgtaaggtcgtcttcagtgtcgtgtagagtaagggatctaattttcgacccagtgctaattttcgacccattgataaaacaaacgttattttaactactatttgaaattttcaaacatttataaatcactgcaatatgccattgctgttatatctatcatgatccaataagaattgcatctatataacggagttttaatcctgaattgataaatcctgattttcttgtgtctgaatcagtcctttttcttccattgatgaaaattcgtcacatattgaaaaggctcaaatcagtataaaaactgatcaaagtgatgtctaaccgataaagtttggtgaaacctgataaaatttaagcaaattgtaattaattttgtgtatctataagcgaaaataaattttattacgcgtttgaaattgttcgaaaattgaaacaccaggtttcaattttcgaccggtcgaaaaagcatgccatgatttcagcaggtaatgtgttttagttttcgacccttcatcaaaagtaaacatcgttcatagtggtggttgttctttcgtggagttgaatttcttgcttcaacggtttttaaccaaaacggtaagacaaatcttgatcttgcttcaaatttatcaagattatatgaattaacttattatagcgcccagaaaagtacagacaagtctacgaagaagccgacatccagcaaatagcatctaaggtagtcaacaagaactcgattatggaattccgaaatttcatatacatattcaattcaagattggcgaagaaatatctatcagtctgttattcgtcctggaccgaccacaatggaggaggagaacgaatttgaagagttgatattcggcagtcagcgacggggatggctagtgaaacgtgactaaatgttgaagcatgttgaagggtttcttgacactgctgaaaggcaaaactattttaaaaacaacaatggaggtgaattgatagagcaagataaataatatcgcaatattcttagaaaagagttgaagagagaatccgaaatgaagaaacaagaccacgctgaagcaaaacgattcgagcaaaatttgtagtgaaaaaaaaagaaaacaatgtaccgaaataacccataaaataaaagtcaaaacctaaaaaagcagttaaagtcgagagctaaaagaagaatttgagtttttacttgaactattaaataatgaaatgaaataaatgttttaaacaaaatggttttacatgtttaaatgacaatatcccattgctgtaccatatcctatcgcaacagtagaatataatgtagtttgatccacgtaaaaccgtttaaatggtagaaaaatcgatcagtgttcatgaatgtcgcttttccttggtcgtacagtttgtacataaggatcaagaatccatcattcaatcatcagcaatcatcaaaaatgaaaaaaaaaaacacacacacattgaacattgcttaaattttgagcaaaaaaaaacgtaaaacgatgatggttattttcttctcaaattacgatatcgtagttcacaacttaatcacgcaattccacaaacaaactattagactattgacgaatcgttttacattcaatatcttcaaaggatgtgacagggatacaaaaccagtatttatggtattcaggagccttccatagatctatcagataataactgttgaactgtttatcataaagttcgttacggaaatgagaagcatacactgtttccactggaatgtaattctaaaagaaaaatcatcaaagaatattcaacagtttcaagtgttttttcatacatatacccgctacaggtcgaaaattagcacatgcatgggtcgaaaaataaaacagtgggtcgaaaactagcacaaaaagataaagtcattaatctataaaaatacaaaaaatgcaatgaaatattacctaacagaagttatacatgaacaaataatatgtttttctattcgactgccaagtttgaatattagttgatgcttttttgcagggtttttgggagttttccactcaaatgctggtttcatgggtcgaaatatagtgcttttaccctactagacttgacttgaagtcgagtctagtacacgacactgaagacgaccttacagttgaggtacaaactactaaagattggactcggaaaaaaggcgacactttgttttgggtgtaactttttatcgcgtgggtaaaaattaatggaatcttgggtaatactagttgagagtgttatgtttataggcctattcacaagacgtttcaaatcagctgatcgggaagctctttgacagttcttctatggagatgacagtcccgtgttagcaccggtcctccaccgatgtaaacaaatgcatagacggacctgtcacatgaaaaggcctatgtgtgcaaaatttgcattcgaaacaagaagaactacgccaacaaaccttggacgcgatgatcgataatcctggtgagtcgcacagatggatcggcaaaaggcttggaatccaccatttcaccgtgtccagcgttgtggagatgttccaggagacgaagatcatcgagcggcgcgctggaagcggccgaaaaccgaaaacggaattcccagagaaggcgcggaagataaggcagtacattaatcataacccgaacctttccacccgagacgtggccagaaaggtcaattcgtcgaagtggttcgtccagcagaccatgaagctggctggattacgtgtttttaaagtcaggaaggcgccaaacaagactgacaagcaaaatacggtggccaaattgcgtgcgcggaagctgtacagtgagtcatggacgatgagatatcaaggcggacaccaaagaaatccccggcttcgagtttttttttatcggaacgtcccgcatggaggttccggaaaagtttcagaagagaaagatggaaaaattcgagaagaagtacctgctgtggtaggcgatctgcaagtgcggacggtacagcaagccgttcgttacaaccggtagcggaatttggagcaaatgtgccaccttaagcaaattgttcactaactttgcctaaagcttataaaatccaccaatttcgcctcatgatgttagtttcacatcttttcataaccactgtgccatttaaaaagaaaattatttcaaaaagtattagttttgcagcttctcaaatacaacctatttttcgacactatggggcaagatggccaccgaatgaacattgcatgtaattctacttgtaatgaaattttctttatttcctattaatattacttacaaagcagacgctaatcgatactttgaaaaataattttaagtttaccgtaataaggggatgctttataacaaggttcaaaacatgcgtaactccctattactcaattcgaataactaaaatgattatttttgtctccattcaatacaatatatatgttacccttttattacggcgaatatgtataatattgaactagatcagcatacatttaaaccaaactggatttcgtatgtataactaaatacttttttcgttcaaatgccacaataacttacacatttgaatagttacaaaaatctgtcaataatttatttttcaccatgctatttagaaacaacgaaatcttataaaaaatcattcaaatttggttgtctttgcacaagtcgatgtaaatacgtgaaaaatagagcaatttccatcatattttgatcattgtattgtgaactttaagggaacatattgttaagctcaaagagaaaatatatactatagtttttataaaaagcaggggtggcacacttgccccaaagtccgctaccatagacgggcagatttatcgagaggaacgcttgcagaagcgcttgctgcccttcctccgctctcaccgtgatctcacgctgttctggccggatctcgcttcatgccattgtgtcacgcctgtaatggattggcgcgatgcgaagggcgttaatgtggtcccgaaggaggcgaacccgccaaatagaccaaaatttcggccaatcgaaaagttttgggcgataataaagaagaatttgaagaaaagcggaaaaacattcaaaaccgatgaagctttgaagaaaaactggaaggaattgtgtaagaaagatgggcaaagcctcgcccaagatctcatgagcagtgttgagagaaatgtacgaacattcagcttgtgggaggcaatttaataaataaattataccaaaaaatagctaatatatagttatttaaacttccagtcgccgcgcggttcgccaccgtcagaaccaccacgctgctgttgtgagcgaaatgggagcttctttcaccagtgttgtacatcaacgcgacgactgaagtgttaatccctgaaaatttgagaagtatccgatttaaaatgaatttttggtgatcattcttgcgtgtctaattttgagtgctttgcgaagacccaagcagtacgattcattttcgcgcgctcggagtgtgttttcgctggcttcgttcgtttgcccagtgatttgcgaagacccaagcagtccgattcattttcgcgcgctcggagtgtttttgtttttcagttagcacttcattcgcgcgctatcggagttattttatattcctgcttatacgtgttgacgctgcgattgttactgttcagtcgaggatggattaccaattggtgagctcgttacacatttgtatcataacatgtatttttttatgaatttgttgaacaaactatgaatagttcatcactttaagtgttggcataagcgcttgttcatgttttataaaattgcgagattcaaacctttgaataattcgatttttaagatgtcgatgcattgatagataactttttaaacagaggttacatgaatcgcatcacttaccaaggtgaatcctgatcatgtggctttgaagccctcccactaacaaaactccttcccgtggcaatcatgaagatgcagaggtatactcggtctttagtaactaacattccttgccttccccgatgaccgtaaggacgtggccggcgccgttattgacattactaatttcagagtcctcgaaaatgtacattgaagatggtatgctactcccaagctacatctgttggttccctgtacaatttcgatgattcttgtcaatcacggagtagcaactacgaattgtacggtcatcaatgcctcatgctcatcattcttgcgtgtctcatttttgccgagttcagtctctattgtcaaagttcatcacattatagtattgaacaagaaaagagtcaaaattttgtctaagaaacgctaaaaaaaaaatctctcaaggtggcaaaagcctaaacaagcttgggtagcattgacatagactaacacagtgtctcatatttcagtagattccatcggactgtaagtgaattggaccgtgatatacaacgcaatttagaattaaggacaggttcatcaactggtccaaccgagcacagggtatacactctgcttccgacctacatcaatatctgattctatcaccccacaacggcgagtgcaaatccgttgttaaacccattacggggcactgcagcttgagtgctactactagagaattcactctctctctctcgacaggcagttaattaattgaatctctgttcgccgagggggtgaactgacgactatagtatcgtgttcaatcgtagtaggcgttgcatggtgggaaatgatgatctttatcacaccatcatcggctctagggtaattcgttcaatgctggtcaataagtatcaggaattggatttcgttttgcaaatcatttcttatttttcgcgaacccatgtttctatctgtatatgatacattttcatataagtagaccaccgttaattacctctattatgcacactgcaaagcttccattcaggccggttctgttatagcgaagtaagtcaatggatcggaaagagcaaatatcccatcgtaataccactaatccaccacactacgcaaacggtcgccaagagccgggtttagaacgaccagcaccggtgagtacagtatgcatgattgatgaaggggttcctgttgcacagcggatccaatcgcgtatcaagttacccccatcgtggagtagagcctcaacactcgcaacactttgcaacacacgcacggcttgctacgatccatccatccatctatcccatatccgtcgacgagaggggatttcaagggcgaccgacacagattgcctagggggatgaacgcaaatcccccagcctactgccattgctgaacggacatataatctaattcgcgtatttgtcttgttttaatttttttatcccatgcagccaaagccaactacagcgagtcgaacaaagagcacagactggaactggacgtgggcgattcggtggtcattctacaggaagcagccaactggtactacggatataatcgaaggtaagtcgatagaagaggggtctgcgattaacgcaggatgtttaattgcagtgctggttggcgtttctcattagttaatgctgtgaatagtgtccaattgttaaaagatacagaacacatacaaatctttacaaatttctcggattttgaccaacttttgatgaattctcagccaaaagtcatatttgaatggattagcccttgatgaacgagaacagaaacagaatagcagcgaaataaccagatcgttatctatacagagatgtcaaatgagaaaaagcacaaaatacactgtgtaatgcgtataaactccatagccctgatactctctccaatacattcaagtcctcaataacccaatgatattctccatttctgtgttgcagtcgaccccacgtgagcggcatcttccccaaatgctacgtccacatcgtcgacagtcggatatcccgggacggcgagctggtcgtggcccgcactgaaatcgtcgaagaaatcaccaccgtcctaaaggagtggcagcacctctaccggcggttcttcctctacacccacccggacttcaaggtcattcggacgaagatgctggaactgatccggctgcgatcgcagctgctttccgggaatctcccggtcgacgaaatgaaggacatcaagcttaaggccacctcggagatcgacaccggaaacaagatcctccggctggacatggtcgttcgggacgagtgcggcaacattctgaacatcgagcggacttccacgacgcagctgtacgagcaccacctgaatgcggtcgaccggatcaaacgggcgagtgtaagaacatttgatatctaatagggctgataacgttagcgagatttttgaagatttttttgaaattatattcatgctatggcatatggatatacgaatctatgagcgtgtacagagaatattttgaacagctctttttaatgcattcgaatcctctgagccagtgaattaaattgtcatcaaaggagacgaaaaacaaacaacaaagcaagtcgctcacaacccgtttatccatacttttgcggattgggatacaatcagaagcaaaattgtcatgacaatcacagggcacaacattgttgcaaccttttcaactcgcgattaatcagctattttaaacacaaaaccaaatttgttgtatgcgatagtgtgccaatgtttaccaacacagataaagttctcgaaaattgcaatgcgaagcccagaaaattgcttcgcacatggtgatcgatctttgtcatattctgttcaagtgatgataaactgatgttgcggataacattgttgcaacaagaataggagattacaatgtcttagttgctgggtgttgggtgacaatttattcactgctctgagcagaatctaaatagagaaacaaaaaagtagattggagtaccttgtagggtaagtgttcccttagttgtgggtgttcctatagttgcggtagtgccgttttcactgattttattacattagttacagaaccgacactgccaatcgacgtattggcttgttgatacacggaatagttgaaaagagcgttcaaattgcttttaaactgatgaaatatcactaaatttgctaaaactgttcttgctgttgcggtaaagtgttcctatagtgataggaaaaccactgataccgcaactataggaacacaaattaaaaatataccgcaactaaaggaacagtgtaccaatagtggaggtattatttttcactgacatgccgtggattactgcgatgaaatattttttctcataaagtcaatggtcgttacttcccgttacaacattaacatgaacattaattgcgtttcttgaaataaaagcggtttaatgaagttcaatagtgcttagtacctccactatgggtacatctaccctaccttttaattccgccccaataatagaggtgattcttttacttttgtaaatgctatccgacaggagcttcttgatcttacgatctgtaatgacctactatcggagatgattgtgaactggcatgattctgatgtagaataattgtcaggtcacaaacaaattcggttcgactttaaagctagataagaaataacgaaaagctaactatagaaatcaaaagagaaccatttgagatctcaatagtttttatttgacgtataagaattcgtataacggtgaacagttcacgactgttgcacgacaggaaaatgcttctattgggattattgactaaatgatctattcttatcatgctggctgtgctattcaacaaacaaggatgtgccttggtggaatggcaagcctggcaggattcaggaagaaatctagagcaaagtttacttcagattgggttgaatacaaaatgccctaactgaatataccagagaactaaggcatgttcaaacgtaaggactggagaggctttacaagtcatttaaaaagaccattcaaatggtctaggtagccataaaaaaaagaagacgacagttttactgctgactcttctgaaaaattgtagggtaaaatggtctaaaataccacattaagggtttgtgtcgttttctcgtaataagatccacattttagggcaatccgatgtcttaacagtagctttacaacagtgttgatagactcacactcaaaatctcaatcaaaacgctctcccgtgagagcaaactcattagagatctgtttcgcaaatctcacgcttgaaattttgatgcaaaatcaactcaatcaactcataccgtaaaaaatgattcagtcacaaaacccagcaaaaattcgtgaaacccgaatgttgttgttaacgttagaaaggattaacataattttaccagactaacaagaaattattgccgtgtgtgagtaaactgtggaaatacgggacaatgagttaaaaaggtgagccaactcatccatgattttttgactgctgagttgcatggttgacaactcacgcatgaaaaatctcaagcgtgagttgtgagaaattgagtttttcacaacactgctttacaatatttactagccaccactatttaaacatttcccaaatttgagattttatgatcttgaatcgtgttgcaaagtttgtttaaaaaggggggtggttgaaaacgaccgaatggatggggtagaatgccatttagtatggagaacgaagagtcagcaatcaagattctccatgagtttgctctgtggcatggaaaggcatattcgttaataaaatcatcggaaaagattacgacttaggcaaaaaagtgaaaaaaattgcagcgttctaggaatgatccaatgagccgagccattttaccccatcagtgcggactggacaatattcccctatgtcgatataatgcctatcaaaaagcttgtgaaatcttcacgctattaagagtcgaattggcattgagttcttttcagccattcaaatctgccgggagagatgaaattttctcaaccttactacaacaaagaagagagacgctttgtccgctcttaacagaaatctagcgtaacatttgaaaagggcctatctgcaaaacgtaaacattgagaaattctcaattgaagattccgtaccatatttataattcctattttaaacccattcgcatttttactaggttcatacctgtgttcgacacccattagagtctgttgcgtggcccattatgtttctaatctcaaataacacaacaactcgtaaaaatggttgaattcaaacatcatcggcagataggtccttttatgaatcttcaaaccagttaggcccttcgattgaacatggtttcagttaggcccttttataatttgctaattttattgatttttgaattggtttgcataaatcttgaacaaaatttagcgattatgtgaaaaaaacactatataatagctaaatattggaaattttcgattgaagattcagtaccatattgattattcctatttcaaacccattcgctttttactacagttaactctcccttactcgatatttcttatctcgatatcgagttagagaaccatagtaaaagttggttttcatggctaattcgatggtcccttggaacgcagttgcactgattttgtgttctgtaactcgatacctccctaactcgatggtccctttaatatcgagtaagggagagatgactgtagtttcatacttggggaagatccaaaaatgacgtccatcgtttttcgggattcctagaacccttctaccccccctgtcacgctttttctaatacacaatccatgcactgtcacattttcgtacatcccccgttggaggaggccccaattgatggacgtcattttcggataaccccttgtgttcgacacttataatggtctattacgtggctcacaacgatttgaatttgaatagcacaacaacttgtaaaaatagttcaattcaaacatcatccgcagataggcccttttacgaattttcaaaccagttgggccctttttgaatttgctaattttattgattactgaagtgatttgcataattcttcgacaacatttaatgattatgtgagaaaacaacacaatatcatacaagctaaatattctaaactattctatacaaaatcagcaacatattaattattgatatttcaaacccgtttttactagttttatacttatttttactagttttatacttgtgttagatacttattatggtttattacgtggcccagaacgttagtaatctcaaatagcataacgactcgtgaaaatggttgcattcaaatatcatcagcagttaggccctttaatgaatcttcaaaccagttaggccctttcagttaggcccttcgattggacatgaattcagttaggcccctccagttaggcccttttattaaacatagttccagttaggcccttttggaatttgttgattttattgcttattgaagtgattttcatagtttttaaataaaataaagcgagagaaaaacaatctaatagctaaatattggatattctcggttgaacgttcagtaccttattgattatatctatttaaaacccattcacttttttacttgctttatacttgagggccttccttagccgagcagtttgagtccgcggctacaaagcaaagccattctgaaggtatctgagttccattcccggtcggtccaggttttttcgtaatggaaatttcctttactttcctgaatatagagtaccttcgtacttgtcacacgatatacgaatgcgaaaatggcaacttgtcaaagaaagctctcagtttataactgtggaagtactcattgaacacaaagcttagaagcaggctctgtcccagtgaggacgtaatgccaagaagaagtataagaagaattcttgcagggctgttacaaaaacaaacgaatttgtttttgtgaaaaacgcgacttttggaactcgatccacaactagaggcaacaaataaaaatcaacaaataaaaattattcaaaatttttaatgtaattgattttttttcaggataaaaaatcagtttttcaactaacttcgcattaagattatgataaaactagtaaaaaagagaatgggcttgaaataggaatcaatatagtactgaatcttcaataaagaatttttattaatcaatgttgattttctcacatacctaatcgattgattttgatctaaaactttgaaaatcacttcaataatcaataaaattaacaaattccaaaagggcctaactagaactaagtttaataaaagggcctaactggaggggcctaactgaaaccatgttcaatcaaagggcctaactggtttgcagactcgtaaaagggcgtaactgccgatgatgtttgaattcaaccattttcacgagttgttttgttatttaagatttaaaacgttatgggccacctagtagcctattatgagtgtcgaacacaagtataaaactagtaaataggagaaagggtttgaaatatgaataatcaatatagtactgaatcttcaataaagaattttcaatattcaatgccgatgatgtttgaattcaacattttttactagtttttatgttatgttagatttaaaacgttacgcggcccagtaatagactatgagtgtcgaacaaaagtttaaaactattagatagcaatgagtttaaaatagtaacaatcaatatgttacagaatcttcaatcgagcgtttctcaatttttacgttatgctgatagacccttttcaaatatttcactcagttccattaggtgagaaaaacactatacaatggctaaatattgaaaaatatggaggaaaattaaaaaatgcacggaagggccaatctgattttgatggaaattttcagttaggccctgttatgaccagttaggctctcttagttttacagtgaaaccttcatgagtcgatattgaagggaccatcgactcatggaaatatcgagtcatggaacagcaatcctttggaaagcagtttcaagggaccatcatagtaaccatgaaattttggttctatgagtcgatatcgagtaatggaatatcgactcatggaagtttaactgtatcattttcagataggcccttttaaatttgaataaaattactattaataatgcattttgcatgcccgtaagagtatgtaggagtaatttacgtaaaaaattatacgaataatgaataatcaagtttgtttacattttgcagttaggcccttttcaaatgttacgctataaatattcaaagctagtgttgagtcttcatatactccaagagcatgacaaaaggtccgagttgttttcattcccaaatctgaaggaaaaagataaaacaacgcccaaagcctttagacctataagcctttcctatgatcttttaaaatgaaacaaataattctcgattactctttcaaattgacgtaagttactttcatgcgattttgagcaaattaatcaagaagaatcacaacctgtcttctaaactgttttaaaatgaatcacctttttaacattttttcgccgtgtacatcgcttaaatttggcatacaatcagctcgcgttcaaacactaggtagtttttattatttcccccaaaaatagttatagcaaaatgataagccgtttctttcagttactttggacgtttttctaccagtgtaaaatcggctcaagtagtgagttgtgtttgatctttcgaccttgacgcttgctcctgcgggggcgggtgatgaacacttgttcggggtacaatgcgtttatcgaattatatcgcgaatccgattaggcgtgattatatcatggatcgcatcaccaaccattggtgactcccagatcttaaccttatcgcactaacccaatatccttgccatgacaactgtggagatgcagagaatgtctaactaacattccttcccttccccgatgactgtaaggacgtggccggtgccgttattaacttttaaaatttgagctctcgatttgtgcacattgaagaatggtaagcccacgcatttcagctcttccgaagacaccaatcctccaaaacatcgtcatcgagagatatcattgattacaaagttcgcattcttatcactcgaagttcatatagtgcaagtcagaaaaagcgcccctaccagccaagtgctcacctaaaaggatgatcttcaacttctaaaggttgttcttactgagcactgtaacttctcgcaaggaagtactgtgctatctattaacgcacacgagctatccaacaatactccaaaattgatgaaatcccataagccctgggtctcatatagcacggattcttataacgcctcccgtcatgtgtctaataggtgatctgactgtaccatgttgtcagtgttgccagcaagaaacatgattgtgtttcgctttcccgagcgcaatgtgtaacaaaaaaatcatacttaaattttgctcaagattcatcataacgaacagaaagtttgatatagtgaatattattgatttcacttgagcacagtgttgccagctatgacataattttgaacctttcatgaaaacttggagaagagtatccctattttttttttttatcttatcgtttatttggcaggctcaagcgctcttaggcattacggagccggattctattgatttattttacaaaatcatatttgcttcttattatctaggttagttttggggaaccgtaaaactcgcggtttggtcgaggttaaggagtacaatcatttttggaagggatgggaattttgggtttactcgttgatcttcaacagcagcatattgtagtggcgttattggtgctgatcaacgcagagtggacatgacgacaacctgtaacggtacaaacaaacgggtttcgagggaaacaaggtggacatccaaaaaacgggaaggggtatacgaggtggacaagcggaacaaaaaagcgtattatcaaacaaaaacgtcgatttgcttcaagaacttgtaaacaagtaacatgtagtcaaagtcaagtctacccaacacatctctaatgtcttccttgtctggttttcctcgggccctgagagatatacatagatttgatctggcaattccgtattcgggacagtaccagacaacatggttgatgtcttggtaaccagctccacaaccacatcgattattatctgcgagccctattcgatagagatgcgagcctaacgagtagtggttggacatcagccgacacattatcttgataaagtcgcgactcatgttcatccctttaaaccacgacttctttgacacctgcgggagaatggaatgtaaccacctgcccaaatcccctttatcccatttttgttgccaactgagcaaggtctgctgacgagcaattgtgaaaaattcttcaaaggcgatttgtcgatcataaatatcgccttccatagcgcccaccttggcgagtgcgtccgctttctcattgcccggaatcgagcaatgcgaggggacccaaaccaaggtgatggtatgattcgacaaagcactcaatttagatcgtatttcactgagaaaatacggtgagtgctttaccggcctcattgaacgtatagcctcgatggagctgagactatccgtaaaaatgaaatatcgatcagagggaagagaggcaattcgctctaatgcatagtgtatagccgctaattctgcgacgtatactgaacaagggttctgaagtttgtgggcggcgctatgaaattcgttgtatacaccaaatccagtggaatcatttgtttttgatccgtcagtataaaacgttctgtcgctgctgacctggccgaacttgtttgcaaaaattagtggtatgaactccgatcggagcagatctggaattccatgggtttctcgcctcatggtcagatcaaaacctacagtggagttggagagatttgagaagcaactacgattgggagcattcaaagaagggttaatctccagactcatgtaccagtagtacagtgtcatgaattttgtttgaggatttcgttcgattagcttttcaaaattttcaataaccaatgggtttaatacctcacagcggatgaggaacctgagggacaattccgcgaaacgatctgataaaggaaggactcctgctaatacttctaaactcattgtatgagtcgagttcatacagcctaacgcgattcgaagacagcggtactggatacgctcaagcttcagaatgtgtgttttcgcggcggattggaaacaaaagctaccgtattcaaggaccgagaggattgtagtgcggtataacattatcagatcgtccgggtgggcttgattcgttgttggcatttctgatacagatacttaatgtgctttccccaagtgcatttggaatcgaaccagaccccaagatacatatgtgaaagaccctgagttagttccttacccatgatttgaagccccaactgtcctgggacatgcttcttagaaaagacaaccgactcagttttctccggagagaattcgatacccagctttaaggcccaagtagacaaattgtctagagtatcttgcagtggtctttgcaaatcatccgcccctggtcctgtaacagaaacaacggcatcatctgcaagctgtcttagcgagcaatttcccacgagacaatcatcaatgtctctgacataaaaattgtaaagaagggggcttaagcatgagccctgggggagacccatgtaactaattcgtgaagctgttgaggtaccgtgagaaaagctcatacgtttctcagacaacaaattgtacaaatagctgtttaataatggtgaaagcccacagtcgtggagttggtctgaaaggacatctatgcatactgaatcaaaagctcccctaatgtccaaaaacacagatcccatttgctccttttgagcataggccagttgaatttctgtcgaaagcagcgcaagacagtcgctcgttcctttgcctctgcggaaaccaaattgtgtatctgatagaaaaccgttcgattcaacccatttgtcaagccgatgaagaatcatcttctctaacagcttgcgtaaacaggacagcatcgcgatagggcggtacgagttgtaatccgacgcgggttttccgggcttttggatggcaatcactctcacttgtctccaatcatccggaacaatgttgctttccagaaactgattgaataagttcaacaagcgcctcttcgcgacgtctgggaggtttttgagcaagttgaacttaatcctatccattcctggggcagaattgttacatgaaaggagagcaagtgagaattctagcatcgaaaagggtctatcaacttcgtttctttcggtcaagttaacgcgaaccttttcgtgtactggaacggaatcaggacacactttcttggcgaactggaagatccaccgagaagagtgttctttgtcttcatttaccgctgtcgcgttccgcattcttctcccgacggtccataatgttgttatagaagtttccctagaaagcccgtttacgaaattacgccagtatccttttttcttcgctttgacgaggctaccaaacttgcgttcaagagaggtatagcgctcatagttttcacgagaaccgcgtttccggtattctttaaacgcgacggacttttcccgatatactgcggtgcactcatcatcccaccaaggggtgggtggccgtcttcgaactttcgctcccggtattggtcgacgctgtgcttcaatagcactgttgataattaactcggataagaactgatactcttccaacggaggaagagcatcgaccgactgctcgccatcggagatcgctttagcatattttccccagtcaatgtgcttggtgaggtcgtatgctacgtcgatctggcgagcctgacacgaatcattggaaattgaaattttgataggcaggtgatcactaccatggggatcttgaattactttccacgtgcaatccaatgataatgaattcgaacagattgagaggtctaaaatacttggaggagctggaggtttgatacgtgttgcttccccagtgtttaaaatagtcaagttgaagtcgtcgcataggtcgtatatcaaggttgaacggttgtcgtcgtacattgacccccaggctgtaccgtgtgaattgaaatcacctacaatcaaccgtggggctggcatagcacagcagatggctgtaagctctctgcgagatatcctggcactaggcggtaggtacgtacttgctatgctaaagctttttcctcgtatggtaacctgacatgcaactacttcagtgcctgtcatcgggggaaaatcaattctataaaaggagtggagcttgttgatccccaataatacccctccataaccatccccacgatcttggcgaataatgttgaaatcgtggaaagagagattcttatcagaagttagccatgtttcactgagagcaaatacgtcacagcgtgtgctgtgaactaaatacttaaacgcttcaatatttttagtaatgcttctgcaattccactgtaggatttcgaccatatccccgacctcattggatgtattatccatcgaaagatatgaacgattcaagaatcggccattttgaagccagacgcttcagaagaggttttatgaaagaaagtgccttactaataaggtttcttattgcgggagagacttccattacttcgaagatgatttccacgatcccagaaagcgttattttgtcggaagtttcgacatgttcttgtcgagatgtgaagatgtttgtttgttggctttccgggcgaaaaactgggacatctggggttttagatgatcccggaagtgaagggaaatctccaggtttgaatttaaaacctgggggagtaactttagtggtatttccgtcacttcttgactttttcagggagagtcgagaattctgttgagcaacagaaacatgagaaggctgctgacggtgccttcgtgctatagctcgctttcgctttgttcctgtttgtataacattatattcttcacccgcctcagagtcagagccttggtcatcatcaggcagggtagtaaagaggttgttactagcgatagagtgggctggtggaacaacagtcggtgcgatcttctttagcatttctgcgtaagattgctttgaccgttgttttagagagcgtatctgatgtttctcccgctctataaacttcgggcatgcagtgagctcatgtggagcttgaccacagcatgaacacttgggatcagaactgcacatgtagctcaccgcattttgcgcaccgtggcttgttacagcagaaaggtgatgtatgaccaatttgctggcacttatcacagtgcataaccgtcggcttatagaggcgaacgggcaaccgaagtttcccgatcaccaagtagtccggaagcgccgatccagagaaagttacacaaaacgaattcgacggctgttttgtgccatcaggagccacctggttcatttgtctggcatcaagtatggcgaccggagggacggcacggtttttaaatcctccaacaccagatttgatgtcagcgcaactcaaaaacggttcggtgaccactcctgcgatctcaatttctcgacttggaaggtatactctgtactccatcgagaagagtttgtaggcaacaatcttattggcctgttcacgatcactaaccgtgacacgcaatttgtcacgactaggagcatctactgattcgatgccccgaaacgactttgccagatctttttctatttgcaatttgttcaatggtttgcctttgggccgaaagaaaaccagaaagggacccttagatccgggtggataggcttttaggcggggggtcgcttccttaacagtaccagaagaggaggagagcaccaggggttggcttacattacgtgtattggaggaggtatccatcggcacttgagcagaggccaaacattcatatgacggagattcaatcgattcaccatcttccgaggggataggactagatgaaccgtttgtacggaatgcgtatccttgcggggtgacagggagggtgggtgagacttcgttggtctccatttccgtgatattctgcggaatcgatgttagaacgacatttgaccggtttggatttgattcatcatccgaggatatttcgtattgcgacggacccccgcctttatcgtttggttccattgtggggtgagactaccccaccaggaagaattcaaaatcgtatgtgcaatcaatttttagcacccagcagatagattttgaacaatatttgcacttaacaataataataacgaaataaataacaacttattgtaaatttaaaagtgcggttaagttcgtttgcacttcaggtgaatcaatcaccttaaaacaaaagaaaaaaaaatgaacaaaaaaaaaaataatactgaggtagacaaatttacctttaggtaaattaatcactaataataaaaaaaatgaaaaaagaaaaaaaaatatttacaaaaaaaaaaaattagtaagaaaaataattaacgcaaaaaggcaactacacactggtaggtgagttgatcaccggctagcgtcgagaagaaagataggcgggcagacaaaagagatcggcagaacgaaataaatacctattcatccaatgtaaccgactggcttctctgcactgctgttgtttttcgtaaacacgtgcagatccgcagatgaatgtattgtccgggacttgctgttcgcaacgataggcacccggtaggcaacacagcaacgatgatttgaggcctcttctgtgctgctgttgctgatgctgatgatgatgatgatggcaatgatttggatgacacaatgttgcgacgaatggccttcggtaaagctggacagtccaaccaataggctaggctaaaggctggctgcttccgtgatccgaaacgcggatgatcggttctttctactggaaagtgtaacgccgtaaaaaccacgcaacgcgaggggaaaaaacggttcacttcgctgagaaagcaatttgctttgaacgataaggaaactgcgcaaaacacaaccgatactggctagcgttcggaaaggaatgagtatccctatcttgccgagcattctatttttttattccgctaaatttcaatgattttgaacttttcttgattcttctcaaacagtgctggcgccataccagaatttgagcttcagccgattgtatggcatgcaacacttccttcaactttgataaacattcggtatcgttatctttgaaattgaatgatatcggcatataacacccccagataattgccttttttataacaattgagcacacggtgctcccctgaccgttattatcagaaaaaaatctccatcaaatctgtgctcaccagtcgttttctatagccatgatgcatgtctgggcaaataaaaaaaaaatcgtagggcccgttttgaagttacgccctttcgattatataggtttacaaattcaatggaaatctaagatatttaaacggattttaattggacgtgattatcagaagaaataaaacattaaaatttggttcaactatggtgttttacttatttgtaacttctaggtggagaagatcaacaaaatatggagttacgcccacggagttacggtgtaaccattaaagacactaattttcaatatattaattaggcattataatacgtcaggcacgttcaaatgttttcaatgacacattgctcttacatgccgcaaaagtcactcatttttcataggctcaagtgctataaggcattacagagcaaatttcaaccaagtaaccaaattagttttaatacaacaatactatgaatagtttggtgaagcaatgaactcacgattcagattatgtaacatgcaattcatgttgtatatcgaagtgtaagttgacgtcatagaatactttcggacttcagtttttgattttggaaagcagggtatagacaaaatgaaattaacgaaaaagaaagacgcgatgaaaaatggaaaaaataatgcagagtatagaacatccgttatcattttgttaaatcgaatttgaaatcatagcacttacagagcctaattttaaatattagtttttgtcacctactgtcaaaaaaggatatgtacgaattatttaactccaataaacttcaaatttggtgtgtatgtactttgataatacagtcatctctcccttactcgatattgaagggaccatcgagttagggaggtatcgagttacagaacacaaaagcagtgcaactgcgttccaagggaccatcgagttagccatgagaaccaacttttactatggttatctaactcgatatcgagaaacggagtatcgagtaagggagagttaactgtacatcaacaactgtccaaaaaattaaaaaaaaagtatccactacagcattacaagcgaatgaaaaattacccaatttcactccagggggtgacactataattgaaataacttgttttcgaaaccatttacagctgaaaaatattgatgaaatacgatgcaaacaagacgaaatgaaatctaagatgtttcacaagtatgacaaatcctttttatagtacgtttctcatagtttctcttgttgtttttaattgaattgtctttaaagtcttatcttcattaaaatatagtctattcagtttcccctaacgtgcactgaaaacgtgattattctacaccttcggtaataatttattttcggtgtgacatttcgctataaatggatttcaggcagttgccaagtttttgaagtcataatcccggtaatttcgagatccatcaactcccttgtacttccgtgagatgtttctatgagatggtatactaatgataatttgaatttgaaaaaaaaaactgtttaattattgtgtgatgttgctccacacgaaaaaatgttgctggtttgagaagctgtccaaattctttgcattgttgttaaatgcacggaatccacaattaggtttgtttgatgtttcagcagaatgggttgattgattcatacaattctttcactattgcatttatccaggaatcttacgtgttttcgagattgaaaagaccggcaacaggtaaaattatagatttgtgaaacatctaaatgttgtaatgtaagccacaaatgatcacaaaagcacagacgtaacagctagaacacttattaaactaaaacatagtcacgtgaacacatacgcccttgctaaaaatactttatttggccaaccgcgaactagctggcggtagtgagcaaacgttaaactcgaacaaaagggatgcgagcgccacgagtattagaattgggaaatattcgattgtgcgatgaaaataatataagtgttacgtctgtggctaaagtattgacagtggtcttgagtgccgtagtttggccaatactgcattactcagtaatcgaggtttaagttccggggcagtacaaagttaggcagaatagccggaggcaaagcttgttgggttataacaatatttcatgacgatacaaaattggctccgtaatgccttgatcgcttgagcctatggaaaatcgatcaattgtgaaaaactttgacggcatgtaattgcaatgtgccattgaaaacatttgaacgtgcttaccggtattagaatggctaattaatctatttgacattagtgacacttaaaaaagggcgtaacttaaaaattcgacaatattcaaaactccacacagaagttacaaataactaaaaacaactacttcaaaccaaattttgataggttagtacttctgataatcacgaccaataaaaatccgttcaaatatcttagattttctttgaatttgtagacttatacaatcaaaaaggcgtaacttcaaaacgggccctacgattttttttaaattttgtccagacatgcagcatagctacagaaaacgactggggagcacagatttgatggagatgtttttctgataataacggtcaggggagcaccgtggagcagtgttgccatctataaccagaatacgaaaacttaaattagtatttccacatctagacgttgcatctttcaaaagcatacttataaccctgtttttttttcgaccgattctttttgcgaccccccgataacggtcataaaaagaggttggaatgtatctgcaaaacaacagtttcatgctaacgatagccgcctagtggcaaaatttagcataaactagcacgaacaatgacagcccttgacttactgcgcaactttgccgaagacgtcgtctctctatatggacaggctcctgcgatatctgaaaaaaaaaaacagtaaatgatccatgcccacatttgccacctagcggtcaaattcagaattaattgagttgccattaggtagcgctcatcttctagaccaacttttctgaagatcccaagtttcgaaattatctggattttatagtgtaccgaactactatgtgcatttgtagatttgaccgcattcttcagggtcgtactgtaaaaactggactcgaaaaaaattggtcacacaaaaatgatcaccaaaaatgattaatcgggtagttcttaaactttgagggattaaattacaaaatattagctatgttttggcataatttatttattgaatatcctcccccaagctcatccaattcttataacactgttcatgagatcttgagcgaggctttgcccatcttttttacacaacaggtacttcttcgtgaatttgtccatctttctcttccggaacttttccggaacctccatacgggacgtaccgaaaaagggccggggatttgtttggtgttcgtcttgatgtatgtctcgtcctccatgacgagacagcctggcttgaccagccactcacggtacaacttccgcgcacgcaatttggccaccgtgttttgcttgtcaatctgctaccgaaaagctaaacattacatataatttgcaattggattagatggacaaattgatgtgaagatttgcgaaaaagttacacgtcttctcagtgagaatcgaactcacgactcctcgatctctagttggggcgcgttaccattacgccatgagaggactcatgaacgcagaagttaacctgaattcgatttcagctcaataatcacgtggtcctatttcgcaaagtgcacctctttcggaaaaattagatgcccatccaaacacaacgctttctatatatatccaatgcctagcccgagagcgcattgtttttttaggaataggaatagcacactacactagccagcaactgcgctggctgaggtttctattgtgtgggcttccaatgggtcgcgacgttctcaaacgaccggttacggaacatgagtccgttgctcgataaatacttgttttaattatgaatcgtggtttacggctaaccagccgagtggaagtttaacaactaccgaaaagctaaacattacatctagtttgcaattggattagatgggcaaatcgatatgaagatttgcgaaaaagtcacacgtcttctcagtgagaatcgaactcacgactccccgatctttagcttttcggtagttgttaaacttccactcggctggttagccgtaaaccacgattcataattaaaaacaagtatttatcgagcaacggactcatgttccgtaaccggtggtttgagaacgtcgcgacccattggaagcccacacaatagatacctcagccagcgcagttgctggctagtgtagtgtgctattcctatacctaaaaaacaatgcgctctcgggctaggcattggatatatatagaaagcgttgtgtttggatgggcatctaattcttccgaaagaggtgcactttgcgaaagaggaccacgtgattattgagctgaaatcgaattcaggttaacttctgcgttcataagtcctctcatggcgtaatggtaacgcgccccaactagagatcggggagtcgtgagttcgattctcactgagaagacgtgtaactttttcgcaaatcttcacatcaatttgtccatctaatccaattgcaaattatatgtaatgtttagcttttcggtagttgttaaacttccactcggatggttggccgtaaaccacgattcataattaaaaacaagtattgtcaatccggttcggcgtcttcctgaccttaaaaacacgtagcccagcccgcttcatggtctgctggacgaaccacttcgacgaattaaccattgttggtcacgtctcgtgttgaaaggttcgggttatttttaaagtaccgctttatctttcgcgccttatctgggtattccttgttcggttttcagccacttccagcgtgccgctcgatggtcttcgtcttctggaacatcttcacaatgcgggacacggtggaatggtggattccaagccttttgccgatccatctatgagactgaccaggattatcgatcgcccaagatttgctggcgtagatcttcttgtttcgaatgcatcttgaaaactacttgacagactgcgattaaattttgcacacataaacataacactccaaaactagttttacccaaaatttcattagtttttacccacgcaataaaaagtcacacccaaaacaaagtgtcgcatatttttccgagtccaatctctcaactaaaactgttgagtgttgttcttaagatgattcttgaagaatactttttgatttggggtcgatagatacttatgttgcaacatgatagtccgaaggttactgctttggattggaaagaatgctcgaagcaaaattttcttgaacacaagattttggaaattgtccataattatgttttgttgttaccgttttgtctcaaattccgaacagacccatattccgaacactcggtttttgtatggcgatttggttgaaatgtttcgctgaaatatgtcaccaaataacaaggaaatgctagttgattgcagctcaattttaacgtccccaatataatttataccgcgggggtagtgatgattctctagtttgagactagtacaacaagctcagataaatttatttgtaaaattgtttatttgaatacgatttattcgtgctgttcggaatttgaatcaaggtgttcggaatatgagacagaatgaacacagtgttcggcatttgagacaaaatgttgttccatacttttatgtaaaaacaatactaaacaagctaaaattaattattgtatcgacgcacacaacagctaacagttagactttgtgagtaaattgaaattttcacaaatatttgctaatttatgcctatcagatgcatttgaaatcactgttggccttaagtgttcggaatatgagtcaaaacggtatctgaatcgtaggaaaagttttaattgttagtcaatagttatttgaatgtttatccagtggcgactcgtaacctcactttttacctgttctacgactctaaaaatgactatttcggtgaatttaaattataaatcaaatagttaatttttgaaatcgtcctttctaacaaatctttactcattacatgcaaatttgttgctaaaattcaagaatttctattcgtggaacaggtagatttgaggttagggaatcgccactgtgtttatcaatagttgcactattggatcaacaagtaggatgtttgagtattcaataatcttactacaatacctacgttacaataaccaatatatgaactgtaccagtttatgttggattcgccgaaaactgatagtgctctacaaacaccatgcgcgttaaagggttaagaacataggaacattttctgacaaaagtgacctcaataggatcctaaagccctgtcccaattttagtgccaaacgcttaagtttaggtcaaaaacatatgtttactcaattttctaatgttttccgatggtttaagtccaaaaaacatttttttaagttttttttttaattttgtcacacccgttggtttaaactcatatttttgggtgtattttgttttccgtgtcccttccgaaatgtcagaaaggagcaaccccggtgttaaaaagttgaacccctgtggtatttttgtcgactaagcgaacgtcaaacatgatctcaagtgtcaaggttcattcagggatccaatttttgaattaaacttttaatatgatatatccgttatttgagtgggaaaaattgctaaagtagttgcagtaacaaactctttcgtattattaaataaaaacaagatttcattaaacattttaggaccctattcaaataaacagcaggattctggtgttcgagacaaaaacttgtttcgctttgttactcaaacagttcgatctcctgaaatttaagatctttaatcgtatacgtatacgtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttggtgttcaagtgtttgctgcggttgatcgaaatcgtatacgatctcaaataccagcacttccagtcggtgctcgatctctacatcaacgaaagcttctcggcgacgttggcctatgagtgagtattagttggtaggtcgggtgatatcacttaattactattttcgatttcagaaaactgatcaacgtggtccaaacgcacatcaagaacgcgatcaacaacgtcagcagcgatcggtcgagctcgatcagcatctacgccgtcaacgagaacgacgaaacgctctatcgcaccaccaagtacctgcagtacatcatgaagttcatcatacgatcgcgcatcttgttctcggatctgaatcagggtaaagatcgtgaactgttcgagaccatgctggaagatctgctggagtcgttcaccgagttgatcaagtaccagaacgatctgctgaagtcgcaaggggcgctgctgaagtatctgcacatcatcgcgtccgatctgatgcaggtatacgatccgatcaagctgagccagcgaatcgtggacattatcacgaacgtcccgaccggacggctgaatcagtccaagatgacctgcatcaaggatgtggtcgactccaagctgttcaagctgccccagtgtcgagctattctgctgccggtgttctgccggcagatcaaggacaaactcgagagcaaggaagaggtaagttttgcgggttctatttatatgtttaaaagaagattgctgcatgaaactcaatgtgttcgtgatcgtgttcatgtgtttgtcataccttttaattgcgcgttgcactgaagtcgagtcggaccctccaaacaatataagcacaaacgtttgcatcccgcctatcaaattacgtgtttcgtttttaagcaaatttctttggttctttctgtttgtcccaataaggcaaaatatattcatgatttttgtttgtttgtctgtttgtgtatgcttgctgtcttgccgcctgtgtcgttcgttcttctcctgtatgcctgcgcccttcgacttccatctatcttacaaagctgtgtgttacaatactttcattatgcatttatcattcgcgtaatacatcgctaccatcatcaccatccaccgaaaagagatcattatcctcttggaagcaccgcattcacaccgcgcccatatgcaaacaaggaagtagttcacaccttccggaggccgggagttcgttgttctggatgaggtagttaccatctgttccttgtgtcgtgtagtccccgtggaagcagaatgtacatatcgtagtgccgtttttgttacataaccttatcatctgcccttctaatgtggtcgttatcatttccattctcatacttcatcataacatatgattggatcatagtatatctaacaaaagtgttttaaactcattgttctaaggctgggccaatatggtttggtcatacactgccgttctacgcatatttgtgccgcggtctataaagttcacatagaacatgggacaagtaggcgtagaagaaaaacaaaaggcaatatgggccacctctgatttcagttcaaaaacagattctgaccccgattactttggggcttcatagaggatgcttcaactagccgtcaccgtgaaaatcgtgcaaaaatttgatttcatacttcatatattcacaaaaaatttctaatattgtttatgtaaaaataagatttgcttaaagtattgtctattacattgagatttttttcatagcagttcgttcttctactatcgatgaacattttgtgtacaaaattgtacaaaacatgtaagaacggagtaatatgatcatagccggtcaacgctaccttatcacaaaaatagaccatcaataggttcattctatttttgcagtttcattgcaatatcgtggcggcatatggttctgagcaataccagaatttgatgactggtcaaagttattcgaatgtcgatattcgaaaagtgaagggcgggccatttggcatgacaccgtttagcataataaccatttgtcataacagtcatttgtcgtaactgtcattctgcataaccagaatgatatctcttctttaaaaagatgcctgttcttgaagaaaaatgttatgccaaatgaccttatgaccttatgacaaatggcgttatgccaaattactttatgagaaatcgctatatgccaaatatcccagacctcgagaagtgaagctctgaaatccatgatttattaaaacaaaatacaattttatgatttaaatcaaactttagtcctaattttgtacagaactctcacatatatatattggcttcttctacataatttcttttaggcgctttttcctattaaaatgatttaatctgatggtggctcatagtgccccgaagggtgggggtgagggattattttgccctgtgggggattttgccatatatagtgcaaaactccacaccaaatatgtactatttttaaaagatgttcccaagaaaactttgagcaaaggggacgcttcaaactacaaatcaacctcatggaacgattaatttgtaaacctcatggaacgattaattgtaatctatgcttttcaagaccttttccttaggaggcccatactgatacttggattgtatggttagtcaactggttctgatcgactcacgtttcaaaccctctctttcccatggtagttccagagctccattggtttacgacgaactctagacaaaccgaaccaaatgaatactatgcaatagttatgctatgattctatacttatcagatcaatccaaaagtaaataaattgtttcaatagtaaaactattaataaacaattaatttactattgaataaaaaaataaataaaccgatttcgaaaaattcagaccatttgcaacattgttttaggattggtagcaggcctcttttcaggtctctatttttaaaggaaggtttctaaagcctcttttccaaaacggtctctaaagtcaccagtttccttcttcttgcattgaattctgattcaaaatacttaaccaggtatttccacaggtattgctctgatttttttttcgtaaatacatactactccagggtttccttctaagattttcccaccaattcttccaccgattttccatgtagttactctaacagaccttccaaagattcctacaggagttctgctgcgaaaatccccaaatgattcttccagagattcgttatagatttttccagaaaccccactcaagaagaaagattttctcaaggagttcttatgccggtttttttttcatttgtatctccaatcattttcataagaattccttcttgaatgctcctatatattatgaactcttctaggaattcttaagttccaaaaaggattcataagaatttctccaacatctattcatccaagaagtactcttacagtttttcctttagttacagtttttcaaaacagttttagtaaaatcgccacggattcttggaagtttcatttgagatttcacactaacaaattcagaaattattacgactgtttctatacaagtttctttagggattctgtttaatgttttacaagaaatgccttcagaaaatcctgtaggattttatcctgggacctcatagattattatttttctataattatcccaacaatccagctagaaaaaaaatccttcaagattttcttcgaagttagggagcttttcaaagatccttagaaaatcttcattagttatttctagagaagcttcatcagagattactataggatttgttatatcaatacttttcgaatctctggattttctctaatgatttctaaaaaaaaaaaaaactattccctggagatatatgaaaacttccatgggaaatttttcaacgaatatttactggacttctccggagtgatttcttaagatattcttataaaaattcttggttggaatgctgaagaaaaactgaatgacaattctggaagagatcctaaaaaatcagtgtaggcatctctggataaattattgtttgagttcttaaagatcgatggaagaaccactgacttttgttgagaaattggtgaacgaatctatggtggaattcctcaagaaattcatgttttctggagtagtttgtggtatcatccttaaataattaaacgtggaattcattttagcttcatcatttttcacactaagaaatcttggaagaaattatgtaggctacaaattgataaaaaaaataaataaatattgaaaggtctcgagttcgaaaaactaaattcatggagcaatgccttagccagttaaagtatcaataaactggtttactcaacttgccagccacgttctaaagaaatttgaaagagaaaataactgaccatactccattgtgcacgtggccttaacgctgttgtaatgttataatctctaattgttaaagccttaaatgctgttgtagtgtttcttctgttgtgaaccattttaaaagttccagagcattctataaattatagagaagagtattactaaaaaattctcgagtattctgctaaatagctattctttaatttaatttattgtttcgaaatcacaggatgtgacgaaggaatcaacgactcgtggaaatatcgagtcacggaacaggaatagtaaccataaagttttggttcagtatgtttcgatgagtcgttttgaaaacgacaatgacgaaaagttcgagaatagtctacgaattgggaagaacaatgtcccagaaaactctagaatattctgccaaatagccttagtagtgctctacaagttgcaattgcaatgttgttatatttaaatcgactgttgtagtactccttccttagccaagtgcttggagtccgcggctacaaagcaaagctatgctgaaggtgtccgttcgatccaggatcttttcgtaatggaaattttctagacttccttaggcatgacacacaaatgcgaaaatagaacttggcaaaaaaagctcttcagtttatataactgtggaaggaagctgagtcccagtcccagtccagtgagaacgtaatgcattagaagaaaaagaagaagtagaagaagactcccagttactgttatagcgctcaatgcaacttttgatgaaacattttaaagcgatactgacagacagacaactcagggatttcatataatgatgaattcctgctgaaaatttctgagacaaaattgggcaaactcctgaattagtttcagaaggaatttctgaaaaaaacttgtatgtattgtcgtataacgagcattaacagtaaaaataataaatcacaggaaagtgtctggctggattctctgaaaaattcctatgaaaactccaagcattttgtctctaaagcttctattttaaaagcacctaaccgctaccagcccagttgtttcttcaagtacattttacaaaaaacttttttttttcgtaatgaaatagtcaatcaaagtcgtgcgaaagacaaggcttgtattctctctctcattaatagaatttggaacccgtcacagtagtgggttattcggggtaatggagttctgagaaattatattcgggataacctcattcggggttatggccttcaatcaaatgacgaattggtcaaatgacacaaaaagcgtctagcaacataaattgctcgacgaattggtttttagttacttttctatgagggaatgagaaatctatacaaaataatctcttagggtggtgtgcctttttctgtcctactaaactttcatccgtgtacatcttttgaggttttagaaggctggctccagaggcatgtccgaggaattttagacgatcccaggaaccccttgtaaacccatggaaacctctgagaactcatgaaattcttttgatatgctttggaaaatcctggttgattacaactagaacttttgaaaatcctgatttatgttttgaaaatccctgctaataaatgaaatccagttctatgaccctggaaacctctggaactgcttgtaaatttctttggaatctctaactagccctaggaaacccaaaacaattcgtatttatttgggagccttcaaaaccaaattcccatgccacatcctgagaatatctgcgtttcacttgggaacctctgagatcttccaatttttccttaagaatctctttaggaatcatcaggaattactgggaacatcaacttggagcatataaaaatttatagggaacccatgagaactgcttgtattttcactagtgggtaaagtgaaaaggaaagatacatttttcaaaagctttttctgtattttttccttcagttttacatgaaatcaatttcaggttactgctcatatttgtttggagtctagctaaaaaatatacgcgacctcatttattttcattaagtcttatgacttgatgaatctcaattatacgattttcattatacactttccaaacggtaccttcaattaaattcaattttcaattgagatgaaaacatctagtccaaatttttgcgaacgtatgaacgatttatttcgaaaaaaaagagccaggtagggcaggcctgacgtaagcccttaggtgctgtgcattaactacgcaaggcaattttggtggtttttcgaccctcctccccacaggattagatattttgtataaaaattgaaaataatttgtatgacgcctaagaaatcgcaaacatcgtttttcctcataatcccttacgaaattaatgtacagctcttttgcagtatacaaaaagttttcaggagtttacgagacttcttgagtagtcctttaaaaaatttcgaatgtctgaaacgctacagggattcgctgacatctgaaatagccctgcaaacccttgaaaatgctttgtagctgctcgataatttctttggaattcctagaatacctcccccccccatagggattcccaagaaacgcgtcgaaacctcgaagggttttctttgaacctcttcgatattcttgaaatccacaaggatttcgaattaacataacttatttttacaatatcgttaatcaaattttgattattctgtactaaataataaaacaaaatgataaaactcacacttgtaaagtgttgaatcccctcctactaaccttctcaataattcgatgtcttcctaagtagttcttagaagctttcagcgatgaccatggtatttctcagtttcacagaggatctcaaatggttttaaaggttcctagaggttacaaagcacttcacaagaagctggaagagcgtttaaatacgcttgggaaccatcgtagaccattgtgaacccctggaaacttctcagaaatccttgcgaattcttcgagtgtctctgaaaactcacaggaattcctttagaaaccccttgagaccttttttttttgagatatttgaaaattcatagagaattcttcatgaaattactcaataaacgctttcgattctctggtaattctcagggaatctctgaacgttaaaatgataaatcttataatagagcgatgagtagattcccgtgctactaagctttcgtcggtaaagcttccttttttgcagcatctaggaagtttacgggaagtccgaattagagccctctatccaaggtatactgaaaagatcacaagggattttcaagggttttcaaaagacgaatatttgggattgcccaccttagaagcagagcccgccatttcccttattcctggtaatcttttgacaatttctgagttctcttgtatattccttgagagcgaattcgatatctcttaaaatccagaagaaaatccaatttatgtaactggttttttgggatgtttgtagatcgacgtacagtcattcaatgacaaataccattgcggatgttctcagaggatgccaaggaatccctagatgtttctcacagctattatgctattgtatctcagggaatcccaaagtttttagaggcttccacggggttccaggagattgagggagggttgaaatacgctggcaataccttgtaaactcgtggacatctagaagcccctagagattattggaaatgccccgagaattacttacaatttttcttctttgaggaagttctgaagacccttaggaatatgatcaccccaaactttttttagttctctttgagaaccatttatgtgtcgctgaaaactcataagattcttctggttatctcctgcatttcttaaaggatttctttagatttatctgcgtttttattgaatttctggaaacactttgtggaactctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggacatttggcataatatcaaaccatccgaaaagtaagggttatttggtataataattcagatacagtgaaacctccatgagtcgatattggagggaccatcgactcatggaaatatcgagtcatggaacagaaatccattggaaagctgcttctagggaccatcatagtaaccatgaaatgttgtttttagtatggaacatcgactcatggaggtatcactgtactccttttttcacatagcactgttgtaatattacgcaaaagaataggccatgttaaaaaagaagggcaaattcctttataaaaatagcaagtcacatcgctatagcaataaccctcgaaagaacaccttatgtttaaaagaagggtaaatctctagataaatatcatgactaaacaggataacataagatgaactagggtgtcaatcagtgacgcaatatttcttaaattgaaattgaaaattgaaaacaaggtcttgactttggaaaacagaagaataaaatgcagcaacattgctgctacaattatcttttaaataacatctcgtgttcaaacgaacccgatcaaccagtgcacactggtccaggaagttaatttaggcggacgtgaggttttcgtctcgatttattgattttagagccatagttgcttctgagaatatgttcagaactttcagtactacaaagtgtacgcatcaattttttttaaccatgatcgtaagagtgacgtatatgccaacgaatcgtgagttggtatgtttagcaaagttgtagcaaatgatcagagttgctcaatatcagtcgtatcagcgtatggctgatttactaaaactatcaatatcagttgcgagctatcaaatcactttgatttggcaaccaacaaaagtgatgcgacatcgctctctagagcataatcaattcagaatgagtgatctccaagctaatcatgtttttcagtgaccaacacatagtttcaagtcatctgcagcattatcaaaaatatcgtattgataagttgacattttatttgctccatttaaaattaaagttaacccatcagtgatatccatagtctatcgctatcaatgcatgatgttgatgtgatatagaatgatccgaattgtatcgcctgtaccaatcaacaaattttaagcgttgatagtgacagcgagcagctctgcaaatgaccatagaaacaactttgctgaacaaattttttctcggttttgcttaagagtctagataatagagtatttgtaataaaaaatcgtttttcgctcttaagtgtttgatatttttagttttattggcctactatgttaaacaaagtgtttatacttatcatttgctacaactttgctgagagcgagtaatgacgctttaacctaggcttccgagccagaacataagggagaaatacctgtgtcccatccctgaaagaagagcacccacaacaatggagtgtacattaacattcttagcaacgcaactcccaacgatttaaacttttcccctgaaatgagacggttggtacggttgtccccgtttcttcctttaaacaattcaaacacttacgtctatcatattattcataagtggataatctgatcgccgtgaacatttgagttatcttcaaacccaagtctgcacagtgggcctggccattttaatatttgtatcatatcaccgatatgctgcacatattaatgctgacaagaaaatactataagaaattttagtatttccaggatgctcttcaatattggctgtgcaagcgcttagaatagaatagaatagaatagaatatcatttgctacaactttgctgaacataccgtagttatatttcttatggttttcatgttatttaagtttttcatcctaaaatttattattttgtatgccttgtttctcaattatgagcagaaaataaatcttcccacctaatgatttttcagtcgagtacctctgatcaaaattaggagaagatgacattttttcatcttgtttaaccttccagtcgtcgcgcgatttgccaccgtcagaaccgccgcgctgctgttgtgaacgaaaagcgaggttctttcagcagtgttgtacaaaatacaacagtgcgacgactaaagtgttaaaattgtttttactaatagacgatatgagataaatccatatttattgaatactagtggtcccggcaaacttcgtcttgccattaaggtgactcgggagaccatgttattttccctatcttttgtctcactctaacaattatcatcaaaactttgtggaagcaaatctcgagttttagtgaaccgatgaagctgaaaatgtattagattgtgcactacatatatagaatcatagtgatacatttttcgcatcgatatatggagtggttcttgggatttgcttcttcaaatggatagagtgattagatgacgtcccgtgcggccttaagtaggctgttgaaaaccagtacgaatcgtcccatacaaaatgacagttccgttcactctcgttattccgactttcccggtgaatatcctgcaacttttatacacacaaacacgtcggaacccttgacgaacaaaatggagaaagaattatccaaatccgctgacccgttcgtaagccatttcgtgacatacaaacaccattccatttttatttatatagattatatagatagattcacacatgctcaactcacaaaagtcatggctacctgagcacatcaaatcaaaggtaaaacgtgtatttatatataaagaaaaactacatcgtttttcagttgttttcgatcaacttggaagcttctgaaagaaattcatcatattttcctttaccggtatttcgtatattcgtaagcgagatcatcgggttggaagtcaacaaaagtcgtataaaatacatctacaaagtatacagtccgattgaattcggtggcataatttaaccggaatcttctgatggtttcgaatcgcatttattgtgcttcttcgagtataaataaattattataaaacagattcagctgttactaaaataaaacggtaataaaatgctaaaatctttaatttaagtatgtacagaaaatatattgaaattatgccaaatgaccctcatatttcacatagttaaaaattatgccaaatgcccgttatgccaaatggcgttatgccaaatgaccttatgccaaatggcccgctcccagtaaatggctaggcatggcgtaccattggtatctcgcgtacctgaaggaataaaatagaatgttttctctgaaacacttaatcgctatagctctgctttagacagctttaaaaacaaaaaaaaataaaccgctgcattcaagaaatttcttaggcagttcttaaaatagttttcagaggtttgctagaataaaattgtaatagttgttttccgataattttttgaaaatcgctgagattgagttagggaatcattcaataacttggcaccacagacataacatgtgttctagttcatagatgtgtaatgatgatgttgcactttttcttttttattagggtcagttttgtatagaaatattcacacttttttaaggtgtaagcaataccgttggaaatgtcggtgctaaacaatatactggtgctatgcgtacatgtcaactttgagtatttaaaatgttgtggaaccttaagtatgaactactgaactcatttttgatatcatacagcatagcaagtataattctttgctcataaaatcgtttattctaaaaaaatgtgcttatatcaagggaaattgcctacatttaggcgtattatgcagattttcaagatttaattttgaaataaaatgatcaaatactcgagttgtaagaattttgacatcattttcagattcaggagacctaaatttagtagacacggaaatttttcattcttaaacatgctttgttatatgatgatcaatttcaccccagtgttgattttttgatattaaaaatatttttataatatgttacatattatttcatgaaatttcgaatacacaaactgataaagatcaatggagtactgattttgtcgaaatttatttgacaatatttaaattcccaagggttgtaaaatagtgatcaatttgcccccggattacggtactcgtttggatgtttctgaaagttcacaagaatctctccgaaacctctagtaattccttgatgctccctggaaatccctaggaggtttttgagaatgtctggaaaacccaggccagaagcatacccaatagagttgggaaaagtcatgagattcacactacagtagccaagcatgggaaatcacagttagcgaagctagtgaaactcagcctatagggcgcttgcagcaaacaaaagtgtgccaaacggctccctttgattttgctgggtaacggtttgaaacggaaaacacgttacagaacgtttcccagcaaaattaaatgggtccgttgggcacactaaacaaaggctgcaagcatcctatcgctgctatgtatgtatgtatgtaggtagccaccatcctagcttgagtcttgctctgcatgcggttccactttacagtaaagacaaccttcattatcaaactgaattcaacatactattgtttgaagggccaaaatggggtgtggcggacccgtaagcagagacacttacacgaaacccgcgggaaatagagattctccttccaataatatgatccaacggaaagtataatgaaatttgctatacctgtcaagttatccacgggatggtttgttataagaagggcgcgtcaaatccattccaactgttgggatagaagaatccatctacaaagatgttctggttacttcaacccttgactccggctggcactctattccattgtccagctgcaacttcgatgatgtccgaatgcaccctccttaatcccaacatattattaatctaaatgaatttaataagatacctgaaatgaaaatcatgttaatagatagttgatatatatgtttaaagttgtttcaacatacttgatgaatttaacctccttaagtgcacttcaatgtaatgtcgatatacatattcattagggaagaacgacttgctgaaaaatttaagatcaatggtctaatatgttattctctgatatgttggacctctatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactaatttctgaatttacaaaacgtatatgattacttctgtaagaatgcaatattattttattactagtaatttacaaactattatttgaaaacttttttcgaaatgcttgaaaaatcacgttatttttactgacaatattttttttattttcatgtttttcaacgtttattacaacttgcaagtgtgtacacggagaacaaaatatagtgttcgtaatcatttttccggtcaatttaactatatttaaaaggttaatttgaagataactaaaaatatagttgaattgacagaatattgttaaacataactataccatatagttgttgacaactatatttttgattgaattaacaaacgtcaaacgtcaaaatttaactatattttagttgactcaaagtgaattttattgagtttacaatatttttcaatgtttactcagcattttgttctgctgtatcaacatatctgaaaagattcggtgctgctttatcgatctaaaaaaaacattgcaaaaatgaaaacaaaggacgagtcgacaaacttgatatgtggtctcctgcgtgagaggtggtcatcttagcacctacactattccttacaagttagaagtaagtagatttgtgagcatgacttgaagtctagggaggtgaatgtttccgaatagtgataattatcaaaattataattgttataagtacaagtggatagctcaatcaaagaagtgtgtgtatttgatttgacgttaatttagtgttggcgtaagttaattttatttcgaaacaactatttgtgcgtaagtaaaagtaattgacaggattgtaatcttaacatacagaaattcttctgcgtgtattcaccttcaaacaagtattaaattaagtttcccaaaataacaagcattttaaaatatatatcgagttatggagagtagtttgcctctcacgtgacatcgactagtggagatatcgagttatagaaatatcgacttatggagagcacggtgtatggaaatttgaagggaccgcaaaatccatcgagttatagaatatcgagttgtggaaagtcgactgtactgtcgaatatatctccagcgattccataaaaatccaaaatctttctttgtcactttcttttaggattcctatggaatattcacgagacgcgacggagacaagacataacacttatcgttcttacaaatcgatttgtaagaacgataagtgttatgtcttgtctccgtcgcgtctcgtgaatgtcgtgtagttcttacgttagtgcaaattataaaaatgagtactcctatggaataatctacaagaaaatcctcataaaaccgtacactacgtcctttatgtgcaactgtagtgtagtgtttgctctaagaatcctttcagaaaatccgccaagaattccatcaggagtcgtccacagatttttcctgattgtttttctaggaattattcaaggaattcccgccaaaaagtcctattaggattccgataagaatacttacataaattcctccagacgttactaagagatttcatctacgattttaaccagggtatctaatcaaaacttttcctctgatttcttgaagaaattcttggagtttttcctaaaagaaatccaggaaaaaatctggaggattttttaaagaaaacccagaagaaatgactggataaattacgaaaaaatacctaccatttcagtaggaattttcatatgtatcaatgtaatggttgagcttttacaggcatttgtcgaagaatttcaagaataattcttgttgttttttacttaaaaaaaccctgaaaagaatttctggatgaatttgttgagtaattattggcacacttcatgaaaattttgtaagaaaaaataagggattcctaaaataaaaaacacgagaaaattctgttggattttaggagttatgactgtaaaaaaacaggtagaatcaatttgaaaatttctgaaacaatttctagaataaggtgtagaggaaacgttggataaatttataaaggaaaatcctaagaatcgcttaaaagaattcttgaagaatctctgagagaatttttctgaaggaactcaaattcaaacttaatacttgcagccatctctgaatagattttagaagaaatccctgaagaaatatgtggaacaaatccttgtagaatgcatggagagatcttcgaaagcgttcttgaaataaatacaaatatgtttgggaggaatctttgacagcatgaattgttgtgaaattatgggagaaatcccttataaaatttctgttggtagcattcctggtgtaattcctaaaagagtcactggtagaatttctgctgcaattgttgcaaagtcattggtcattttcgccctcaatgcgtgatggaaatttttgttgaacacataaccttaacataggaccattaaaaaaatatccagttttccagagaaaaaagaggtaaatatccaggtctaactccaagaatttgatgcgatgaattctaccagaagcttactttaacattctcccctaattaattggaattctttaaatgaattcttaaaggattcaattctagaaatttatctaacatttcctcagggatttcccttgcagatttatacagcaattttgcctgaaaattttcacgagtcaaaagtttatcaaaagtatcaagaaattaaattttaaactaccgtcatcatttcccgtgcattaaaaaaaaatcttcggctcaaaaaattgtatattcttttcaaataattttaaccgaactaggataccaatacaaagcatcgcacgcagggaaaaaaataatttcgtgatgcgtaacaaaaaattctcaaatattgtttttacaaatgtcatgttaagatcgactcgtaccgttatatgtgaccatttaccgtgcgtcgagttttcgtcatgattaatttcgaatcttgaagaaacgttgttgtgcagcaactatgttgccagtaccagtgtgcgtgtgcgcaattattatcaagggtattaaaatctttattacaataaaaaaagtgaaaaaaatgcatttttcatttgttttttttcgttattggcataacttatatttttttgttcaattaaatcgttgtagaaggtttgactggattgttcaaaccatttgaaattcgctcaaaaactaaatataaagtacttatatcacgacataacaataatttcatgccttttacactaatgcacggtaaaaggatccatacatattaaaaagagtccatacgccgtgcatttgtgcctcgtcatttcatgtcatttttgtgatattctaacgttaaaattaaaaatgtgaatttttgatgtttctattgagaatgttaaaaaatcttattactaaacatgattttgacaatataaactaagtttttgaaatgctttgtgaccgggaatgcttcatttaattggttctatcttattctgccagcaaaacaataatttgtgctaattgtatgacttcactaatttttccactggatttctcagtaattacttttcaaattctaaatcttgtatgaactcttccaagaaaattcactaagatttattgctaagttttagaagaaaaagtgggcttcgtggccatacggttagcgtcatcaattgtttaggcatatcgtgaatgacacgaagtgtgggttcgattcccgctccagccggtgaaaacttttcgtcaaacaaaaaaatcaccatgttgttcttatccttatgttagcgatcgttcagtttgtgcagcctgctttagctaaggacgatgtaaactgtcaaaatttcgttaggacttttttcaaacaaaccattcaagaatttttacgactacaatatttctgttatttttccagacactttgatttggatttctagaaaaaaaaagcaattctagggattgctccaaaaatttcaccagggattatttgaaaaataaatcttttcaaaacttatctagtaaacttaactattaattcctccacaaatttctcttgcaatttcttcagcatttaatacaaatattactcctgctaatcttctaaacatttctctagtgaattctcacataaactcttcatggattctctaaaagtttttttttgcaccaattacaacactaatatcacagcaatgattgaaaccacaaatttcttcagggattctgtctgatattttaagaaaatcctgcagggtatttgaatgattttttttcttcatttatatcatgaattgatcaagaaaatcttccaatacttcttgaaaaaagatggtagttctatcagtaatcttaggtcttaataaaaggttactttaaaattttcttaagaatttacactcagatttatttcaaaaaagtaattcaatatttaaaaaaccttgcgtttctctggagacatccttagaagaatgactgggaaattttatttatattcagatgaaattcctagtgaaaatcatgacaaaatgcatacagtaatacgtaaagtaacacttgtggtaaaatcacgagaaaagcagatttttcgcctatttcctgttaagattctttgtttccttaatttatgtttgatttcgtgtttttttctgattccagtttggtgtcttttttaggaaagaacttaaaatttcccctcctataccagtcctggtcaagagttaatatgttttttagagtttttcattgatgcatttatccaggactcctacgcgttcgtgcacgtgaaaattccataagctttaaagataacgttaggaaattgtgtgtcataatttgaaatgtaaaatttcgtaataacgaaaaaacaaatattacaaaaacaatgtgctaacaaatgaaacaaacttattattgtcatcatgtcaaaacttagtatttcattttgccccacccgttatagcttactccggtgtaccttacagcagtaagaactcaaatttacagaaataatgtcgattaatcgagaaatactcgtcgattaatcgttgtcgataatcggcattcttggactgtaatcgattatcaactaatcgattaattgagattttgcgacaaccctaattcccaattcaagcttgatttgctgctgaaaaggaatcaccgaagaaatttttcgccgataccttgcaattttctacagcgattcccgttcgaactgacatttcttttcaactgcgtactccggccagaaaaattgaactttcttgatcgattccttgcaggaatttcccatgcatcaagataggccatgaatagtagtttacggaggggcccaaatagccgtagcggtaaacgcgcagctattcagcaagaccaagctgagggtcgtgggttcgaatccaccggtcgaggatcttttcgggttgaaaattttctcgacttcccagggcatagagtatcttcgtacctgccacacgatatacgcatgcaaaactggtcattggcatagtaagctctcagttaataactgtggaagtgctcataagaacactaagctgagaagcaggctctgtcccagtgaggatgtaatgccagaaagaagaattggttcccaaaccttcaaggctgcatgccttcaagtgttttcaaaactgaatcactccagtggtcctttttttaagcccagaaagacagttcttccttagataatgtttcgtggacaatggaactgatcattcttcagatccaacccatgacaatccgatagtagtgtaatacgtcttatgaaacataacaaattagattcataattcaatttcacatgaaaaattgttctatctttatggaaaactcatcgcaatagccatggttctaacaattatgaagtgtgtgtataacatcccatcaatcttatttcatcttcatgaaaatcattgccgcaccaacatcgctgttcacctcaaaaaatcatttatctgtttagaatagcctcgttcgatgcgtcgtaagcaacgcagattgtaactaaccccaggccttgtttccctcgtgttttgatttactaacccgcctatggtgttcagagttacccgttactaacgttacgcgctagttagcctactgagaaataactcgatttttaacaagttttgtatttttcttcccttcccaacctccatctcatcctgcttccttcgatcgatttgattctattccaaaatttcaaaattaacccatccggtggttggaaatccgtggttactttgatcatcttctcacgaccacatttgcgcgaatcgtttactcacgcgcattgtaatatttccctctctctgtatgtgtgtgtgtgcgctcatcaaacgcaccaccccgtgaccgtttccgccgccccattttgttattttctgattttcgctggtgtttgtgtgcctactacaactaccactactacccctactgattttgccactaactgaacaatgaacaaaccacacgaatcgggcaccagggtgaattcatgttcgacatccggcagcaggagaagaacctcatcaaggcggccaaggtcctcggggagagcaagtcgcagctgcacacgcgtgaaaccaccgccaaaacgaaggtatttatgcgctcctattgtgttctgctgtctctctctctctctttctcgccctagtcggtgttttgttgcacactaatgtaatcgatgataataagcgatgcagcaggtgcgccataagcttttggctgtgtgtgcgtgagcgttcttcgtttccgtaaataatgcaagagagtgctgtagctttggctttgagtttgaaagtgagtgtgtgtgagtggagctgtttatgttgaaacaatagacatttgaggcggagtgcaaagtgagtgcttacaatcattgtatcaaatttatagatggaatttcaaatatcattctcacattgtgcagcattttattactgttagaaatttcattgtaattcaggcatcaacaatgacaatacgacaattagatcctagtagcttcaaaatttcaaacgaagtaaccgtcattattgatgcagcctgctacgattgaaaagaagttgtcatggaaaccgtcgctttttctcaggttgccgaatgcgtgaacatcatgaacaacatgctggagttgctcttccacagtgaagaggacattggatcgacggagaacgatgtccgggagataatgcagattctcctgcgcaccgtcatccagagttccatcgccatggatcgcgacaatccgttggtcggtaatctggtggcgatcatgctggggatcttccgcgccatgacggctgtgcactatcaggcgtacgagaagagtttcctcaccagtttcgatttgctggatttcctcatggaaattctgttggtgttcaaagagctggtgtcgaagcccgtttttccagttgactggttggacatgataatgcatcagaatacagtaattcttgaaagtctacgtcactttgccgttataattatggataggtttttctcgccattcgagaagcaggtttggtcgaactatttccagtgttcgatcaccttcctgacgcaaccgtcgctacagttgaacttgttcagcaaaaccaaacagtcgatgatcttgagtagctatcgggacatccggcgtgagactgcgttcgagatcaggaagatgtggttcaacctaggcgaatacaagatcatgttcgttccgcagttggtagggcccattctggagatgagcatgattccggaggtggaactccgaaaagcgaccattcccatctttttcgacatgatgcagtgtgagtactacagttcgaagtacgtgatggagagctacggggataccaagaggaacgtcagtcacgtaaaggggaacttcaacgatttcgaaaaggagatcatcgagaagctcgatcactatatcgagggagggtatggagatgaagagtacaagacactgttctacgagatcatgtatgagtcatgcagcaatcataatacgctacagacctacggtattcagtgcgtccaggtgctgacaaggttgatggagaagctgttggagtatcggtgcttgattcatgacgaaagcaaagagaataggatggcttgtacggtgagtttgctgcagttctacgccgaggtcaatcgaaaggagatgtacattcggtacgtgaataaactgtgtgatctgcatatggagtttgacaacttcacagaagctgcatacactctaaagttacacagcaatgaattgtgttgggacgatacgccgctttctccactgttgaagtctagtcgtcactccggttgtagtacgcattggcatttgaaggaacgactgtacaggaatatcatcgatctgttcgatcaaggtaagatgtgggagtcggcgatcgatatgtgcaaggagctgtcccagcagtacgaaaacgaatcctacgactatctgagtctagctgagttgtacaagaagatgtcccagttctacgagaagattctgcgggagaaacgattcgagtcgaactactatcgagtggcgttctatggcaatgggtttccgcaattccttcggaatcaggagtttgtctaccgtgggaatgagtacgaagattccggttcgttcaacacccgtattctgagtcaacatcctagggcggagttggtcccgacgttgaatcccggcccggagattcgtcaaagcgaaggccagtttatacagatcgtgaaagtcgaccccgtcagccgggacatccggatgagcagggaccggaagaacattgcgtccaatatcctgaagttttaccagacgaacaacgtgagcgagtttcagttttcgcgaccgattcgggactcgaacggaggtggagatgacatagcgagcacatcgtacgagcggacgatcttgatgacgaaggacgcactgccgggcattttgcggtggtccccggtgaagtccagcacgacggttgtggtgagtattacgctgcagtacttgacgtcaagaactttagatcatttttattgaaacgattctgtgttttctcctagatctcaccaatcgaaatggcgatcgaaaccatggaggcgaagaaccgtggcattcgtgagctcgtcctggagcatcgctgcgatcccaccctgccgatccattcgttgagcgccaccatcaatggcgtggttgacgcagcggtcaatgggggtattccgatctacgaggacgcattcttgtcgccagaatatctcatcagatacccggaggatgatcatctggtggcgcggttgaaggaccagatcgcttcgcagatcccactgctggaggttgccatccaggtgcacaaggccaaggcgccagacagtctgatgccattccacgagcggctggagacgtgcttcgccggactgcagcccacgatcgaagccaagtacggcaaacggacgaccgacatcaagatcgatcgggacagcgaggtgacgctgaggcggcagatctccgccatgccacaggtcagcatcgactccagccggctgtcggagaccagcatagggtcgtctgagtaagtatcaactgttgcgcctgaaactatgcctaacctaattgatttcaaaaatttgcagcagtggaatctccaagagccaaaacagtcgcccaacaacgaccagctcgggcggcttcaagtccaccttcaccaactttgcaacgaatttcaacagtacaaggtaggtcgatctgttccattctagacaaatgttgactgtaaaaaaaatacccagcaaaaaatcgcgttagctctcatgccattggacattatccatccaaattaaccccatgtagaagatttgagagtaatttgcgcagcaactaatcctgtaagatcagtatgaactgaattcccaccttttttgtttatcttcccacctctgacaaatgttgttcccaccttcccatatcgtaccgcgccgccatgatgcttccctccatgtgtcactgtcatgctcgctcaacccatcgcgtcgcagtgactttttcgagtttgatcggctgagcctgtccagcgtcaagctcgggacgcaatccggcaagctgatctgcaacatttcgaccaagattggcagcaaaattagacagtgtgtattgcccatatcgtttcgccatttagtagtttgtgatagagcagaagcattgcaaatcccacttgaatctcacacatcggtttttcttttttgtttcttttcatttttattgtgcttttatatcgctttttttaccgcgtgcgtgcgctcgttgcgaaatgttgaaaagatcatggccatctagatcgctgcaaattttgtagcaagccagctgctgaacaatcgcaaaacaaacgtctagattttaaggggtgtgcgctttctcgaaatcggaatcgttgaatcaggataagcaaagtgacgttttgtgtcaagtttttttttctttctttgttgtgtgacgttggagccagatatttcaatggaatgaaacctggcttcctttttattttcctgaatcggtcgaagcctcaactggtctgtgttggaaatttgttcactcgttcgcacttcgttccgttctacttgattacaagacatcaagatagagtgcgctagcgttttccaccaataaattacacattaaatacaacaaacactaatatatcgtaaaatgtcttaccgaacaaactgttttctttcctcttgtttcattctcttgtgcctactgcaaacacaaccctccggaaatcggactacgcagactcgacctttcgtctcattcgtttctcaattcaaatggaaaaatcatgtctcagcatatcttttctttcttacaacattagggacgtcatacttttgtgtcttccatttcatgcgtgtgctattctgttggttgaatttttcccgttttgtttttgcgttatttatcgttgttcgttttttgttcttcttttcctttcaatcatttgttttcattttttcttctttcgaaatttgcattattacgtcccatctagaacatcactcggtagctcacccggtgccaagggcaagaaggacaagtacggtacgaagcgaagatcgagtcgcaaggtgagtagtatccttctcggatcggccgctagatggcagcaccattaacattttgcattgtttcctctcgacagagtgatcgcgactcgttgaacctgcaggtttcgaacagtcaattctacacgtctcccattacgatggccagcgagattgtcggggcgggcggtggcaacagcagctgcagtgatcgggacagtatcgtgttgcagagtggaccgaccagcatcgggtcgcagtcgacgacctgttcgacgccgacgaccaccggctgcagcacaccgaaggtcgagctaaccgaagaggtgagtagacgggtggaagggttctagtaagtggcgctgaagcagtgcagtgatggtcgacgatcggttgaacttcaacggctacaaaggctgtaaaggtggtcaatgcaataatgaggatcattatcgatcaaacatcaattaggagtgcattcaacgtttataacattcctgacttaagccgccagtccagctatgaacatgattcccatgaagaatcgtgtcaaccctagctagcatggtctcactatttataagatcatcgtagaatcatgaaaggctttatctacaaaaaggggaacaagctaaaatgtgagaactatcgagcgatcactattctaaatgccgcctacaaagtactatcccagatcgtcttccgtcgtctagcatgaatagaaaacgagatagtgggaagttatcaagccggctagatctacgtacacatacagtacagatacatatacagtacgccaaatcctcaaaaatgccgggaatatcaagtccttacgcatcacctgttcattgattttaaagcgaaatacgacagtatcgatcgcatacagctatggaaaatcacgtccaggacaaagacagtgcgaagaggatgtagtcaagcttgggcgacactttcgcaataaagtctgtggccagtcagacgctaatgcggaaaatagcttggtcaccgacggacgaagcagggagcttcaatgtggtcccactcgagcatggagatctgttatcgcaactgttcctaagattgtcatcctaagacctcaatttgtatttggttaagcaacggctgctggcggaagagcttaaacgtgctgatcgtctgggcgagaccgttaagggccgaccggtggcattcgtgggtcaccagtggatcaagaatgggggcaaattcaaggggagtcaaagcagccacgtgaaaaaggaataataagaaaggtcaagcagccacgtgtcagaaagggatgcacaaccgcgatgcaccaaccacgccgatatcacagaacagataggaaagattacagcaaaaacagatgccaaaattaacgcaaacactagcgcacctggtggcggcgggcaagctttttacactgaaaatttttcgaaaaatgtacataattagacaagaaaactcgtcttaatcttttttaagattttcactccaaggttgttgcaaaacaagggtaatcttcagagggagtggaatattttcgtttggtttgagggtaaaaaagtggttttgcatattcttcctgttttagccatcagattctacaatagtttatttaattgaattcaaatatgaatgataaaagtccgttaacaatagtgttaaattccgaaaagctaaacattacatatactctgcaattggattagatggacaaattgatgtgaaattttgcgaaaaagttacacgtcttctcagtgagaatcgaactcacgattcctgatctctagttagggcgcgttactcctacgccatgagaggactcatgaacgcagaagttaacctgaaaacgatttcagttcaataatcacgtggtcctttttcgcatagtgcacctctttcgaaagaattagatgccaacgctatctatatccaatgcctatcccgagagcgcattattttttaggtaatgaaatagcacacaacactagccagcaactgcgctggctgaggtttctattgtgtgggctttagggcgtaggcgtaggggtaacgcgccctaattagagatcagagagtcgtaagttcgattctcactgagtagacgtgtaactttttcgcaaaacttcacatcaatttgtccatttaatccaattgcagagtatatgtaatatttagcttttcggtagttgttaaacttccactcggctggttagccgtaaaccacgattcataattaaacacaaatagtgttaagttgtttttttaagaatattacaagaggatatgctcttagaaaaaaagtaagaatttcaatattaattattcttcatttctaatgactttaatgaccggcatataactagtggtaacttacgaccggaaattttatttatattagtgggcggagtaagatacgtattgtcgttttttcggcatttaaacacaagtttagataacattacctcaactattaagaatctctctttttttttgtgattatcagaagaaaaagagggtaaagcggagtgaagaaaaatgtcctaaaacttacatattttaaaactaaaaataaatggttgatggcctaaattttcagggtatttgtaatttaacagttttctagatgccttttctgagattcagagtaatattttgaacaaaaactgtatctatatcagatctttcgatttattattcgtgcttttgaccttatagagtacatggtagatttatattggcactatattaacatccagagtaaataaaagtgctatttgattacttgagatgccgagacagcaaatgtacctaaattaaccatatcatattctaaacctattctcatgctgtcacttgattcgaaatgatgaattcagttactataggttctcagaccagcagagaggagacagcaggcttagattgcgagcctccaaaaggcaaaggaacctgtcaccaactgtcactggaaaacggtacatttgaagggaagagcgtgaaatatcgtcaaaattcaagtcaacgtatttaaaatttctaggtgtttttagatgattttacatttgaaaaatttgaatacctaaaaatagttgtgtgttggcaaactgttattgattttttatattcatatcctttttcatagtccatctgtgtgttgtgcacatgccaagaattaaatattgaaaacaaagaaggcaagaagcatgtagacagttgagctgtctgcactttctataagtgaaaaattatggtattaggtttaaagttactattaggtaacatacaaacaattttataaataattaaaaaagtcgtttcttagagtttgcgaccattatgatacaatcacagatcatattacagtaaaaaatcttgatatatgcgatttatgtcatcttcaaaaccaaaaattccaaattgcgcaaacaaccaaaaatcgcctaagaatttacgtaatagtttgtactggattagcttaaattttgacccatctccagaataatatgttagtaaggattttcatccgaaatgaaggaaactttttatactgatatatgttagaattgtacaatgtaacacaaaacatgtttgtacagtaaaaatatcgtaataatcgttggtattttttaagtcatgaagcaatttaaatttcgtttacaaaaattgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggactgagtttgttcatttaaattgcgatctgcatatcacatgctgccaaacgaatgacggcgacttgtccttaagggccgatttcttaacacccacttaggccttgtaaaacgtgactctgattgaaaactctgattgattggaattcgacattcgtttctctactctggctatgaaccagacgtcagccatttactctgggaagcggatctgatgcgccataccgggcgctaagggttttaagaaaaatctttttcatgcattccaaactagttgtgccgtagcaaagaagatttgtattaatttatttcaacgaaaagaaagaacataacaccacgacaagttaaccaaccttgcactcgtctaaaaatttccacatttgactgacagctgttttttctgctgcactttcatcatagcaaaccattggtggaaaattatacacaaaacaaaacagtggaattgaaaattggataatttcaatgacatccttcccgagaatgtaaaagcaacacgatcggaagaggtttggaggcacgttaaggtgaaacagtttggaatcaatttttaagattgcactaaaacttcaaaggcacaaatctcgcgaagaaagcacccaacaatagtgaattttttattttggctttgtgcactagcagaaagcttaagacaagaagatcagaaacgtttgttaactatttatccagtttagtgcctttgaaaacgtgagtaggggcacaagtcgtccattgtgccgaccatcttttgattccgagatgtttcaccttaacctttcggtcgtcgcgcgaatttttgtaacgcgagtagtcgcgcgttgtactttgtacaacacccttggttttgcgaatatctcaggagtctgaccacttagaaagatgacgttttcggcaaagttgttcagtagctcaagggctatcattattttagccaagaaagtcgggattttgccattaggcggcgctagtgagcatgaaacttttgtatcgcagatctcaggatcctgaccacttagaaagatggtgtcttcggcaaagttgctcggtaacttatggactatcattgttagagctagttgattcaagattttgccaataggcgtcgctagtgagcataaaacatttgtttcacgaatatctcaggagcctgatcacttagaaagattgcgtcttcggcagagttgttcagtagctcaaattatttctttgttcaatccttgaagttcgaggttttgtaaaataatgatagttcctgagctgctaaacaactttgctgaaggtgcctgtctaaaaagtcaagatcctgcagtatccgcaaaacaaaaattttatgctcactagcaccgcctggttgcaaaatatcccattttttgcttcaaataatgatagtccttgagctactgaactactttgccgaagacactatctttctaagtggtcaggctcctgagatatctgcaaacaaaagttgcatgcatactagcgccggcttgtggcaaaattttgaatcaactagctcgaacaatgatagtccttaacctactaaacaactttgccgaagacgacatccttctaaatgatcaggatcctgaaatatttgcaaaataaaagtaaaacttccttgtccactagtgccacctagcggtcaaattccgaattaaatgcgataccatcagatagcgcttcacctccagaacaactttactaaagaccccaagtttctatcttatctggattttgagatataccgatttaaaactatggtttactcaaaccgtatatagtgcgttcattattatgcgactttcatgtacatttgttgattttaccgtattataaacggtcatactgtaaataaaaaccgtcgagtattgttcttaagaagattcttgaggaatacattttggtttggtatcgatagatatcattgttgcaaaatgatagcatataaatcacaactgttgtacaaagtacaacagcgcgacagcccgaaggttaagcaaaaacagtgtttgcggcacactgtacatgaaacaaaacattttttcgtcatctttttctttcatttatcgtaagttaaaaaacaaattcattaactgtgaagcaaggggtcgggtcgagcttgatagtggttggtacaggtcgaaatcttcggtcacacataccagttaccagttaccacaccattttatacacatttccaaagaaaatttaaacccaatagcggggaatcgttcttgtttgcctttcggagcctatcgggcttttgttggcatatattttgacttatgtagggaaaatgaaccggtattcaccacccgaattatataccgttttacgaaacacataagcaaaaatcgttgagtgttagtcaaatcgttttaaaatcgtacggaaacattcttagaaatttcaattttttttctcagaaaataatagaaaaaaaatcctcagaacgtttgctcctttgcaccatggtgttcctgaattcaccaccataaataaaagaataaacgtaaatgacgaattcagatactgaaataaaaaaacacggcataatactggtgcaagtggtcaactcgtcaccctcgtaccgtcgtcaactcgtcaccccaattctcaaaacaaaaacaaattttctgaccagtgctaatatttttcctgctaaacatggactggaagctttcgttcaacgtattaacggtaatcaaaggtcttttgatttatttataaaacaaaatttaccttatggtggtgaatactggtacacctaccctaccttcttgatgcaaggcttactgtgctggcaaatcaacgatataaactataaaactggctgttgctagcgtcgaggtgctgttcctcaagaaagaagctgtgctcgaaatgagtggctcaactgctaacgtttgccaggtagaacgaaatgatctgcggcatcgtcgccttggtcatttcgacaaaggtgacatggccaaagccgggacagaatcgattctgcgatgcctgtgcccagggtaagcactgtcggaaacctttcgatgacacacgtccatcgcgcaaagtggccccatcgagcgcattcattcggacgtttttggcgccatagacctgccggcttgggagggatcgagatgtttcctttcgtttatcaacgacaaaacgcactttgccatgatctacctgatgaaacggaattcagaaatcttcgagaagttacaggagtacgaagcctttgttaccgcacaatttggattttttgtaccgtggaaataccccgatgtttgttctttaaactcgtccctacatcagggaattaaacgcgcacgtaacaatttaaaacataatttattacgacacgataaaaggtacgaaacgatacgggacgtaaacaaactaactgaagtacacagatacaatacgatgacaaccacattaaaaccattcattgatgcgcttctccagaatcacacattgacagttatgctgcctagtgcgagcccagcggcgtgcgaagtactgcatagtacacctcgatagggttgtcctcaacaggattgaagatcttgaagcgcaccgtagatcaaggccgtgagtatggttctacagcgcagaaaggcgtctacagaaggacatccaaatcgaagccatcgtcgcctacacccccggcagaatggcgtggccgagcgattcagtcggatgctggtggaatcagtgactaccatgctgatcgattcttcgatgccgaaatcaatgtggtgtgaagcagctgtaacggcgtgggtcccaactcaacttcggaagaaattggacggcaagagtcaggaaggcatcatggctggttacgcccccaacggataccgcctctggaaccgaaataacaggaaggtggtgattgctcgtgacgttcgtttcgacgacaactatttcccatacgcatctgaaatgaagaaaaatgagaaaccgttcgtagtgctaccatcgtacgagcaagaagaggaagcagaatcagcagataaaccggtgcaagaagagcctgctgataatgaggacagctatcaaaaaaatatcgacgatcccgcgaagtacgagcttgctggcccaactaccgccacgctcccttcgtaaacagattgacgcgatgcccagggcaagtcgtcgaggcgcagcgaacagaagcgcaagttaccagataagttgttgttttttcactggtttccgagtaacttctgccgcattttgctctgcagtagatgttactgagacttactgggaggccctgagttgtgatgaccgagacgagctacagtcgatggaaaagaaccaggtgtggcagctgatgtcatgctctgccaacgtgaagccgtggaaaaccaaatgagtttttcccatcaaggaagccaaaggtttcgagactgggactggacgaaacgtacgcaccgattgcgaaactttcgacgatgagtatcataattgaggtgggcgtccataaaggtatcttcttcaacctgatagacgcgaagaccgcttttcttcatggcgagctgaaggagcatatctacatctgcgtcccccacggtgtgaaggtagcaacggtaatggcgtgatagctgtaaaagtccctgtacggcctgaagcagtcgccacggtattggaaccagaagttcaccaaccagatcgagaaactgggctttgttcgatcgaagagggactactgtctgtacgtgcggcaccgtgacggtgataaggtgtacataatttagtacgtcgacgatctgttgattgctggtagaaacctgagcaccattaggttgatcaagaagaagcttgcgtcttcgtgttccaaatgaccgactgcggttaattgcggcatttcctcgggatacggatcgactacaaccataggaatcgagcatcgaaaaggtcctgaatcgcttcgggacgaaggggaatgctctgtatcaggccggatatgagtttccctgtcgtctatcttggacggtttcagcaggattctttgaccgcgcccatgaatactctaaagcgtttgcttgtagtgcttgagcgagactaaatcgctaggtctcgattttcgctgaaacagcaaagcagaagcgctatagtcggctatgctaatgccgactgggcggccgaccttgtggattgaaagcttgtaagcggatctgttcttcttcttcttggcattacgtcctcactgaggcaaagcctgcttctcagcttagtgttcttatgagcacttcaacagttattaactgagagctttctttgccatttgcgcattcgtatgtcgtgtgacgaaacgatgatactccttgcccagggaagtcaaggaaatttccattacgaaaagaccctggaccgaccgggcatcgaacccagacaccttcagcatggctttactttgtagccgcggactctaaccactcggctaaggaaggccccggatctgtttacaaggtgtataggtgcaccgtttcgtggagcagcaagaagcaatctatcgtgtcgttgtcttcaagcggcaattttcgaggacaattgtggctgagtatgcatggccaagaacctcgagtataaaaggacaaaacatatcgatgtgaagcatcactccatccgggacccggtcgagagaggtacgttgaatatcgataccatcggcactcgtgatcaactggctgacctggccaagaaatcccttgatgtcacccaattccaacggctggcaactaaacttggtatgttggattaagagggggtgaaatcgtagcaatctgaggtttgcctagaccggacacgttagtcgagtcggcgtcaacatcgtagtctaagaaaccatggcaatcgaatcaaccgggagggctataatttttttttttttttttgtaaaagtattgtttatttcagttgatttgttcaaaaactaattacatggaatattttgcaattaatcataactcaacattcaagtaaaactctaattcatctacgtctactctgttatcacacttattgacaaaagcgacgtaattaatgatgtgtttcattacaaataatctttgtgttatgttcgtgttatgtaattctgggtgtagcatttgttcaaacgaaattctccggccattcaggatgttcatcaatacgttttgcagatgttcccatgctgcagccactcgaggacactcattgaacttatgtttgagagtttcaatcgctgcattgcagtgaacgcactggtcgttgtccgctcgacgaatagtacaccacagctgttagtgttccactttctcgttcactaggagataccagtgactgcgttgagctggagtaaagttgttatttcctatattgaaccacacgcgtcgccagtttactgcaggataccgcaattcgacccttggccgatcggtttgatcgacataatagcgatgtaattgatcggaggacatgttttgtagaatttgggtgggcaggctttggcgcgcctgcaggatagttttcaagcaaggaaggtcagcagcgacattaggatttgcttgggaaattacggaattgtaatatgggattgagccaatctctctaaggtgacgattaattagcaaagatttcgctttcatagatattagctggagtttgagcccaccctgttccttcagtcttgcaagctgtatcatcggtatgcgtgcaggttgccctctccacaagaaagttccgatggttgccgttatcttagctgagtgtacagagtaggttggtagaatcgatgcaagataccaagctttggccgtgatgtaagtgttgacaagaaaaatcttctgatgtagggtaagtgtgcgaagcgaattgagccaaacttgctgcgctattttcccaactaatctgtcccagttaagggttatcatgcgccgtattgaatttgcaaacaaaacgcctagtattttgatgttgttttcggtttccaaccaattcacaatgatagggtggccgttgatgaagccgacgtcgacagaagttgtttttcgaaggttcaatacggctcctgaaactcttccgaagcgttgaaataagtcacgcatggcatgaactttttgcgccgatgtggcaaccacacttacatcatcggcatatgcgacgatcaagtcagtgccgcagaccgtttcgagggaggtcaaaagaggatgcaaatacaacacaaataaatgcatcgagattggatctccctgtctcaccgatcgttgaatgggaaaggcagttgttaggtatccgtttacaagcagacgagatgatgagagagcagagattctagatagcagatccacgagttggggatggatgccgagagaacgcatattactgcacagaaacgagtgtctcacccgatcgaaagcgtggtctagatcgaaactcactagcttgcccacccgtttcgtcgccgccagctgtgcgatcctatcctttagcgctagggtggcttgaaagatattgttgtgtccgtttgaacacttttgagcattgcttagtatgtggttggccttcatcacgctgtccaaacgcgctttcagtatgcgggaaaacagtttatagtcgaagtttagaagcgaaatgggtctgtacgaagcaagagtgttgccagttcctgattttttcacaagtactataacgccttcaacaaacttgtgagaaaattgtgcatttagggcttcgttcattatcagatttatctctcgatggatgacatcgaaagctcgctggtaaaattccttgggaattccatccggtccaggcgatttctttgacgcacttgatttgattgcggcccatacatccgcagtggtaatctcttccatgcatcgttcgttcgttgcgtcgttttgcgggataatctggtcacactgaaattcatcaagtcgctccgtctcaccattcgtttctctatatagttcggagaagtattggagtatttcgttttgaatcgtttgcgagtcgtttatggttccaccttgttcatcatcgagtcgtgtaatagtggtacgcttctttctcctatcacccagctgaaatgtcgagagaggctctcctgctagtattggctcatttatccgcgtgaaagtatgagtaaaacgacgttgcagtgccagtaactcccctttcaggtggtttatcgtagacaacattctcggattttgatagtacccgttgtaggcacgtcttagctggctgtacagattttcgtgtgcatgatgatactcatcgtatatctgtttagatttccagcggaagaaactgacaattttcgacttggcaaattccaaccaccaatccatccagctggaaaagtttcttctttggcgcgtccagaactgccatcgaatttgaagctctgttatggtttcttcggtgagaaggtggggacggagcgaccaaaatcctcgcccctgaggtcgaccgagatgaggcaggcatattcgaagggtcacagccatgtgatcgctgaatgagcagacgtgagtttccatcctacgtagctgttcgcatagccctccgcttacgtatatgcgatctaaacgtgatgatgaattcgctgtaatataggtgtgtccggcgtctctagagcgtagttttatccaagcatcgttgagctgtagctgctggacagtagattgcagagaggggctcgaattagaccctgttgcgtcgctctgtcgcagtacgcagttgaagtctcccgctagtaacaaatgctcagttcggtgacggagatagtatgcaatagtgctattgaaaaatcgttctcgctgcgcacggtacgctgtgccagacggagcataaatacaacaaagggttgtatcgaggatgcggactgcggttagacggccatccaaacttcgctccacatgagagaattgaatatggtcttttaatgcgattgctgtgcctcttctggaatggtcgacgttggcaattacattgaagccggggagagtgagttgctcgttctcaacttcttgcatgaaaacaatgtccagttgcattgtttggacgaatgttctcagcgcgttgattttgttgttgttcgtgatggtgtttaggttgatggtagcaatattgtagctagtgaagagagcggctcagagtttcaggtcggtgacatgattggtttcgcttttgtcgtgtctcattttcttaccaatcgggcgtctatcagagtaccgactggagttggaagtgtcggtctcgttgccatcagaattcttcgctgaacggcgcgttactctcacccacgcttctgcatcttgttgttgatcgggtggcagatttgtcatttcggcgacttcggtagcacgatggattacactagcaggaggaggcatggtggtgctagtcgagggtgtcgggcttggtgctgcgtaagtagggagcgaatcttttggaggtgtagatttcgggagggctagcttcgtgcgctggtgtttcgaaccgatttgggttcgagaggggagcgggtttttggcggcatcagcgtatgacgtgccgcttgtcgtcaacttttgcaccaacaattttttgttctgtacacatgaaacaccattatgtacagattcgccgcaatgacgacagctttgttgttgcccataataagacacgagcgtggtttcagagtcgattgtcacgtaggatgggatatttttgcggacgatcatccgtacgactcggacaccggtcgggagtccagcaaaaaggtgcttctcatcccaaacctcttctcgaattgagagtaactctccatacgacatcagaaatctagcaattttgctgttcgtgacgtcctcagagaggttgaagagcttgacctcaaccgctccgtcttccatagctagacgtagcttgaaagactttccatctactatgagctcgtgtttattatcgttgttttcaactactttttgtgccacttcgagcgaagcagttttgacgaaggcgactccaaggttgcgactgtattggatacgttgcacctcatttcgcctcagcttaagcgtctctccgacgaattggtgaacctcttcggaggatggcttcttcggcacgtttccataatcaatacggaaagtgttctcgcgacggtttttcgtggccatcgtgacacgatgccagagaaacgaaaacttaagaaactcgcggtacttcactaacggtgcttctacagaatcactgaaaatcgatgtaaaccgacggttggcttccgcagacgacttatgaaacgcggaatgcgtctgatcggctcggaagttgagcacaaacttataaattgcaaattttcaccctgctcggttagttccaaactaaagggagtccacgatgaaattgccccactatgaaattgctctaactttttaactgaaaatttgggtggatttagttcatagtgcatccttaagttttaatgtcttgtgatcaaaactcgcggaaatggagtcgaaagaacagctcgtgcgtgataaaaccttgcgcattcatcacgagaacaaggatctctcgcatcgttccatcgctaaaacgttgggaatcgcgaattacacggtgtcgtgagtgattaagcggttcgaggaacgattgaccaccgatctgaagcccagaagtgaaggaaaaagtattccgtacaacaccaaaaatcacaactgcgtagttggaaccttcaaccgaaacccgaacgcctccgttcgggatgtggctaagaacctgcaccttgtctctcccgaaggcccacaacgtcccaacaatcttctggccggatttggcctcatgccactactccaagggcgtgctgaagtggtatgcggacaataaggtcaatttcgtgccgaaaatgttcaaccctcccaacactccggagctccgccccattgagaagtactggacgattatgaagcagcaccttcttaaacgacttaagttagtgaagaccacgtatatggctactccaatcccacctaatggatttgacagcagccaagatcatttgagtatccacattgaaatgcatttgagtatccaacggttgcttagaacatgttggattcggaaagatggcggcgccgcatactgctggtgaagacagtcgaggaactgaagaaagtatgggtttacatgcaaaaaacggttggtgcacaggttgtgcagaatcttatggccggggtaaaatggtaaaatgaagtttaatagttatttttcaatccctgaaaatttgatggcaatcggatgaaaactcgaattttgcgaatcaattttgtgtttggcaatttcatcaaagacatcgtggacaccctttaagcagtgttacgatagccggggtacgttcgaagtgcaacttaggagaagttccaaagataatccggttaagcaagacgtttgacggcacttcagattgcatagccatatcaagatgcatctgataacgataattgagccgtggatatagcggtatatcggccattcacaggatgaattgtgtccctttacacctcacacgaaggcttcgaggtggacataagaaccagttattcgagaacaattcaacgcttgggacgtgaagtcggaaagactactcgccaacgctagaaaacatagtctatcgttatttttgcattataacaggtaatcggtttcaataaggaccggagaatttctacaattcctagcaggatgtttgagcgaggatggagcagtttgactagaaccttattgttaatacatttcaaacaaacagcggtaggtatgatctgaatgcagatgaactcattgaagtgacatcaaccaagaaatattcggagtcggtggaatgcaaaactaaacactttccatgctgcttgtcctagaacaagaagatgcgttcagagggatcgcgcatgattgaaaactgttggagatgagacggaaccgatcgtagcagccaaagaaggtgtcaccacgaagaagaaacaaatacttttagttcattctgttactattactatggaccgatgcacgagttcactatctgacgtttgagcggtgccgtgttatttacgtgaccatggcaacgagtgaattcggcaccgctcaaacgtcaaattagtgaactcgtgcattgatccattactattattagtattgaattcagacgtttagacccaagtcccgcggtgtctcattgttagccaataggttgtgggcccagaatcgtgaaggactaatggcgaatacttcgaatcgaggaatcaagcgttttatcggaagggagaattggatgccacagaaattcgccgttcaaacctatctagaggtggacgacctgtgggaggctatcgaacctaagaaaaaggttaacggcacactggaagcagtcgttccgattaagtacagaaaaccaagagggaaaattatcttgtttctggaatctgaaaattactaccatgttcggcaaacggctacagcacgggaagcgtttgaagaaactgtatgacaactggtgacaaaatgtttagaacttcttgaaggtgtgaaaaatgcgcgaggaatggttgtagctgctgacaagggatccatgtagattgaagaaagacaaattccgatacacatccagtatattccaggattgtcaaggatcttctatcagtagttcaaattatgaagaaaggctacagtgtgatgatgaatgcaggaagaagctagcaaggtagcaaggtagcaacaggtattatcgaaaacgatctattttcaagctaaatcaattgaaacatgctggatcagttatgttgagttcgtgtgaagcatcccttgaagtttggtacaaacgtttgaggcacctgaacatcagcagtgtgaaaaagctgtccaatggtctattggatggtgttcaaatcaatgcaagaagtgatcgtgattttgcccgataagaaaacatggagactgaaggctagatgatggtttgattcagcattcccactgacactaatatgtccgtgctccctccgtgacaagcttcaaatccaccttggtcacaggtgttgaggctcagcgtacggaaacactccttaccaggcaagtacaaggatttttctatcaattgcaaaggtcttcccgtatcaaaatctccactggcatccgtgagtcgttcaagtgatattcagataagcgatgacaatgctgctgaacgtatccagggtcctggattcagcggtgttgctaacaacgagattcatcagggcgtgccgcatgaaccgaaaacgtttgacgaagctatatcatgccgatatgcggcatggcggctcaacaagcaatctggttgaacctactattgaaggattttaatgctgaacaggaagttactttttttaaagataatcagagttggctgaaaatgtcgatcattgaaaaaatagcaatagaaaaccgaaataagctgcatctattgtcccactgaactcatggcagacttattaacaaaaccgttggcaaaactgcgtaacaaaaagttagctgagatggccggactgaccgtttccgtctaggagaagtgttggagatgatacggaaccgatagcagcctaagaagatgtcaccatgaagaagaaacaaatgcctttagttcattctgttctgacagtcattgaatacaggcgttttaaacctaagtcctactctttctcattgttagtcaataaaaaccgactaagaagaagtgatttgagctttctcgataagctgacatcaaacattgaggcaacacatatcatgttgtaatagcgaaggacaaaagtccagtgacaccagttgaaatgtggccggacaaattgaagacccgatccgaggcatttatagttccgttacaaatttgaaaggatagatgtaaacaagaattttttctgctgtaacgatcgacgtcaagaacgtgttcaacagcgctgattggggatgcgacatacaatgtgctacatacaatggaaataccttgacagagttctgaacagctatttccagaatgggagtactggagacgcatatggtcaagagttagcaagagcaaatcagcacaagtgagacgtgttgaaaagacagagatactccaaacatgatcatttcttgaagtctctgaggcatgtggtccaagctcaatgtaaaaaaaacctcagaattactatgaatgtctctggaagaatgtttaattgaaacaatcaacgtcatatcaaacactttctaatttataaattcttgttgaaatagccggtaaaggccttagtcccaaagttatcaccgttaccatttgaacgcatcataaaccagctcgcaacctcctcatcacagcccaatccggtagaacccggtcttctgccgccggctcttgctcttccgaccacctctcggtgccccgcccagccgagagtagatcttctgcggtgccggatttttcgcctcgttgatccggaagcacttccacagcccgtagcgtagctccagcgcgtcgaagaacagcgttgcctcgttccaggtgatgtgatgctgcgcgtactcgtagatttccttcagcggtggattcagatgcggggcgtgatcgaacctccggttgagcacggtgttgacgtacgccgtcaaagacgatcctcgatggatccagttgatcagtgtcatgatgctgatgcacgtggcatggatgcagttcatctgctgctgattgtaaagcgagttactggaagactccagtagacgccgttggattcccagcagaaggcagacaaccgcgcaagctgtatagccgcaagggatttccaccaggatcatgcagatcacgttgtagaacacttccagattggtgcgccgttgactgtgaaactctatggcggtgctcaaagcgttctcgaactcccgtcggtgcgtttcgaacatctgccgctgtgccggaaggtatcgattgatgtctatgtcatagtacgttccttcgtggaatatctttggggtgttgaactgtagaaagttgcgtcctcgatcgagaattttcgcgaagatccgactggcgaggatgcttttcgaagcagtgcttgatttgatgtaagctaataggtattcttgaatgaggatttcttcttgagagggattttctgagagttcgagagtggatgcagcaaactccacggtggttccgaactcgaggatggcctcgtcggaaagaatggtgtcgaacgtgagcggcagcatggtgatcagcaagctgctcagttgattcggtttgatgaccttgatcagattgcgtagacatatctcgaaacctcgccgcagttcgtagatttggtttttggattctccgatgacggcgctgctgtggtagaaccggagtagttttgacatgtccgagtgcttgatttcgtcccagtattgaggctggatgatgttctgtagaacgactactgtgtgacgagcttgcaggacatcgttcctagccagtaaggtctcgacgtagttgacgatcttgtagagcagtagcgaagcaggacttttgcactccaaaaccatggttagtatttcaacacagataaattccaccttccagagattttcacgctgcaagaagttgaggatggtgtcgataaccatctcctgcatttccggaatgagcaggtagatcagcgattggaaacatatttttgcactggcgaacggctgtttgcgaaagcgatcgaagaaactgcgcgtcaatttgagatgggctacgtaggcctgaaccagcactagggaacattctagaatcatttgtttttctggaatatactggaggatttcacgatccgtgtgcttgattatgtgccggagaatctattcggatgactgagattatcatgatcaattctaagatagatctagtcgaaaactaaccttcaaagatttttgtccttgaatgtttgttgatcgaatggtcgcatcaagaaaaatggccgtactttgcttcaactgttgtgccttgtaccgtgcgcgggaatcggaatgctttcttttcgatttagtcaaaaactgtatgagcgaggacgctgccgtcgtcttggccgtcgccattttgcaaattgtcaaacaacatcgacatttcacagcttactttgtttccaatcccattcgcagctccatcccaagcgtccacttcgatcggaagtggagaaggagaagcgtcactctcgaccgccgagcgttgtgacgcccacgctgagtatcaagactctaaccagcactggaggggacaccgtctcgattggttccgccgaaagcagtagcaatcgcaattccatcataacgaacggttccactacttcggaggaagatctagtcccgccgccgttgccgatgaagacccgagacagtgactatggcaacgtaccgctgaacgaaagttcactgtaccggcggaccacttcggccagccattacgtgagttgtaagccgttaccaccggttcctaccggtattgtcaactcggcgtacgacgtggtcgagacgagaaacaatagcgttattgtgatcagcagtggtggcatcatctacgacgaacggaagcggccaccgacacctccgccaaaaccggccaggaattccaaggtatgatagatagattatctctcttcgattttctttttgtttccacggaaaccgataatcaaaattagtgagtacaaaagtagtgtacccctcgttttgcggtgagtacagaaaggtaggaattgatcggcaagcgcatagatacgcgattagataggtgggaattgtgaaagacatttagatagccgaatgcgtgagtgtcctaaaggataaaggacacgcacactgtattccgtttccgatgcaaaggaaacgccagaagccattttattttacgttctcgacgtagtatttcgttttgtttcgctaagctaagagaaaaggcaaagccggttattatcgttgtttagttttattcgcggatgtagtaggcgtgtgcaattatacgttttatttcaatacgcaatgatccgttttccaagttttaacaacttaccaaagacgacatagtaggcgatgaaaaatcgtgcgtagatcctacttttaaatgcatctatgaatgcatacggtagttttaatattaggtagattaagcaatccagttactgtgtaaaaaaaacgataacgaaggaacaaatcagagagcttctaactaatcgaaagcta

SEQ ID NO: 98 - DNA, 2100 bp, Aedes aegypti
gacagaacctgcttctcagcttagtgttcttatgagcacttccacagttattaactgagagcttctttgccaaagtttccattttcgcattcgtatatcgtgtggcccatatactatatgcccagggcagtcaaggaaatttccattacaaaaagattctgaaccgaccgggaatcgaacccagacacctccagcatgactttgttttatagccgcggactttaaccactcggctaaggaaggccccagaattcaatggtattatactgaatttggttttcatttatttacagatattgcactgatttttcaaagatttattaacttcttgaagccttcttgaagccttcaagtcactaacgttagaaatacattgagtacggcgcaacgtatgatcgaaaaagtagttggaacaattattccaatacatgtggtcgaagaactttatacaaatttcaagctcaaaaaaaaagctcattggacccccttttatacttgataaatttcattcatattttcacgttaacttctgatgtttggggtgaaaaaatctaaagggtgtaacctaagacttttgcgctttgatgatcatgagcctccctattaatcatgttcggaatggcaatcatagtggtatccctcaacagtattattctctttacagcctgttctgaccaagcaaaaaactcaacagcagacaaaatcgtcggaggagtggaagccaatcgatatgagttcccgtaccaaatctctctccagtggaacctgggaccgaactactcccgcgccccaatccacttctgcggaggttcgctcctgaacaagaactgggtccttacggcggcgcactgtcgggttcggtacaccagacgaggctggatcgaggtagtagccgcagaacacgacaccacggtaacggatggcgacgagcagcggcgaaaggtcatcaagtataccaaccatcgaagctactgcggaggcgtctgtccgttcgacatcggactgatcctggttgacaaacccttcgagttgaaccggtttgtcaagccgatcaagctgccgaagcagttccaaaagttctctggagattgtgttgcgtccggatggggctcgacatcgaccaccgagcggcccatgtatccgaagcgattgatggtaagttgaatgcagtttccaggtgttcagttttcaaaactgtcgtttatacttcagaaggcagtgttgccgatagtggagttcaaaacgtgctacaaaaactgggtccaggaaggggatccggatgcgctgtcgaatgtgtgtgctggaccgcaagatggatcccgaagtgtatgctcgggagactccggtgggcctctggccaagttcgacgagaatggagagaacccggtgctcgttggagtggcttcgtggggaacgattccatgtggcatggaggaaaagccggctgtgtttacgaacgtagcaagctatgtggattggattaaagagaatatgagataataaagaatcgtatcacaactcctttttagccaggtgtgtcaagtagaacaatattatcacaaaaaataggcatcgctagatctttcaccacttaaaaataaagatttttagctttcatttgatgtgttccccaaaaaaaatccaccgaggaattccgaacattttttttagcttaaatttgaatgaagtatattattttcaaacatagtcatgataaaaagcagttttttttttcaagcttaatggtagcccaaatttcaaatgaaagttgatataacaaagatatataagattacatgatgtaatggacataactgttctgtatgatctatggcccaatgtcagcaaaaaatcaagtttacttaaacagcacctttgggtgccgtcatcaagcgtcgcttttactaagatgtcagcaagcgacctttaaccgagatttgtaacagctgagatcggtattctgatttaagtctgtatgtatttgattctagtgtataactgtttcttttaatgttcagaatagatgattttttttcgtctgcctggaattacatctctattgagacaaagccagcttcttagattagagttcttcggtta

SEQ ID NO: 99 - DNA, 90402 bp, Aedes aegypti
  misc_feature (44381)..(44766): n is a, c, g, or t
  misc_feature (72296)..(72683): n is a, c, g, or t
  misc_feature (77260)..(77359): n is a, c, g, or t
tgtcagtgacacatgacaggtttctctcgttacttcaaaaacaaattcgctctcgcattaatggatgcgttaccacctaacggcgcgtttgaagggaaatataattcaatttgatcttacattataatttaggcacaaaaatgttggtttaagacacattatataggtgctgcgctagtttaacgaacaacgctccatcatcgtaatcatcgtcatcattgaaatttcaaaagcagtttttctgttcaaaactaaaatttatacgatcagccatcatcacaaatgaaaacccagtgttttcgttcaaatttaaataactccttatgaaaatctgaaatttaattacatacatgaaatacaacgcaatgataaattttgctttgagcaaaaaaaaactggtttcgcaaatttgtaaatcgatgatggctactacaagcaatgttttctttttttcaattaggtaggtcgtagtcgtatttattatttttcctttgataaaaaatcttgtaaaatctcaaatctttgcacatttaagatgcatagaatctgaaaaacttggtcctcaagtttaaactaccataattttcagcttcggcggtggcgcgtgccgcagagagagcggtctattttttgccgattctgtcttggccgcgagcttcgtccgttgcgctctgtacttgtgtctgtgccgtcggtcccaacggacgtattttgggacgtattctatccgtttcgtcgtcggtttagtgcttcattccctatctgtatctttactgaactctggtgtgttgggttgttttacctcgtctggtctatcagtttgttcgtgctgctttgtatgcgccgcgttttgattcttgtccattttcgattccgctagctctgggctggattcttttttgtgcaacaacctatccctgatacctgacagtgtttgtagactgtgaatcgatgtggtgttctgaaatgttgtgttaaaaattaatgtctcacagtgtgctgatcttgttcatgagaatttataattgaaaagtgggttgctttctgtgaggaaagaggctcaagtgtccggaaacgtgatatgaccatcgttagaaggtagtgcaaaaataaacagcatgaagcgaaaatgagctgtcaaaggggaaatttcttttatcaacatagcagtcattgcttgcgtcgtcatgaagcccaaaaatgaataccaacaacagcaacagcatcatcaggtgtaaatttcgattctaatttgaactgccagtgttcttactaatccattggaaataagtgaagtcatcgtccggaaattggaaattagtttgatatttttacggccgtcaacgttggagataaaacaaggtaaatgttcttcttcttcatattcctatcattttcagggctggtagcggtcgaatagcaaaataatagtgaataaaatacccggataaaaacgcactattaagtgaatggaataaaccattgatgtgcaatataacgtattggattactgcgtatagtaattgaatgtcaaagcaaaatttttcttgtttgattatacaattcaattgttaataattgacttgtattatttttataccttataattttggcaaaatttgtattaacgtgtaaaacaactgttgtttctatttttttacagtgtagcttgactgacagaagtaaacaaaataagttcagaaagcaaaaaaatattgtgtgaaaaatatttaaaacgtagaaataagtctagaaagattcgcgaactaggcgaaactgacaaaatgtacacaattcaagaaaatatagcgttgaaattgtagcttggttgtctattcactgcatttgaacttttcccctgtcaataatttgactattcaaaaaacgcaaatttgtagaagacgcaactttacctcgtacaaaaccacacactttgttgattacgtctgtgtttttgtttatcaaagtgatgggcgcatctgaaatcgaaatcaaaacacggcgagagtaaacggcgacactgcaaacaaaaaataaacaaggcgtacatggcgggcttaattgaaaccagaatagacttatccacggtcttcttttattgtcgattttctttgtcttttccgctctaaatgcggtgtttacataaaacgacatccggaccaacatccagtaaagcaatgttcaccaaatgaacatgaagtggatgaatgtgtagcgaaatcgttcattttctgtaaacacgcagtaaaggttttcttcccgctgtaagttgcagcgtgacgtcatcgtagattagttcatgtaaacacggcgcaaaagtaataggcgacactgaaaataatatcgattacaggctcataacattgggcgatactggcgttctcaaatacgtttttggcgaaaccttgtaatattttgttagttcaaaatagctagaggaactgtagaagatgtgtgtaatattgatgagcattttaaaactaggtttatgaaatgtgtattaaagtgataaggtcaaagtttgagtgtattttctccagttgggattataaattcacatgagcatttcattgattattttctcattgttattgttttgtcagataggcccttatcgcgaatccctctcgaagtagttttgttaaaggcttctttatgggttaaaactctgttgttactgttagcaccaatattaggtaagttagggacaattcttacaaaatacaaattcttttcttttcaccaccaattgaaatactgttcgttgaattgtttatgcattgtacaacaatacacaaattgtctaacgatacttaacaactgaaagtggcggcggatatagcatcggattcagcaacccaaaatatactagagacgcatgatttgctcctagagacacgcaaaaatataatttttgttacgctgtattgtcaaataaacggtgtcctaaccaagtaaagaatctcagtggattgacaaaaaaacgattatcaacataaatcaacaaagaaagtgttaaaacagaaacagcaacaatgtgagatgaaaacaaaaatagaattaaaagaagacagataggtacgaaagagggaaggagggcgggaagagagagagagatatttttcgtaggcccgtatatcgggccaaaacctgcattttgatagcttttaagtcgcatatacggctttctagcatttaactacctgcagtaaaggtgcatatactgctaaataaatgctttgtgggcttcgtggccgtgcggtcagtgtcaccaagcatttagccgcatccagtcaaggagtgtgggttcgattcccgcttcagtccggaaaacttttcgtctggaacgtatttcgactgtgccactgggcgttgcgtgctagtccgttgtctagtgtggtgcttccttcaaaggacataatcgtccactggaagcattaacgtgtcggtgtctttttttttattaagtgcttactggttgcctgggttgtaaaaaaatataaaccttagaggctttagaattttcggttgaaaatggttaataatttactgagaaaagcaaagaaacaaatcttgcaagctattccccgttagaaaggaataacaatcgtcggtaaaaatcaaagtacagtactgtacagaataaagtaggcattggccgattttccatacaaaatggtcaagtttgaaggcttggatctcgtgaccaaatgtattttgctccaaagcgggacaaaatttcacattttagatcatgttcgcaaatactactgcgccacagtagaaaacatgtcgttaactacaaaacttaaagatacaaaacaaaattgttttaaaatttgtaaatcagaaaagccttacagttaaggccggaacaagcaagctcatggatctattatcacaaaattttcatgtgtttcctctttttgtatatgttataagcagagcaatccacagtactgcttttttcaatttaaagctaaaatttcagtttaatgacttttaaaattgttgttatgattaattgctttcttggaagacacacaataataattgaaatctaaacaaaaactccgaaacattattattacagaattcagagaaggcctcatacatcaatcctagtaaagatcagacagaattgtaagatgaatgattttcataattttctaggtagcattctcacatagtccctcaagatttacaaaggacaaatttctggtggaatactaggcctaatctcacagaatcctaagcaaaattatcacagaatattgcgagagattccatgagtgaacgtaagagaacaattgtttaaatatcagaaattgaatgttgagttttctctagaaggttttatttttcactgattaacaaccattggacaatgcgaaaatgttggttttagttattttaaagatggcacaaaaatcaagaatgactcgacaatattcctcagacttcatcattgaaacctgttgtcaaacgagtaggaaaaagcacgaatcttccgtatttttgcataaaatacacttgtatgttaaaagaattggtgggaattttgagcccaatagcttagaaggggcctccttagccgagtggttagagtccgcagctacaaagcacagttatgctgaaggtgtctgggttcgattcccgctcggtccagaatcttttcgtaatggaaatttatttgtcttccctgggcatagagcataatcgtacctgacacacgatatacgaatacgaaattcgtataaaaaatggaggagattatcaaggtttccgtaaaatgcgggacattacgcgggaagatacttttcagcgcgggacaaatgttcgcgggactgtctcgcgagaagcaggacgtctggtcactttaatctaggagaattttatacagaagtatgtgttggtatttttgtgattatttcacatgcggtgaaaatttcaggtcggagccaagatcctttgtatgaaaaacagcttatgcgtattttattctgtcagtacgggagtccagataccatggaaacatatcatacgacatttgcttcgcccaatattggtcaactggaagtgcaaacaaatctatatgaagaaacgttattgtttatagttttatgtacgatccaaaaaagttgatgaaatttgtatcaattccttaagagatagtcttactgagcgcccagtgaccatcgaatggattatgatggcctacgacttctagtgggtaatattactcaacaactgaaatgcaggagactagcgttgctttgcttagaatgtccttcggtttttcatacacaattgttacgaattttcagacagtaattttcacctgcaatcagttcagcaatttactacaaaaattagaggattacaaggtagtaaagagttccaattgataaacggattgcttcagaaatattgatacaaaagagttcctaatataatgtacaaatccacaatcaggggttgtattctgaggagagtaggtatctctcacttatcgctctcttgtaacaatcatgatccgcaacatatcataagagtgtgttaatcgtctactgcttcaactctgattatatcgattatcggttttattatatgattaaattatgtgagaacgacttacggattgtattgcagaaaacggtttagatggagctcctgacaaaatccagaaaccctggttaaagtttaagtaagtaatgtgtggtgattcagtggtgatatctttgagtgactttagtgacaatttttctgaaaaaaaatactaataaatttttgttgcaaatagtgacttctcagttaccaaatcgaaaatagtgactaagccactaaaaggtgactcgctaccagccctgcgtgtttttttctttttcaatgagtgggggagtacaatgctcgcaaactatgcggcatgggcgggggagtcaggtggaagtagatttaaatcaatcttcgatgcatataataatattcaaacgccgaataaggcgaaatagccgtaccgaagtctgttataattgattcaacagttccaggcagtcacggcaacgatgacgacggcaaacggtttaaggtgcgagcgatcgatcgaccaggtcgtgtgcacgagaactcaaaactttgattctgttagctggattgctttttttttcgagcttagtttggttggaagctgtggaggtcgaccacttccgttcgctcgcctctcggtgacttcgttgtactggaattattgtgctgatcgctctcgatctgagacatcaaattcgagctggaacagcagttcacttggatgggtgcaattggaaagtttagtaggcaaaataaaacgaaaaaggaatctatatacagtcaaacttctatgagtcgatattggagggaccattgactcatagaaacatcaaattaagggatcatcatagtaaccatgaaatttaaatttttgtatggtttcatgagtcgatatcgagtcatgaagcatcggctcatgaaggtttggctgtaaataaaaatggaatgatgtcaatagttggcttacgaactggtcaataaattttaatagtttctttcaccattcgttcagaacttttacggtttggttaaagagaaagttaaggaaagtttccagactattcgaaaaacgagaggaaactaatctatcattttgtatgcgaaattactctctcgtcatcgtttgaatagaaaaaaaaatgtttagagaaaattgtgtgtggaaaggaaaacctttccggtaaaataatagtacttcatagttaacaaataacctttgtggtacactgcataactgtttcattgaataaaattttgattttcacaaacactaaatgagtgaggaatgatgaatgtgaagtgcatcataaataattggcgtttccttaacttattaacatatttactcttatttgccgaaagtttttcatcacaagctaattgttttaactaatgaagtcttttggtagtcgatttaaagcgatttgttatagtccaaaggtattgttggccaaaacctacgtagttgtgctgttttatagtctaaatatatttcaaacggtgtgccttccttagccgagtggttagagtccgcggctacgaagcaaagccatgctgaagatgtctgggttcaactcctggttggaatcgtaatcgtaatcgtaatcgtaatcgtaatggaaattcccttgacttccataagcatagagtatcattgtgcttgtacacgatatacgaatgtgaaaatggcaaccttggcaaagaaagctttcagttaataactgtggaagtgctcataagaacactaagctgagaagcaggctctgtcccagtgaggacgtaatgccaagaagaagaagatatttcaaacggttgtattggctatatatagtcaactctccgttactcgatattgaagggaacatcgagtaatagaccacgaaaccagtgcaaatgcgatccaagggactatcaaggtagtcatgaaaatcaacttttactatgatcgagtttctgtaccattgagatatggaaaatcgcgtaaggcagagctgactgtaataaaatcaaactagtttaattatctttgttatatagaataacctatacactactaatataagtgcatctggagagttttccattcgttgtgagtgactaaggtgaacaaaaagggctgaaaagccaatgaaacaacaaaaaatatagatgtttccagtatggatcacattataaggctgtctttgtcctatcgataaaggtacgcatgttagccactgcgataaaacgcattttgaaaataaaaattgaatccggacaacatagcattgaggaaatgcatattaagggttcattcacaaatttcataatgctaaaaatgaccgttctcgggacccacccaccccctcgttactcattttgtacgatttttttttaaattttgtatgatctgtaacatcctgaggacacccaaccacccccttcagcgttatgaaatttgtgaatgggcccttagatatgctaaaaacttcagcatttcagcgaaaattaaaaatctgagtgagtagttttccttcctacaaaattcccttaaaataaccgcaaaagttctccgtggatttcttcaggaatctcacaagtttttttttctatggccattctcccaagtattctctacggaaattccccaaggacttcgtcagaatttctgcaggtagtccaacagaaatgcttccagagataccttcagaactatcaaatctcaataataaagaataaacttcagaaattcctgctggtgtcactcaagaaattttccagaaaaagtttcagaagttcttctagcgatacatcggaataccttatggttaaggcgcaaatatttgtgtcttcctcgatatggctttgggaccagtgtgcactgttttttcatacaaatttgggtactttatgttgaaaaattcgtaactcttttacaagatttttaacattttttatgtcttctacaaagttgttacacatcttaaaacgcgtgtttttgctgaacatcgcacctctctatttcttaaagtaaaagaattatcagtcgaattcgttttaataaggcttatttgtttgatagtaaaaacccatgcaaatacgcttatagacaaaagtttttatcaattgccgaaaggggagatatggtactttcatgatttgtaagagttttcttcgccattttgcgccgaagccagttatagaggccttaactaccccttgaaaaaagagtaattcatgcaaaactttgttacttcaaaagatagggtgatgatatgttcagcaaaaacacggggttttccatgacaaacaactttgtagaaagcacaaaaaatgtaaaaaatcttggaaaaaagttatgataaaaaacatggtttttaggggccattcacatacaacggcatatatctcaaaaagtataagagatagaaaaattgtgtcttcgacaaagttgtttcaaattgtcaattctacaactttgccaaaaacaccatatgtctatctaaatattttgaaaaaaaaaaatagtttttcagattgatcacaaacttttttcgtcaaaagttgcgctttaatataccaagaaacttctcccaacaaactatatcgctaacatcaacggtttgggcgctattcaaaaagcgcatgaaatcgaaaaaataaaacacagtgcggtgttccctcaccgaatcatccgaagtttctctaggattttttttaggaattatttcggaattaccccagaagttcctctaaaaattcctccaggaattctttcaaaatttttgccttgaattcctttggattttctccattgaacttctttcggaattcccccaaaaatttctccagaattcctccagtttctctaaaaaatattccgcagttcttcctgcaaatccttcgatcgaatttatttggaggtccttcaagaattccttcagagttcctccgggaagtccttcagattttgttcatgattcttccagcaattctttgggagttcctccaagaattccggggttacttcaggagtttcactgataattccttcagatttcatccgggaaatcttccagaattaatctgggagttcctccaggaattccctcgcagttcccccagcaattcctccgaagatcctctggaggtctaccggaagtttgtcagcagttctttctgaaaagtctctggagctccgccgataattcctttgaagtttatccaggtacttcttcggagttgtttcttgccataaactaaacgattctgttggttctttccactatttgtttgtttttatcgatcacattcgacatggatgcttacattttcttttggtctaaactgattcgaaacatgatacaaataatcattatacagaacaaggctattttgtggacgaaacatattgaaacttaatagtgttgatgtaaaacataaaaaacgcaaaatgtatccgtattaaacatgttcacgcaattattaatctatttatccggaaaacttcagcgctctgctagaagctaagcgatgctctaaaaaaaagagcaattgttgaatgtcaatttgtttttggtagaatactatttttccactagcaggggttgaattcagataaattgagaattgaaagtatctctcgcttatcgctctctgtaacaatcatgatccgcaacacatcactgctacagttctgattgtatggggagatcacagtgcatgatgaatcccatctatgctccaaacctaggatcaaggggtggatcacttctgatgcatctgatattccgagaaaatttgatgcattcaaatgcatttaaatgtacacttctagcaaatttgcaaatcatggcttactcaaacgtttgtctttgtcaaagtgtcaaacttgtcatttcacaaacttgagacgattgctacctcatctaaaacatgttgaatacttagataacgatgttccaaaccttttcgtggacagttaacccttagaacatattgaactagggagcgagtgtctaaggtgatatgcaaactacttttacccttttagactaatttccagtatttctttcgttagcgcagatgctttgtttcagagtcattagccatgttttttgggtttgtcatcctctcgggattactgtaggtacgaaattggacaaggaagatttctgtaacaagatgaagcttaagatagtcaccgtgattgtgggctgtctgcgtgctcaaagaggaagaataattgtccagaacagtggaatgagttctcttggttcaagagttttcgttatcaggttaaaaagtaacacccttcatagacagtgacaatttcagtgatcctagttgttgtttgagagggactttaacccgaaggtcattcgtccctttaaaaccttgtgatagataggctcgtgcgcactcccctcgtctatcgacgccttagtgatcctagttctaatcactattggcccattctagtgactctgaagtctggagaccttgaaggctggccagtatcgtcatctggatgaccatacactgacagtagtacaataactgcgttacatatacttgacaagttcaaggcatggctcgatccggagagattactaccggtatagaaaataaaataagttatatatttggtcaaaaaaatctatattttagtcttggtctttctgatacacctgaatgtgagatcaacaacccgatccgcccaatcgaataaaggtgttggtagttcattgagataaatccggcccacctccagtaagccgcattactgaaaacgggtttaccacaaaagagtttctaacaactcctgctccatttctttatacacgcaggagaagacttgtaattagaatacttcttatgcaatgcctcaaagatccgataaaatacttgctcaattaactgaaataaataattattagcaatggatcatcataatgaagaacaaaccttttgaaacatgcacaacaaacaaatacgtgttgctatagaatacttcgttgataaggtggtgttgctaacaccactgctaagttgatgcgaatgtctaaaaactgcatttgatgcaaatgaatgcttttgatgctcattgagcaagtgatacaccccttgcctaggaggcattatgtaccaatgcacgagttctcgaatttgacgcttgagcggtgccgaattcactcgttgctatggacctatgcacgggttcactatttgacgttttagcagtgccgtgttatttacgtgaccatggaaactagtgaattcggcaccgctctaacgtcagatagtcaactcgtgcatcggtccattgctattgaatttcggggaatgattataatgccagtaggataaagcacctaccccccaatggtaaataagtgagaaaatgaattttttgcaattccgttgcaaatcagcctactttttatcgaggaaatggacaacataacggcctacttttcctaccgaaagaaacagtgctgaaaagtgctacttttcagcactaatattagtatcgaaaagtagcacttttcagtactgttttggaagttatcaaaatgacgtcggattgcatccatacgttattcattcaattgtttgaaatttctcaatgacttagtcaactaggtactgattctacttccgtttgacgaaccgaattgacttggattcgaatcgtaaattcggatgtagaagcagaagttagttgaatgtgaaggattctgagtttaaaaatgttcactacaaaaaagacggaagctttatggggcgattagcgttcacgtagacaattcagcacctgaatgacttataatatggctgaaaattgtataaaggttctgattctctgacgattcgaattgagccgggtttggattgtgcaacggatattgaatcggaagccagttggctgtgaggtattctatgttggagcacgatcgtcttgcggacctagtggaggcagtagaaattgttggttcattctcaagaatgtcgggagctttatgcggcggatcgtgtaggcaatccagctcatgaaaaaatagctttcatattattagaaaattgtaagtggcgtcttacctgatcagcctgaaaatagagtcagcaacggaaatgtgaaaatttgtgacagacatttcacagcctatctgattgagaaatattgagttgttactacgcattgatgctcatgtgggtgttcttgaaacatgtttatgctccaagaataaatccatctgtaacggcagttttcgtaatagcaaaaaatgttgtatgcaactcgttgcaaaacgcgattttttcagcactcgtcgtatttatccaactcggcaagcctcgttggataaatgtacaactcgtgctgaaaaaatcatcattttgcaccttgttgcataaataactattatcatcgctctctctttggggctctcttttgctgctgttatttatcaagcttgttacaacttgcaatcagcttcgaaacctttgaaatcaattgagaacgaattatccaatgtctgtccactatttagtgggtttatgttttgtcgaccttttctgcaaaacttttcatgttcatgctttcctgctaattcttttttgcttctgttagggtacgttacggtttagtgagtaagttaaaaccatgaagtagaaccctaagacgaaaggtgatcgtgccgaacgaaatctcccagcatctttctaaagcacttatcttttacataccacgggaaccacctaatgcaagtagtagaagcttccaagaagcaagtcatttacgtgatattgacgaagtttccactatacgaaaacgtttcgatacttataccaacgacaacacgaacacgtcgatgtaagttcaaagcagtagtgagtagacgtgacgctttcttcacgatttacaaccttttcccgtttcattcatagaaactacactaaaacgtgcccaaacttgacatcgcattgcacgaggggcctgtgccaaattgaataacactaattagccagttttttttttcgctgaggatgaatacgttcgtcatcaaaggtaagcatcatattacatacaaaagcagctttgaaacaactgctatccgtagggaatcgtatgtcaattgctgccatgtttctggaaccagaagagagaaatatacgtattgtgtaggcttccgtgttaaacctctctattgacaacggatttttaatcctttaacttttttatttggtaattctaaagaaaaaaggagctctaacagccgtagcagtaaacatgcagctatttatcaagaccatgctgaggattgcaagttcgaatcttgccggtctaggaacttttcgtaatggaaatttgcataaaaacgatcaattggcgaggaaaactttcagtttgttaccgtaagtgctcataagaaaactgacaagcaggcactgcacaagttgggaagtaacgccagaaagatgaagaagaaatgacatggtggagtgttttacttagtaatttaagattacaaaatttaaaacatctttctaatgtgtttaccgagatgtcaacatgagtagtcatagctgaaagtttgttagcgtgcaagtatctgaaaagacaaagagcaacgttgacacatgttcaattctggggatcatataacgaaatccgaaccagtatgccgcatactacgctctatttgggttgtaattgtcggattaattcactgccagatcccggtaacggtactattcttagccaggccgtaaactttgcgccgcacagtcaaataaaattaaatagccatcataagcccaaacccaacccggagtcgcgaatggtgatgcacagtgaagtcaacccggataacaaacaaatgacaaattttgatattaatttgtttaattgaaaaaagagttaaaataacaaaaaaaataatagctcagtttgtatggcacaaaaatttaagaatgacttcttttccattacaatgacaaaccaataacaaaaatttagactaaaggacacaacagaataggatatcattgagatatcgatgacaaaataaaaaaataagttcttcatgtatggagctagacaggagggtagtgtaagcagtaaaatatctcattcttcataattttgttattcacctttacccgggaggtgactaacaacgaaaggaacaaaagaagcggtttcatagtgggcttacagttaccgacaacggttaccggcgttgaaggccgtttcgtctttcttcaatttctttcagacacctcaactctagcagttgtcccatgtgctggtgctggttgaatgaactgcatcaggaacgcttcctgcttcctcaatcgagcagctcacttctaaatgtgcatctcagcccgcacatctcggcacgagcatgatctattgtcacgacttgaaactcctctcgagtctcggagtcttgagaatctttatttttaaacccatttcaaatgacacagtttgcatcgccaccgccaccgactgcgaatggataaagacgggtggccccaaaggcagcgtgggtaattccggaggaaggctcggtaggtaagctccggcccgctgcgctcctcccaaattcattggccaaatacttgcgtcttgggtcgttacggtactgcaccagccaggcaacaaaaacacacggtgcttctcagaccgttattatcatcctaaaaattctttgaaaatatggtataatattggccccaaaatgctaccttgaggaacactagctcttacaggaagtctttcagaataggagctctgagaattaacctgaagtgcacgatttgacagataaatttggattattctaacaatgtatgttggaaaattaaagcatttaagcattaaagcaacgttcatgccaaacactgtcgaatgcttttttatatgtctagaaaagcaagaccagtagaatagccttcagatttgttggaacggatcaaatttgttacacgtaaaagttgatgagtggtcgaatgtccatggcgaaatccgaactgttcaaagtcaccaatgacaaaacattttgacttattgcgagtcaattttcgcaattcagtttggagcaaattgacctactgtcaagagcattgaaaaggcaaataggcagctatgaaagtatatttagcaagctgtgtttcaactgaaatacctaaagtttcaaaaactttagtttcaaatgacggaaacagttgatgttttatacgcctatgaatgatgattgcaactcccccacatgccccatcaagtcgatcattacgataaacaaaaaagttaggatcttttaaaagttttgatctaggttttaaataggtttcagtaataactgctttatgcacgttattagctgtaagaaaattaaacagctcgtcatttttaccattcaaggaacaagcataccaatttaaaatatttaaattattatttataggatccattagaaaaacgtaatccaataacaatttgattagtaaattttgcacctacttgggctgcttcagtcatagtagtggctttgaatattgcatcaatcattagattcaattgttcagttagaaaattaaaatcaaaggcggacatatcacttgaagtgggtacattatctgatgatttcccgttagaattgtcggtagacgaagaggctgagtggaaggttcctgtggcaacagggttttttctatttgatttgaattaattggcatggttactcatagtatgaaaagggaaggagttcaaattacctgctacaatatcggcaaaggattttccttgggtagatacattcgaaattacaagattcgaacggctacccgacggattaaaattagtttttgaatgagtatgattataatcttcctggtgggtatgattcttaatcaagcgatcgttaactgaaaaatgagcattgttcgatactctaccagggaaattccggaaacgaccgttatcgtaacggacattatctttcatctacctggcacgagccttgacgactcgcctacgcaaagggcaagcccaaaaatttaacctatgattgccccctaaatttgcgcatatgaacttttcggtatcttccttcattagacagatgtccttagcgtgagaagcatgcatttagcatccatgcggcaattttttgtaccataaccccacttttggcaccgacggcactgtgtgggattctgctaaattcctccaggtttctggaaatgttcccatgtcacacggacatcgaacataaatctagctttttctaaagcttcaatattagttagatcttttttgttaaggtgaactaaataatattcttgagaaagccctttccgaacaatgccagattgggttctcctcttcataatgattaattggactgggaaaaatccaagtaaatcatttattccattttagatttcttcaggtgacttatagtcacttgagtgacatttaaatacgactttgaacaaacgttcagttctgtcgtcataagtaaaaaaatgtgcttctcctcttcaagatgtttgagaagaagttcgcggtcttcaagagtttctggcaaaacgcgacagtctcctttctttgcgatttggaaggagaccttgatactcctaatggagttcaagatctcctgcctaattcccccgaattcggaacaactgaccacgataggcggcactctttgctttctcatttgaatcgaagagactgcttcgatttggtgttcagaaaatttgtctagagcatcgaactgattgctcatttcgatgcagttatcaacattacccatttcacccttggaagaaagttcgaattccggagaaacgtcctctcttccattcttgccacgtttagtgacagttttaaatcccacttttttagaaggaagttgtgaattcagagattcacccttccttttgtttgtagttgcaaccatgtttagtgaataaacgaaagaagacgtgaccttctagaggttttttttcccaagacggtgtccaagaaggattaccaccgctagctttcgccaaagggtccaaacaaggatcgtaaaaggatcaggtagtaggtaactgaaaagtaccgtttttaattttagcattgaaaagtactgtttttgtagcactgaaaagtgcagtgaaaattcgtgtacgcacagcacgaaggtacgatgcgcactgtgctgccaagtgcattgaaaaagcaaataggctgctatgaaagtatatttaccaagctatgaatgatgatagcatcttcccaacatgcttcatccagtcaataattacgataaacaaaaaaagtttggaacttttttgacttgagatttaggtttcaaatgagtttcagttataactgctatatgtaataccacacatacagctgttagaaaatcagacagctcgtcctctttatctttcaaagtacgagcattccagttcaaaatatataaaacattattaaacaattgttcagttaaaaaatcaaaatcagaggcagacatttcactagaagtaagtatatcttctgattattttctattggaatttttccgttgatagagagaaagaatagaagtaacacgtatcttcaaaacgtgttccgttttttttttcagaaacgaagctactggggagcaccgtgccaacaactacagcaaccgccacatgcttaagacgaagacaacaagaacggttgaaattacgcatgggaaggtcgttcgtttgttggctccactatttcattttatcgtcaccatcattgtcgagtcgcacctcacggctgcgtagagctctatcaatcatgcacatccaaatgagtaggtaatcgtgcgtcgtcatctccgccgcagaaaaagacgcttcgaaactggtggtcgctgtcgtcgtaccgtttagcaaattgtgtaaaaccgctttcgggagattactggtgtagaacttgtaaacgagcgcaaacaaatgatgtcacttggtcttaagtgtattccgatggttcatgccgggtccgatttagcgaggaatgcgaattttagcatacaatgaaacgctagcctatggtgaaaaacttcccaaaaactatagtattgcactgttataaatgaaagaatgcgaggaaacagagaatctctcattggttcacaggtgctttagtaaaattcagctagaaaaattgttttatgtggtgaacccctacagaacaaaacattttgaatcactttttggtatgaaacttatttagattgaaaataaacataacattattcaacaatcaatttgtcctgatcagcgctctaaatgtggattatgttctatttttcagagagacacactcagctcctggataaagtgacgtactgtacacctcggtaagttgttgaatggattccaaagaagttttgttgaaaaaaatcaatgtgctgcaaataaaaaggcaaagttatcaggtttcaaacttctcaccattaggggcgcgtatcgttctcactaccatctgcaggttttgttgcacatacgcgtatttcgtgaattacagttacataaaaagagaaacctcaaagtttgagccaaaatgattgaggtggcgcaagtgacttgatggcgaattttcaagttttaaattatgactttcagtgaaatcttcataactttgttattttccaaacagttttgaagctcttagcatcattttctttaagattaaatgatgaaaaaatatatgtagaatatcaaatttatatgtggataatatatataactggtgttctcggccaacttcgtcttgccatcaagtaggctgttgaaaaacgcaacggatagtcccatacaaaatgctcgtttttccgactttcccggtgaatatcttgggatttttatacacacaaacccttgatgaacaaaacgaagaaagatcaattcagatccgttgagccatttcgtggcatacaaacacgtatatacaaacaaaacgtatattttaaattatttagataatcaaaaatagtctcaattaaaagtagttttctaccctttttttctttttactataaacttcatctttattgaccatgccttcacgaatactttaatgattcaaaatcgtttttacatgcttttgaacttttgactattgacagaaattcgaactttgccttaagaacaagcttttgatcttctaataaattttcaggctgtttcaggccatgttataagctgtacaaatatggaatacctgttgtagctccagaaaaaaaagctctgaaaatgattctgaagctccttacctggtatagtactaatgagttacgtagaatatcaaatgtttcaacatgggatcaaatatcgaataaaattattaataattttagacacaaatcgttgcaatcctctattgttacgataaatgcagcttttgaataaaaacaacatctacaacgccttaaggcataggccaattgaagttgtctcggattcaagtcaacgcccaatagtagccttgaacttataccgcatcatcggactgctcgagtctgctattcatctaactcacaaagcagtatttgggtatacagggctggttgcgactgagtgtcttaaaaataggaacttttaagacctcatgcttaaaaatgaaaccgagttgaaaccaacaagagactgataaggaaataaatagagaccatacttacttgatacttgatgggctacaatccgctacgttgaatctacgccgaatggataattcttctccactgggctcggtcttgagccgatcgcttccagtcgccctgatcgttaagtgcccttaagtcctcttcaactgcaaaaagccaacgtgtgcgcgccctaccacgaacccgacggcctcgtccgggttctctattgaatattatttttgcttgtcgttcttccggcattcgtaccacgtgacgagccaaacgcagcctgccgtgttttatgagcttgataatatccacttctttatatacttggtacaactcatgattcatgcgacgccgccagatgccattttcttgtttaccgccgagtattgttcgcagcactttacgctaaaaaactccaaacgctttccggtcgacctcttttaacgtccaggattcatggccgtatagagcaaccggaaggataagtgtcctagtgcgaattttgttttcgtctgcaggctacgggacttaagctggttacggagcccgtaaaaagccctattcgcagctgcaagacgccttttcacctcgcgggtaacatcactaccaacgtcacgattggaaccacgctgtctaccagcgataatgtatatagttttgctggtgttgacggtaagtccaatcctcgctgtctcccttttaaaaagcacaaatgcctcttctacggctcgacgatcaattccgattatatggatatcgtctgcaaaacccaggagcatatgcgactgggtgacgatggtaccgcttctttgcacgcccactctccttatagctccttcgagagcaatgttgaacaaaaggttcgaaagcgcatctccttgcttcaatccatctaaggttacgaaagaagttgaagtctcatccgcaacccgcacacttgatttcgacccatccaacgttgcacgaatcagtctaatcagtttcgccggaaaaccgtgttctaccattatctgccctaactcatttctctttactgaatagcagtcttcaaggatcatcattgctgcacagattttttgaaaagcatgctttgaaaatatcaatgcttcgcgtaggattcgcgccttttcaattcaattgctcctgtgctcacttgatcaaaaataatgcatcattgattcaaatcatttcaaactccatactctagacagaccatagccagcataggaaaaaatcgcttgtagaataacggttttcagctgaagttggctgggttcaagcatcctgtcgatttccttgacgtcctgggcatagaatatctcccatagattatcacccttattcatgtttacggcgtatcgaatcttattcgttcgaatccatgtcgcatctgattttgctggcgtaaacggggatgcaaaatgatgttcgatcaaaagtatacctgggtgaaaactaataatttcttttagtaccagaaatcgtttaaatatatgctatatctgcgaaaaaaaagtttggttcaaaatgtaaaagtcatatgttaaaaacgttaatggccaaacttgaccatccgggcataatggaatttgtttatcgggttaaatggacttaaaaagaggaacttttcatgcgttttttaattgagtgtgagaaaagaggcgcgtattatatataaaaacatttcatttggtagatttttttcagacattccaagaacacttttattaccacaaaacataggataaaatattgtgaagtaatgcataatgagtgttgaagatcagggtccgtataatattgccttgttctgaacggtgcaataaaagttgggctccgtgaaatgattcatgcctcccacagcgctacagaggtggtgttcctgttcgatcatgacgccaatgccataagcatgcatatttgataaaatatcgtagaaaaaacaacggaaactgattgtgaaaactgtaataaaaagatgattacattaacgtttatatagaatacatgagcaaattcaactgatactcaataacaagtgcgtagagcagcaaccatacatgacttgaattctgaataataactctgttcacacaacatcgtgtaccattttgataaatattatcacttgttagccattgacgcgcacttcgtgaattcgcgatgaaaagaaaacagtgtgcgttgctaggcctaccagcaatgcttgttatccctctgcagcttagtctaccttgttgaatgagtcacaaatgattcagaaaaatgatgcagtattttcaccgaaatgataggatcaaatcaaagccttgttggattgaaaaataaggatcgtgcattctctttctcgttgttttatgaatcaaaacaacgcaaagcaaaggcaaatttgaagactgctgaatagtacgccgccttgaaatcaatgaacagatgatgagtctgcaagttgtactcccggaatttatttaggatttgacgcagggtaaacatttgatccgtcgttgatcggccctctcgaaaaccagctaggtattcgccgacaaaggactcctcatacggtctctctgttcaacagaattccagacatgattttgtacgccgcattaaggagtgttatccctcggtaattggaccaaagctacacaatttaaatacaattatatgctcctcaaacgtctagcccatgtggatagataatcaaggtaattttgctatggtatttattgtgtatttctttcactactggactgcgaagtgcggcttcataagtgcgaaaatgcgaataaaattgcgagattggtgtcttcagagcacttattctttggactgcgctgaataaccccgctgaagacaccgactcgatttggtgcaatcgcgcacttttattagcgttcccgcacttgtaaaaacttctgcgatagtctagtggtgaaagaaaggcgcaatacaagattttcactcaagggtaatttatacagactatagcatcatccgcaagttgtctaagcgtgcatagttcttccaaactgttgtcaatatctgcaacattaaaattataaaacaagggacttacaaataggaagcttcaaatggctaattctggaagttgttagttgaccgagagtgtaaatcatgtgcttttctgaaagcaattgctcgttgtccgaaagaaactagtagaatatcttattgaagcaacgctagacaagcgtttgtctcttcaaagtcacaaaaatcaaaactagtgtttaaaatcatattgttcaatcctgtcgcgataggattatttatttttcttacaaaaaggtaaacaataagaaaatttgtacacaataaaattaaatattgaatcgatttgtttattgtttcaataacgactgtcgttcaagttcattaaatggaaatattgtcattcgattctcgatgatccatatagtcttgatttcaactggaacattttaattatggacttgatagagattcagtcaaaattcaatctcgtcatttactatgaacgactttatacatatatttggtacagaatattttatatgcaacattgatcaaaaagctcatttggtaccaaaacccctgttaagagatctgacccggcccgacacttaaatccgacactgtgcaccggagtgtactacttcatgcatttttttaatatcatcagcaaccaaaaacatataaacccaaagtttctttaaggtaatattcagaagatttcttaagaaattcacgtattgactgtttaacggccttcttatgaaaatcctccataaatttcgttcaaaatacctcgacgagttcaacgtggataattatttaactccagaaactacttcagagattccagcttaacttttcgaggaattcctccaaggattctttcacaaattaagaactaagaaaattaagaaagtcttctaggaatgcatgaagttaattttcaatcgattccgctaggattttgtccaagacaccatccaggacatcttcgacaattcaactagtaatttctgcagcaatactttcactgatttcttaagattttctctaaaattgtcgttccgaagaagcttgtaggaattcccaatgaactatttaaaaaatctctgaaagaactccatgattcctgaggaagtcatggtgaattttgttgataaattgctaaaatatttgagtattgaaatacccgatcgccgtctttcttgtttacggcggatccaactttcaaccgaatcctattcgttcgaatctacgaccctcttgattttggtggcgtgaacgggaatgcaaaacggttttcgattcgaaggagcagaacactcgaacataaacaagaatatggttattctcccatcgaatcccccggataataatgtatgattttctgaaaacaaactccagaaaaacatctaatgcaatccaggaaggaacttgtacagaaataatcgaaataaatgctgtagtatttgctggtgtaaatcttttatgaaatctggatgaaatcacggagaaaaattactcaagagatgtttggatgaactgcaggaataatttgcggaagttgatggattcatgaaggaatccatatgaagatgattggaagaagaactgaaaatagtcgacgtaggactcattgaagatttccagagtaatttctgtagaaattattggaggtacatacttaaacggagtcgccgcgaacccaacagcttatatctcggcaataatttgacgattatcggtaaaacttttaccgagatctcggtaacgttcgctgagatctcggtaaactaagtaccgagattcggcatagaaaattgccgaattctcagctgttgggttctcggcgaaacgttttactgaggtcggtgaaataatttaagtgtgtagtctcgttggatttccaacagtgaaataatgagtaacgttattagttattcctctaaatcgctgaacgaatttcttcttggttttacatcctcactgcgacagagcctgcttctcagcttagtgttcaatgagcatttaaacagttatgacctgagagctttctttgccaaggttgccattttcgcattcatatatcatgtggcaggtacgatgatattctatacccagggaagtcaaggaaatttccattacgaaaagatcctggaccgaccggaaatcgaacccaaacaacttcagcatggctttgctttatagactcaaattataaccactcggataaggaaggcgcatattggtcgaggaatctgataaggaatacctggagtctctgaaggattctctggaatctctagaatcatctataatcactagaatccactgcaaggagaaagaagaataatgagtttagacatcattttggttaaaaaagagactttgaagacctttgatttaaaacagacaccaagtctctagaaaaagattttccaccagccctgtatgtaggatttatggcgaactgaaaaaaaaaacgatgagacgccatgaaaggacaataaactctgtaccgaatttaaaaaaaaagaagccgttgaataatcacggaatgaaacgaatcaaaacagaacgcaatttggaacttgttccagttctgtgacatttaatatttaatgtgtgtctccaaattcattattgaaatcaggtgattatgatattatcattcaggaaaacccacgtaataattcttcagtggcaaaatctgcacaccatagagtcactccccccatggggccccaccgtaatttccagcgatcagcaccggtaaactaattaaatcgctcactcagtccagccgggcagaaactcgaaaacaattaccgtcagtcaccaaagctagttgccgccattcggatcggtcccgatatggacgaacaaatagtctgaagaaaaaaacacgaaatccgttacacagtaatgaccgttcgaaacacaattcgggttccatggggttaccaaaacaaaactaagctagactcaaaaaaataaaaatctacaaaggcggagatccgttccggatccttcaatttggggtaatttcacgttcaagttttttttgtctgctacttggcatgctaaatgaacccacccgcgtctccctggcgtctgttggggcctcagttaggtcggcttacatgggcgtagctaagggggaacaggggggtcactataccgctgtatttaaaaaatatcattatatccacgaaaattgattgaattctaacgactcactgtgatatagtaaggggtcagaaaatatcacttcaatgttattataaaatgtttaagaataatattaagatctacggacatccccatccattcctacagcatgatgaaatatgttccctaataaatatgaaccgtatcagtactgtttcccatagcttcctaaaccatttccaacagtatctgaaccatttcgaataatttgctaaattacaatatatcacccctacgttaaacggttttcacaattcggcaaacagtaaataggaaaataacaatgtggggaataggcggttaagttatgtaaccattcagaatcgtcgattttctcgaacaaaatttttgatcgacaatttttcaaacggtagctttattatccattttttgctaaattcatcatatgacaaacagttgaagaacagttcaaccatatatttattagaaaaacaaataacgtatgtgtaattattaggttacggttctttaacgtatttttgcactatactgtattgtcatgttgggattatattataagaactgaatatgcgaatcaaattgaataaataagagaaaaatgaaacaaggaagtatgtgaacacactttttccttgtttcaatgtttcttatataaggtacaattaaaacacacaaggttaaatttgattattcccattctcttcccacagctggtttctagttggatttttcagaacctgtattatgactacgattttcttcatttttcttctcatttgagcaatttaaataaataatttatttacacactctaatatgagtccacttcatactgtaccattatattttctactgctgtacacttatacaccattcactatccatcggttgattagtggttaatctggaacatcggaggcttccgagtaatcttcttttctttcgccggcatcccaacggatgccgcacttcgccactcgaaaacatctactactggacgccacccgccgagaatgtggtcggtattgaaacatacgggacattacgggaaaatcctagtggcgcttctggatcgacattcaacaggaggaaagtttgaaggcgtgccgtcacgttcgacacaggaggaatttcaggaatcatccgcttttgacttcagggatcatccgggtgtgcttcgaggtgctgctggaatatttccgttaactggactgcttcgtgcatctgtctaaagcgaacttaacttgtttaacttccactgggcttttgaatctatttcactttggcaccgaaaacaaaacaaaaataaactcacggaaacattacacgctcaaaaagcttcacacagcggttgcaatttcacaaataagtgaaaaaataaatattcctctatccattaaaaaagtgagatttttgcaaatttttattgctgcgctcaggttgtttagctcttttggttaagatgtacagaaaagcatttttttattaccagtgtgaacccctaaaatcaagaacatttatttagagttattatgaaacgaagataatttgtaaatctatatcgttcacaaataccaaaaaaatgtaattattcgccaaatttttaagcattggtaaaataaagtaaaatgtacatgtgttagtgtgctgcacaaattcaaacaaaaccaatttcccaaatggtggcgaaatatttccaccatttcttttagaatggcatctccaaattgttgaacggattctgaacagtatggtattctgttactgtttggtatgggttgcttaaacagtttcaaataataaagtgttttgagatccatgttgtattacatcaaaataactgtttgtggtacattaaccatttcagatagaagaagtttactgtttttaatataagacaagctgttttttgctatgcgggttgatttcccttaaggctcaagaatccatcattcaatcatcagcaatcattaaatattaaaaaccagttttttcctccaaatttaaagcaatcctcatgataatctatcattgcattacggatagtaagtgcaatacaatgatagattttcatgaacagtgctttagttttgagcaaaaaaactggttttaaagatttgtaaaacgatgatggttattttcctcttaaaatgcattggtcccattaaaatacaacccaaacgtataagcacaactccttttgatcgtttctcacagtgcagcgaaaacaatatttcacaccacaatcaaaggaaccgttttacgccgaacatcacgcacacattgaagcgctcaaatattttactctcaatccggattccggaagattctttgtttgcgttctcattcatctgcgatcgttgggagatttttttttaatttcgtgaatgaacgtgccataaatccttttgttcttttgacttttactgagcgccgtgtgttggtgctgtcttgctctctctcacgggcaacttgaaaacagcgcgcacagtaaaagtcagacgttttatagcatgcagaggctcattatagaagtttgacgacgtgggattcgaataaaatccttcagtgaagatgtacgaagtttacgatagtgtaaataagtgcccggtgaagtaagtcacacagaggggcgggaagaaatatgaatcgtaatgtggcatggctcagtcgatcaccgatcagattttgctcggtacgtcttcgtcgatgcgatatcgatgaaaacgatgaaaaaatacaaagtggattattgaactgaagttgtttatcgaaatacggtagttttattgcatttttgttaaacaagcggaggatccataacagctttcacaagcatacacttgaagaattaatcagtattgtgggtcaatataattagaaattgactgaaaagtaaccttactataaaatatttgcaagcaaagacactcataagataaaatgaacaacaagctctatcaaactcaggcttcttcctggccaacgtctggatacttaacgctacgcaaatccttagtaccgaaaatactcgaatttctgagaaataaaagataaaaattgatcatagattttcttgacggattcgcacccaaatttctgcatgaattgctctataaattcttcagtaatgattagtacagaaatggctccaaggatacctatcgaaattgctcatagattattcataaaattcgtgttcagatttcttgataattcaaccatgtatttcaacatttatttctttttgagtacctacaaagttttctgagtcgattactacgattcatacagacaattcttaaaagattttttttaaataaatttttcaaaaatttatttctaaatttcattagctttttttccaatgaaatattaaatctttggtggatcgagaaattaccaaaaatatgacttcaaaatttaaccctacaattaatttctttgaaagctctataaaacattctgaaagagtaaagaatacaataggattaaagaattctttagatgctagataaatctatgaaaaaaaaacatggaaaaactttcaaaataattaaataaatgtgtagagacatatttcaaagaaatttctgagttgctcaaaaataataagctcaagattatcttaaggtgaagatgaatcaccaaatttgaaccaacctcaaattttcaagatcacaaatcttgagaaccaaacatccggttaagctgaaaacttaatcgattggtcactagctggtgttgaccaattgattaagttttcagctcaaacgggtgttcggttctccagatttgtgctcttgaaaatttcaattttggcttcgattcatcttcaccttaagtatgcccctaaaaataacttaagaaataactatttttaaatatcttctagacgaatccttcaagaaatcttcggaaaaaatttggtttgtaaattcaaattatttctaaagaatttctgtaggaacccttagaggttttttatcaaaagaaattccatgacaagattatatgactattttactggaagcaataaaaagtacatggaaagatactaaatttaacaaaggaaattataaaaataatcctgtagcaaaaatcctaaaaatatgtagttttttacaggagagaaatgtttacgggtattctaaaacaaacaaactaaaaaaatagtagagtgcgacttatttttcaaaagatcttaaaaccaaaaatgcgagtgcacttatgaactcaaatcacactaaaagacaaacttcaaagtttgagctaaatatttcaaaatttagagcgctacctcttgaaaataattttcaagttataaaaaattactatcagtgaagtcaccaccattctcttcaatatttaatttatgaaaactttattgaacatcaaatttgtctaacatcaaaactagtcccatttaaaaataattttcctaaaatgtttgatcattttactggaaaaaacctctttgttttatcatagcttcttgaatactcaatcgattcctaatcatttaacactattttagagctataatttagttgttttcaaactatgtacaacttatttcacttaatcagggttttgactttgcttttcaacaaaaactacccaaaaaaaatatttatttttttaaacatacatttttttatgatttaagaaaactttcggaatttggatttttactatgaaggtaaagtttttcatgcaacttgtgttaatcacgagcctaatagtgcatatattttaaacacatgcacaattttttttaaaatttgtagcaaagacctttccgaaggttaaacaaatgagaataactaaaactggtttagagattaggttcaactgccaacaatttgaaaaaaaaaactttatcgctaaaaaatatcatgtttttgtacagtcttggtcaaaacaattttcaattgaaatgttttgtatgtacagtttaaatacagctaaattagcgttcaaagtgcgtataaagttcggttgagtattcatgaagttatggtaaaacatagatgatatttttagtaaaataagaaaaaattgttgtactttatttttaacttagataattttgatttaaaacaaacttgatgttctacaaagttttcataaattaaattatgaagagaatgatgctaaaattttaaaaattgattgaaaagaaaacaatggtatgtatactataccgaaggtcattttttaaaacttgaaaattcaccttcaagtcgcgtgtgttgttaatatttttggctcaaattttgaagtttctctttttatgtgatttgaattcagaagagtacatgaattttgaattttcagaacttttgaaaaataagtcgaaccctatggaatagatatacagtaatggacagaataaagtacgcattggccgtttttccatacaaaatttcagatcaatcggacctctagaagctgagattcagatctccaaacttgaccattttgtatgaaaaaacggccaatgcgtactttattctgcccagtactgtaactacaattaggataatatctggagaaattttatgtaatattgtacagaataattccatgaggaacttttgaagaattgtctgactgattttaagtagaattaggaaaaatacaggatgaatgccttcatgagtatctttaatcataattgacgaaattttcttgtgagatttcgagcagaccatctataagaaacctctttaaataaacttaaagaaactcctcaagaaatagctggagaagtttcagacattcagaatgttcagtgatttttaaagaatccttcataaaaatcaatttaatcatgaaagaaggaattattggttaataaacgggtctagtacacgacactgaagacgaccttacagttgaggttacaatacgcatatctgtcaaatgatacaaattttggagggatttaatggtattgtcctaaattcggtattcactattttttggatattatggagtatttctacttcagcaatttctctcggaatcattagagagatgcattaagttattcctttggtattcgatataactgatcaatagtcctgttccaatcaagtaatctgcggatacgcctccgttaccaacgaccccactaagactcgtcgtctctggctcagctaagcgtagccgaaagagcggagaaacgtcatctacttgatatcaaaacccagacaaaaacaaacaaagctctttaaaaccgctgtttaaaaaagattgtctcaaatctaaacttcatagtgattactaagttgtgttccactgtacttaagacccgaacttaattagtaagaagtgcgggcagtgaatactataagcaaaaatgaatttagaagcatgaattcttaaaaaaaacgtcttaaaaaacacggtaaatttttcgcaaaacaaaccaaggattaagccgaaagtacataagtgttgcattttgatttcatccaggaataagtttacctgaaccatctcgtattgatttctccgtgaattgttcctataatttcccaatgaagtttcttcttcttggaatcacgtccctactgggaaggagacagttcctcagcttagtgttctaagagcacttcaacagctattaactgagagttttgtttgccaaggttgccatttttgcatccgtatatctgagaacgtgttctacggaaaactatttacagcttgaaactactagcccaaaagcatatgattgatttgaagcatactttgcacgattattctatcatctagttacattgcggtctttcagcatgttttgttaataattccagaaactaacatgtaatctgtgagcactttatgaattcaaagttttattttgattaattcccgttgatttgggcctaaaaataccatgttaatgtatgattttaataccaaatatattcagaaaactgtgatttatgtacttcgaagaatgaatcttgatcgaacaatgttcaaacttacttaaatatctttagtgtgttcgaccaacttttgtagaataaaatgagctttttcaaatgctccaatagccggatacttcgatttttcgtatgatggttataattttccaaaccctcaaataagtccaaaacacattattaccttgaatcacattgtaatctatataaataaaaatggaatggtgtttgtatgtcacgaaatggcttcagaacgggtcaacggatttaaaagattcttccttcgttttgttcgtcaagggttccgacgtgtttgaatgtataaaaatcccaggatatttaccgggaaagtcggaaaaacgagcgtgaacggaactgtcattttgtatgggatgatccatgtcgtttttcaacagcctacttgatagcaagacgaaatttgccgggacctctagtttctattaaatgagcttccttagccgagtggttagagaccgcggctacaaagcaaagccctgctgaaggtgtctgggttcgattcccggtcggtccaggatctttaatggaaatttccttgattttcctgggcataaagtatcatcgtacctgccacacgatatacgaatgcgaaaaattggcaactttggcaaagaaagctctcagttaataactgtggaagtgcacattgaacactaagctgagaagcaggctctgtcccagtgaggacgtaatgccgagaaaaagaagagctggaaatttcgtcagacattgttcttagcatgagaattatgagtattgcttaacaagtacatttctatacatgttttcaaatatgaattggtttacagcagaggttgtgtatgatgatcgtttttgcgtgaaattcgggatcgtacgcctcccatgatggaaaaattggctacgcccgtgtagacttatatgtagccattaaaagttcctgtgcaaaaaaaaaagctatgaaaaatttctatgcgtcatctcttgaacgggaacggaacggaaaggtgactcaaaaactttatatatttatatggtcacaattagtatctactaaaacaagaggttcgaatcaaattccaatccgacacaaatgattccttcgaacagatatattcgctgattgtcggaaccttttgatcgaaacggatttatgatatacttgttcatatacattcatatgacaaaatcacaataactaatatttgtttattattattactatttattattgaggcattgaactaaaccgggctgcctcatataaatagttcatataaactaatgataaatttttaaaaaatgttcaaaaattcaactcacaaattctgcgagattttttttaaagcgatttattataagtattcaatgtttgaaccatttaaaactactttcgaaggaacattagaagtaatccataacatgtaagaatgtattgtaattattgcatgtagtctacctatgcttgacgaaagaaatgaaaattaaataagcacaaattatcattttcaacatattcagatccatacttattagtcagagaatcggccgataccacatcataacgcttacaatgatctttaaaaatgatttgaaaaaaaaaacagaaatctgcgtaggagagtacgaactctaatgaccgccaagctcggctttgtcaaccggtgcgtacctgccgattgaatttcaatgagcttgacatagaggtgagacgttggttgtgtcgcagtgaaggaagatgttgatcgcgtcgatgatggaaggaaaactacaactacgacgtgcaatttttttctgctctgaaaaaatgacaagtttgtgaaacaagatggatactctaaagaactacagtatggcccatgaaaaatgcgtaaatcgtcatatcatgttttatggtagttttttttttatggaaaatgaaaacaaaacaatattttaatattcgtattgtttaatctaattaggctctgttttaagccttggacattatttgtaactgttactttttcctcactaaagaggaattgaaagcataaagccgggattggtggtctaattactagcgcttctgcttcataagcagaaggtaatgggttcaatcccaggcccatcccttttctcgtactttgtaaatgtatctttcactttcttctatcttgtactctcaatctattacagttgatctattcgttcatagcatgtgctagaaccagagacagacaaaaagaaccgtttcccctcgccttttttccataattatagcacgcctttccttatgcctgatacataacaaacaacaagcttctctgccataaaattacttttcccctatacctttccgcattaacttgcgaaaatgcaggggtatatccggtctaccgtgggccagttttaaatgcatcatcaatttctccccctttctcttattaaactgcattttgacgtggcaggcgccattgttgtctaaaaattgaagatcatcagcacttatacactgagggtgtctgttattgtgccaagctgtcatctggttggttccttgtgtaagtgcagctaatctggcgatactggagtagcaactacggccggccaatcaagctcaagctcattcacttacagatagtcaacgaacaaggttaaagattcattatccgatttggggtaaataatgttttatgatcaatcccttatcggaatcagggatttatttcatttatttagttaacatctatacagataccactgaaaaaacaatttcacgccacaatactcgattcgtggccgcatctctccatccccggttctgccctaaattcgccaaatcgatacgcacttgaaccgccccctagctcgctgcgctcctcgcattcttgtaccaaccgaatccgatgcgaacatcatttttgcaggtttgctgtccatcattcttgcaacataccctgcccatcgtagccttccagcttcggccaccttctacacggatactgggttcgcacaccacaaaagatcgtcctaagcacccgatgatcgaagactctaagtgcttgtaagtcctcctcgagcatcgtccacgtttcatgcccgtagaggactaccaaccttatgagcgttttgtacatggtacatatggtgcggctgtgaatcttttttgaccgcagcctcttgtggaggccatcttcttcttcttcttggcattaacgtctctactgggacagagccggcttctcagcttagtgttcttataatcacttccacagttattaactgagagctttctttaccaaagttgccattttcgcattcgtatatcgtgtggcaggcacgatgatactcaatgcccagggaagtcaatgaaattttctttacgaaaagatcctggaccgaccgggaattgaacccagacaccttcagcatggctttgctttgtaaccgcggactctaaccactcggctaaggaggccatagtaggcccgatttcaactgatgatgcgcttccgtatttcacggcaaactttattgtgatggtagaagaactcgtcaaccacctcgaacgtatccgcgtctatcgtaacatttctgcctaggcgagccctgtcgcactcggctccacctactagcatgttctttgtcttggtcgcattcaccaccagtccaactttcgctgcctcgcgtttcagatgggtgtactggtctgccaccgtttcaaatgttcgaccgacaatgttaatatttttcgcgaagaaaacaaaatgactggatctcgtaaaagtcgtgcccaggctgttaagcccggttcttcgcataacggcttctagcgcaatattgaacaacaggcacgaaagcccatcatcttatcgtattctcggcgggatccaaacgaactggaatgttcgcctgaaaccttgcacatcgttttatatatcagtctcgtgagctatccgggaaagctgttctcgtccatgattttccatagctctgcgcggtcgatactatcgtatgccgtcttaaaatcgatgaaaaggtgatgtgttgggacctggtgttcacgtcatttttggagaatttgccgtacagtaaagatctggtccgttgtcgatcggccgtcaacgaagccggcttgatactttccacgaaatcgtttactacaggtgacagacgacggaagatgatctgggataacactttgtaggccgcatttagcatttagaatggtgatcactcgaaagttatcacaatctaacttgtcacctttcttgtagatggggcatattaccccttccttccactcctccggtagctgttctgtctccaagattgtgcctttcagctggtgcagacaaatgatcagcctctctgggcccatctttatgagttcagctccgataccattcttcccagcagctttattgttcttgagctggtgagtgaatccttaacccccctcaaagtgggggctggttgatttccatcgcccgcagtacagacaaagggatttcctccgttgtcccgtccttcatttcagtgctcccagcgccattcaggtgtccgtcgaagtagtacttccacctttcgatcaccaccgctcgtccgtcaaaatgctcccatccttatacctgcacatctcgactcgcggcacgaagccgttacgggatgcgttgagcttctaatagaacttacgtgtttcttgcgactggcacagctgttcaatctcctcgcactccgtctcctccaggcggcgttatcatccgaaagtggcgggtctgctgttgccgttgccgtctataacgttccacgttctgtcggatcccttcctcgtcgaaccaatcgttccgtcgactccgtcccacgtacccgacgtggctctcagctgcattgttaatggctgcttttactggtctctagcagtccgcaagagcggcttcatccagctcaccctcttccagtaatgcagcctcgaggtgctgcgcgtttgcagctgcgacatccggttgcttaagccgctcaaggtcatatcggggcgaccgtcggtaccgtacgttgttaacgacggagagttttgggcgcagtttaaccatcgccagagtcgatgtatgctccacgatagatcctgatgtcgataatgtcggagaagtgccgtccatcattcagaacgtggtcgatttgtgattctatctgctgtggtgatctccaggtgtattggtatggaaggctgtgctggaagtaggtgctaagaatgaccatattcttggaggcggcgaaatcaattagtcgtaccaatggtacgccatggccagtcatgcttcgataaattgtctggacaaataactgaaagaaatcattgagtcaatattcagccaaaaaaatcgatcaagctgaaaacttcgaaccgttgtcttgttccctaggtttgtaatcttgaagatctggtatatatttgtatggcttacattcattaccgttgccaattcaactgtattacacatctaaagacgggaatgattggttcattttcgtcgctgctatccaatctaatatcgcattcaaattattattctttgactggttgcatctcgcaaagattgtgaaaccaaacagactccaccttcattgttcgcatacctaccttttttgtaattactcatcaccaggttagccacatcggcaaaccagcagcaccttctcggcgtgacgatggaagaagttctgtggtggttctgtgttctcatttgacgaaacaaataaatcactgcaacctttgtttgctgccgagcgattcgttttcttctgggtgtataggggtagaaaggacaagatgagcactgagattgatgcaaattttgaagtttaggctctcctatacttaaacgatgtcaattgtgataaatatcatacttgcaacatacattgttagataatcctaagttatcggtcaaatcatacacatcaggtcaattatcagaactccaagtctgatagacttcctgtaagagctggtgttcctcaaggcagcattttgggaccaatattatacaatattttcacatgtaagctacctgagttacatcagggatgtcaaaaatctttggatctacggatgacacatgcctctccgccaaaggacgaagcctgggtgtcatctgtactgttcataactgcatatttgtaacattccaaaaatgtaggcatagagtgaatggaataccaagtgtgcattttatggcagtatgagaagaaagtaaaatttctaaaaagaactcaaaaactcttattggaatgaaatggatgaaattttgtacagttcatatcgcaaaataattctgagagaaatttcattgctactacatgtataatcccaatgtgactgttatgcggtttcaattaccaattttgaacaacgagtgcacacttacatattgatttattgatcggtaaatggtgctcatcttgccccgggtggccatcttgctccgcctacccctacgtttagtccgagtggtcgtgtgctagatcgccctgaaagtgtgctcatcgcaggcagccctctcttcctcgtaaaatgttgaaaatgtccgaaacaattcaatccacttcccgtcgtccacgagcgcctatctattctttgctctctcgcaatttgcgggatgtacagtactgaacagaattaagtacgcattagccggttgccatacaaaatggtcttggcgatctggagctcggcttctagtggttcaaatggtctgaaattaatactgaaatgaactgaaaaatcacaatattggaaacacaaactgtaaaataattaagaagctctcattttgaaaaaatgaattattttgttttggaaatattccgaaaacaatcagttttactgaaaaaggttattctacaagctcgcgtgtcttatcaaattaaacaattttgtagaaaatcttgttgctctaacgatttctatttcaaaattattcataattgaaaattttatcattattatcaaaatgtttgaccatttagtatggaaaaacgggctatgcgtactttattctgtctaatactgtaggtactaagattcaactacgactagcccagttcgattcgtgtctgccggcgacgaccaactgcaacgaaatcgaaacacaaaagaagaaaaatgagtgcagttatacttcgattgtctcgcgggtgtaccttcatagccgttagaagtgggtctcaagaagaacagcggggatcaataagaagattttacttacccagagaaaagctttgtgaaatcaacaatatttgcaaaacagatctcatgttgtttcaacaatacaggatagctgttttataaaaagaatttatgaattgaacaaaacatatttttgaaaatatatctttacaaacattcgagaagggcactaaaagtcatgagcccacaaacgcgaaataacaccacaattttgaatagttgaattgggctcggctgcgccttgcaaagccattgtttcccaatgtcgatatgcccttttcaaatgtaaatgcaatacgagttgtcacagtgctctcaattttgacagcttgataatttcccgcgtaacttttcaaaatgagctttctaacattgagagacaatcaaattaattaactcattacgcgtggtaaagatggataaagggataaattatgggtgaaattatgaaaaaaaaaaacacatgctcggcttcgaacccaggactcttgaatgttagacgagcgctttatcaactaagctaccactaagccacttggtgacctaataactcaaatggttacaagtttcaaattcaaatccccacagatcacgcagactcttttcgcgctcgtctagcatacaagagttctgggttttttatcccagccgagtacagtttttttttcaaaatttgacacacaatttatccatctttaccacgcgtaatgagttaattaatttaacaaccatgcggattggattaccgaacatctcaatatacgtttcaatataacattgagaggttccgccataaatgacttcaaagattctttaacaaaattctcaatcaatgttttcagtgttttcaagtacataatttaggggccttccgcgggttagagtccgcggctacaaagcaaagtcatgctgaaggtgtctgggttcgaatcccggtcggtccaggatctttccgtaatggaaatttccttgacttccctgggcattgagtatcatcgtacctgccacacgatatacgaatgcgaaatggcaactttgtcaaagaaagctttcggttaataactgtggaagtactcataagaacactaagctgagaagcaggctctgtcccagtgaggacgtcaatgccaagaagaagaagaagaagaagcactgaaaaatactgtttttgtagcactgagatgtactgttttatgtttgatttatatcatcaaagagaatgcctaattgttattaaattaacttatcgtcaaagttcttaaaactataacatttcaaatatcgaaattattttttaatattaaacgaaattatgattgttgttgcaatgcgaaccgttttctgtccgtgcaggtcattccaatctactttaagtagtacataaccgagcctaccggaagccgaaggaacggcgttgccacctttcacaggcggagatattcaagtaattgggtccatatgtgctggctgaccctgctttacgtcagcatccaaaaagtctgacttagtcttcaatcagtttgcctagtcgcttctttatttgcccattgtttcgagacttcgtgcggtacctacaaatttgcatcacgcccatctgaatccaattgtttcgtttcatcgttcgcctttctcatttcacgatcggtcttggcttcctaaaactatgccggtggcattaaccggatgactgtgcagtaaggtggcccagtttatggggaaaatattaactcgtgaaaatcttaaatttgttcatttggacccctggtagctgtcatttctacctatctcaagtaatattcattattcctgatgactgtggtaccttttacttgttcgtgcctataggatttttgagctgtatatgctggctgccgtaggcgcagaggagagacttcccggactgtggactgattaacatattattttattttttatttgcaggatataaaagtagctactgtgaataatttgagcggaatccggcaactccaagggagacttaatgagcttgaaatttgtatgaaaaagaatgaccaaatatatgggaaaaatacatcaatttctattttcgaacataggtagcgcttcgtcaatggattacttacaaaactgatttgaaaattcttcactcgttacagaggagactggaacaaaccggatttcagtcattatgtttaggttcgaaaaaagttataccaggggaaactacatataatttcggtttcccccttacagtatagctcaaaatttcgcagttgcttctggggtccaaatgaacacaatagggcagtgaaacataagatttttttgtagtttaaccattatgggccatcctactgtgcactttgccttccaacctatctcagacatcccgaaagtgctccactgcagaaaccaaaagtcgatcttaatctatcacgacatttgcgaacggcggcagtgggaaaggctaagcctccacactataccgtgatgaatcatgcgtttcatgccagacagaaacatcatcatcgtccattataataaccgctgttcgccgacagtgagtcttgggaaactactataatcatgagcaacgaacaaaagttcacacgtactgaaatttgctctcggtgacgagtcacgtgataacacctggtcgtcggctacaattcacgcgagcttttgttgctccactaattgactgaaccgaaatgggatttgtacctgaatggcgaaaacaaagcgacatcttacacaattttcacccagaagagaaatccgctgccaactacaaaagttcctcaattacgaatctaatgtttaccgtagaaacatgtttgttgtattcaaagacctacaaagacaactttcggcagcaagctgcacttttggagtaccgtcgataggggtggcaatgggtctagggggtgagattgggtcaaaacggaaaattatgatttttgaaatatttcaggcaataacgctgatatcactagaattaataattcatatgtgaaggaagatattattacttgtattcagctgcgttacctgcactgtgacttttcgtttatggctcgtttgaaggtcgggcaccttgagcctcccgttggatgcttgttgttcacggacctgccggaacaaatcaagcacttgggagggttcttgcagcctagtgccttatgaccttcctcaccacaacgcctaaacaacttggtcctatcagggcctttacagccccaggacttgtgtcctggttccctacacctaaagcagatcaccggttgctcgtgtatggtcaatgaacatactaaccaacccaccttgatcttacctaccttagcggacttatttgcgtccgccacaggtagctgtactaaggccacctgagttcctaccggacttttccgtagccggacggcagcggtgggcacctgtatctcgcactgttgccgcagtgccgtgacgagctcttctgcgtcggtgatctcgtcaagattcatcaccttcagagtcactgcctgcgttagagccctcacctcgacaccctcgccaaggacctcttccgccaaacttttgtaggcggcgcccttgcgctccttgtcgcgcttaagctcgaggatcatttcacctgtacgagtgcgtctgacactgcgtacgttggctcctagatctgcgagcttcgcgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcttttcgggacgcctggctggagtccgattttctggcactctgccgaatttcgagattaatatttgccgggttttgcgagcgccgccgggtagctcctcccctgacggctgcctcgcacgcttctgcgattgcttgttgtaagcatgcgcttccgcacttttggggctacccgcgaaaacgaagggctccgtctagggtagacttcggcaccttcaattccacgggttctgccgctgccacagtcgccatgggttcagcaaggttctgcttggccgccaacatcggcttacgaagtctgaacagggcctgcttgaggtccttgctgatgttagacctcgaggacgcaaagtcaatgatggagtcaagctgctgtgcagccacttccattgcagagagcttatctctacttttattgatggccctcatcaaccacgctccatccataacctcatccgatacgttcgccggggatgaaatatggtgtcctacgtgcactgctgcctcctcctgcttccgctctcctcaacggagacctagctaacccacttcttgcgaaggggttcgcttccctactactgctacctgcgctactactgctattttgattacaatttgtactcattacccaatgttttcttttataacaatctaactaatttgctattagcagatggatccatctacccttatctgagttatcccattcctgctgccatcttctgagcgttgcgaactcctttggtacctctttgattgaagcattcaacatcttccttgatgatgagcccgatgggcgtcatcccagctatgatacacacggtctctttagataccgttcggtatgcacttgctactcttaagcacatgatcctgtacgcgctttccaggcgctttagggttctgctcgttctacacgcttgtgatcagattggtcctccgctatagccgtagatgcccttttacaggcatattcagcgtggctagcgaagctgagcttgtcatcgatcatttccccaagatgcctaagggatcgcttggactctatggtgcaatcacctaccgagataagcgcccgttgctcggacttgcggttgttcaccaccaccacctcggccttgtgacgggccagtcctaatttcatagacttcatccatccctcaactatggaaatagagtgcgctgctgtcaactacgccagtacgtcatcgtacatcgctttccataacagcgggcccaggattgaaccttgaggtacacccgcgctaattcaaacgcttctctgcctcttctctgtgtcatacagtagaatcctaccatcaaaataactttctagaagcttacacaactgcaccggtactttgaggcggtaaagcgcgtgtgctattgcttcccagcttacgctgttgaacgctttctttaaatccagagtgacaaccgcacagtaacggatgccgctccttttatgctcgatagccacctcagctttctaaacgtccgactggatagcgtccagagtagatttacctttcctgaatccaaactggttgttggacaggccgtccgcactctccgtatacggtatagcatgttgagaatcaacctctccaataacttgcccgtcgtatctagtagacagataggtctatacgccgacgggtcacctggtggtttccccgcctttggtagtagcaccaatttctgtcgcttccatacatccgggaagattccttgatcaatgcagcattgcatcgtggttctgaacatgtccggatccgccttctctgccgcttttaaggcaacattcgggataccatcgggtcccggtgccctgtttgacgcgaatgatttcacgacttctgccagctcttcgttcgtcactctcgccacttcttctccttcatctgccgcatacggcgctggggccatgggcttatgtgatgtacgggaagagtacatcgattatcgatcgcagcaattcgggcgacttctcatggggcgctgtaggcgtcaccccatggactcgaatggaccgatgcacgagttcatcatttgacatttgagcggtgctgtgttatttacgtgaccatggcaacgagtgatttcggcaccgctcaaacgtcaaattagtaaactagtgcattagtccattggtactctcgcatagactaccaaagcatgctcgttttcgtctctggatttcctttttgagagccaagtttgcctctctgaatgctgcaccgcgttcttctctttgcattctttgcgttcttctcattgattcgcaccaccagtacactggcggcctgttctctctaggagggtcttttttggcatgcaagcatcacacgctcgtgatatctcagcaactagttcttcaccgtttaggttcagagtattccgttcgcgcctcagggcttcagtgaatacttcgccgatgaagcgcgttgttttccaacgtcgggcttgggtcgagttacatcgcgctgctttccgcccgcctggtgttatactatagcgaatcaattgatgatcgctatgagtacccaagtaaccaaatagcagtttaattcaccctgcgtgctaacacagtggtattatacagctgacatgccctatactagccgtataatagccctatagatccgaaaaggcgtattagcgggctagtggttacttgggtataatcgtcttcaacgcgacagttcatggtacctaaaagcacagacaaacagacataactcgtgaattattttcatcgtacagcagaatagtgctcaagttgcattttaatcgtcaatcaaagtagacgtgttttttattcgctgaaacccgcgcgcgactcgattttgttttatttattctattttttgcgtacgtcatgaactgcgaaatttgtgctttggacgcttctgccgactcggtattgtggacatgtgcggggtgtccacgtaaattccacgccgcgtgtatcggtgttacggtgcagcggagttcattgaggaggaaagatagaaaattgattgacttcacctcatatgttttgccttgctgtgagtcttgccaagaactcgtacaagcaaaattggacataaaaaagctgaatgaagagcataaacttcttggttttatcaaacgctttggttctaactttaatgatccatacactattaaaactttgtacgtcgcttacgtgaggtctatattagagtattgtagtattgtatggtctccttttatgaagacgcatgaagaacgtcttgaatcagttcaaaagcaatttctgttatatgctcttcgtaaattgggcttgacatccttccctcttccatcttatgaatcaagatgcatgctcattgatattcagacattgaaaaagcgccgcgaattcgctatggtttcattcgtgaacgatactgtttcgcatcgtattgattctcctaacctattaaacagtttaaatttttatactccttcccggcaattgaggaatcgtaacttgttttttattaatcaccgtcgtactaattatgcaaaattttctcctctaaaccgaatgatgagtttatataatcaacattgcgaaacaatagacttaacaatgtcgcgtagtaacctaagaatatactttaactctgtaagatatagcagtatatagatttaagtgttaacatgtagtctactttgattgacgataataaataaataaataaataaatgctaatacttggtagttggccgacgggccacttgtggcgctcgcatcacttttgttcaagtttgacgtgtaatggtttgacacctagttaatggttggccaaacacagtggttttagcattgggcgttattgttcgcgagactatgtttttaattaataattgttctagcagttacgtctgtttgtctgtgctaaaaggttaggactacaaaacgtcacgtcgataatcgattctgcaccatttctgcggaaggtactcactgtacccacatttgccagctctacatttaatgcggccagggtttccagcaatagctggcctctttggttggtgcagcggctatcccactccactgcccatgcattaaggtcgccagctttcactactggctgccaatcagctagttcggctatcatcctgtcgaccatgtgggaaaattcctcaaacgaccaccttgaggacgcgtaacaactacaatagaacacgccgttgattttgggtatcgtcctgtcgtccctatagctgctagctgacctatccgccacccagttcccgttgttggctggtattcggtatgggtccgatactaacaccacgtcagtcttggtttccgagcctgactgccaaagcagctgctgggctgcatcacagtggtttaaatttaactgtgttgcttccgttttggctgctttgatactccgcttgtacccgaccagcctaccttgagtatgctcaagttcttcactttgttggcctctgcgaccggcagcctcatcgccgccacctgggtgccctgcgggccctttctaaggtggatggccttactggctgcgtcgatgtcacactgctctttgagatcagccgagatccccgctgcatcggtgacctcatctagatttttacactagtcgcttcagcagtaagggatcttacatcaacctcgtcgccaagtacttcttgtgccagttgcttatagactgcacccttttccttggcgtccttctttaagactaggataatttcactaatcctagtctgccttatgctccgcacatctgagctcaatggcgataacttctctgtgcttagataacgaaggcctcgcctaaattcctacgtttcgctgttttcggtttagcactctccttgggctccgtttttggtttcctcaattttttcttattttcaattcgtatccacggatttatgttgccttgcgcccgtggttcctgtggctgcaataccttggtgttggcctctccactgttgccatgtcctcttgatcgtgcagcttggcacgatccagcttttccgctctgaaggacggccgcgtaggtcacttttcccttagcaaccatacgccttttcgccacgtattcatcctcggaaggtcccctttctcgcatcgcgtatcgaataatatcatccgatatgttcgcgttgcctgtgaaggaaaacacttcggtctgacacgacttagtgtctctttagccttctaccttgccaagttgtgctttggctttatcgtagtcctgacttgcagctaggactgattgtcgcaatttcagtagacttattttcaaatctttgctgatattgcttttgctcttaacaaactcgatgatgacattcagttgctcagcagctacctgcattttagggaggtactccctattgcgatccatggcctcgattagtcccaggccatcgttcacctcacatgttgcactggagcggccagtgcctgccgtcgtcacagtatttgcccacactgttttcactaaagttgatgttattcgcctttttctttggcttgaaacttaaccggttactgttaggtcaagaagcctctccttcacattccgtttcgatttccggtcacatgttttggttgatcatctcttatgggtccccctaagagccgcaatccaactccgctggaatagtcgcctatatgatcccatggttatctatgcaagcagggatgccatgctagggttgacatagtcctttatggggtaatatgttcagagccggatcggcgcaggtcaggtaatggcatcagatcctacccccgcccagttggaataaccaggcgacggatttggaacgtactctaaggcctgccacggttttacgggacgggggcagccggcgccattaacccactcgccgtttcgggccagtgtcacccaaccctactaagggagtagaatgtcgccgctgtcagcctcaaagcatattatccagtacacatttggatttttgtggtttttatgaaggtttatcagagcccctgggcaactcctcaacttgcagaagtcctggggggaggggtccgttaagcccctggattttcgtccctgctgccccgatagatcttacctagtaacgcgccttataaccatatattacatttcatttgccgtaccagttcagatttttcacaggtgagttgatttcatctgcttataagagaaaaaaaaaacgctttcaatttacttaacctaaatatataacgtattaatcgtggcaatagaagattgcaacgatttttgtttaaaattatttttaattatattcgatatttgttccaatgtttcaaaattggatattctatgtaactcattagttctataccagggagggcttcagaatcgttttcaaatttttctattttgattcctctgcagagttttctttctggtaaggtacagcggggtaagtggatgatttggccatattaagcacaaatacttgaacattttagatgttttcgcaccatcgattcgattaaggttatattcatacgtccactctgatactactgcaaaactggtactacttgtgcacaaacacaatcaaacatgttagcagcaacaatcaattaatttcaaaattgttatctgtcaatcaaaaatcaattgtatccttgcctaaatttcaatagtattagtttttttcaacgcatggtaaacatttcagttcaaattgagtgaatcacaatgaaaaaaatgatttttataaataaccacagatatattggacatggtacacttccccatacttcttaatgggatggggtaagtggatcaagtattactatcatatatttgcagactgcttacgtggatttgaataagtttcaatatccttgaatgttgtcttcctggtaaaaacaacaaataaaacaaaaattcaaaattcaaacaaaacttttcgtggtttatgtaagctgaattgcaaaagagcaaaatatacaagttcttcaactgaatatcgtaatatcgtaaatgatatcgtaatcgtaatattccaagtgtaattttgtgaaagctgccatggttctgcaagaaaaagccacattatgcgattatcttaaaatgtctatatagggaaggtgtaccggtattcgccatgtaccagttattccccaccccagattatataccgttttacgacatatatggttgcaaattgtttagtgttcgctaaattgatttaaaatgatacggaaacattcttggaaaccgcaaaattttctcagaaaataatagaaaaaaaatcattttccttaaaatttttgctcctttgcacctatttttcgccacctgttcctgattcgccaccctccataagaaatcaaagtaagtggcgaattcaggaaccgaaattaaaatcgtggcgaatactggtgcaagtggtccagtattcgccaccactatttttaatacaaaaacaatgtttctgattagtttttatattttccctgctgagcatggattgaaagctttcgtctgatgtattaacagtaaccaaagatcggttgatttatgtataaacaatatttttccttagggtggccaaaactggtacacctaccccaccgtcgcagtgattataaaaatcatcgaatgtttcagatttagcaaatttggaacattcgcgtccttgaagaacgaaaaaatccaagcctacttgaaatttgacgttgcgtttgaattgcgcgcatattatctgcgcgttaccgccgccgctggatatggatttgaaatgagcgccgcaatactgtatatcgataaataacttcagttcaattatccacttttcactttcttcacgcctccctatgtgactaacatcaccgggcacttattttcactatggaaaccattcgtacacagaccgcgtaaaattgacaatgtaagcaaagttcaatccgtcgtactgagagaaaaaaaaacttgtgcgcatcaatgtgtgcgcgatgctcgacgtaaaaatacggttcctttgattgtgttgttttcgctgcactgtgaccaaatgccttaattgtacggtcaaaaggaattgtgtttatatgtttgggctgaattttgatggtgaaaaatgaactgtaaagaaaaataagtatactccaacatgctgaaggaatggagggagatgcccgtagatctatatattctagtaaaacattttattatagtgttgatatgttgtgttttgaccactcactatatcacagttaaccgtaagttgtgcgacgaatctggaaactgattgcgacagaaatgaaagcgatacgacggattgagaatacggaaagattcattttttttgcattatttccaaaaatatatcaagattaatcaaaatcttattgtacaatgctaaagccgttttgagaaagaaatgtttggcattggtttgtatcagcatcattcactgcaatactgaaaaaaatgcagttctcactgatcaatgatacgatggatactagcatattacccaattattatttttaagttcacgagtatctctagcaaacatcataaggaacaatcctacaatacttctgtataaccagtgcgcatcgtaccttcgtgctgtgcgtacacgaattctctctgctcttggaaattttcttaaaaactacctaaagcaataaaacagtacttttcagtgctacaaaaacagtacttttcagtgctaaaaataaaaacggtacttttcagtactatttttctactattgatccctttacgatccttgtttggacccgtgccttcgatttttcgttggacccgttggcgaaagctagcggtggtaatccttcttggacaccgtcttgggaaaaaacctttcgaaggtcacgtcttctttcgtttattaattaaacatggtatcaacaacaaacaaaaggaagggtgaatctctgaattcactacttccttccaaaaaagtgggttttaaaactgtcactacacgtggcaagaatggaagaaaggacgcttcctcggaatgcgaactttcttccaagggtgaaatgattaattgtatcgaaatgagcaatcagttcgatactctagacaaattttccgaacaccaaatcgaagcagcctctagcccaggctctttgattcaagtgaggaagcaaagagtgccgcctatcgtggtcagttgttccgaatttgggggatttaggcaggagatcttgaactccattaggggaatcaaggtttccttccaaatcgcaaagaaaggagactgtcgcgttttgccggaaactcttaaagatcgtgagcttcttctcaaacatcttgaagagaagaagcacaatttttttacttgtgacgacaaaactgaacgtttgttcaaagttgtcttgaaaggtctctcaagtgactataaatcacctgaagagataaaaaatggaataaatgatttacttggattttccccagtccaagtaatcattatgaaaaagagaacccaatctggcattgttcggaaagggctttctcaaaaattttatttaaggtaccgcggggcaagtgggaactaaaaaagcgatagttcaaacgaatcgttcaataaaattttcaaatgtaaatatttttcaaatccaacagcacaattacattttggcaacatatttgctggtgtgtgcatgaaactgatcgaataatttcgaaattgtgaaatccttggaaggaagttttagaatgaaccatttgacgcagttacctcgctaaacggggcaagtgggacacatccagtttcatacgtcaatccacatcagtaagtcaaccattacaataataggattgataaaccatagatttttaatttcgagtacatttttgatgtacataagggatcaaccataaaatacgtaacgctttatgaagaaaacgtttatataatagtatgtcacctcccatttgatattacttgaaaatttctaaataaaagcgttcagaagtattaaacctgttcaaaatatatcatttataagttgttaattaaaagttagaacattaacaatcaataattgacgaaattataaatatgttttgttattatttatgtacatagtagaaaaccgtttaatctggtggaattgttttctgtcactaataaatttggcagaaataataaataaagttcaaataaaatagaaaaataatcgttctcatgatgcatctcaaatttcatctctatgtttgttcaattttgaagtcgtatttcaaaaataaaaaccaaataaaaatatatagaagaataacacatttcttcttcctcttgtgcaattaagtaatttgagattgttcttttttgataaaaatcatttgttttaatgttttagtgctactctttaggaaaatgtataaaacgtctacgaaaagttttgattctggtttttgttttgataggtcccacttaccccgggtacaaagaaattttggggaaatttagatcatcaaaaatttcatattaaatgaaaacataataccggtttatcgttagcagcttgtaataatacttaaagttgttacttactgatggaaattcgatttataaaacatttattttttgcgggtcaatgcaagacgtgaaacgtgtcaaaatgtattatgcacgttgaaaatggcgctgaattgacaactgttacatgaaccacatggtaataaaaattacaatatgttttgcacctaatacattccttgtcattgtatcttaaacttcctagaagagtacccccattaaaaacttttcctaagtgagctatgacgaaacgccccacttaccccagatactcacttgccccggggtaccttagttcactttaacaaaaaagaactaaataatattaaagctttagaaaaagcaaaacttttgtttgatgtccgtgtgacatgggaacatttccagaaacctggaggaaattaccagaaccccactcagtgccgtcggtgccaaaagtggggtcatggtacaaaaaattgtggcatggatgctaaatgcatgatttgcggaggttcttctcacgccaaagacgtctgtccagtgaaggaagataccactaaattcatatgttgtaattgcggggctaaccataagtccaatttttggaattgtccttcacgcaaaaaggtcattgaggctcgtgccaggcagatgaaagataatgtccgttacgataacggtcgtttccggaatttgcctggtagagtatcgaacaatgctcatttttcagttaacgatcgcttgatcatgaatcatacccaccaggaagatcataatcattcacaaactaattttaatccgtcgggtagccgttcgaatctttctatttcgaatgtatctacccacggtaaatcctttgccgatatcgtagcaggaaattcgaactcctcccctgttcgttccatgggtacccattctacttgtttcaaatcaaatggaaaaaaccctaccgccacaggaaactccgcttcttcgtctaccggaaattccaatgggaaatcacatgacatgtctgcctctgattttaattttctaactgaacaattgaatctaatgattgatgcaatgttcaaagccaccactatgactgaagcagtccaagtaggagtaaaatttacaaatcaaattgttattggattacgtttttctaatggatccatataataatttaaatattttaaattggaatgctcgttctctgaatggtaaagaggacgagctgtttaattttcttacggttaataacgtgcatatagcagttattaccgaaacgtatttaaaacctggatctaaactcaaaagagatcctaacttttttgtttatcgtaatgatcgacttgatggggcatgtgggggagttgcaatcatcattcataggcgtataaaacatcaactgttttcatcatttgaaactaaagtttttgaaactttaggtgtttctgttgaaacacagtttggtaaatatactttcatagctgcctacttgccttttcaatgctctgggcagcaagttattttgctccaaactgacttgcgtaaattgactcgcaataagtcaaaattttttgtcattggtgactttaatgccaaacatcggtcatggaataattctcaaagtaattccaacggcagaattttatttgatgagtgctcttcaggatatttctcaattcaataccctgatagccccacatgtttttcctcttctagaaatccatctacgattgatttggtcttaaccgactctagtcatctttgtagccaactgattactcatgctgattttgattctgatcatatcactgttacatttcaaatatcccaagaagcgattctcaatcctattagctcctctttcaattatttacgagccgactggaatatatataaaacgtatgttgactccaatcttgatgttaacatttctttagaaactaaacttgatattgacaatgctcttgaaactttaacaaattccattgttgaagcccggagcattgcaattccaaaatgtgaagtaaaatttgaatccgtgattatagacgatgatcttaaactcttgatccgtcttaaaaacgtgaggagaaggcaatttcaacgcactcgcgatcctgctttgaaaattatatggcaggatttgcagaaagaaatcaagaaacgttttgctcaattaagaaacaaaaattttgaaaataaaatttctcaattggaccctgactctaagcccttttggaaattatcgaaaatctagaaaaaacctcagaagccaataccggcattgaaagaggaaaacaaattattactaactaattgcgaaaaagctcaaaagcttgctatgcagtttgaaagtgcgcacaattttaatttaggacttactagtccaattgaaaatgaagttactcaggagttcgaaaatattctcaatcaagataacgttttcgaaaatgcctgggagactgatttggaagaagtgagaactattattaaaaaaatcaaaaacatgaaagctcctggcgatgatggaattttctacatcctcatcaagaaacttccagaaagtagcttatcatttttagttgatatatttaacaaatgttttcaattagcatattttcctgacaaatggaaaaatgctaaggttgttccaattttaaaaccagacaaaaatcctgcagaagcttctagctatcgtccaatcagtttgctttcctccatcagtaaactttttgaaaaggttattttgaacagaatgatggcccacatcaacaaaaattcaatttttgccaatgaacagttcggattccgccatggtcattcgaccactcatcaacttttacgtgtaacaaatttgatccgttccaacaaatctgaaggctattctactggtcttgctcttctagacatagaaaaagcattcgacagtgtttggcatgaaggtttgattgtaaaattaaaaaactttaattttccaacatacattgttagaatgattcaaagttatctgtcaaatcgtacacttcaggtaaattatcagaactccagatctgaaagacttcctgtaaaagctggtgttcctcaaggcagcattttgggaccaatattatacaatattttcacatctgacttacctgagctacctcagggatgtcaaaaatctttgtttgcggatgacacaggcctctccgccaaaggtcgaagcctgcgtgtcatctgtagtcgattgcaaaaaagtttggatattttttcttcatacttgcaaaaatggaagatttctcctaatgcttccaaaactcaactaataatattcccacataaaccaaaagctctttatttgaaaccttcaagtagacatgttgtcacgatgagaggggttccaataaattggtcagatgaagttaagtatctagggctcatgctagataagaatttaactttcaaaaatcacattgaggaaattcaagccaaatgtaataaatatgtaaaatgtctctatccccttatcaatagaaaatcaaaactttgtcttaagaacaagctgttgatattcaaacaaattttcaggccagccatgttgtatgctgtaccaatatggactagctgttgtaataccaggaagaaagctctgcagagaattcaaaataaaattttgaaaatgattctgaggcttcctccctggtatagtaccaatgagttacatagaatatccaatgttgaaacattggaacaaatgtcaaatacaatcattaataatttcaggcaaaaatcgttacaatcttctattgccacgattaatgcgttatatgtttagcgccagcgccgtatgtggcagatgaaggagaagaagtggcgagagtgacgaacgaagagctggcagaagtcgtgaaatcattcgcgtcaaacaaggcaccgggacccgatggtatcccgaatgttgccttaaaagcggcagtgaacacggatccggacatgttcagaaccacgatgcaacgctgcattgatcaaggaatcttcccggatgtatggaagcgacagaaattggtgctactaccaaaggcggggaaaccaccaggtgacccgtcggcgtatagacctatctgtctactagatacgacgggcaagttattggagaggttgattctcaacagactagtaccgtatacggagagtgcggacggcctgtccaacaaccagtttggattcagaaaaggtaaatctactctggacgccatccagtcggtcgttcaaacagctgaggtggcaatcgagcataaaaggagcggcatccgttactgcgcggttgtcactctggatgtgaagaatgcgttcaacagcgcaagctgggaagcaatagcacacgcgcttcaccgcctcaaggtaccggtgcagttgtgtaagcttctagaaagctattttgatggtaggattctactgtatgacacagaggaggggcagaaaagcgttcgaattaccgcgggagtacctcaaggttcaatcctgggcccgctgttatggaatgcgatgtacgatgacgtactgaggctgccccttccgacgggtgttaagattgttggcttcgccgatgatatcaccctagtggtctatggtgaatcgatggaggaagtagagttgacagcagcgcactctatttccctggttgaggaatggatgaagtctaggaaactaggactggcccgtcacaagactgaggtggtggtggtcaacaaccgcaagtccgagcaacgggcgcttatctcggtaggtgattgcaccatagagtccaagcgatcccttaggcatcttggggtaatgatcgatgacaagctgagcttcgctagccacgttgaatatgcctgtaaaagggcatctacggctatagcggcgctttcgaggatgatgtctaacagctctgctgtaattgccagcaaacgcaagctgctggcaagcgtggcgctatccatactaaggtatggaggaccaatctggtcaaaagcgcttagaacgaacagaaacctaaagcggttggaaagcacgtacaggataatgtgcttaagagtagcaagtgcataccggacggtatctaaagaggccgtgtgcatcatagccgggatgacgcccatcgggctcatcatcaaggaagatgttcaatgcttcaaccaaaggggtaccagaggagtccgcgacacgtgtaaagaggaaacgctcagaagctggcagcaggaatgggataactccactaagggtagatggacccatcgacttataccaaatgtgtcagattggtatggtagaagccatggggaagtgaacttccacctgacgcagtttctgtcaggacatggttgctatagacagtacctgcataggttcgggcactcagaatctcctgcgtgccccaattgtgctggtgtagaggaaacagcggagcatgtcgtgttcgattgcccccgtttcattgttgtgagaggtcgcatgctcactacatgcggaggggacacgtcccccgacaatattatagagagaatgtgtgcggatgccgagtgctggaatgcagtaactacggctgtcactcacattatgttagaattgcagcgtctatggcgcgccgaccaagagttggctgcagaggattagccctgccgaggctggtcccttgtaacattgtttaagtcggctaggagaagcagtttgcctaggctacttctgctacacgtgttgtgctatatgcactggtcccttcccgaagaaataccgtaaggtggttccggggagatgagggtctgagtccaagggtcatgtcgatgcactgttcaccacttgagcaattctaaatgaattgctcatgcacagtgcataggctggttttagcgggtcgtcgttggtgcgtcatccccgcattccctgagttatcttctcaggggatctgtttgcagatttcccccttgtaaaaaacaaaaaaaaaaaaatgtttagggtaagttaggttaagtatattaaaaacgtttttttttctcttataagcaggtgaaattaactcacctgtaaaaaaaactgaactgctacggcaaatgaaatgtaatatgttgttaacaaaatgttaattaaatcttaaatttgttttaccaaattaggatgatagtgttgtcaaataacacagaacacctagatataagaaatgaatgtaatgtttggaatgatactaataaagaaattaaaaaaaaaaaaaaaacttctgtataacctatgggcatcaaatggacgaattttctcaaaaatgttctagttgtaatgttttttttttgttcgaattagtgtgaactaacgttaaatatctaatttttcctaatatttttataaaataaagatttttttattttaaaactactgtatgcacttataacaagaataagagtaatatcattcttactatacataattacatcacatttgttttgagaaaatattattttttattggtgatccactaacctcaccatggtgaggcaagtggatcatttggtgcaaattttcaagtcccttatacttaatacataacggtcagaaaaatcgaaacaaataacgatttgaagtatattagtccctcatttgttatccacattaaaaagtttgaataacaatattcaggtgagctgtacataacaatggagttgactattgattttacagtatccaatccacttaccccccggtaccttattacaactgcgagtccattttggtacataatacaacatgggtgtcctgaaaaaatgtttgaaggtcaaaagcgtgttctaaagataaagttttgattttctgttaaaagtggatacagacattttctatttttgttacattggcttgaatgcccccactgtgaatttcaaaagttaaattgttatctagcgtaagccctagatactaaacatcatctaattgatttattggaacccctgtttttgtgacagaattattgaagtgttcatcaactccccacggtcaccaacgccccatcccgtcccctatctatttcgcttttgaaagaaatcgcacattccaaagagggaaccttatttcaattttgaccacgtttagacacagttttaaaatccatttgtttagaaggaagctgtaaattctgagattcacttttcctcttggtcttggtagttacgtctcagacagtattgtacacttcaagaattattagaaaatcttaaagagcactatgatagataattatgataattttctaagaggggttttgacttgtattcatcatattttagaaatatgtgtgtaataagcaggaactttcttcataaagtcagatcatctaccgaaaaaaaaagttcagctatcgatatgacatccacgagcaacagccgcgaccttccagtttcaaacctacgcaataatcgattcgtcaataaacacgacgatcaaaagtcacccacctgatgatagtctctagaatccggacagaaacttcaaagtcaagatcgaacgagcgtctgatcaattagcatataccctctatactaaatctgtcttcgtcagcatcgcaaaaatggcaagaaacgtttgaacctgaactgcgcccgtgagatgaaacttgacagtcttcttgatcatcttgcggcgatcacctctggctctggtggcgagtgcgcaatgtgacgatctattgacgcgacaacagatttacgacggaaaacactcgcaacccgttagtcgtctcgtaaagcaacattacaaaaacaacaggtttcgtttcgaagcaattagagtgcgtttcgtttcctcgctttttttattgcattcgtattgccacttgatcaagtgcttttcaattttttttgttgcttcctttaccactctcggacgtaattaccctaggtaagaagtcatatggtttcgtcgagtggatcacttgatttctttctatcctggggaggatggtgtcaccggcaggtatgaaatgagatatagaaggaggcttgaagctgaagagttggattcccaagtatagcatagatggatgcgtaactggattgggcttttgaatgtgtttcgtaacagatgacgctgtctcgttgcaggatttgaacgttaaaccttgttttcatgtgtgattttcagatcaggagtaactagttaaaagcaggttgttatctactagtgtggaacaaaagttagattccacaccatgtagtccactttttggattgcatttaactgtgcaaaattcagctcgatcgatgaaactatattttagcgtcagctgttcaaagtttgtatgggatttactatagaaaaacttattgactgagagctttctatgcccacgtttccgtttcgcattcgtatatcgtgtggcaggaacgatgatactctatgcccagggaagtcaagaaaatttccattacgaaaagatcctggaccgactgggaatcgaacccagacaccttcagcatggcttttctttgtagccgcggactctgaccactcggctaaggaaggttcctcgataggtatttttacgatgaggaataatgccgaagaccgcgaaacaatccgacgcttgtagaaaaacttattcaattaaaacctgttggcaaagcgacgttcattagaacgtaaaggaaaaacaataataacaaaattgggcaaaatttccgaattatgcttaataactattttcacatgcatcagattgctttgcggtcatcgatttttttatttaactagtttgtttatttgaggctcaatcgcgtttgacgctttacgaaattcatgtttgtgttatttacaatctattgactttttcagtaaaattagtacgtgatggagccagggtactcgtggttactctaggttgttggtacaatggcgaggatcctccatccaacacaaaggggacaacacacaaaaaaaactggggaagaaaacacaagagaattaaacttttataccagacaagcagagaaaatcgtaaattgcgaccatatacatgaaatcacatctctaactgaaacatagggttgtctgcctcgggccgatacccattcaaaaattgtgctctggaggcgtccatattggggcccagatagccgtagcggtaaacgcgcagctattcagcatgaccatgctgagggtcgtgggttcgaatcccgctggtcgaggatcttttcttaaaggaaattttctcgattcccagagcatagagtatcttcgtacctgccacacgatatacacatgcaaaaatggtcaagcggcaaagaaagctctcagttaataactgtggaagagctcataagaacactaatctgagaagcaggctttgtcccagttgggacgtaacgccagaatgaagaaggcgtccatattcgggcactgccaaactacgtgatcgatgtcatcagaaccggaaccacacctttcacaagtattgcaggaatgtaacctccttcccagttggccaatcgctttgccaaccgtgacgagaattttgacgtactaaatgaaaaaaactcatcgtgtgaaattctgctatcataaatttcaccttcctcagcgctcacctttgcgagagagtccgccttctcattgccatgaattaggcaatgtgaggggacccatacaaaggtagtcttgtatgatctttcgaccagtgcacacatctgctctatcatttttgtatgaaagtaagatgtatgctttaaaagtttcatcgaacaaagagcctcaatagaactgagactatccgagaagatgaagaagtggtctgcgggcatgtttgagatcttccccaaagcgaagttgattgccgccagctcagcaacataaaccccttgcacggaaacgtgggcattcctgaagttttcgaagccagtagatcctttaatacgggacccgtcagtgaaatatgtcctgtaggaatagacattttggtactttgcgttgaaaacacgtgggatagttatacatcgaagttgatctggaattccatgaatagcttgttttatggacagatcgtattcaacaggggaactgtcattggtgaagcgtacacgtggaggcttataacatggaagacttatgtcagatgacatgtaatagagataaactctcatgaattttgactgagtattcagtttgagcaatagaaatataagaaattagaacgctaatgtcgctgcaaaccttgtgatcaacatctagtggacataatttaagggtggtactctaagtgtcaaaactctttgatttaatcatagtaacatgtttttgaaatcaaaataacagttcttgacaacgcacatgcgtgttgtgcttcattgaaacaatttgattttcgtatgaaaaacaagaaaactaattaactgagagctttctttgcctcagttgccattttcgcattcgtatatcgtgtggcaggaacgatgatactctatgcccagggaagtcaaggaaatttccataacgaaaagatcctggaccgaccgggaatcgaacccagacaccttcagcatggctttgctttgtagccgcggactctaaccactcggctaaggaaggcccctccttagatttacatagattgaattctttaaccaatggcaagacggatggcgactatctctttgctcccggtacttttcaacctgctgcaactcgactctgtatggtgaaactttggagacatgtgcgaggaaaacgcaaagatcaaataggacaattgcagttatttaagatgaagatgaatcgaagccaaatttaaaatctgaagaactgtacacctgtttgagtagaaaccttaatcgattggtcaccaccagctaatgactaatcgattaagttctcagctctaatgtttgattcttcagattagagcttttgaaaattggagatttggcttcgattcatcttcaacttcattattcagtagcttctcattcccatagcatctatcttccaccattagtcaaaattcttaaatagttttagtaatataaaatgacggaccaaaagttgaagataaagcaaataaacgttgttttatttcaatgaaaaattaagtacaaataattatacatattacgcatacgtgtatccgagcgaattctgagtgtccatttcagattcgtcctgccgttagcaccgactcggtatggaagtttttatccatctctcttgtatcaacgattataatcctcgacaaaaaaaaatttttggatggatcagggatgcgtctatatgggtcttgaagtgcaagaaaagtgtagaaagaagccgttttcaaatgatttgcagcacccttggattatgttttgacaaagtttgaaaatttggtatttttaatcacaaaatgggtaataagcaaaatatcaatatctttttgaattcaattattcaaccattgaatttgtcaaatcaatatgttttagcactagatgacttcagggaaacgtgcacaatttcagaagaatgttggcatcaattttatatatgaatttggaatgttaacgatcattaaacaagtatgtgaggatgtgcaccatataaatactacattttatttctatttcacacatctggttcattatataataattattataggttcaagaagcgacttgattattatttgattctttgctctattaaataaaacaataggcaatgcaatccagtaacatttgatttgaacaaggattcgactacggaaaatttatgtgtctgttatgtttatataggctggttgctttaataaaccctcagcagtaatataaaattaggttggacactgacatgtaagtggtcttacatgagctagtaggtttatcaggagacgatgacgaagtctgtgaataatgagagaatattattatctgcgatttctaaatattttgataggtactcattaagaatagattacctatcgtgagatccattctttatcagaatatccctcgaaattacagactaatgtaaaatagcaaccaataatccagtaatcaacattttcacattttttgcggcaccactttacagccgctcaggcaggcatgagctctttttgatccagtttgtgcacaatactaatcatttgtgaaaattggtttagtggtaacatgcatgcttcttacttttaagatgaaacaatttctggttaaaccatttccgatatatttttttagtttttggtactacatttcacattttttcggcaattttagtcaaatttttctaatggagcgttagtttcttgagatgttttcttcaatgggtttagttgtaagcatattagaaacataaagaagtcgaccattaaggttaattttaaactcgtttcccatatgaggccaaacgtgtccctttatgaacttccattcccatatcctctaaacaagtaaaagtgcttttcgattaagtgaaggaacaatttatccatccatttatgataaacaatttttcgaaacttcacataatgtctgtttttctttcttttagcaggaaggcatagaaaaacaagtgttttactcatttaaattatattgcaattatttgtgcaatttaacctaagtcccaaaactgaaagtttgattaaaattgccgaaaaatatgtgaaatcgaaaatggtttaaccagaaattgtttcatcttaaaagtaagaagtaggcatgttacctctaaaccagttttcttaaatgattagtgcacaaactgaatcaaaaagtactcatgtctacctgctgccggctttcgcaaaaaaaaatgtgacaatgctgattattgaattatttgttgttattttatgttattctgtaatttttctgaggatattctgataaaaaataatctcactataagtaatctattctcaatgagtacctgtagtaatgttatcataattttttacagacatcgactcttgataaaccacttatatgtcagtgtacaacctacatacattttgtatttctgctgagaatttattagaccaaccagctcatttaaacataacagacacatcaattttccgtagtcgaatccttgttcaaatcaaatgttacgggatttcattgccaattgcttcatctaattgagcaaagaatcaaatcctaatcaagcgtcttcttaaacctataataattattatataatgaaccagatgtgtgaaatagaaaaaaaaagtagtatttatatggtgcacatccccacatgcttgttcaatgatcgttaacattccaaattcatatataaaattgatgccaatattcttctgaaatggtgcacgtttccctgaagtcatccagtgctaaaatatattgatttgacaaattcaatggttgaataattgaatttaaaaaaatattgatattttgcttattaccatttttgtgattaaaaataccaaattttcaaactttgtcaaaaaataatccaagggtgctgcaaatcatttgaaaatggcctctttctacacttttcttgcacttcaagacccatatagacgcgtccctgatccatccaaaaattgtattttgttgaacagtgttaggatttaggggggcaacgtggcgtagttggctacacgttcgcttcataagcggatcgtcatgggtttctttcccagctccccaacaaaaaactcttcgtcaatccgcttgaaaactacacgagctccacccgtccaacaccatggccgtctgaaagcggactgacaactgaccctcttctgagcgaacatgctcttatgtacctggataacatgacgatcgacggcaaggaataatgaacttctctctggactctctctggaaaatccacaaatggaccgatgcacgagttcactatctgacgtttgagcggtgccgtgttatttacgtgaccatggcaacgagtgaattcggcaccgctcaaacgtcaaattagtgaactcgtgcattgatccatagatttaatcgataaagcagaagaaaaaaaaaaaagaactgtccgatttgaatttgctttggtgatgcccaagctggcgaataagagctcaagaagttaagtaaatagagaataaaaaaaagattaggatttggcttcacttacatcccgcattttactttccttttcacttcaggatacgaaaggaagtacaaaacaatcgttttgacactttgagtcggtagattgcgccaaaggaccgatgcacgagttcacgaattagacgtttgagcggtgccgaattcactggtttcatggtcacataaataacacagcaccgctaaaatgtcaaataaaaaactcgtgcatggatccatagaaaatcaaggctactatggttcattcattcccatcacaaccatcgtatggaaggaacagcgcctctagcgttctaaatctacaattttttctgtgaaatctactattttagcaacaaaatccgtgaaaactaacaattttactgtcatcttgtaaaatactaacgtgacagcattatttttaccaaacttctgtgaaaacattttaaagccgctctggtaggcatgagctccttttttcccacttataatcattgaaagccggcgtagcggtaacacgcctactttctgatcggtaggtcgaaatatcaattcacagttaaaccattttttgagttttttctttatgcgtttgttcaacaattttacagattggcaagttatttttcaccaaacgttcagctgttgagatcgaatttttatttgaaatcgctgttttctgctttcggaaatttaaaagtggttttaattcatcttcgccttatgctttcgacgttatggtggatgacggaacacagtttttatgagtctcaagcacacagtgccaaaatctctaccattattgaactttcatttacctccgttattttttacgaaaacgattagtatttaggctgaacattgtagctgaaaggttaaaaatattctgtcgatgaaagtttcccatacatttaatatgggacggtttaatcgggttttcttgaacatagaatggaaaacaatcattgaagttgaagaattccaattttctccaaagaattatttgaatctttctgtgtgtaaaagttttgttgggatcaacacatcgtcgaaaaaatctgaggcacacgacacttcgattataatcgaaattttgacaccataatacaaaatcaggaatatttcaagattttcaccaaaactatgaatatttccgatagtgctgaatatgcggttaaacccattcagatacattaataaagcttaaaaaagaaatatttcccaacaaaaactcgcttagttgtcctaaccaacaataaaagtcggaaaacttctcaactaaagtgattctgccgttatgaaatatttgacgaaatcactttaatttgcctaattgtcgcaggacatcactcaaattaagaagtttgctaaatcaaataaaacaaatctgtttaggttacaattgtaacacgccagcctgtgcgtttcggggtttaaagtaaggtggcttacgcgccactcctttcggagaccacctaccagtttagggcttgcccggtcgtagagacccctagggattgggtcaaattactcccgatcggagatatttacgagtcggcagacgtccaactttgcgaagaacaattaaaggggaaagggacaggatgacaaattacgtgaaacatacgaacgaaacgacaacgtataactaactcgctaggttctcatcaccggccgacctgaccaatcatcgaactagcacgaggaaaaataaggaacatcaatggttgtttcggggaaccgccccagtaaagtaaaataaattacaaacaaaaaaaactacgaccgaattaacatacaaaatctttatgcaaccatttattgacgactcttcactaacaaattaacaacgacataactttttccataaattccgcctacatttattcttcccacgttactctacaacatatatacagcataacataaattcatttgctcattttattctctcttcgcatcttcattacactagcctaggcctactctttgctttcccttctatctacctttctcttgtcgtcgttatttggataatgtgttcatgtgcagttgttcattcaggggtgttttttttttttgttttttacaagggggaaatctgcaaacagatcccctgagaagataactcagggaatgcggggatgacgcaccaacgacgacccgctaaaaccagcctatgcactgtgcatgagcaattcatttagaattgctcaagtggtgaacagtgcatcgttatttggataatgtgttcatgtgcagttgttcattcaggggtgttttttttttttgttttttacaagggggaaatctgcaaacagatcccctgagaagataactcagggaatgcggggatgacgcaccaacgacgacccgctaaaaccagcctatgcactgtgcatgagcaattcatttagaattgctcaagtggtgaacagtgcatcgacatgacccttggactcagaccctcatctccccggaaccaccttacggtatttcttcgggaagggaccagtgcatatagcacaacacgtgtagcagaagtagcctaggcaaactgcttctcctagccgacttaaacaatgttacaagggaccagcctcggcagggctaatcctctgcagccaactcttggtcggcgcgccatagacgctgaaattctaacataatgtgagtgacagccgtagttactgcattccagcactcggcatccgcacacattctctctataatattgtcgggggacgtgtcccctccgcatgtagtgagcatgcgacctctcacaacaatgaaacgggggcaatcgaacacgacatgctccgctgtttcctctacaccagcacaattggggcacgcaggagattctgagtgcccgaacctatgcaggtgctgtctatagcaaccatgtcctgacagaaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttacagttgaggtcgaaatacgcgtatctgtcaaaggatacaaactctagtggaaataaagtggtacagtactaaattcggtttttttcatctacttatcctttgaatgctttccttagggggtcaatgttcagaggcacgcgcgatattttggctacagcgctatcccttttgccttttgggcggcacataacatgtgcgaattgcttcagtcggaactcatttattgggtgatatgaataaaaaactttgaactttactacatgtagcatctactcaaaaacaaaatccaaaatgtagtgatttactacacttttggaatgaataaaaaacttttcgaacatgtagtacatactactttcgaacatgagcagtgactgaagctgcacgttaagaaatttccattcagagtgcagagtgattctgcacgtaaagaataatctattcagagtgacgcttaaaattaatactatcatgcatatgaagaaaatgcatggaatctaatcgattacgcgacaatttgcacaaatcatgaaggtgctgttatttgacaagatttgtagtgtaattttgcgattagtctggtacttacttacttatttggcgattagtctggtattctctctatgtctatgattttatgatgatggtacatcaaagaattttctgggtggttttcggccttcgccaacgccgatgatttttaaatactagcttaacatttatgaagagatcttgagattacagctatcaaatttggaaccacatattttctagcaccagtactgagattctggtgaaattgcggtagaattttgatgctctccgtgtgttttcttaacagtgttttcttctaagtgtttccgtgatattctcgttattttggtggggtttctgatagtatccttggaatgtctagaacttataatgtagagatttttatgagaattgtagtgattccattggtagtcgttagaattcaatgaggatctcccctaaaacaccagggttcccctttgaaattattaaaattcttaacgattccacaaaaaatcccattgaaatctataaaatatttaccgacattcaaaacgtttatattaaagctttactttgaaattccaacggaactggagatcaacggaatcttaaaggtttttacaataattacaaagattgattttcggaattacaaatattcacacaatatttcgcaggaatcccaccgcaatctcatagattcttacagaaataccgtctcaaagatacccacagaattccaagagattaatattcggaatcccattcccaccccaattctagagtttttaccagattcctaatatttccgcaatattcctagaatggtattaaaattttcagaattatcataaaaaatccgacatccctatcggaatctcaaagttcctacaggaattcccgaattcaaaaggaaatctgagatgttagaatttacacgtaaaattcagaattactttagcaatatctgaattcctaccgacatcctaaaattcctagaaaataacataattatcgtaatgccagaattcacacggatattacaaattgctactgccggtaatcttaccggaatctcagaattggctgagcgaaagttttcgtaacctcagaattcctttgcaaaactcaaaataccttccgatatatcaaaactcatatcgttttcccatgatttttactcaaaagtaaattattccattcaattccgcaaactcaaagcatgtgtagcaaactctgaagctaactaccagtagctttgtagtaaatgctacctctattcatagcaatgcgttgtttgtagtatgttcgaaaggtgtagaaaggaaaatgacacaaacatgttccactcgtgttccacatatagcgtttactaccgagaatgtagtaaactcaactttactacattttattcatacggcccaatgtggtttgaaggatgctacctcatgaacttagaagcatgttcatgcagggactgaatttgtttaccttagactggttcaatatatttaactatctaaatggactaatgttttgaagcatacgaaaaacattgaactaaacataaattaatcctatggtcgttacacaataaaatcaaaattaatagaagatcgaccagcataaatctaacttcaagatatccgttgaaattatagggtcgatttagcgtttgaaaataaaaattgggatatcaaacaaagtaacgatgaagaacaggtgctccgcgcagcaattttatttcaaaaagtgctccgcaatccataaaggctgaaaccccctgggatagattatcgagggaattttgcaatgatctttgcaagatttcggctcgtggacccttcatagagaccacagcatcatctgcaagttgtcgcagcgtgcatggttcttccaaacagttgtcaatatatttgacataaaaattataaagcaagggacttagacatgagccttggggtaggcccatgtagctaattctggaagttgtcagttgtccgggccttccttagccgagtggttagagtccgcggctacgaagcaaagccctgctgaaggtgtatgggttcaattcccggtcggtccaggatcttttcgtaatggaaatttccttgactatgcccagggacatagagtatgatcgtacctgccacacgatatacgaatgcgaaaatggcaactttggcatagaaagctctcagttaataattgtggaagtgcactaagctgagacgcaggctctgtcccagtggggacgttaatgccaagacgaagaagttggccgagagtgaagctcatgtgcttttctaacaacaaattgcacaaggaattatttattattccaggtagtccactatcgtgcaggctttctgacaatatgtctatggaaactgaatcaaaagcgcccttaatgtccagaaaaactgaagcagtggcgtagctagagtctttggggcccggtgcggagccagatttaggggcccctccgaaggaggtttgcaaaattattttattaccgaactcacacgtactttttttttaaacattcaatatattaattaattaactcattacgcgtggtaaagatggatgaattatgagtgacatcataaaaaaatcacgagctcaggttagattcgaacccacgactcttgtatgccagacgagtgctttaccaactaagctaccgagccacttggcgattcaatacctcggacggttacaagtttcaaatttaaacctaatatttgtaaaaaaaaatcgtgattaaatggtcaaaataatctctgcttgtaaaaaatcacccataccagggcgttattagaatttcgtccaggaaatagtttttgttgctacgtcttgtggatttaaaaaatatatattgttacgacgcgttagtgggaggtggccgtgatatggtggatcatatcaataagataaaaacgcgttcgtaagcgaacaaacaattttaataaaggactcaacgtgttaaaagtatacactcgaatgaatgatacgaggcacagtacaatagagcatgacaactatgatttgcggtatccggtttatgcttctgacgtctatcgtgtggcagcatgtagctgtcaccgatgagcccagctggaaagcgatggtgaatctgtgcgctgaggcagtgttcccaacgcttctgttccgttgtctcaacatctccccttttagaaccgttggtataggttgaacctcgctggcggtcttctcggtctggaagagcgacgaagtaatcttggctgtactgtcggcgtgctagcggcagccgactcgaagctggaagatgtggtgcttgaggacgaggacgtcaggtctgaattcatgaccggacaaggtggtgataacgatggaatccgaaacgtgtcgctgatgttcgaagttgtagctgttgtttcgctgcttgaacctttcgtggatgacggattccaagcatcgagaaggacgttcaatgaagattgaaggaactctgaaggaatttccggaggaattcaggacaaaattctatagaaactcctaagggtttattcataaatttcataacgccacaaatggtaatttttgacacccaccctgataacgctttttgtatgaatattctacaaattttgtatgagctataacaccacaagaatacacacccacccttagagcgttatgaaatttgtgaatgagccctaagctattccaagaggaactccggatgcgttcctgaagaaactccgggtgcatttctgtaggaactccacgtttctagaggaacaccaaaaaaaatctgcagaaacaaacacaaaatacgaagaaattcccgggggaaaagaagagagggtctgcaagaactccagaggagttccgaaagattttcggtcgaaatccggaggagttccaaggaattgcttatgaaatcagagaatttctggagactcaaatatcagaggaactccgaaggaattcacgaaaactctgcagaatcgtggagacgctagagaatttccgggaattcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccaagcgaccagtttcggtgagaacgttgaacatgacttgtccaactttttcaacaattttgccgggaatccagttccaggcgttcttggcgtagatcttgacgtagacaaggtcgttggcaatgaaggacctcatatttagcttcttctggtcaaccggtggtggtaccggtggaggacgctcggctggcggagaatctatgacaaaaggtcgaaagacaaaaggtcgaaaggacagaaggtcgaaagacaaaaggtcgaatggacaaaaggtcgaagaacaaaaatggagggacaaaaggtcgaaaatattttttcaaagaaggaaaaatttcccaccaagcaaatcactttcgaccttttgtcctttcgaccttttgtttttcgaccttttgtcctttcgacgttttgtctttcgaccttttgtccataaaccgctggcggacgtagcagttcgagacaggtgcgtatgcgacgtccgaacatgatttccgacggcgagagaccatcgggtgctgatgggtttggagtactacggtaggccagcaggaacgtttccaatacttcatcggttgaacttctcccttcttcgagttttttaatcgcacgcttgaaggtatcgacgaaccgttccgcctgcccattggattgtgggtggaatggcgcagtggttacgtggtcgatcccatttgttgagcagaattgagcgaattccacactgctaaattgggtgccgttgtcggacacaagcgtttctggcatccctaggcgagcgaaaatgctgcgaaggatgttgatcgttgctgacgccgtgatacggcgtgtgcggatgacttccggccatttcgagtaggaatctacggcgagcagaaaatagtcaccgtcgatggggccggcgtagtcaacatgcactcgttgccagggacggattggcttaggccacggtatgggtgtggctgctgcgggtgacttcgctgtcaatgcacaaggagaacaggccttcacgtaatcggccacttcgttgtcgagcgatggccaataaacgtagctgcgcgaaagtgccttcatccgctgtattccggggtgccctcggtggagttcttcgaggcatcgcttgcgcagaggagttggaatcactagcctttcaccgtgcagccttgcaccgtggagagagattcacggcggttgttgaaacggacaagttctcgatcggcgttactggctagggacttcggccagccttcttggatgtactggtagaccttcttgagcaccggatccgacttggtgctttgttgtactgctttaaaactcaaaggaaacacgttaaaactatcacatactactgacctcatatcacactccagcgtgacggatgcgattacgaagtcttcttcgggtttcgcatggtggttgatgaggcgagaaaggatatcagcgtcgccgaatttttcggttgccacgtacttgatggtgaagtcataggagagtagcgttagggcccagcgctgcaatcggttggctgtatataccgggatgccctttttgctaccgaagatgcgcagtagtggctggtggtcagtttgaagcaggaacttacgaccaaaaatcatacggtggaatttggttaccgcataaatgatggctaacccttctctgtcggtttggctgtagttgcgctctgcaggtgccaaagctcttgaggcgtgctggacgacttttattgacccatccgggaagcgatgactgatggtcgctcccaagccgactgatgacgcatcggctgacacgattatgtcaaggttggggttgtaatgggtcaaaagcagatccgacgaaagaatggttttgaatccgtcgaaggcttgctgacactgtgacgtccacacaaatttcgcatcgttcttcaatagttcatccaacggaaatcgtagagctcgcattttcggtacaaatttcccgtaatagtttacggctccgagaaacgaccgaacttccgacacgtccttgggcgccggcatttgcttgatggcctctactttcgccggatcgggacgaattccgtgctggtcgagcatgtgtgccagatattttatctgctcgcgcccaaatgaacacttctccaagcgaatcgtaaacccaaactcttgcaggcgctgaaagagcgcattcaggttctgccaatgttcctcctcattttctccaccgacgattacgtcatcgatataaccgcaagtgtgcttgagtcccgccagcatggtgtcgacgagttgctgaaaagctcctggggcagctttcactccgggcgccaggcgattcaccttgtagagaccccggtgagtgttgatagtgaggagcgtactcgttggttcatcgacggcgacttggaggtatgattccgacatgtcgataatgctgaacaccttgcaattggcgagcttgacgaagatgtcttgcggtagtggtagcgggtattgatgaggctgaatggcgtcatttaggccggttgaataatcaccgcaaattctaatcgctccgcttgctttccgtaccactacaatcggtgtggcccagtcagagtagtcggtgggagtgatgatcttcaagcgctctagacggtccaattcctcatcgacggcttgatacatggcgtaggccacggggcgctttggtcgaaacactggacgctggtctggcttgaggtctagcttcactgttgttttggtacaccgaccaagactggtgctgaaaacttgcggaaaagcggtcttgagccgctcgaccatggaggaagaggaatcgttcacctggcgacagaaaacgttcatcggcacggcatcaagcttgaacttctccaccaaatccaggcctaatatgtgcagctcctgcggaacgacgtagatagtacctacttgagttacgtcgttcatggtgatcgagcaatcgaactccgatagcaggttcaaaggatcgcccgatgctgtcttcgcattcactgatggtggtctggttggaggttgtccgagctgcttccaggtcccactggagacaacggtgatgtccgacgcagagtcgaactgtaatcgaaccgcgacaccgttcagaaagaccggaacgaattttcttctttctcgcacattattcactgacacttgaacagtctttgtctctactgtgacatttcttgatcgtcttttcaccctcttcttaggggtctttttgtcactgtcacaataaccttctttgtgtccacactggttacacactgaacacttatggtctttaaatctgcaatcgcgcacgtagtgcatcgatccgcatttccagcaagggctgggtggcaatttcttcttgccttcgctggacgaagtcgacgatgatggactggaggaatgtttccagggtcgggaatgtttgtggaatcgctgtttgatggcattcactgtgctgttggaagcctcgatcatggcggtatcgtgccgaagattcagcatacgctgacattcagcggacaactgttcgagagtaacgtcgttcttttcctcgattcctgccagcaaccgagtccggatttcggcatccgcttccgacgtcaaaccacagacgaaaatcagcactttaaattgctcctccgagagatttcctaactcaaattcgacgcacgtcttgttgattcgacacgtgtacgtcacgaaatcctcggcggaatttttagcgatttggaggcaacgataacgtttgcttatcagcgattccgaagctccaaaaagtcccttcagcttggttacagtttcggcaaaggtgaaatccttcgaagtccttggcaggatgaaactgcaatagcgctcgtgctcggagatgccgagctttcgcatgagcaacctaaccttagcctgatcgtcaagccgtgcagcgtcgttggcgaacaactcttcgtaccgcgaaaaccacgatgaaaaggtgatgctgttctcggtgtcataccggaactcttttacgttcgatgccaacgagtcgagaatcgattcaggattcgcaggaacttggacctgaatgttccgaagggtgttctcctgctgctggatgaacacgcgctgctgctcgttggattgctgctggttgcgaaggagctcgttcgtcacaagctgctgctgctgaagctggttaagcacctggaggatgagtgcatccatggccaacggtgctccttgttgggcgtctccgttcgacatctcggaatcgtcctctgaaggcgatggaagcttgcgctttttccgcgtgggaggcgcgattttggattttcacttttaacttcgcgaaaacgaaacaaaactcgcgcacccgagtcgccactgttacgacgcgttagtgggaggtggccgtgatatggtggatcatatcaataagataaaaacgcgttcgtaagcgaacaaacaattttaataaaggactcaacttaacgtgttaaaagtatacactcgaatgaatgatacgaggcacagtacaatagagcatgacaactatgatttgcggtatccggtttatgcttctgacgtctatcgtgtggcagcatgtagctgtcaccgatgagcccagctggaaagcgatggtgaatctgtgcgctgaggcagtgttcccaacgcttctgttccgttgtctcaacatatatgtaaagcgtttgcctcagaagtttctatatgtttcgatttaaaaggatctttagagatattcttgaataacttttgggggacggacctggtgtagtggttagaacctgagacgagacgaagacggtcttccttttctgtgattgctgagtttttttcttattccactcttatttccacattgtgcataccaattatgcgcatgctgttcaaatcctcacatgaacctctcagcaaaaaatgattaagtttgcatcacatcgaatcataaatagccatttaagtgaaatttcatgccagcaaacgtagcagacattagaaataattaatcttctgcttagatttatcagcaactttggaaaaaactgctccgccgactgaggtttttaataacagtttactttgaacacaatacttttcactttttcagccataaaaacggtgggctgcatttgacgtttcgtgagaggggaatctgggctgcatatgacgttgatatttttcctcttcgcgagtctctctcaggttagaaccagtgctgggaatggtaaaagtagtaggcttgaattttcgcgaaaatcacgtggctctccagtacagtagttcaaaaacgtgaatctcatcaagtagcctatgttgggtgcaggaattttctaaatcatgagtgtcattgaaggctctaaatgcgggaaatgcagcggaaaatagaacatttttctacagtaattttgggttgcccttagcaacgggtgttttgctattttcaaggcttttgcctacagcagcgatgggcgtgagtttcactggcttcactgactgtgattggctttgcttggctactgtagagtgaatttcaagacttttcccactgacaaaaaagttttagtgacgacttccttcggaagggaagtaaagccgttggtcctgagatgaactagcccagggctaaaaatctcgttaataaagataaaaaaaaatgaataactttctgtacacacgtaaaacaaatcgcagtatcctgtgaaatgaatcaccgaatttgaactgtaaacaataaaaacacagattttcctgtaaaatctactattttactgacaagatccgtgaaatcagctattttaccggagaaaatcggtgaaatcaactattttaccggaaaaaaaatccgtgaaacaaaccattttaatgtaaccctgtgaaatactaacgaacagttcggtaaaagcattttttaccgaatttctgcgacagccgcttgatcttccttttgtttcagtttttgcacaccactaacaagtagtgaaagctagcttagtggtagcaaggaattcctgatcggtaggtcaggagtttgattcccggtcgaaccattttcttgtttttcatgattttgttcaacgattttacagattgttcggtgatttttcaccgaaccttcagctgttgagattacggtgaaatttcagcgtaatctgtaatttttttcagtgtgtacattgtacggtattaagtagtatgcttaggattattcctagttgaacttcttgagctctcgtgaaaaattcttggaacatatttactatatatcagatgaaattgctggacaaatttcagatattcttgtattgtgctaattactgataaattaattagcaggctatgttatgttattttatgaggaattcccagcgaaacttatagagttgtccctagagaaattttttcaatgctttgtaaaataaaacatgcacagatttttctgcagtaaaaatctggaacttattgaactctgtcgaaactccttaaattcttggcttttttcggaactttttgtaaacgaaatcttagaagaaattttgctagaatatttaaaagaatgcttaaaaaactagtacttgtagttataaataagggctcactgaaaaaaattgaagggcaaatcccaaacgattgccattccatttatctgaggaattctcgcaaatttataagataaataccataaaaaaatctcagataaatctcaaggggtatatttcaaatacgtgaaataattcgtagaagaattcttggagttaattgttaagaaatacttgcgaaaatcaaaggtacgccaagaaatcccttcaatggttttcaggggaaaatgctcaaaggtcgccttagtgaaattattggttgaaaccttgataaattcctagaatgattcatgtaggcagtcttgaagaatccttcaaaaagaccaaagtgacctattcggaatccttaaggcaatttgtttaagtcccgtaatgaattgaccaccatataggcttatattatgaaatcattactagctttatcatagtgattttaagcccgaatcaattcttcaaaaaataatataaaaattcctgatagcattactcaaaacattctgtagagtttttacatgaaagcactggaaaaagttccctagatttatggttaatcttaattctgtagaaatccagttaggatttctacaaacattcatgaaacgaattcttagaagaatttactcgtttaacgaaatctctcgaaacttttaacaaaaaataaatgttggtaaaattcatggcaaaattgcgtataaattacaaggagaaatttttaaagaaatatccttatgaattgttttaattggtgttctaaaatgattaaaaaaataatacctgaaaaaatttcgattaacaataaatgtcttgaagcagtcattggggttctacagtgtaagtgattattgtaagaataatcaaaatacttttttaaacaatttcaacaagacagggtattaacgtttttaatttcaaataaccccatggaacaacgaccccaaggacaaccttgaaacacaaaaagcgtattgttctgttacatttcaagaaaaaaaaatattaaaattaccctttttatgtattttatttgtttgcaccccagtttgtaccctgaatatttttccccgccttgagccttccaagtggtctcgaacataaaaaaaaaactagtatttgcaccagtctttatattttaataaaaaccaaaatacacatattacaaaatttattattttgaaaatattttgaaatctaaaaactgtacactcatttatcatattgagaaggtatctgtatcatttctgaaatgaaaaacaatgataatggttaagatcgtaggaaaatgtgtacaagctcaaagctcaccaatgctctagatttttggagctcatcaaaattaggtagatttgatttgaaataagaattcatgttcattgttgtagatttacttcagcctagttctggtactgagcctgaacacggacgctcagggaggcctcaacacacacctgagaccctacatatcgaacccatcaacacacgggccgggaccaacggctttacttcccttccgaatttatgccttagaaattcctgacggcgtcgacgggaattgatacccaatcgactggggtgagaggccatcacgcttaccactacgccaccgacgccgcttatcgaagtctcagttttctcatgagtgcaatcgattgaacaatatcaaggaaaacaatttaaaaaacaaatatttgtgtaggcccctaaactgtgggggcccaatgccatggtccctcgagcccctcgacccattctgaacctagctctgaagtattaaaaataatggataatgaaggggcccctgtacatcgctgatcctccaaaaattatgcttgtcatgttcattatctttttgggatctttcaaattatgaatttccaacaagctatgtcgaactgtttatattatgagaaatccgccctgcgattttggggcccccaggagctcggggcccggtgcggaccgcacccaccgcacccccctagctacgctactgaactgaagccagttgctccttctccgcagaggctagttgactacactgcggaacacatttttatctcaagcaccaaaatagcgctatttactaaattaagggtttctgagtctattgccgttttcagaaatatcatggccagtgaataaattgttacccaacacgcagcaacaaagacattgtcacctcctattcttgttgcaacaatttaattctgcaacatgagtttatcatcacttgaacagaatatgacaaagatcgatcaccacgtgcgcagcgattttctgggcttcgcattgcaattttcgagaactttctccgtgttggtaaacattgacacattatcgaacagcatccataaaacaaattcggttctgtgttttaaataactgattaatagcgagttgaaaaggttgcaacaatgttgcgctctgtgattgtcatgacaattttgcttttgattgtgtccttatccgcaacagttgcgacaaacggttgtgagcgagctagcattgttgtttgtttttcgtctattttgatgataatttgattcactgatcagtgatcatggcacgtctagtttacgaatattggctgttgaaaatccaaaatttgactgtttcagccaacttgcatgcaagtttgccagcttgtacagcaatttatttgcttaatttgtcacagaattcaaacttcatgcataaaacaataattatcaataaaattcgtaatatttttgatggtaaaatgttattttttggtggttcgacgaattttatatgaaggctgcaagcatgttgaaaaaatctatttaaactaatttttgtcgtgaaatttcaactaaattgtttctaaattaacagttaaagtcctatttaacatgtatggtaaaagtttgataaatcatattttaaagttcatgtaaacatcaataacaccagtgttttatacaactttggcgacccgcagataaaaattgtgacgtgcaggaacatttctgagaacggcatcagcttcagcgacccaaaatctacatataatttgatccttgagacacgcaaaaatgtaatttttgtcacactgtgctatctgataaaatcaacactagacaatcgtttgttcctttacccttgcgaaagccaaattgagtactgaaaagcatattgtttgattcgactcattgatcgagtcacaatgggatcattttcttccaacaatttgcactggccctgccccgaagaaataccgtaaggtggttccgatgagtgaaggtctgaggccaagggaaatgttgtctacagaatgggatctaaagaaagggaaatggtatacagaatgcatagataccacttacagtgcacggactaatttgagagggtcgccggtggggcggcatccccacagttcctgagttggtttctaaactctgcgttcgatggctataaaacagatatcgcacaaacgcacaaacgttccgattactcaccagctttatcttttttttgcgattcttttcctcagataacaccatttgtacccaactggcgtcatacaacacagcgttttgccgttacacacaatccgcatccttcaaggaatgaccatcgaaatggccggccttacgacgtcggagatctgcgaaaataccaaattggcacgagagatggccgttatggggaactacgattcggccggcatctactacgaaggagtgctacaaatgttgcggaagctgctgatgggtatctccgaaccgattcggaaaggcaaatggaccatggtaggtacacaatatgtacctaatctgtgcggttttattaacttctttctttttcgccgtagatccagcaagaaattaacaaggagtactcccagatgaagctgattcagaagagtttgaccgaaattactatggacctacagaatgcacccctccaggctcgaatccgcacgccattacacgaaacggccaaccgagatccggccgcgtggttccgagcggatcccgatgtttggatgccgccgaacccgaaccgagatccagacgtttggggacctccgcccgatatgaacacatcccgctcgattgcctcccgtaaccaaagccgatcgagcaccactttgaatcgcaaggcagaagtcaacaggaaaaacgccgttacaaaatcggccacctcgacggccatttccggcagaaagacggccagctccaattcacggacgagtaacggaagaactggaacactacccaggagcaaagcgaaacaaaactcaatcgataccggtcctgagggaagcaaaggagagaagatcgacaaggagaaaaatgatgacgacaaagaggaacaggaaaaccaagaggagcccgaacggaaatttgaaccggccagtcattctgatgtggatctagtcgatatgctggagagagatattttgcagaagaatccaaacatacactgggacgatatagcggatctgcatgaggccaaacgcctgctggaggaagccgtcgtgcttcccatgtggatgccagactatttcaagggcatccgaagaccttggaagggagtactaatggtgggaccaccgggaaccggtaaaacaatgctagccaaagcggtagcaaccgagtgcggcaccacattcttcaatgtgtcttcatctacgcttacgtccaaataccggggcgaatcggaaaaattagttaggttacttttcgaaatggcacgattctatgcccctagcaccatatttatcgatgaaatcgattcgctctgctcaaggagaggatccgaatcggaacacgaggcctctcgtcgggtcaaatccgaactgctagtacaaatggacggagttagcaacgacgaggccaccaaaattgtcatggtcctagcggcaaccaacttcccgtgggacattgatgaggcccttcggcgacgtcttgaaaagcgtatctacatcccactgccaaacaaggaaggtcgagaggcactgctcaaaatcaatctacgcgaggtgaaggttgacgaatctgtagacctgaccacgatcgcgactcgcctcgacggctactcaggggcagacataacgaacgtctgccgggatgccagcatgatgtctatgcggcggaaaattgccgggctcaaaccggaacagattcgccagctggccaaggaggaactggacctgccggtttcaacccaagattttaccgaggcgatggccaaatgcaacaagtccgtctcgaaggacgatctcatgaagtaccaacaatggatgcgagagttcggttcgtcgtgatcccatcggtgtgttcctccgggaatgtccggacgagagaatcgtgcaatagtgatcgcttgtgtcgttcgcgtcgccatcaaaactcagttttaaacaaatgtttcattttgtgcgttttattttgtctttttaaaaacgaaatgttttattttgtttttctgtgaacatagtcgttcaaattgttccaattttgtattctaacattcacaccttaaatgcatgactgatatctggattgtttaaatatgttttaaaattttcgttaagcgcgttactttacgctcattataattttgcgacggcactaacacacactcactttaacaatcgaatttgtgattgaataaaaatcggtctgtacgtttattgctacttttctcacaatatgcttggtcaataaaaaaggatgaagatgtttaaggataaacaatatttaaaaccttcctagaaaactacaaaatatcactagaattactaaaatatttgataagattaattttattaataaattttaaattgtaatatgtgtatgccacttttattaaagatatatctaaaagccatatcaaagagttgtttctgctccattgcacaatggaaataaacggacccataaccacaacttttaaaaaccgctcttataagcaggtgagttgatgagagcaaaaaaaaaaacatgttttcaatatacttaacctaacttaacctaaatatataacgcattaatcgtggcaatagaagattgtaacgatttttgactgaaattattaaatattttatttgacatttgttccaatgtttcaacattggatattctatgtaactcattggtacgttggtactataccagggaggaagcttcagaatcattttcaaaattttattttgaattctctgcagagctttcttcctggtacagctagtctatattggtacagcatacaacatggctggcctgaaaatttgtttgaatatcagaagcttgttcttaagacaaagttttgattttctattaataagaggatagagacattttacatatttgttacatttggcttgaatttcctcaatgtgatttttgaaagtttaattcttatctagcatgagccctggaaatttaacttcatctgaccaatttattggaaaccctctcatcgtgacaa

SEQ ID NO: 100 - DNA, 47303 bp, Aedes aegypti
  misc_feature (962)..(1061): n is a, c, g, or t
  misc_feature (12519)..(12618): n is a, c, g, or t
  misc_feature (20477)..(20576): n is a, c, g, or t
atcagtttaatttttttttaacaatattagtttttttttcaaatcgacttatatttttgtcaaccgaactaggtcaaaaaactaaatatgaagttttgtagggaaactcaggagctttcattcgcagtgtaccgtagtgaatcgaaatttggacggtacctatacccggacactcagataatatttaccaataaaatgctaaattgaaaacatttatacaattatattgaatgaaaaaatagctgtttttgtatttattacgacgtattggcttttcggaggtctgttcaacaaactcatcaatgtccccgatgagatcagctcaagggtataaatttattggttagagataatcgtatagcatatttttattacttacatttggtctcttactaggcaaacaaattcaaatttttaaatttaatataagataattcagggctctatctgtgattatttagttttattaaacatatagtaatcatatataaataataattcacttaataaacgattttgcattcacatcgatcaatcaacaatgagaaggtattttttcaattctcattaccccacttgacatttcccccactcattcgcatgaatggtatctacgcgttcgaggagggcttagatggaggcaatcgtcgcagcagtagtgattgtaacataaagttatagtgataataaatcttcgagctgtttagtagaatacctataagtagatgaaaaaaccgaatttagtactataccatttaattccactagagtttgtatcctttgacagatacgcgtatttcgacctcaactgtaaggccgtcttcagtgtcgtgtactagactcgacttgaagaaaaccatcgtatgcacacattatatattaacactaggtacgccctaaacgtatttccctaccaattattattttttaacttaaaatttatgagctttaggtacattccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgggtctatacccaggtgatctagtatacgtaaagcaggtcggttttctcggcgctggttttctccacaaagttaaaatctgattacacctggataaatacattgtttataataataatcaaacacggtttgtctaatctatctaaaattacactgaaatgtgtgatcaattttagctattgttaatttctcatttaaaaaattttgaattgtttcaaatatctgtaaatttgagtttttgggtcatagaagggctgttcagcaatgcagagttctgtttgatctttcgaccttgacgcttgtttttgccggagcgagcgacgagggcaggatcaaacatgtcgcgcgtcggtctagtaagtgaaaaagtggcgtgatcggtaagttcggttggagtaagtaaaaaagtgccgcgatcggttagttctgttagatccttcgaccttgacgcttgctcctgggcagtgcgtcaagaaagcccgagcagtcgtcagttttttttttccttttcgggtcgcgcgcctattatttatctgagtgcttttatattgccgagcaaacgagtgaagctgaaagtggattgtggctgctcagtcaaggataacggatcaattggtaagctcgtttcatgctactatttctaatctataaaatatgaatgactgcacatttaatcgttacaatggtgggacgtaaatataatttttcaacaaactatggatagttcgtcactgtgagtgtcgacacaaactcttattcatgatttatttatgtttaacatttattttcagaacacctcttatttaccttaatttttgtgattcgacactacaagtggagacttgcgaaaggttcactttattcaataaactttggatggttcgccactgtaagtgtcggcataagaataagagtgttctatgatgtcccaaccaatcgagttgggaatgagttataatataataacacatgcttttgtcctgacagctgtaggaatgttacatttaggtatttgttcaacaaactttgaatggttcgtcacctcaagtgtcggcataactttcctctacatagaaattgttcatatcaatgaaaatattttatttacatataagcatgtatatatcacaaattattgtttatcatggtctattcgcttatcaaagtgaatcctgtgacccaacgatccttcccattaacaaacatccctcccagtaacctttgtggagatgcagaggcaaacacggtctccaaatagcaaaggttacacactaacattccttcccccaatcccacctgactgcaaggacgtggccggcgccgttattgaccctgtatgaatagaggcactgaattatgcacactgaagaagattatggccaatcccagccgaacttctagttgattctttgtgcattttcactgacttcggtcaatcacggaatagcaaccattgatatgtgtagtcagtctaagctaagctaagctaagctaaagttaaaatctgattacacctgggtatagacccgccttggtagagaatagtctttgttaatcatatttgggagaaagcgagtaacttcaacaacatcaaaaacatgataggtacataccatgaacatactcacgaaaaagctaaaaatatactaccactatgtttataaaagatttaattgtaaaatttttcttcagtcaagcaaacgacaccaaactagtcagtaaaaacttaaaagtgattttgtttattaaaatctaacgagcaacatgagtagtcgctttctcaactgttgcagaccgtttgcagaaaaaaagtgttcgaaagagctacgaaatctcaccgaaagcaccatagataaactgaaagcggctggttatgctccaatgtctacattgaatacaaatttacgcatttgtacgtcctgccgtttaaacgttgacaaacgggcaatctgtacatcatcggtggatcaggttgcaggaagttcgaaaacaacaacaactgagaaattactagagaaatcagaaagatatatttcatgtctgatggagcagcatcgcagtacaaaaaccgtaagaatttttcgagcctatgtcaatttaaatcaaagtacggaattgatgcagaatggcatttctttgctacgtcacatggcaaaggtccttgtgatgctattggaggaaccataaagcgcatggccacaagagcaagtttagccaaagaacgtgagcatccaattaaaactgcaaaagaactatttgattgggcgaatcgcagaaaagaagaagatttaacaaaattatcattttgttttactactactgaagagtacgaattaacggcatcagagctcagcgagcaatataataacgcgaaaacgatccaaggaacccaaaaatttcactgtttcattccattgtcagaaaataaaattaaagcaaaactatactcgaactgtactgataatgatgcaaaagtgttcgatattgtaaaaaaaatgaataacaataaataaataaataagtattaataaaatgttttcatgacctcataacgcatacccaaatccaaaacttttaaagtttatatataacatttagaaactcatcgatcatactctaaaaaaaaatatcctggtaaaaaaaaatttattttcgtgtaatctgttaattcattttaatttatacatatatacatatacatataatatttatacatatacataatatttatacatataatatacataatactaatgaatacatgaaaacgacttgtttaattcacgcaaggcccttaacaataaaatcagcaacaaactgcggttcccgtaataatttacaccgaaaaaaaaaattttttttctactaaatgtgaaaattgtgacatgtttgaaatatcataacttttttgtttattggtttaccatcaccaaatttttatggtagatagctaatgtaatggaccgttttccctcaaaaaattacgttggtattccgatagggagtttgagtttttgtgtcaaaaattatgttttttaatgcaaaaaaaaatatatttttttactgtgtgtattttttttggaatctttatttagttgtctaactttgtttctttagttgtctaacaatcgaacgaaccgtttttgctgtgcagctttttgaatatttttgaaccattttcacatacacccttttgaaaagttagtcgtgactcaacttgaagatttgatatcggaaaatgacgatttagatggaactgaaaaactgtgcaaagtttcagctcaatagaaaaaaatgaattaaaaaatttaccaaattttggtgctgttgcttggaatcactctatagttaagttgattttatctgtcttcaagagatttttttttcattcaacttaacccaactcaacctcaatatataacgcattaatcgtggcaaaagaagattgcaacgatctttgtttaatattgtcgacatttgtccaaatggttaaacattggatattctatgtaactcattagtactataccaggaagggagcatcagaatcattttcaaaatttgattttgaatcctctgcagagatttcatccttctattacaaacgctagtccatattaggacataccccatggctggtctgaacatttatttgaagatcaaaagctttcatttggcttgaataccctcaatcattttgattttcattaacgtgtttatgataggccgcattttactttcacccctctgaagttagaagaagaaataacatgatataattatataaagtgatacagttgtaggtatcaataaaatagtgttctggtacagggaaagttctcgtgtcgttcaaaatcagctgttttcattgcttgcaaattcaaaggctgaccacagttaatcgatattccaaaattatttctcgtcacgctggattgccaaataggaaggtatcttcgaagatcactgttaattggaagacaaaatgttttccaacattgttttccaatcacacgatgttaattctgtaaaagtacgtcaaaaactaaaacgttataaaaataataagttaaaagagcaaatttttccaaaccaccaaacagctgtcaagattatcttcgaatgatcaagattgcgagatgatattttttcacaagataaaacagaaaggacagatgataaaaggccaaggtttatacattcagaccctacaccccaccttttctctatttgttttaaaatatatagtcgttaatacataacgaaatccttcaataatttcgattttgacctgatcctcttcgacgcccttactgtctcttcggaactaccttctctcggattactttttttaataggattgtagcacttctagcaaagctagaaacttttacctaacccaagggggtgatcactctacacacttcgccggcacatattttttccagctgtgccttcgaagcgccaaggtgcgccaagcgcgcaaagcttgctattattcgatatgctataaaacacattgaactgaaattataggaaatcaatctcagcaaacattgacaacagtaattttcgtctaatttttcttttcaatgggaaggtattgctgtgtgcatttgaaacgcaaatatcaaatgcgggagcaccaaacgcgataagatttatcacaaataatgcgaagtcaaaatttgattttctttgctaggttggcggtgatatggatcatggttgctaagtatcctttgattgctttgtgttatcgcatttgaagcccagttagccaaggtttgcacgtcaaacgcaaacagtaatattggaaacggcccaaaacaacaccagtactgcgataagaagtaccagaggttatatacaggataaaatctttatgttaatgggacgtgatgaagagaaacggagtgtatgtggagcttttactagtagaagcattaaccgaagaatgctaatgtcgctgctgttcgtgttaccaacatctagtttgccacgaactgacagcgtgagtaacgggcctcaaagtgtcagattaattttaagaaccaaaacaacatcatggtattgaacaaacaatgaaaaaccataatttaaggtaatagaaattgaaatcagttttgtgacaactacgccattagcattctactactaatatttctattcttttacttgaattattgttgacacctacgaattaaggatataccgttttcattcatattacggacacttaaggacccagcatagagcatacaaaataaatcattatgtatgataccttagcgttgtcgagcgtagaaagcccttatctttcgaatggtgggtaaagaatacgcttcggcaacttgaataattttaaataaatcaaaatgtgtggcctttgcatgattcttattccggacgcttcctcacttttgcctcatattccggacactttgaatcgaattccgaacagctcatgataatcattaatggaacagtcaaattatcatttgaaatcgtcaaaccactaaatagacatccaaggtggttgggcattataaattttcgaaggtatttatggaaaaagcttactaaaaagagcctcgaaattgagaacttttgaacggcaaaaattgaaacatttcgtgtgaaatgtttcccatacaaagtagagtgtccggaatttgaagctgtccgtaatatgaatcaaaacggtagcccaagacctattcagcgctaacaatcataaccttccacttatccaaaagagcgtgtctttgtttcaaaacataatttcttatctcccccgtttcctcccacatttaattcatttatacttccagagctcggtatgcgtttcatgcatagtgttaaaacactatgtaccgatgcacaagttcactatctgacgtttgaacggtgccgtgttatttacgtgaccatggcaacgagtgtatacggcaccgctcaaacttcaaattagtgaactcgtgccaagttccatagtggacgaatgtcactggtgttcttgtcctcgttctagaacaacattttcacgttatgtccaccagcacatgattttccaacaggaacgtcagcaacattcttcctctgtagtctattcccataacgttgatctgaaataatacaaaattgatgaatagaaaatatgaaaatgttagaataataaatatggaaaaattttcctgtcgaaaccaacatttgtttttcattatttggcaggaagcaaacaacaaagacaaatcaatggttgctaagaacaaaatttcagttcactgtgatttttatagcaacccattataaataaaattgtgccagttggtgtgcatagatgtgcccaagctacgcaaggcacactgtgtagagttaccgcccccttgacctaatccggttatctgggagcacatggggtttaggcatgaggtcgatcctgcgattccggtggaaggaaactaccggttcacaggcgccccaacgatcatttgctgtttcgcgatctactaagctaatccccggcttaggatcgattctcaattccggctggagggcgacttccggttcacaggcgcctcgacggcttattaccgatactacgttacgctcgttctactcggtctagtctccgacaaaggatctagcccaatgtttgttttgaatctatattgcactaatacaatcaaacactgactttctcctcatctcttatatatcacattggatctagcctactccaatcgtcttgttccgctgctcttctcgccagttgcgctgtaagccagacattatatgaaccaccatgttggtcatcatattccaaagatcgggatcgcttatcattccgtgtactacaccttctacgctgaagtactcaacaaaagcagccgccaccgtgtttcgttctatcttgaacctcgggcagtcgaagacaacacgttctgacgtttcttcaatctccatacactcaggacagaatggtgaagacgcatggccgaatcgatgcagatactgcttgaggcagccgtgacctgacaagaactgtgtcagctggaagtgcactgctccgtgttccctgttcaccaaggccgataaattcgggatgagcctgtgggttcaccttcctttctcgaaggcaccccattcttgctgcaacttagccagcgaatgaattctttccaacttcctcgcctgcctagtttctcttcactgatagcagtcgatttcttcggacaggatatcatcccggcgataacgcatgccgcctccgacgatatagtcctttacgcgctcaccactagcatgttgatgagtcggcacgtgctgtttaacttatccagattcctcttggtctgtagcggctcgccaaaagctggcgcaccttatcttatttagtacttagtaccgctactttgcggtgttgatacgacagccagaagacgcgtacttctaggaccacctatgttgggcataagtcttgtgagcgcattgttcgtcttcaccgcaatctcgcttccataatcgacgtgactgttgaagttcagccgaacgtctagcattacgcccaggtgtttcagctttcgctgtgatgctatggcatgctccccgacagtgatcttaccgtacatgactgctttgcagttgctaactagtagcacctccgtttctccgagctatcttcagcttgactccctccatccaattttcgactagaccaattgcatccattgtcgcatttctacttcctccttcgtctcacctattaccgttaggacgacgttatcggcgaagccgacaatctcgacccccttgggtagctccagcgatagaaccccgtcgtacatcgctttccacagcgttgatcacagtattgaaccttgtgggactgtagctgttattcttaactccttcgggccgccgtcggtttcatacctcagaacactgttttggaagtagctcttcaaaatctaacagtcgggacagtagtcgggaacccgcattctttgcagcgcagaggcaatggcttcccagctggcgctgttgaacgcgttcttcacatctatcgtgaccacggcgcagtaacgatctcctctacgcttttgtttcaatgctttttcggccctctcaagcactggccttattgcgtccgccgtcgaccttccttcccggaatccaaactgcctctctgatagcccgttctcgctctctatgcatttcatcaccctgctgaggataacccgttccaagagtttaccgagtgtatccagtaaacatataggcctatatcaggtccgacccactcgagctcagattgggtaccacttctagtactgcatttggtccctcggtagtataaaaggtacccaagtttgacagatcgtagtacacttttcacggcattctagattaccttatgagccataaaattttgggcaaatgaaaggtacatggaggtctttaatttgtctttgcctatatgatgctggatctccgggcggttttcctggcttgggcaacagtaccagtttctgaattttccatatttctggaaattgaccttcgtccaggcatttctgcataaccttccttaccatatctggatacacaaggaccgctgctttgagtgccacgttgaggattccgtccggatccgggccttgttcagcttcagcgctttcacagctgctataagctcctctttggagatctcacgagcttcggcatttcctaccacttcattgccatatggtgtggccggccacattataggatcatgctttgggaatagaccctcgacgatgactcttagtttgtccgcacatgtttcggccggcgttgacgggcccttgattttcgccattattactcagtaggcatcctcccaatgattagcatcagctgctcggcacagctctttgaagcagttagacttgctcagcttaatctctcgtttgaaagccgttctggcttgctggaacacaattcctcgctcttctcggacttcttcgtacctcgccctctgatatcgtctcctggcaagcggcgtgaagagcgcagagtgccaccagtatacgggacacgggttgtttgatggcctctattgttttcaaattctgaagcctgatctgtactatcgttttcatttgctgaaatgagtttcaaatgaggtgcactttttttgtattctttacccgattcacttgaccgaatcacaacttcttactaaccacactgtactcttccggtccgaattctgaactcagcttattcattcatatctttcttcattcgttttgccagcacacgctcacccaccttaaaagatcttttttttttctctaagctgtttggatccctgacctattcagaatcaaatgtcgtcgctggaacatatggtagtttggttcgcattttacgaccaaacattagctcggctggggccttcccggttgtcaaatgataatctgagtggtacatcatcagatacttgcgcaattcctgcctccagtcatggccaagctcttggtctaaactgcggtccgttatcggctcgaagtacttcgggtattccgtatcggaaaaatatagaaagcatctctctaattgtcgatgatgttgaaacatccaacatctccacaaccttatctatatctactatagtaatctatatagaccagtaaattctctctgttcggtatagaaccgagaaaatccacatcaatatgttcccagaactgctacggaacatcatcggttctggtgaatttggtgctgacaccaaggaacattcacggcatgccttgacaaatcgttcgacctccaggtccatttttggccaccaaacgtttcctcgtaggtgtgttttcatgatccttatgcccggatgtccttcgtcattttcgcagcggctgtaatcacttcgttcaccgctagctcttctgcctcatcgaaagatgttgggacgaaggtcaaaaggcgagatagagcatcagcgaaattgggttttctcgaaatatgtacgattttgtacttaaggtgaaacatctcggaatccaaagatggccgacttgtgcccctattcatgttttcaaaggcactaaactggagaaatagttggcaaacgtttctgatcttcttattttaagctttttgctagtgtacaaagccaaaataaaaagttagctgttgttagcgagatttgtgtctttgaagtttcagtacaatcttagaagttgatcccaaactgtttcaccataaggtgaagatgcatcgaagccaaacctcaaatttttaaaagcacaaatctggagaactaaacagccattgaagccgacaacttaaaacttcaacaaattcaccttaaaactttggagatgcaatacccatcgctcaatgcgcgcacatagacggggcacggagatgaaaagaaaagtcagcgctttgcaatccgtcagtaggttaagcttcttaccgatcaagaaaatctgaaatctttccacactccagactaatgccaatgcttccttctctgtctgacagtaccttctctcagtatctgtcaacgacttggaagcgtagcagatgacatatgaatccccaatcgagtctgtttggataagaacactaccaagagcatgcggacttgcgtcggcaattacagatgttttgttttccagtctgtagaaccctaaccttggagcaaacttcgtttcactgcacgaaacgcagatttctcatgatcacctcaatgtaatttaacacctttttgagttagtcgtctgagtgactcgtctatagctgccagaagtaattcgtctagcttctcattaacagctccctctaacggaattgggatacgtcgtagcggttggaataccggagtgatcaatgggtccatagaaatacgtaactttgtatcagtaatcttggagaacggagcattgtagatttccttttcggtaactctgtttatatccaaactgatcttcaggatctctaactgtttcgaagtagtgtctctgcattgaattgggtaccctaccatagttctcgtttgaggcactctaccatgatccaattctctaaaaatttcaatcaggcgcccatccacaattctcctgttgggcaccctaccatgatccacttcatcaaaattccaactttattattaccctacctcagttcttttttcggtacctcatcaccaccaacattcttttttcggtaccggtaccaccaccaccaacatgtaaaacatccaacagggcccctagcacagttcttatttccacaccaattctcagaaagttatcatgaatctctttcttgcttggtttcaaccttatccttttctcaatgccttatcaagcaaaaatcacaagtttgctaaattcgtgaaaataaatttgggttaattctacgagtggcgtgaggtgagaattgtcggtgtcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttacagggccccgaggatggcctcttcactggccgcacactaatctctccaaagggtaaataatctgtgggctggggcccctttccacagcgataaacaatcttccggaatgatccggacgattctcacctcacgccagtcgtagaataaacccaattgttttttttaacatcacattttaaaatccagtaattttcatctcagtaggtcaacctgaggaaaaatcacttggataaatcccaaaagggctcagaaaaatgaatctatgtaattttcacagtacaataagtcttcaatctgacagcaatattcatcatttaaattagtttcaatatctgaaccaagtttcaatgccgatcattgattcaactcaatctcgaatcatcgacttgaacatgttggtgtttcagtcatcttgaaaaattcacggagatgaaaaaaaaacgttttgcacgcactttatccagttttaccgttttgactcatattccgaacacttaaggccaacagtgactttaaatgcatcttataggcatgaattagctgatatctgtataaattttagtacctctacaaagtctaactgttagctgttaagtatgccgataaaattgttcatttaaacttgttttgtattgtttttacgtaaaagtatggaacaacattttgactcaaatgccgaacactgtgttcattctgtctcatatttcgaacaccttgattcaaattccgaacagcacgaataaattgtattcaaatgaataatttcgcaaataatattatctcagctacttttattgctctcgagctagagaatcatcaaaactcccgagctataaaataaattggaaaacattgaaattgaattcatatcgccatacaaaagtcgagagttcggaatatgagttcttcttcttcttctttctggcgttacgtccccactgggacagagcctgcttctcagcttagtgttcttatgagcacttccacagttattaactgagagcttactatgccaatgactatttttgcatgcgtatatcgtgtggcaggtacgaagatactctatgccctgggaagtcgagaaaatttccaacccgaaaagaccctcgaccggtgggattcgaacccacgaccctcagcttggtcttgctgaatagctgcgcgtttaccgctacggctatctgggcccctgaatatgagtctgtttggaatttgagacaaaacggttcaaatatttaaaatatagtcgtcgccatatgtaaggttatccaaaggggttacttggggtttgctgatcaaacaagctgttcggatgttcaatgaaaactcactgaaacacacagtattcgcacactaggcactaatgatccgttcactgcgatggtcgcaatacttctcccggtctatttctcgcacgcaacgattctctgtcgtcgttttcgtcttcttcacgaacggtcgtcgttcgtggtgttccacaagataaaacaaaaaggacagctaataaaaggccaaggtttatacattcagaccctacagaacccatctcatcgtgacaacatgtttacttgaaggtttcaaataaagagcttttggtttatatgggaatattattagttgagtctcggaagcattaggagaaatcttccatttttattgacaatggacctatgcacgggttcactatttgacgttttagcggtgccgtgttatttatgtcaccatggaaactagtgaattcggcaccgctcaaacgtcaaataagtgaactcgtgcattggttcattgcacgaatttttagattctaatgaaattgttcatttgcaagatacaatttacgcactcactaataccagtaggcgtatgctttaaaagctatgacgtttcaaaattgttcaaagcagtaagacaaattaatgacaggcatggcgtgcaattgctacctcgcgtacctgcaggaataataaatagacacttttgtgtgaccctgtcctgcccagcaactccaatcactattcccccggtaccacatgggatacgagatactttaagaaagatcgggtaaccaaccccggtgagaatttagttgtatgctgacaggaaaggggggatatggttttacaaacctggagcatctgtactccatgtcagggctcacaacagtatctgttccttatgtcagggatagtttatctttcagcaaattcagtcttcattgacgactttgggttctccctgtaagtattccacattgacgaacgaactgaaatttagaaggatttttcctgcattgctcactggagaattcttatggccatttacttttcatgtaaatccttattattgcagtagttttcgcaaaaaaaaactaatgccttgtttatgtgataatttacgttcacacaaaataagcatcaaaacagggacgaaaaacgttggtaacgaaacagctgtcaaactgtcaaactttttaattttatttattaggcactccgtgcacttggccactactatgccgaggatcatatttacagaatctatttatatcctagttcttattgctattcctcccacaccgagcaggtagaggagagtgctgccgttggtccaatccatatccatatcgaagtccattggtgtgcggtggttcattttgccatgtatatgtgtcgtgtgaggcaacagcctacaaagagggtcaatgtgtctcagtcaccatccaatactgacgaaggatggatgtgttcccttatacacagtccttcgtgcggcgtctgctggtggctggacggagttttttgtgtggggggattgggaatcgaacccatgaccttccgcttacgaagcgaaaccgtaacctcgaggctacgagacccccctgtgtgcaaatgttcactttgcaaaaattttctgcatagtagtctaataaggtgcaaaatgctcaatacaaatatgaagaaaatataaccaaaagacttcgtctttcagatttaaagttctgatgattaaccttgaccttcaggttttttggaacgaatcaaatttgcttgatgagtggtcgaatgtccatatcggaatccgaaccgatcattagcaaaaattgaattttcgtttatgtggaccatcattctgcttaaaaattttaagttaaaatgactttttaaacaggtttacttattaagaaactcaagattattggacgatagctggaagcttctgcaggattcgtaattcgacacaaacttggatttttccatttgtcaggtaagtctgccaactaaaagcatttattgaacattacaaccaagctactctttggaactttcttgatgaagatgattgatgactagagtcgcttgatttctagaagagtaaaagcaagtagggcattaaggtattgagttcagaaactccctgaagatcactcatcacataggattgcttattaacttgctggccagtgcattaaaaaggcaaataggcagcactgaaaaaacaaacgctgaacaaacaagtttggatctcttttaagtttgaattccgattttatgtaaaaaaataaactgcgttaactgatatatgtgtgttattagctgttagaaatttaagcagctcatcctttctaccttttaaagaacgaggatttcaattcaaaatattaaaaaaataatattttgatccattagagaaattttatctaataccaattttatttgtaaattttacaccaacttggactggaattttccttcttttaatggtaggctgtacttccaaatcatttcgttttatttcgcagagacccgtcaaacggccaaacttccttatatacgcttaatactaacatacttttcattttcacttcaagcatacaaatttactaagttcagtatgttataccgataattaaacaaaatctggaaaacgtctttggaaaaactatcggggaaatggttttcgggcaaatgttggacaatccgctacgacaatttgacgacgcacccagccggcagcgattcacgcatggaataattttattccgtttgaacttgtctttatgtggttggcaataaattatagttggagtaaattttgggctgtccaccgtcacaggtagaaacatgcattggaagttcaaatggctcgtagaaagtcgacgaaactggatagttttcttctatctggtgtaacattccaactggagcagagcacacttctcagcttgccattggaccattttagcaagtgtatatcgtgtggggaagtcaaggcctggcagccctaggaagtcaagaaacattcctttacgaaaagatcctcgaccggcaggattcgaacccacgacccttagctcagcatggtcttgctgaaaagctgtgcgttcacttatgggtatgtgggcctctatttttagatttagggcagacaaaacgaaaattctttgaagaccattctcaataagagatcaattttctgatgcatttaagttattcctatcattggatgcaacgcctgcaagcgttgcatccctgctgcagcccacgagcagtcaaaatgaaaaaaaaatgacccagagaagcccgcgccctttgtcgagccccaaaccatcatcacctcacgcatcaaccgttccaattcacgacttcctatcaatccttcttgtatcgcgcgggttgcttattaacacgttttgtgaaagttaataagaacagaccgggaggggcagaatttatggcagcacgatcatgcagggccacaaaccgaaatcgaatttgttcctacggatgtctgtctgtccatacaagtttttggggcgacaaacgtgtatccattcatgggaggtttcgaatttcaaccgtcctacgatgggtcccttctcagggttttgaaggcggaacccctcatacagctttatttatgagatcatacccactcgaactcatccagtaactgattcggttctcttgtttctttcgtttaattacaggtagcagtaccagcttggctccctccctcctgggctattacgactcgttagctaccaaagtgagtgacgatcccaacgtcaacagcaacaccgaaatttcagctgcaagctctacaaccaccaacatcaaaactgcaaactcgtcgatatcaatcaatcaacagagcattatcaccaccgaaaggtcgttccagtccagtagttccctgaagctgaaatcattcagtctgagcaacggaacaagtctaaggcccacacgagcagccccacaacttcccaaatccggagacaaatttcgtaatctatcaaacaacgtagcgcgaatactgtccaacacagaaacggctgtagacggcgaaccgaaccgaccgcgaccaccgccaacgcctttccatcgcaaccacattcaatcggcgtcgttcaactcaggtcgcgccacaacctcctcgtcacgatacgtcttcaagaacttcccgttgtccaaaaacatcacaaaactcagccatcttggctgcgaatcagtgcgagaaccctccaagctatcccccatctcgccagacctatccaatggaaactgtgatacttccatcgaggaagacatccccaagctgagtttcatccagcagcgaatcaaatcactcacttcggctctgttcgatgccgacgaagctgacagcgaggtcagcaaaaaccagatcgaccagcagccggtaaggacagtacaggaagacgtcgatcccgaaccagttcttagaaatccggaaaagtctatggacgctagcgaagccgatccgcacaatgccttcgtcgagaactgtgacgaatccgagcaccgtaataccatcgtggaaacgagaaatccctacttgaacctagtcgttgttgaaccagcaccggaggaaccccaaccggtggaccgaagcaaatctttcccacgaaacgtacagatttcgcctaaacttccgcgatccacctcgacctcgacgccgagtctggacaccagttctgcttcgctttcgtcgagtaaaacatccctcacacagcagaacgctccgggaacccctattctcagcacccggccactgtcggcctcctctatatgttcgtactcgtcgagcagcagttccggctcggaacacctgctactagtcaacgggaaatgctgtggagcgccttcctaccaggccagcgttgaaagcctagccgatcagagtgaatgcgaacagggcaccgccgccagtggactaaccatgtgcgaacgggccgtcatggaaatcatcgattcggagcggagctacgtcgaagatctgggtcagatcattaaggggtatgtcggatcgaggtcaactgttcgcagtgcgcatagtacggtcgtgctgtgcgcacacgaattctttctgcattcagaagtatattaaactaactaaatgaatgaaacagtacttgtctgtgctacttttcataactattgatcccttttcgattcttgcctggacccgtgccatcgatttttcgttggacccgttagcgaaagttggattctatactattacccggaatatcattacctggaatgcaatttaccggaagaccacttaccggaatgtacccttacccggaaaaccaaatcttccatgttcaacaacctttatcaatttgtataacgttttcattctctttcattgatgttcagcacaacttacactcccgtgcataagtttgggttcaccccctaaaaaacatgcaaaagtgttctgtccatatctctgtgattaaacgtccaattgaaactctctaagtcgcattcgaaaggcaaagagttattcttacttcgtatgtgtttttccaaaaacattctttgaactttgtatactaaatttttacttaaagttgtgacatttttcaaaaaacacactgaaaaatcatatttaatttcctcaggattgggtcgaccaaaattttcaatcaaagtgtcattagaatcgttaacttatattctttgaagaaacgctacgaaattttggcggaaaaatctgaaagtaccgttttgattcatattacggacagcttcaaattccggacactctcatttgtatgggaaacatttcacacgaaatgtttcaattttcgccgtccaaaagttctcattttagaggctcgttttattaggttttttccataaatatcattgcaaatttataatgcccaactaccttagacgtctcttaagtggttgaacgatttcaattgatgatttgactgttccattaatgattatcatgaactgtccgtaattcgaatcaaagcgtccggaatatgaggcaaaagtgagggagcgtccggaataagaatcatgaaaaggccacacaatttattttatttaaaattattcaagttgcggacgcgtattctttacccaccatccgaaagttaagggctttcgacgctcgataatgctaaaaaatcatacagaatgatttattttgtatggtccaagttgggttatacttcactgaggccttaagtgtccgtaatatgaatcaaaacggtattcaaaatcaatgaaacagtcagtctcttttccatgatagtcgttacagcaagcaaggcattgtcagtgaatttcaattcaaatgacttttgaattatttgaatttcatcgctccctgaaaaaatataattggtgagcccgactttatcattctgaagttcgattacggtacttttcgatggttcacatagtccaatagaaaatgtgcaaatcaattttcatatttgacatttctttgaacctttcttactctgacaagaacacgcttttcgtctttgcaaggctagtaacgactaggaaagagacctcttaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcgtccacaacttgaattaattctaaataaaataaattggggaggcctgcccatgagtctcagtccggagcactcccctcacgtatgcataatcatccggacactcagtcaagaattcgggcaaagtgcatgggctcccactaatggaactgtcatctgtgaaaattgaaatcgttcaaccacttaagagatgtttacgggtagttgggcattataaatttgcaaatcggttgaaaaatagcagagatataaacaaaaatgataaacgtgcggctcaggtgaatccaaaattttgcacgatttgcatcatactgaggggtgaacccaaacgtttgcgcgatgacttgactgactgtttcattgattttgaatactttccagatttttccgccaaaatttcgtggggtctcttcaaagaatataagattacgattctaaggacactttgattgaaaattttggtcgacccaatgctgaggaaattcaatatgatttttcagtatgttttttgaaaaatgtcacaactttaagtaaaaaattagtatacaaaattcaaaaaatgtttttggaaaaatacatacgaagtaagaataactctttgcctttcgaatgcgacttaaagagtttcaattggacgtgtaatcacagagatatggacagaacacttttgtatgtttttgagggggtgaacccaaacttttgcacgggagtgtatgtcacgctaaccatgtacattctcgactccctcggattccataaacactttttcaaaatacatctccaaactgctatgaaccaaaactgttgttcttctttccggcattacaactcaactgggacaaagcctacttttcagcagttctaggacaatttctacagttattagccaatgttagctgaccattttggcattcgtttatagtttgacaagtatgtacgtactctagctcatatttgccaaccagaaataacttagaaccggcggtattcaactctaccaacctcagtttgatgtttctgaatagcttcacttggccgcaacgcaggccttacgctatgaacgaaaattcagatgaacgtccaaagccattggtaagacaaatgttgacaactattttatgcatagtgaagctcagataatttatggaatcataggctggaatttgaaagagactatatttaagaggcccaaacgtaaaggacacttaaacgacgatttggtcgcttttaagtagagtatattaaaaaaaacttctttttcgtagttttctaacgatattttaaacagaaagaaacaacaaattctcagaaaactgactagtttaaaccgggtttttcaaaacttggttttgcttctgacggaattttgaatttgtgtagctttttttctttgcgctgaagtgaccggcttatctaaaaaaaaatcaggagaaactgaagattattcatcgtccagaaactccttcaaataccgttttgattcatattacggacacttaaggcctcagtgaagtataacccaacttggaccatacaaaataaatcattctgtatgattttttagcattatcgagcgtcgaaagcccttaactttcggatggtgggtaaagaatacgcgtccgcaacttgaataattttaaataaaataaattgtgtggccttttcatgattcttattccggacgctccctcacttttgcctcatattccggacgctttgattcgaattacggacagttcatgataatcattaatggaacagtcaaatcatcaattgaaatcgttcaaccacttaagagacgtctaaggtagttgggcattataaatttgcaatgatatttatggaaaaaacctaataaaacgagcctctaaaatgagaacttttggacggcgaaaattgaaacatttcgtgtgaaatgtttcccatacaaatgagagtgtccggaatttgaagctgtccgtaatatgaatcaaaacggtatttcgttagaggttttcaacaactctgtgaaaaaaaaaatcttacggaaactcgaaatagtgcatttgcatttgcatttacattgaattctgattcgaaatactacaccagaagtttccacgggaattgctctgaaaattttcaaaatagtattccaagatgtccttcagagattttcccaccatttttttcaccgatttttccagtagttactcagaacactcaacagaacagaatttctaaagattcctacaggattttttttttttcaaagaaaaacttcaaaggtttattccattattgtgaagaatattgttgaaggtgtttttttggaacgcctacaagaatttctcaaggtgttcatatgcctatttttctattcgtatctccagtcatttcaatatgagttttttctcgtgaattaatttatggttaaacttgagaatcgctccaaaattcttccaggatttttttagaaattcctcagttaaatccaattaagctagcaattactccaactcttgccgtttttccaaataattctcaaaaatcaagtaaaattgcaacggactcttcaaaatttcattcaagatttcacaccaaaaaatacagcattattccgattatttctacataaatttcttcagagatattgttcaatgcttttcaaggaatgccttcaaaaaatcttgcataattttatcctgggatacaactgaatatttttctataattatgttagcaattcaacttgcaaaaattataagactttcttaaaaggtagggagtttttctaaaaatcctcacaattgttcaaaaataaattcatcgtcgatttctataggatttgtataatcactacttaccgttttttcagcgattttttcaaaaatttctaaaaaaacaacatcgaaaattccctagagacatccctgaaataattactggatagatcatatagtaacatcccaaaaatttcacaaagaattttttgaaaatatccgtataaaaatgattggttgaaatattgaagaaaaactgaacaacattttgagttcttaaagatttcataaatggaaattttgaacaaagtcatagcaaagccggtacaagagtcactggatgaatatttggacgacctttcttgaacttgtaatctatggagttatttttgactaaatttataatggagtttctggggttatctttggaaaatctacgttgaattatgaagcttcattgaactaaattcatagaggaatttcttatcaataaatgaattcctgctgaaaaattcggtgttacaaaactttgggcaatttgtatttgtttcttaaggaattcataaaaaaaagacttgaaaaaagcatacagttgtatgagcagtagaacttgttattcccaaaatataaaattattataaaaaaaaaatctggctggattttctgtctaaactttaatttcctgattcatgcctagatattttttgttttcttagttcccgtgcggtctttttccggtttctattttcaaggcacttagcctctacaagccatgtcttcataatcagctatctgaacttcttccagaaattctcacgacaattctgaatcagcaaaaagctcctagagggttttctgtgggagtagttgttttgaaaatcgacaagagattaagaaatgtatctatagattatataaagagtgttcgctcattcagaaatcgctagcaccatcacactcgtgctgcgtatatcacgatgcatcttccaaagtttcttcaagaatcttctagtattttttctatggatgttccaggaactcctaaagaattacttccaggaattctcacggcaatatgtcccagaaaaaatacagatttttcagacaccatccattgcttcattcaggattgctgcattaattttattttccaggatttttactatagatattctcaatcgttcttcaaacgaataagaacttttggacgaaatacacaaaccatgtcacgcatcagggcatcatgagtaatcctttgactgtcctacccaggtgtttctatgcgtagtacatgacctatctttcctacccacttcccgcgcccactgaatattatgatatcaaaatttggttgaacatgattaattaaaaatgaatcgcctgatatagattggaaaactatgtcttcaaattaaggctaaaaaacgaaacattacaggcaaggatagaaaaaatgaaaaaaaatattgtgttttacttttttaatgttaaataataacgatgtcaatataaatcgaaaaaatcaaatagggtaaaagcaccggttttggccagcctaagaaaaaataccaataaaaaataaataggatgccgtatttatactacaaatatgtcaaatgcaagctttcaatccatattgtgtgtgtaaaatatcaaaactgagctttaaccattttttcgctttgaaaatcccgttggtcaatataggccaacagaaccaattttcgccagagatttaacttcggttcctaaattagccaaccgcattgacttttcatgagagtggccaaattaggtttatgggggttagaattataaggaaaatgaattgttttccttatgttttgaatcaatgtggacgagtaaatgaaagtagctctatcatgtgaataagagctactgaacacgaaaggtttcatgctgattggctatgtaaaatggtgtataatcccctatggctacaactggcgtatggccaaaaccagtgcttctaccctaagtagggacaatggaaattcgcggcaatttttttttgaaatttcgcgggtgaccaaggcgataaaaccaaaatttcgcggttctatactgcctacgcataattgtcccatgtgaatagggaatccagcaaacatgggactgacatgcatttaaagacagtatagttttgaccatatttaacataaaaatgcataattacagtaaaaatgtcctctataagtgtaaatttaactgaattgcatttaatatttcggtttattttataaatgaagataataagtattatatccgtttgacgataccaaatttaaaacataacaaataagcctgaaagacgtccatcttgaaactgtaagaaattttttgaccactcaaaaatgaataaattatttttatgagcaaaaatctgaaattgactgcgattgtcatataaattctttaaatgtagcttatttcgcggcatttcgcgagattttctaaatttcgcgttgaaggccaaattttgcggatttcgcagcttccgcgaaggagaaccgacggtcgaatgttaaaagttaagttaggtgttcctggggtagtatgcattggcgaggcaatacacaccttttcaatttttctgcaataaacaagttttaagtaaaaaacgatgctgattgatgaaacgttccaaattgttgacaccctgagaatttgatacattttggaaaacttaagagtaagatacatgggcgaagccaggatttccatcagaggggggcaagtgaccttgaaattcaattcacgcaaaaccgatcattaaacacgttctttgcatcctttctgcttgaaacgttaaactataagacatccatcctttttccttttgcgacacgcaaagagttcaaaacgcgtgttggttcaatttgttggctgagtaacggatccattaacagtttggaaattcatgattaaaaaagttcttaaagttcgattggtatagtttctgttggccagcaatttcaccatggccagttattgacactggatataagaatatcgttcaattccgccaaggattcataacgcagattccactaaaatatgttttacggaatagttcccaaatttctccaagcatccctaaaatagttttctgaagaattcatccaatgaatctgttaggaattcccccatataaatgtctcgagagtataaatcgagtctagtacacgacactgaaaacggcctagcatttgaggtcgaaagacgagtatctgtcaaaggataggaagctatagtgtaattaaatggtatagtacaaaaatcgcttttacatttatttttagggtggaatacctaaaaaactcaaaaatttattaagtctcgagaatcctccagtgattttcggtgcttttttacactttttaagcagctctttcataaatttatcaaattaaatttctaaaacacattagtggaaagatcactccgtaaactccacagatctatcaacctctttctcttggtttctaccaagtctatttcaaaaagtttcgcttattgttgatccaatttctcaacatatttttagaatatttcctgtcaatttctcttaagaaattatactcggaattcctcttgggattgtttcagagattcaaggattttttctaaatattatttcaagatttttattcaaatttacatctagcttttgtcttgagacatcgtcaagatatttctatatacattattcctagtgggtttttctggtactctgccataaattttcgataaatcccattaaggatttctttacatatctatcaatctatctatccatataaataaaaattaagtggtgtttgtatgttacaaaataacttgaaatcggatcaacggattgaggtaagtttttcgtgcaaggaaaaagtttgggaaagtctccggaataatcgggaaaacgggagaagactcaggtgtaattttgtatggcggattacatgacgttttgcaacagcctacttgatggcaagactaagttttccgggaccactagtttctcataaaaatatatccaaaaatttgttcgaaaattatttcaggaataactatttttttttttattcttttggtatttcctgcagttagtcttcttggcatattttcttggattctttcagaattaatacaaaggacaactacaaaaatctcaatattacttttattttatcaaaataacttcataccgtcgatgggggtgacaatgggtctagggggtgagattaggtcaaaacggaaaaatatgttttgtgaaatatttcagctattaacgctgatattactaaaatttataattcatatgttagggaacatataattacacataattaataacaacatgcatttttagaaatagtagtttttgtgtactacatcaataaacttgcatgttgaaactagataaaatttacaacattaaatttctcctgtacaaagtatcacgcatgtattctagcctctatcgttgtattagtagaatgttgaaagtcttctcattacacatcacaggtattttccggaatcggtttgattttcccacaaaaaaatcatttttttcggtacgatgtctaaaacattgaaaatgggggtgagattgggtcaagcaagaacgatagtaaatgaaattccaagtccacttttttgacattttacggtgccgggtgttctcttttttcattaagatgtgtttattctttctaaataaagcatctctgaaacatcaaacaagtctacttgattattccgtgcattgaataacaatacaacgcattttgacaacttctcaaaccagcaactgtgttgcgtgcgcagcaacatcgtaaatttttatcaaaagggtgtttttttctaaatttgattatttatcagtgttttcatattatagaaacatctcacggaagtacaaatgagttggatcgctgaaatactgggattatgacgtcaacttctgcctgaaatttattgatcgtgcaatgtcgcaccgaaatttaactatttgcgaaggtttaaaataatcactgtttcagtacacctttggggaaactgaatgggttttttagcaatggggatgagactttgaagacaatttgagggaaaatccaagaaaatttatgtaaatttgacgataaatgttgggtttacatattttgttcatagctattcaatttacagtataatatttcttttatcatacttgtgaaacaacttagacatctttttgtcttgtttgcatcgttttttgtcaatatgtttaagttgtgaatggttttgaaatcatattctcaaaaacaagttatttcaattacagtgacccaatgtcaccccctctatggggtgagattgggtcatttttcgttcacttgtggtgccgctgtgaataaatatttgtctttaattttttgaacagttgttaatgtaccatcaaagtacatacacaccaaatttgaagtttattggagttaaattgcgatagttattcaaaaaataaatcgcacatatccctttttgacccattgtcacccccaacgacggtataagagttcctttagaggttttcttcaaaaaaaatttcaagtgactatcaggcattttatcaagaggtcttcttgcaattcctttgaatagaattctataggttcaaccattcattctaaaatacttcaaaattatttattttttttgggaagtactccaaggttgtttttttaatatcacttgcagggactttgaaaatgcaaaaagaaatatattaaataactagtggtcccggcaaacatcgtcttgccatcaagtaggctgctgaaaaacgtcacggaaaatgcaatgcttgtagatcttgttagtaatattcctggtttggtactaaatctgtctaaattagagatggaaaattagtggattttttttaaagaatttcttcttgagttctcagaggtatctcgaacaaaccttaagataagtcgcagcttacgattcatcaagaaataccagagatattttgaagaaaataattgttttaggaatatttggatgattccaaggatttttttcatggaactccaagagagctaatagaaattatttctaaaataattcccgaccgaattcgagaatgagtgaatctaaagaagtatgtggagctgaatctatgacaaaaggtcgaaagacaaaaagtcgaaagacaaaaggtcgaaaggacagaaggtcgaaagacaaaaggtcgaaaggacaaaaggtcgaagaacaaaaaaggagggacaaaaggacgaaaatttattttcaaagaaggataaatttcacaccaagcaaatcgttttcaacctcttgttctttcgaccttttgtacataaacctgtggagctattccttatcatttttggaataacttaacaaatagttggcaaaaacttttagaagtccatactagatttttgacagatttcttgcaagatccatggcaaattgttgattgcaccttcgaatgttttttgataagatctttggcagaaattattttggcagaattgcaccccaagaattatccaataagttattatgatgcaatgttatgtaccttaccttgataccttgatggctactgcgtagcatcacgccattgccgggcgtattgtagagctccatcttcgtcggtcttgggcgaaacttctccagttgccccgaacgtttagggtcgccaggtcttcttgcactgcgtacagccagtgtattcgtggtcttccccgaagccgccgacctctacctggttccctgctgaatattattttcgcaagtttttcttccgacattcgcactaagtgaccagcccactaaagtctgccgtattttacacgcttgataatattcgcatctttatacacttgatacaactcgtgattcatgcgtctgcgccacaaatcattttcgagtttcccaccgagtattgtccgcagcactttacgctcgaaaatatcgagagctttccggtctgactctttcaacgtccacgcttcgtacccgtagagagccaccggaagaatcaatgttttatagagggtgaattttgtttccgtttgcaagctgcgggacctaagctggttacgtagtccgtaaaaggccctattcgcagccgcaacacgttttttcacttcgcgggaaatgtcgttgtcacatgacacaagtgttccaaggtaaacaaattcttcaaaaatttcaaacacatcccatcaaacactacctcagcacctacatcaccaagcctgactctatctctatctgcaaccatgtacttcgttttggtagaattaatggtcaggcctatcctcgctgtctccctcttcagaggcacaaaggcctcttccactgacctgcgatcgattccaattaggtctatatcgtccgcaaagccaagaagcatgtgcgaccttgtgacaatcgtgccatttctctgcacgccagatctcctaatagcaacctcgagtgcaatgttgaacagtaaatttgaaagtgcttctccctgctatccgaacacttgatttcaaaccatccagcgtagcacgtatcagcctaactagtttcgccggaaaaccattttcagacattatctgccaaagctcatttcttttcactgagtcgtacgccgccttgaaatcaataaacagatggtgagtctgcaagttatactcccgtaatttgtctaggaacattcgcaagctaaacatctggtccgttgtcgaacggccctcacgaaatcaacgtcatattactcgctttaatatgtcggtcttatatgacacaaaataacatgaatttttcgaagtattgctcagaatattctgtacactctcagaaaatatcatgtaaaattaaatgcaaacgttctcttaattgagaatgctttcgaaggcctgagtaaattgattttcaattgggctttcagtcctaaattaaaattatgcgcgctttcaaactgcatagcaagtttttgagttttttcgcaattagtgagttaatttttttcctcttacaatgtcggatttggttcctgaggttttttttcaaattcttcgataatctccaaaagagattagagccagggcccagttgggaatttatttttcaatacttgtgtttattaattgagaaaaccgtgttttttttcttttgcagatccttacatataattttcatagcaggatcgcgagtgcgttggaattgccttctcctcgcgttcaaaatcgcggattcgaattttacttcatattttggtattgcaatgcatcttgcttcaacaatgaaattattgcggcgctaattttaaatccacatcaagcggcgacggtaacgcgcagaagatatgcgcgcaattcaaacgcaatgtcaacattcaagtaggtttggattttttcgctcttcaaggacgcaaatgtttcaaatttgctaaatctttaacatttggtgattttcattatcactgcgacggtatatagacattttcagataatcgcattacgtggatttctcttgcagagcacaataattaaagtttcgagagccttgtcaatatcatgttttgtttacaacgaaatgccaacatcaagattactatcgatgtatgtatttcagttggctcgtaaataatgtaaagtagagctgataggattgagaaccgcttcatgggatattagaaatgtaacagggacatgatcagaatcaaaattagcgtgagtgcccagttggctacaaatgtgattagagtcggttaagaccaaatcaatcgtagaagggtttctagaatgatcatgagcattgaattcgtgattgaccagaacaatcgaagttgcacaggaaattaatgaatggggcttgggattagcttaccattcttcaatgtgcacaaaccgagagctcaaatattaaaagtcaataatggcgctggccacgtccttacggtcatcggggaagggaaggaatgttagttagacagccgttgatactagagatcgagtatacctctgcatctccacagttgtcatgaaaaggatattgggttagagggataaggtaaacatctgggggtcaccaatggttggtgatgcggtccatgatataatcacgcctaatcggtatcgcaaaataattcgattatctcattgtacgacgaacaagtgttcatcactcgcccacgcagaagcaagcgactcgatcaatagatcaaacactactaacggaccgcgcacttttttactactgtactaccgacgcgcgacatgtttgatcctgccctcatcgcccgcccccgcaggagcaagcgtcaatgtcgaaggatcaaacacaactctgtagaaaggtttctagaagaggaaaaacaagtagggctatcagggtataaaattgagaaatatcctgaaggaattactttgagaattattccatgaacgacgtttggcattacagtcaccaatgacaaaaaaattgacttattgcgagtcaatttgcgaaagtaattttgatgcaatttaacttgctgcccagtgtattgaaaaggcaaataggcagctatgaaagcatatttaccaagttgtgtttcaacagaaacacccaatatttcaaaaactatggtttcaaatgacgaaaaaatttgatgttttataagaatatgtataatccaaatttctcttgcattacagttacctggaagactggaaagaacgagcttgcctcaaggtggacgaactggaaattctcttcagcaacattcaggagatttgggacttcaacagcaggctgttggaccgcttgaatgaaactaaaggtgatccggtcaaaatctccggttgcttcatcgatctacacgaaaacttcgattgttacactacctactggtaagttggtcatcgatccgacctacttctgcgtaaaatctaacacgtccgatcacttcattccgcagtactcgttacccggaggcgatcgccctgctcacgagtctcctgcaagccacccacaccaacgccttgctcatccacacccagaagatgctcaaccacaacctcccgctcggttcgtacctcctgaagccggtccaacggatactgaagtaccatctgctgctcgatgtgagtatctacgtgttccaattggcttcaatacgatctcgatgggtgacgttacgtcaggcgaaatcaatttcaatcagtcatcgttgtcggtccgcctcgcgtatgcaataatgcgactctgctcggtgaaggtcatccctttcacgcggacagatatgaggaatgcattcactgtgctttactttcacggtgtgctgtcgggaaacaagaaagagaatctcaaagcaagtcgataaatcttccatcggacgtgagaagcaagtgacgggatgcacacaaacagttccctggaaattgtcatcaccgctgattgtttttttttctcttttcagaacctacggaagcactgcgacgacaaacaggtgtcccacgcccatgagctcatgaagagtgtcgcacacaacatcgatcaggtcaagaagaagctggaacagcaaagccgggtcaaggagctggccggaattgtcgacgggtggctcggaccggatctctcagtgctgggggaactgcgccaggagggactgctcagcgaacacgccaaaccacgcgttgtgcttctgttccaaacgatgctcatcatcaccaaacccaaggaggacaagcggttgcagtttcgcgcttatattccggtaggtctagaaatcataatgaggatcgataaggacagtatggaccaccccgaggaatattttttaagaaaagatccttagagttgttttattgaaccagtggcgtagctagagttttgcgggcccggtgcggagatagatttgggggcccttgaaatagagatttgcaaaatataccgctaattatcgaactcacaggtgccttcaacattttttttttcgaaaacgtttaacatttgaaataagtttcgagattaaaacgacaaaaaaaattcttccggtaaaaaacctcccatacgagggcgtagccaggatttccaccatgcagtagtttttgatgctatatttctttttggatctttatagatattcttggataatcatgtttgatgttagatattaaatagtatgctgacggttattcctaattgaactctttgaagatttgttgaaaaaaatcttgaaacgattaacaggaaaatatcaggtgaaatcgctgaaattcgaattcctgaaattcagcgaatcactgaacaattctttgttgtgggttctgatgcagatctactaggcaatcaaaataaaattcaaagaggtacaggtcggactcgattatccggagtatcatttttttttcactccgcataatcgaatcactaagaaaaaaaaaatgaaatcttcgatataagaacttaaatattatctttcttcgttgttttatttatatgatgcagttgcgcagccagaaattatttctaggaatagtaagggtgtctacaggaaaaacaattttatttttgatcaacatacacaaaaaaacacttttttaaacccccccttttcttaaatacgttctaaactgcaaaaccattcatattgtatattgcaataccaaattatctcagatttgtgcttaaaaattgaaaatcaagaacatcaaaaaataaattccggataatcgagtctaaaattccggataatcgaaccccggataatcgagtccgacctgtatccctagagaaaattttcgaatgtaccttgaaaaaaaacatgcagagattcttctgaactaaatatatatttttctaaaactgcgagatttcttaaattcttggatatttttttaactttttgtaaaaaaaatcttaggagaaatcttgcaagaatatttagaaaaaaaaatcatgaaaaaactgttagaatgacaaaggaatttctggggaaatcactgctttcattacttgaagaatttcttgtagtgctggacgaatccaagaagggctccttggaaaaatgatgaacgaatccaaaaggatttccaattatctaaggaattctcacaaatttctaagatgaatttgtaaaggaatgctttggaaaaccgcggaatttcttggccaaaggtatgccacaaaatcttttcaccgatctcctcaatagaatttcattgaaaagattgaaagattaataaatttctagaataaatcctaaaggaattcttgaagattccttgaaaaatcgggttagaaattttcggaaattctgtggtagtttttttaatctcttaactctctagtacccaaatttttattttcgatttaagtattatttttcgttatctaaaatcgttctaaacacgttttggtcatttattttttttattcgcaaatttttaaattttggtttttgatttttataattttcatttttttttcatttttcttgaagctttttctagttggagttgtgtttgatcctttgctcgcgtcgcttgctttcgcgggggcgggtgatgtgagcaggatcaatcgtgtcgcgcgtcgctcgcgtggcatgatttattagtgtcgcggatcgcgaagcaggttagttgtgtttgatcctttgctcgcgtcgcttgctcctgcgggggcgggtgatgtgagcaggatcaatcgtgtcgcgcgtcgctcgcgtggcatgatctattagtggcgcggttcgcgaagcaggttagttgtgtttgatcctttgctcgcgtcgcttgctttcgcgggggcgggtgatgtgagcaggatcaatcgtgtcgcgcgtcgctcgcgtggcatgatttattagtggcgcggttcgcgaagcaggttggtagtgttcgatccttagctcgcgtcaaataatttatcatggtctaatcgcttatcaaagtgaatcctgtgacccaacgatccttcccattaacaaacatccctcccagtaacctttgtggagatgcagaggtaaacacggtctccatatagcaaaggttacacactaacattccttcctccaatcccacctgactgcaaggacgtggccggcgccgttattgaccctgtataaatagaggcactgaattatgcacactgaagaagattatggccaatcccagccgaacttctagttgattctttgtgcattttcactgacttcggtcaatcacggaatagcaaccattgatatgtgtagtcagtctaagctaagctaagctaagctttcttgaagctttttctagttgttgatttttggcaataattgtttttaattgttacggtattttgaaaaacattaaatttttaatttttttcggagcgtattttattttccgtgtaactaacggaaaaacaggattgaaaagatttcaataccaccaggctcttcgtttgtgataggttgatcgtagaaaaatataaaaggtacgattttttatattacacgataaatgaagcccaggcatttgtaggttaaaaaagaatgcaatttttcaaacaatttctaaaaatacaaataaagtttcaaaagtcataaaaaacttttcttatatgcgtgttatgagtcaaggtataagccaaaaataaaatcattttgatttccgagctacgaaaaaatacacaaaattccaaagtgtaaccctctaaaggcggggttgggtattagagggttaacgaactgatgtccattttggaacgccagatagatatataactatcagccagaaagttatataactattagccagatagtaatataactattagctatattatagtggttttacgtgcaacgcaattctttcagaaattactagaaaaaatcctggtggcatggcaaaatccagttgaatttctccaaaaactcgagaaaagttcttggaagtattttctcgttttttcaacgaaatcttaaagaaatctctggatacctttaataaaaaatgtgagagtaaaccatggcataatttcaaataaattaacgggataaattttaaaagaaatatcctggtgaacttttaaaggtcgccaaaaaaatttagatgatttttggtaggtatttttggatgatttcaaaaataatacctggaaaaatttcaatttacaataaatttcataaaggtgttattgaggattgttcagtaaaacacgtcaaggaatcatcgaagtactttcaaaaacaatttcatcaaatcattggtatactccataatatgaactctgaagaaatacctgtgtttatctctaagggattgattttgagataagtctaagtattatttttctttcatgtcaacaagtccctttcccttttttaaagggagaaaaagattaattgttttgtttaaccctatcagagtataaacctttttaaagtaaaaaaaccccatggaacaacaacacaaaggacaacctaaaaccagtaagagcgtacataacattactttcttaccgccgttcaaaaaaaactaaaataacagtttttgtattttatttgttagtaccccaatatatttttcccactttgggcctcccaaaagatctcggaaaatcactatttgcatcagcctatatagtaaataaaatcgaaatctttggcttactcattctacaaaattcatgattttgaaaacatatcaagctttgaaatcttctaaactgtacactagacctattcatattttcaaaaatgactggaaactccccagtcaaccaatactttgatttttttattgcgaaatgaacgtctggtcaaaatttcagtcaatttggagtaaatttaggtgtgcttcaaatcaattatgtgtttttagctattttcaagctttcaaaaatcataactaccgaacgaaacataaaaatttatcgaaaatacctttacatagtaattaatgcaattttactaacctttgtcgaacacgattttatgattggagcaagttttaacatagtttaggttaggtttgtctctcgaggttcttgaaaatctcttttttcgtgaagtgttttcactgaaaagcatgcctgcatgcaaattttggatttttaatttccatacatgatgactatgcatatctaaaagtcaatcccgttcaaagttgccatttatcttacgaaaataaattgtaaaaaataggtaattatgaagcacatttgtaaatccactgtgggtgagtgggtaatagtacaaaaacgaaaccaattgcctgtcaaaaaagaccacttctcattggtcgttttagcaaaggcctacttccacatcgttgatttgaattgcaacagggcactttgctgctagccaggccgtgttgctagttcttaaataaaaattttctacaaaagtttgaacattttgcattaaatctttttcttccaaatctattgatattcgatgttaagtttaccgcatgtgctcctacaacgctaaaataaatataaaatacttaattgagagcattacaatggaattgtgccaattttctctaaaaatatcaccagttttgaaaacaaacctggttgtttaaaaatctagcatcttcttttgaattaaatgaatgaagcgtgcaagtagctactaaattattagccttgatatttgaatatgttcacaagatttgctcaaaaaagacactggtttttgcatcgtcaaggctatcgactgaataacaaaggggtcagtcttagttgagctgtcacatcctgtcttagggtgagccaagagcaccaccgtaagaatacaaaaaatgagcacgttagcactgccttttctcattcgatgatgatgattgttttcaaatcgttctaaatgatcagtgaaatgcgatcaaaacaatcatcactcggaaagaaaaagcaatgcaacttgttcaattcattcgttttcgatagagtgcctgtaaacaagagtgacgtcatgatccagttttgacaggtctcctgctcgattggaacgcggatttgtatggaaatgacagttcgccgctgttccaattttgacattgacggcactcttttctaaatccactctggttttcggtgcatgtgtcatgcatgatttaactatcatcatgttgcgatgcggtgttcgatctttgggcatttattgtaatttattgccttaagcaacatgtaagctgttgatcgtcaataaatttataaatttattatgttcgattcccgttgattagggcctgaaaaaataatgtcaatgggtcttttatataccatatatattgagaaaactgtaatttctgggtactgtatagaacaaatttggatcaaacaatgttaaaactcaatttaatcttcccgcataatcatgaatcatatcggtactatggaccgatgcacgagttcacgaatttgacgtttgagcggtgtcgaattcactggtttccatgggcacataaataacacggcaccgctaaaaagtcaattaggagactcgtgcattggtatgtatgacatatgacgtgtttgacaattttgagaatagtgaaaaggaaaataacggttaagttatgtaaccatataaatatggcgattttcacgaacaaaattttccatgaatagttcgtcaaacggtagatataccgaccattttttgacaaatttattttaagccaaatggttaagaaacattaaaaccataaatattcaataaaaacgaataatgtttgtgtaatagttggtttttagtgctaaatgattattttactatatgtggtattgttcttttggatttaaaccatgaaatagaaatgatacattttgagcatcttcagcagagttatattttcccaagtataaaatcccatggactgtacttttaataaacttattttattatttcacattaggaaatggttcagttgttaattctccacttgtaaatttttctcaggcgtaaattttcaggccttaaagaatattttccgatgggttccaatttgccaacatttaagcttccgctcaacgggaatcgtgacggaacagcgtagtgcaccgtcccgggaaaacattgcttgtcttgtttctggtgaagcaccggtctggtttcggtcattttatctagtcccagcgtctccgatcccaaccattttgctgaaggggctcggccagttcgacagcagatcgtgtcgattccgtcgatgattccactcccgcatctaagagaaaaacaaatgactcacgtgctacattaagattattcagatcaattacttaccggcgctactgttgctggacatttcacactgattcgtgctgattttataaactatttttcccaaaaataaatcaaccaaatggatttcccttttttccatatttagatagagagaaaacaaacactctagtaaaacatcacatcagcaatgtaggttttcgatttttttcgaaatatgttttcacacaatttgttgaaaaactataaaagggttcattcacaaatttcataaccctgaagggggtgggtgggtgtctttaagatgttacagctcatacaatattcgaaatatattcatacaaaatgcgctacgaggagttgggtgggtgtcaaaaatgaacattattattattattattattattattattattattaatattatttattaacgatactttaccctcgtcaggacattcgtgtcggatttttggcgttatgaaatttgtgaataaacctaaagaaccaaaaaccggtagtttttcaagattaggttggattttttttttcaaattatttataatgcttacgctgttgtgagaaaattttaagagtggataaggttcgcttatgaacctgttcacgaatactattgcgggtgactgtttgccaaactgtaatgaaaaggtaaaatacagtgaaatgcatatatgtgcaagtgtgttgcgtacaaaccattttacggacggtaattttatactgccactatttcctacgagttttctgtttcataatatttcacaatttctgaacagtattatatactgttactgtttgctgtggattatgaaaaccgttattaatagtctaaagctttggaactccaattgtccaacaaaaaggtcactatgcgggttattagcgtgttcgacaaactttaacagaacagaattagctttcaaattgtggtaatagcaagtggttttgattttccacatgctagttatgatttttcaaaccttgaaataagaccaaaaacacattttcaacttgaagcatactgaactcgttataaaatgagctgaaaatttgaccagacattgttcttggcatgagaattccgaattctgcttgaccggtagatttccagacattttcttaaatatgaacaggtctactgtacacccatagcatttaactcatgtatatgctatagagcgctgcatatgacgagcctaacctcacttatttgacagctgttggtcctgttgtttacgtttcggacttagtcgttttttccatcattttttcatcttcgcatttctatcaccagcatgctgatggtgacgattttccacggtaggaagatagaataaaacgatccgtgggtatctgcagtggatttgacctctcctcgcagcaaactttcacgaaattaagaatgattcgaaaaaagtactaagtccaaactgtaaacaacaggaccagtacctgtcaaaattgatgcgtgacgtcacagtgcagtggaggattgagaaggtctctgtatcatttttaaacaaatgacaatgagaatggttcaaatcgtaagaatatgtggacaagttcaaagctcaccaatgctccagatttttgagaccttcaaacttgggtaaattttattgaaaatcagaatcagaattatgaattcaaagccgtagttagactcaagatcttcaaattaggtatctaagcttacttaagtatctacatcagcgtcgtgtttaactataagaaggcccagttctctcatatgtgcaatcgattgaacaacaaggcaaattacataaaaaagtttttgtgaaggcccctaaaatatggggatctaaagctcaggtatccccgtgcccctcgcacacttcaaagtatcaacaataaaggataatcaaggggcctatgtgcatagctgatgcaagtctaataaaaaaaattatgcttgccattctcattttctttctgagatcgttgtcagtttcctacaagctatgtcgaacttttaaagttataagaaatccgcattgcgattttggggcccctaggaactcgggacccggtgcggaccgcacccaccgcacccccctagctacgctactgtattgaacaattaggggaacttacgtattggtgatcttacgcaaagctaaaatgcatagatggcgctcttctggaatagggattagtgcatcttaattaaaatttctagtgatatctttggaagaaaaatcaccacaatcatttaactgacaaggtttttgcaatttaaggcacaagaaaccgtaaatattcatttcaatttgaaacattttcgcaacataacctcacttttgatcgtcaattgtcggaagtctaagcatctgaacttcaaaacaagctattatttaaaacctaaagctaagtatgctgttccgctcaagaaaagtaaaaatttcttcccaagaaatggtaaagaaatttcgtacagtgagctccatttgaattgacatttcttttcaactgcgtactgcgatcaaagaaaaatgcatttcttgagcatttcttgcaagaaatttcccacgcatcgagataggcgattacttttctgttgaagtgcatacttcgcttaaagcctgatttgctgctgaacaggaatcgctaaagaaatttctcgtcgattccttgcagaaattttctacagcgacttccgtttgaactgacatctcttttcaactgcggactgcgatcagaaaaatgtgattttcttgatcatttgttggaagaaattttccacgcatcgagataggcgattccttttcttgtcagtagcaaaccagccttacatcaagataggccaagaaattacttgtcggcagcgaatcaggcttaaagcacaaaaagtagcaggaagcacttgaaatacacttgtggactttttatttattgcttattatacacaaaataacatattatattgggattccatttttggcaactgagtcaaaattttctgttgccaaaaacggaaccaaaaataagtggagaaatacccaagatttttcaaaacatggacattttcgcaaactgtttagctagcaggcgtacgaggagtccaccaatttgagaaaagcgaaacgaccaccctttagttttagcatatactagcgaacattgacataaaattggaattctaactatttgtgccgatggcggcctggtttcagcgagaattgctcatataattacatctaacgacaaaatctctgttaattattctgactctctccctttgcagtgcaagaacctcatgctggtggagcatctgccgggcgagccaactagcttcaacgtgatcccgtacaacgaccctaaaggccagatcaagctgaccgctcgcaatcgtgatcagaagcgacattgggcccagcagatcaaacaggcgatgctggagcactttgacattccgaagcgcgccaaggagctggtgctgcagctaggcgatgaagacggtaaactaaacaacagtagatgatagctttacaactaacacacatcttccttcctgtttcagatcgtatggctgacaagaatgccagctggaaatggccaacgcatcacccgtcaacgcccgagtatttggaaaggaggcagcaattccgacgcagcgagatgcgaaatcgatcgaaaaagatgcacaagaaggctgccagcaccatatcgttggatgggatatcgcagaaggatatcaagcaaccgacctttcagtcgtactccaaagcgttggagcaagagtgtggtgaaggttcaacgccgaaggaagataccgggggttgcaagtgtgattcggtcaaaaaggaattggaacagaaacagctgaagagtagaagtcgctcggaatcaagacttccagaggatcgtaaagcaaccaaaatgagcgatgaggagatttttgccaaagcaatggcagaaaggaataggtttgctacgcagcgaaggaagactaaggagagccttgtcgatgtgaagtcgtacaactcgacgacgataccgaagcgaatagcgaatatgcgaaagaccagatccaaaacgttgaccggaaattcgacgttctacactgatttggaggtgggcgatggcgaagaaaacaccacggtgttgaagatcaccgaatctacggataatttgagcctagtagaaacagagactccgactgaagtggacatgagaaaatgtgatgacgctaaggagatgacggaagaagatggaagcctaagaagggattcggacataatttcccagttggtgttggagaagactgagtttagaaaaatgagtagacctccaaaaaagaagtcgtttgattcggtccgatcgttatcgtgtactagtcaagatgaagatggtagttcagaacgtaaagaagtagaggaggagcaggtgatccctgagttgccaaaaacggatcctccagaagatgccgaggaagaagaatttcggaaggttgataaattgaacaaagagtcggaggatttgctgaatcgcttgaatgagattcaaacagatctcgcctctcctgaaccaatatatgagtctttactacgaaacgttcatgttccgtataaatatgctcctccgttgtccagatccatatcgcaacagtatggaaaggttcaagaaagttttagaccggactcaacgcctagaaggtcgcgtccggattcggattatgtaacgcttgcctactcggagaacaggcttatcaacatcgatggccatagcgttgtgccgaagtcttccattgctcagttgagaaacagcgataccaatatcaactatcatcatccatggcgaaaggatgaagaatccggacctgtgcaggacacacgctctgagattgtcacgctcgctaacgaagatgctttgaaaccgctggaacgacaaggaagtctcagcatcaagtcaccaaagaacctgctccaaagattcatcagcctacatgcttcttcctcgaccaccgggagctgtgacagtaacctcaaccaacgcaaggttttgagccccgaagatccgactcctatctacaagcaaggaagcttagatcttggctcacgtattgcaaacctggattatgccgatccacgaacgctattcactgcaggtcaccaacgtaacattcttatcaatcgggcatcaataaaaccgctatgttcagaccttgagcagcgagattccatcttctcgctcaattcatccaatgatagcgtatgcggggttcagaacgagctggacgacgattcatgcggtttctacgagaaatcagtcgaggaatgtcttgagaatgaagacttccgtgattcagccgtttacagtggggacgacaatcggcctgacctggacgagcaggtggtgtacgaatcgatcgcagaactaaacgaacaacgtttgctgagaccagcctcgcaggtagttcgctcatcttcctcggcatcgagtagttccagtggacctccgcctccggttccagtgaagccagcgcacttggagcagttaaagaagattaagccacaagtagcaaatgttagctcagaatcgaatacatcaaccaaactggctccagctcccaaaggatgggtcctacagcaggtcaagagatttcagtgaacgagactgatgcatgtgccttacaaatggttccaagtgtctgaagccaaaaagaagggtgacaagtcacccaagatttcattgtcgtggttttcgtttgcgtgttttacatgttttagtgataaaaaccaaacggttgtgtcccggcacggggatgcgtgtgttctattcaaacaatattgtatttattacttacttcagttttcaaaccagcacagattttggtctatttatgtgatttcgttactgtaatagagaatttatgttttatgtactacgaagttggactgaaagcggaaaagatttagagaattttatgatgcggaaatcattacggagttttgaatgaaaccacaaacatcagcataagccatacatatttgaaggaagcaatagattttcatcacaactggaagcaatatgttaagttataaagttttaatctattttaaaatactgtcactgcattttattttgttgagaaattccatgcaatagggtttgtggcggttattccggcctaagatgtaatgtgggcccatcacacgaataaagcattaaaacgaaattacagtcacccacagttatggatagcacacagatatggatcagaggtggattaaaacagcaatatctcatcaaatacaggtgtaatttcacagaacacattttacctaagtgaaccataaatctgtacagcatcacaatcaatcataatatcgcttaagtatagtttttcgaccgtaggaaataaaatgtcaaccgtattcccagaagcgttgattcataactagggtttcaatgctagtaatggaccccttagtagctgaaattcattctagacgcttttccgcaatgatatctcagacgcatatacgttttgtggagtctaacaacaaattcaatgtctttacttcatagtacgtctatgaaacatacaaaatcattcgatttttccagcgatatatgcatttgaaaaactgttgttcgattgcctattatggaccctcccggggtccataataggattgtttacaaatttgacgttgcgtatt

SEQ ID NO: 101 - DNA, 30586 bp, Aedes aegypti
cagttgagaagaaatttcactttaaagggggctctctgtaggaaatttcttgacccattcagtcaaggaatttctttactttccttgagcgaaacagcatacttagcttaatcgatgaatggaattttcgcagcgcttaaattctaaagtgtgacctggcctgaacgctcaaaaatatcaatcgcgcgtacacgcaaaaaaattgtgcggtaaaaactaccattttagggggttaacttaagcgctcgcaccggcaattttcagcagaccagaaatgtgcttgattttaccatgtctgtagttggaatcagattgttgtaaattatttctgtcaaatataccagtaatgcggtgggatgtaccgttaacatagtaaattggtctgaatttccatggtagttttaagaatgggcgtagtcagctaaaatagttatttttaccacagaattttttcccgtgtaccaaaatcctactccaaacgatgacacccctgcgcagcgatctgttgacttttgcgcgttttgttttttgttcgctccttcggctgtctgtcatccgattatcacgtcatcgatttttcatcgttcagtccgagtcgtcgtccgtcagaatcggaaggaagcagaacctaaaatctgcgaaaatcgcttttgaaattttgtgttttcacaaatttttgttggtccaaaattggtaaaattgctttctttgaaaaggagtgagtgatactgcttggcccggacaacgatggcttcctgggagatccacgatgacatgaacttgtgagtatttctggatgcgtttttatttttgcagagtgaattttgatgggtaaaggtcgccctcggatatggacttaagattcgcatatattttttatccagttgggattaattttctaaaattgcatttccagttacatcacggctgataagttctacatcgaaccaaacgggaaaagtgaagtgttgataatcgaccggatcagtcgggaaacgtcgcttcagggtaatgaccctcaatttctggtcgcgtcttattcttgaaagtaattatcgattttttttgcagtcaagaccaatcagctgccgcagggaatacaggtgcgcaaaatatgcggaattctgggcgtgatcaagctgatcagcgggttccatctggtcgtgatgacccaccggatattcgtcggaatcatcaactcgcaggtcatttggcgactagccgggttcgatatcattcccttcgttccctcgctgacgcatctcagcgagacgcaggtcagtggttgtaactaacttagtgggatgattactgggctggtaactggtctctttttagagagttggtctctcttttaatgcatgtctcttgatagtatctatattattggtactagagaaatcttcacactctgaagttcagaaactatgacgcgactattcaaaagttcttttcagattacttgaggaaaagcttcaagaattatctaagtaatttctctagaggtgttccccggctttggactgacttgcgcccttattgccgactgacattaaacattagcagcctactctgaccatttctgtttccactataattaggaaattcgtaaaaatcacgaaaataatttctgtagaaatctttgtagtaatatctgaagcaaactttaggccagtggtcctcagcctacatgaggtgcttacagaacattgtacgggccgcatgtataacaagcaagtttttaccaacggaatttcaggcaattcagaaaatagtaagaagatattagatttattaaaatataacgaagaacaatccagtaagcacaaaaagttcaaattcgataaaaaaaataaataaatagattccctgaacatgagaaacttgaaaatgtatgaaggctgaggtttagacaacaaatgactaaatttgttggtaatgaaccgcaatttactgatactcgacagttcattccgggaatcagttttttttgcgcaatataaaaatatagtcagtatcaaatttgaaatgttgggaaaatccataacacaaaattaaaaatgatctcggagtttataaatcacggtgtctttttcatgtaactttataacaaaaaaatcggcatgtctcaaatttggaccgatgaaaggtaagacctccctctttcatttgctgctaaaatcaaaataatccatcggggggtctagtgcaactttttttttaaagttttgtttattgtaacatcattttacatgcaccgtaaatttataaattttgatgaggtgaactgttgtaacggatttagatgaaaatggtgcaaaaatctagtatcaatatcttgtagattatattccagacagctctacacctaaacatttacatgcatgggtccaagttgcctcttctttgcttcattcattgttgaaatttgcattgcttttacaactaagtatgtcaaacaacctttttttaattttaatttgtaactcaagagcaatattcatcttcctgacttagtttaggaacaaacgatcgaaagacaaaaggtcgaaaggacaaaaagtcgaaaaacaaaaggttggaagacaaggtcgaaaacgcaaaaggtcaaaaggacaaaagttgaaagtgatttgccaaatggaaaatttaatcatctttgagtaaagatcttcgaccttttatcccctctttattcctcttcgaacttttgccctttcaaccttatgtcatagattcaagaatattgacaagttcacatttgtgccaatgacagacgtaaaataacacttaataaatccaatattccaacccaaatgcaatggcagtacaatgttgacactattgtccatgtgctggttatgatgattgacagaacatttcttttgtttgcgatggaaaaacaaacaggattgctgacaaatattttaagattagccagtctagggctgaaaatctattaaataaagataagaatattaataataatgctggcaaatatacacttccttgttaaattgatggtagaaaagtggtaatgaattcaaacaaacatggataggtttaatgcataaaaaacctacctgtgaaaaattgatggtgtgatcgtggcattttgctaagagatctcaataagatgctgtaatgttcagttttagcatagttttatttgagttgtacggaattctatagtaatacattaaacaaataaattcaatcagctttgaaaatgttacttagtaactttacgattttgctagcttaataacgaaatcatacgaagcttcaacaaaaatctcaggcatatcataagagtagggtgcagaaccatttggacacttccatgattcactttggcatgggggggttttttcggccgaattgtctgaaactttgcagtaagatgcgcttcagtacaacgcatgtggtaaccaaatatgagctctgtagctttaaaaaaaccccactgtcccccagtgaatcacaagtgccaagaacaggatccggctccctatccgatctcaagtactaagtttcgtatatatgttgtgttcaaaacttacgaaagcgccaactcgaacgacttttgatgctaatgttccatcaaaaaaagttcaagttggtgctatagttgaattagaagagtcaaagaattcaaaatcatgaagtttgaggcgtcgcatgcagttttggtgctaaaacttagtggtcacatattacggagttcctggtggtcattccagtgctccaaaaggagcaaaaggaataaccatccattcattcttttggcaaaatacatccaaacaaaataaatcgttatgagttggacacaattcatttggttttggtgcataaattcgaataatttcatcgaattgtccaggtttactaccttccgggactccaggaaccagttccgcatgaaccagactggaccgaaatgttcaagggaaatttccaattccggatctccggaagggtttctgaaactagacatgtgtacctttcatataagctcaacagaactaaattcggtcaacacactgattttttcacaacgaccccaagtcacagtttgtacttttttttatagaagctcccttaggggtcattaaaaacttttgtttccgcaaaaataaaatcccacataaaataataagttgtttcaatcaaaagttacaatgatttgaatttttaaatgggtcgtaaaagaccctaggtgcttactaaggtaaagttataacccaaactccgtagaaaatattgaaaaaaaaaaaattgctccagaccccccgaccgattatttttgttttagttgcaaatgaaaggggacaatcatggctttcttgtgtcaaaatttcagacatgccgaattttttgttttgaaattgctctacgaaacacaccgtgagagcctgcttctcagcttagtatttttatgagcacttctactgttattaactgagagctttctttgccagagttaccttttttgcatatcgtgtggcaggtacggtaatactctatgtcctgggacgtcaagcaaattgatattacgcaacgatcagagataccttcagcatggctttgctttgtagccgcggattctaaccactcggctaagtgaggccctactaaacagctcgaagatgtattttcccagttttctcgtttaacccatatccgcccagcgtcctaaaaataggacagaagccccgaacgcccagcgtcctataaataggacggtatttgtagtgcaaatatcttgaaaataaagatgtttacgagaaaaatgtcttctgcaaagttgatcacaggactgctgacttccacttggtaacaattgtaattcagaattaactcaccaggtggcgcactgacgccaacaaatgttgcatctataagcaaaatatgaaacaactttccgacgtacaaatatttgcttcgtttatatctccgtccagcggtgagatacaaaattggtgtcttcgacaaagttgaacaactaaataatacctattcgcatagaaccttatacattcggaaaacactcccaagatggtgctagtgagccacaactttatttgtttatattttagtccaacgatgagatacaaaattgatgtcttcgacaaagttgaaaaattcaataatacctattcgcatagaaccttataaattcagaaaatgctccaaagatggcgctagtgagccaaatcattattgcttatatcttagtccagttatgagatacaaaataagtgtcttcgataaagttgatcaactaaatgaaacctatttagtttggaaaacattcactagatggcgctagtgggcaaagattttattttgctctcagtcaagtgattagatacaaagtttgtatcttggacaatgttgaacaactaaatgaatcctattcgcctagaaccttattagttcgaaaaacactcacaaaatggcgctagtggtcaaatatatttttttatatctcagcccagcgatgagattcgaaattggtgtcttcgacaaaagtgttcaactaaatgcgatctattcgctccgaaacatagtagtttgaaaaactctcccgaggtggcgctagtagacaaacatattatttgcttatatctcaatacagtgattggatacaaagttagtgtctttgacaaagttgaagaactaaatgagacctattcgtctagaaacttattacttcggaaatcacctaaatggcactactgggcacacattttattcgcttatatatcagtccactgattaaatccaaagaaagctattcgcgtaaatccttcttagttcggaagtcattttcatgatggcgctagtcggtaaatattctattcgcctatattgaagtccagtgatgaaaaatttgatatattcgaaaacagtgatcaactaaaaaaggtattttcgcaaaaaaaaaaaacttattagctgggaattgcttttatgtgcaaaacatcaaggaaacaaccaataagaaattggtctgcctggatcaaaacaatggatacttactatcgagtcgagcaataatcgcttatttcggatgcaatgctccttacatttttagatgaaccttgacatcatttattggaggctaaacgaagaaaacacatgttttctagccgtcgaatgaaaaagatgatcttttgaatctctagtgtcaaaaatcttggaccgcgtggattcggttctatcggtggataagaccatatgcagtaacttcaacgttatagacaaattatgttggcttcaaatattcacgtctgtaaagcatgtaacagttggagtgcaatatttgactgtcattggactgaaggtctaacttttgattagcactaacgaaattctgatattgccaaatatatatttcgatcgctgtcagatccgaaccacattgtatactaataacttgacccagaaaaaaagattaggatagtcagctggcaagttttatagaatcttttcgaagaatattctgaaacatctgtaggtttttttataatcaaaatatttgacgtaagattttattttgtttttggtataaagggtgtaagtgggcataattgtacatgtacatgtatggaaatgtatgtatgtctctatcttacttacttacttggtagagcagacaattgaattgaagtcactaaatgatttagttttggcatgcatctttcgcctctgaaatttttattcattatgttgcaatttgtttatcaggatacgtccataaattacgtcacgcaaagtttggccttattcatcctcctcaatttttctctatattacactttttgtatagatttcattttttatatgggtagtcaccagggttctgaattttcgtatcaatgatgcgaaatctacgatttttcgcacgtaaggagaatgcttttttcgcttcctcgcgtgaacatcttttatcgctcacactaattttccctggagctacgatggtggataaccgaaaatcactccactctgtggataatttgattttcactccatcatattttcgctcaccaactgctccggagaattatcactatgtggataaacaaaaactagtgccggcgatgggattcgaacctagaacattgctaaaaacaaccgcgatacgtgcacgctaaccatgctaccacatcaacttgacgaaaggagtggttaatttggtgcataaaagcaactgctgctcgtggcgatggatacaggaaaaattctccatggatcggagaaagagaaaacaaacttctcgcagctgcggaaatgtgcaattatctattttcgctttgttttgtggacggataaaatctcaaggcagctgatcgctgaaaattgctgtgagggataaatccattatcgtgagagtgagtgagaattcggaagcctggtagtcacgtttccttgtaactccctccttccaccttctgtacgggacgtaatttatgaactacccctcaactgcagttttttttaacttgtttacattgtaatgggtcgaagagcatgaaaatatatttgattaatcttgaaaataaactcatagaacaactagatatggacgacacactttcaagattttggatccccaccaaagacttgaaattttttggtgaaattaggtttattttatgggaatacgattatgaataacaaaaacggagctgaattccaattgtgagataccttgggcgttgacgggttaagcttgatatcaagtaatttaaagaacacccaaaaattttaatcaacctaatattaagaatggcatttcaatatattgattataattctatagaacttccttgctgtcaatcaactaaaaaaaaccgaagaaacaactgtgaaacaacaagatccgtcactgaatcatcaacaattatacaaaatgtacgttcattgtcagtccagatttctatcctactaattcctcctcttcggagttctgagactgagggaatcgttattcagatatatttaaggtttgagaaaattcagaagattttatttcgattcctgataattattcaattgtgtaacatgtaggatagctaataatattatgccatactgctctaaaccatgttatcatgaagtgacatcatgcgagccacattacactaacgttcaaaatcatttcgcgggccgcacaaaacctccctaagggccgcatgcggcccgctggccgcagtttggtgaccactgctttaggcaataagctgagtgaattcttggaaaaaaaatatagtaataccagctgtaagacttgttgttatatcatgagatatttagatttttgaaggataaaacttttatcttgtcggcatagtagccgccaagtacacggagtgcctaacaaataaaaagtgaggaataaaaaaaaactctatctcctaatttttgtttgagttttgtttgttttctgattcccatttaatccgtttttatttttatttaatttcttttttctggcaagaattctttaaagttctctattttaaagacacttaatagttacctgacatgtaataatatacaacgtacatcgatagtagtcttaacgttagcatttgtctgtaaacaaaatttgaagtaagaaagaaacttattttagtcctggatcctgacggggttggtggtccaattactaccgcttctgctttataagcagaaagtcatgggttcaatccccggctcgtctctttcctcgtactttgtagttgtatctttcacttgcttctatctaccactctcaatatatcacagttgatctatcacagttcatagcatttgctagaacccgagacggccagaaataaatcgtttctctacgcttccattctttcatcataatagcacgcctttccttacgcctgacacataggcagtcccgcataaacgggcgtagacgcagtggtatatacggtctaccgtgggagccagttgaatgtatcatcaactccttccccttcccctcattggtctgcattctgacgtgacaggcgccattgttgcttaaaaatagaagatcaccagcacttatacactgagggtgcctgttaatcacaagcagtcatctggttggttctttgtgtaagtgcagctgatctggcgtagtaaatagtaaccacgagcggccgatcaagctcaagaaagaaacctgggtggagcatgaggtggaatttgcaataggatttatttttttatgtcaagcatttgtagcccattgcaatcataaatcatcattcataggcgtgttacattcgtatttttcatcatttcaaaccaaagtttttgaaagttttggtgttaaattgaaaaatctttatttgcggatgaaacaggcctctccgccaaaagaacgaagcctgcgtgtaatctgtagtagattgcaaaaaagtttggatatttttttcttcatatttgcaaacatgtaagatgcttccaaaactcaactcataatattcccacataaatcgaaagatctttatttgaaaccttcaagtagatatgtcgtcaagatgagatgggttccaataaattggacagatggagttaagtagggtaaatgatggcttcggcaccctgagggtattttcggcagcactaacttatcgtccttgtttaaatttatctacggaacaagagttaacttcaaagtactcatcatatttcttgaaatatgatcttccatgtaattcacatctttcacaaaaatattatataacatggattttatcattaaatgaaataaatgcttacgaaattatacccatgcaatatgggcattttcggaacgggcgcgacaaggagatgacggaaatcgttgtccgacgccattttgaaatccaagatggtggcctctggtttggtaaaatcatttaaaactaatgcaatacaggtatgttccgtttttgccacgttccgatttctttcacaatttattccgtttttatcaacacaaatatatttttatttgttggtgtagtaatcaattaaaatgagcacttcgcgaacaaacagtattacttgctcaaagccgcagagacgcgagaagccgatcacaccgagcagcgcaaaatcacagactgacccaatgcagagcatacggtagtgttggtgcaaattctcaatggatagataccgaatagggttcagtataaatagacccgtctaccacatccccttttttttaccaatttatagaaacattttattcgcatttttgtgatgataaatagaacaatacttctagaacaaaaggtatacttatcttcaaggactgaatctgtcggcaggtctgatgatccgcagcgatcgtctcataggtcccgaaccggaaacatcagttgctgcggtttcgggatattctgtagacttttggatgacttggtgggtatttggttccatcgttgattcttcgttttcagcatcagatagagcgttgaatttctttaagtgtgaaacgtttctgttgaactgtttgccagatttattagattgcactgtcacgttcgatccatttctatccaacacagtaaacttctcgttgaggaagttggtggatagcttattcgatggaagaagatttttcattagcacaatatcaccagcagcgataggactgagctttgcacgccttctagtatcctctctctccttctgctgaacctttttgaccaaatcttgatccctgaaatcggtatttggcggtgtcgtctcaagatcgtcgaactgaggaagtttcgatcgcaactttctgccctgtaacaattcactaggtgcctttccggttatggtgtgcggagtattattgtatagatccaggtaactgtctagttctaccttccaatcatcatgaatagcgtgagcaattttcatccgtttcaataaagatcggttctgtctttctacttcgccatttgcttgtggccaatatggcgaagtatggttgagatgtatgccgttgattgaacaatactccttgaactcagttgaaacaaactgtttcgcgttatcaagcgttattgttcttggaggaccccatgttctgaaaatgcgccttaaacgtttgatggtctcttgagcagtgattcggttcattatttctatttcaatgtatcgactgtaatagtcgattacaactaacagatactctccggatggcataggccccagaaaatccatcgccaaatctatccagggcttttccgggagcgtacgacgcatcatgggttctggaggatctatagattgtaccagttgacatcctgcgcatttttcacaaaatttcacagcatctacatctattccgggccaccaacatcgctcccgaagcctcctcttcatcattgattgtcctggatgaccttcatgagccaattcacacatccttgacctcagagcagtagggataactagtttagttcctcgcataatcaacttgttaacaaatgagaattctagtcgaaaggctttgtattgcttcacattttctcgctcccaatgatcggtttctatgcatttgatgaggtcttgtagctcatcatcagaagctgttgcttgtacgacctctccaatatcgattgcagccgattcttgaactgctctgatcatttcttcagtttttgtgtcaaaatcttgcgtatcggatgaagtcgagagaatagacaaagactgcaccacaactcttcttatgaaaacatccgtttcttctgtccattgagggtcttcaacatgtgccgctaatctagacaaacaatctgccaaattagccgagcctttgcggtaaatgactttgaatttgaaagcctggattcgcaacagccatcgctcaattctcgctgttggtctggatgttgccgaaaataatgtttccagaggtctatggtctgtttctagttcgaatgtgactccgagcaaatagtttctaaacctttcaactgcccagacaataccgagggcttctttttcaataggtggataggttttctcgatctcggataaacttttcgaagcatagctgataattcttggttgacagttcttgaactggatgaagacggcccctaatcctactccagaagcatcagtaactagcaaagtgcgatctttagggtcaaaaaaacctaagctgcctacggatccaatgagtgatttcactttttcgaaagactcttgatgtaacgctttccactcaaagggaattccctgtttcagaagctgtctcaaagggtagtttatggtcgctagattcggaataaacctaatagtacaccaaattacaaacacatcgaaaatatgttacaaggttatataagtttaccttgaaacgtacgtcacaagacctagaaaacttcttagctcttcttttgtacgtggagccctgcaggataaaattgatttgatcttttcttcactgggcgatacgccgtccgctgatagctgatgtccaacaaacttgacttcccgttgtttgaacctacacttatggtcattcagcagtattccgtattgactcaagacatgtagcgtttgttttaccgcagcgtcgtgctcttcctccgtctctccgaatatcattatgtcgtctataaacacaacagtgttcttacatcccccgagaatgctttccatgagattttggaagagctcaggcgcgcagtttattccaaataacagccgtttataccggtacagcccccagttcgtaatgaaggtggtgatatcgcggcagtcctccgatagctctacctgatgaaaggcctgcttgatgtcgagtgatgtgaaaaatcgggcgttgcgaaaccttgctacaagatcttcgaagataggtagaggatggttcaatctttggattgccagattcgctcttctcatatcgatacataaccgtaaatctccgttttctttaaggataggcaccaaaggtgaaacccatgatgttggtttcattactctctcaataatgtccatttctaagagctcattcagtttttgttctaccttttccaacataggaatcgggcagcgtctcaacggttgaataacgggagggacagttctatcgatagggatgttcaattttatgcccttcattttaggaaaaacctttgtggaactttcaattgtcctgattgatgaagagtgagtgctaggtagcccaaccttcagaactcccaatttttgagctgtcacttttcctagaagtggttgttgacccttttgaatgacatggaaagatgttctagttctcaataaatcgccgttatcatcaacttcgagctcagcatcgaaagtcgtaataagcttcaagggtatgcgaccatatgctaagaatcgtttatcggtgtctactctttggttggttatcttcacgtcccgcaatttcatcaattcccatgttgtatcgtcgataaggttgtgcttagaacctgaatcaatgagcatagcgatctgaacaccgcctacacgacattgaatgacttcatcttctccatttcccacattgtaaaccggcaagtcttctggtgattcatcactgctattttctttgacgttaaaaacatttctagcgcgtttctctgatcgatatttgtctctggtagccgtaaagctatgcttacgtttccgagtaccctggagatttgaatcccaaataatataacataaacaaaaaatagaactggttcgacttacccaatcatcgttggactgtgacctttgcttcgatcgacataccgttcggaaatgtcctactattccacattgtaagcaggttttgttggatgcggggcatctatccccaggacgatgcgatctatatccacaacgtaagcatttcttcttatcttctgcaggagtgttgggactaggatgaccatttgacattgttgattgttacgttttccttttctttgctgttcattttagcagattgataccgcaccgcttgaaaagcgttcacgatttttgttgtatcatcgagggtcaacacctccttctccagcaacttttggcgcagatcatctgttgcatattgaattatcttgtcgataatagcaatatgacgactttcaagagcagtctttccaaaacagattttctccgctttcatttgaaccctcgaagcgaacttctcaattggttcatcttcctggggagccattgaccaaaagaggaaacgctcaaaactgtcgtggtgtttcggtgaaaaatgctgtgttaacttggctttcgcgctttgataaggaaagcagtcatcttcttcgtttgcttcttcatcagcacctggaaggccgtagtaggcacactgtagctccatgccacccatggccaataactgcaccttcttgctcgcctcatctaacacattagctgcagccatgacattatcaaaccacctaatccacatgttccaagcatttcgcacctcggtttgtgggaggtgcttatacttgaagtgaggtagattatacgatgccgggctaaaaaactgcacatgttgctgaacgatttgttgactgtcttcgattccttccattttgctgaagctgcatccaaaaaaaacataacagaacacacatcatgagcttttcaatatattttctactgaagcatattttcttattgctacacatttattttcaccacaatccataatcttttctttccatttcattttgtttttttttttcatcaagttaatttacacatcaaagacattggatatttttctgagcctgaatagattcggtaacactttcaaaatatccagcaaaatattcacaacacgcatcatcaaccgtaattcaatcggtcacataaccaacatcttgcataacaacacaattgtgaaccgtaatttaatcggtttcttgtctaactatttcttcaaaccggaattcaatcggtttcgtagccatcaattactgtcaaccggaattgaatcggttgcttattcatcaacatgttcatatgtattccgtttcacaccggcattgaatcggctacacaacctttcatgcatctcattcatattcgtgccaaacagacaccttcgacagtcgacacataattatccaattagaattttctcttttctttctaaacacgcatacggtttcatttcaccatcaacgatttttctcactactacacacatagtgtttctgtaattcattccttcccatcataaagaaatactttccatcaccaatacacacaataggagagaaaaaaaaaatgatgtggcgtcactttagcattttctttttttccagcacttgaattaattttatgctaaagaaaaaacagattttcttcattcacacattcgttcgcttacatcaaaacaccttatagcaccactttaaaactcttatagatagataagtaactctgtgccaattcagcgttgattttttttcaaggtcaacttctgcgatttccaatatggcgctaaccacacaagccgaatccaacactaattttcacttttttcacatacctgccacgattttcaaattattactcgatgctttaacctggttttcacctcgtcgccacggtttgtagtaatcaattaaaatgaacacttcgcgaacaaacagtattacttgctcaaagccgcagagacgcgagaagccgatcacaccgagcagcgcaaaatcacagactgatccaatgcagagcatacggtagtgttggtgcaaattctcaatggatagataccgaatagggttcagtataaatagacccgtctaccacagttggtatgtttagaaagtcaacttaagacttattttgggataagcaatatgtttttcaaattttcgacattatggcattgtaacgtaggtattaattcctatacaggtcggactcgattatccggtgtaccaatttttttttcactccgaattatcgaaccactaaaagaaaaattaaaactcttttttcgttattatatttatatgatacagtggcgtatccagaaattatttttaagaacattagggctcctgataagaaaatgttttttttttaccagtatacacaaaaaaccctttttttaaaccccctattcctacctacgtccaaaactgtcaaaccattcatattgtatattgtgataataaattatctcaaatttatgcataaaaattgaataataagaatatcaaaaaactaattccggacgagtctaaaattctggataatcgaatcccggataatcgagtccgacctgtaccattcaatgaggggtaccttcttctcgtctgctatccaaacagtcccagaatgttcaagcttgactagggctgctagacaagatcgatacatctttctacagccgagacttgttctggccatgtcatagcaacagctagggattgtaattacagaacaaatacatgatttgtgatttccgtcatcccctcattgtgcccgttccggaaatacccatattacatgggtttcaatggttttaccaaatcggaggccgccatcttggatttcaaaatggcgtcggacattattttccgtcagcacctcgtcgtgcccgtactgaaaatacctatattgcatgggttttcaatgattttaccaaaccggaggccgccatcttggatttcaaaatggcgtcggacatcgattgccgtcattccctcgtcgtgcccgtttcgaaaatatccatgagaatataccttgagttatttttattggcttttttcccattatgcgcaagattttggattcagtatttgtatcaatgataggatagatagggatagctatagaatgttgcaaatagtatatttttccccaaagatagatgataaagatatgcttggtccatcagtgatgaaaaaatggtgatagtatctccatccgtctatcaattgatagagataatatagtctatcttctatccatcattttcaagaagttatagtatcccttccctatcactacccatagtgatagtatcatttgatagtatcaaaagatagacgaatgaaagggataaacttgaagcctgttacctggaatcgacccaagaaccttgcgatcgataggctcgtgcgcactcgtctatcgacgccttgatgctaaaacgatacataatgctttcgtattacaataatcgttccttctttcttaaggcaaaatgtatgaatttctatagtccagatcgccgcgtgtagaattgatacgcaataagaataagtcaagaggatcgtgttcgacaattcccccctccgcaacggtctttgtatgaaaaaaataaattttgtgtttgagccgcaacgtttgagcctactccccctccccatagagtgttacgtaatttgtggacggcgccttagtctgcacaaattttgtggcgttatgtattcaataagccattttacgaagcctggtcaaatgacaggagacctgggatttttcaatcatcgtcgtcagttttcgcgatgatgatggttcatgactgtgcgcatctctagcgtagcttttcatcctggcgaaaacttaaatggagaaaaattattaaaatatttctgatcagaaaagtgcttttttatgtgcaatatgggtaacaaagaggtagctgatacaataaataggtgtaatgttgcagtaacgaacatttttggatctcatttttgtcattttctccatgtccacgtttggtaagatgaggcgttgttgaaaatcacgctggatttaatcccaggtctcctgtcaattgacgccgtttcggcgatcagctgttccgaaacgtctcgtaaaatggttcatatgactctcacctattctatttatacacgggaaaaacttctgtggtaaaaattactattttagctgactacgcccattcttgaaactaccatggaatttcagaccaatttactatgtttacggtacatcccaccacactactggtacatttgacaaaaataatttacaacaatctgatttcgactacagacatggtaaaatcaagcgcatttctggtctgctgaaaattgccgatgggagcgtttaagttaaccccctaaaatggtagttttgaccgcacattttttttgcgtgtaactgcaataagccattttatgagacatttcgaatcatatgttttccgtttgtttacaagctttaaaatttgctggcgggcccatttatttacgtttcttctagcgttacatttggaaggagcgcattcaacaatggcgctttaataaacttttcaatatttccacacgcaaaaaaattgtgcggtaaaatctacaattttagggggttaacttaagcgctcgcaccggcaattttcagcagaccagaaatgcgcttgattttaccatgtctgtagttggaatcagattgttgtaaatcagttctgtcaaatgtaccagtaatgcggtggggtgtgccgtaaacatagtaaattggactgaatttccatggtagttttaagaatgggcgtagtcagctaaaatagttatttttaccacagaattttttcccgtgcatgttaaatcaaatcagcaggaagggagcaatatattttatctactggtaacacaaaacatggaaactgggtagaataatgcttcaaaagagacgggaatgccataaccaacaaaaatgttaccagcggcattcacatgtcatgctagttttttgaacaataacaattagcggcccgccggaaaacgccattcgaacgtctcgtaaaatgacttatgcattggccctttcaaagagtagaacataatgagtgacgttcaatttcaggcataggcctattcacaagacatttcaaatcagctgatcgggaagctctttgacagttcttctatggagatgacagcgtgttagcaccggtcctccaccgatgtaaacaaacgcaacaaaaggcctattgtcaacaaaaacgaaaagttaccaataccccattaaacatttgacagttcaacagccgactaaattggttgaaaaatcggtcgattgttgcaccgacgcttatggaagattaacacagggatcaaccgaatatcaaccgatttaatagggtgggccgacataatcctacccggataaaaaatacaatacaaaaacaatataacgtattgaaacagtaccattcaatatattggaaatataatacagtatattgttaaatgacaatacaattacagtacaatatattgttttgaacagttctctgtattgtatatgagatatggccaatataatgtatgggtggttaagtatcgtaacaatacaaatatagatattttctcatacatacattttgaaaatacaatacgatatattgttcatgtattgtcttgattagcaattcgtgtattgttgtacaatacaaaaacaattcaaggaactgtatttcaattagtggtgaaaagcatagaatgtgtattttgaatggattgtcccccaacttaccggatattcctgccaacagtagtaaaataatttaactcctatagaagtaaagatatttatcatggttgcattcgtcgttacagctaatgtcaagtgacttctacaaaactacttatttttactttttgaatatttttcccccaacatttcttgctttctgaacttgttttgtttacttctttcagacaagctacacagaaaaaagcaacagttgttttacgcgaaaatagtaatttgaccaaaattgtaaggtataaaaccaataaaaaacaatacagtgttctgttacaatatattatattgtttttgaattgtatattcaaacaagaataatgttgcttcgacattcaattacaatacgctgtattgtatccaatacgatatattgtacattaatggtttattccattcactgaatggtacgtttttatccgggtactaccgggtacccccgttggattgaccacatttaatctggacactttttaatttgtaccccgctaatttgcacatcgttcagattaaagatggttcaaacgtcatttagctcatggtacggagtaaagtgaaatggaacgcaacggaacggaacgcagaatcaaaacaaaacagtgaaagaggtaaccagaaacacgtttctagggtgactagatgttcaaattaaaaatgaaccccgatggtttgcatgaggtaccgttcaaattaacgggggtgtacggtaaataggtggataaatcggtattttaagtaaaatccaagcaagttgacctactaaacatcagatttcctcggtcacccgattcaatctagcgattagtcagttgatcgctgtgttaaacttccataagcgtcggtgcaacaatcgaccgatttttcaaccaatttagtcggctgttgaactgtcaaatgtttaatggggtacataacctgggttttgtacagaacaagaagagaacaatgttgttgccgacaatagtaattgcataacaagtgcttcgtgactttcgtgaggaaaaatagatgatttagagaacaaaatagtattttgtgcataataattaataaatgaagtgtgctcaagtgtagttcaggtgtctccagtgatgccacatacacagatttatctgtaattacacagattgtttcctgttcttccctacagatatctgtgatcaccgatcacagatttttgagataaaaaaagattttaaagattttaggatattacacgagtttagaacacgattctggaagatataaatcagaaatgtcatttctctgtttaatttttctcaaaaacttaaatattttaataatttagaaactataacgtacctttaacttacttttagaagaataatcacaaattagaaattgttggtatgccaaaaacagtcataatacgtttgcaaaaaatcttttttgacctaaaacataaaatttttagatatttcacagatttttaccaagatttttggaggttgacttaagataaaaaagatttttttagccgaaaacacagatgagagtcggaaaaaatgtggcaacactgggtgtctcctgctaattgttgtgctttgttattgtgtataattgccttcttaaaagttcagctgcttaggctgccgacaatacgtataagttcccctatctggacaaaaactaaattttcaagaatcacattgagggcattcaagccaaatgtagatgtggtacttgtgcacttgacagattgaatgataatcctcatttcataagtttttaagtcgtcaaccagttcggacgcgtttgttaattgctccagcccacctgtgcgcgttttcatttgtgattaaatttttattacatcagcttttagtagctacaggtgccgtgcgcgatattgtttataattgaatcagtttttttttcgtcacgcgtaatgagttgcgaaatttgtgcttgcgacacttctgtcgactcggttttgtggtcatgtgtaggctgcccgcggaagttccatgcaaactgcattggtgtcaccgtgcagaggggttcactgcggaggagagacaggaaggtagtggacgttaactcttacgtactaccatgctgtgaatcctgtcaagagctaattcaggcgaaattagattttaacggactattggagcaacaaaaagttctcgaaaaacagctgaatgccaatacggaagtgatgcacagactctcgcttcatcaagaaaaacccaatgttgtccacgaagctatcgagggtatggagattttgcttactagcgtaagaaatgagctggcagcaataaataaaaacagcagcttggctgggagtgtcgttgccatcaagaatcatattaccggccttcttgataccgcaactactgaaaatatgtactccacgctaaaaacggtgacatccgatatatctactgacctgcgcaacataaacgacgaaattagccatttaagtcaattatcaattgacacagcggcaagttgcgcgatgaattcaaatccaatgttggggctggacatcctcgatgaattaaagtctttgtccgcaaatatattgacaaacaaaaatacgtcggctccaccatcaatagaatatccaagtttggaagccgaattgaataataaaattgctgaggtatcaggatggcggctaattggaaacagaaaagtttggaaagccgattggacgcgatatgacatgcgccaaagctttcacaaaaggcagcaaaatatggccgataaagcaaaaaagcgtagaaagcggagaattaggaacgctaacaaaaattgtaataagaacaacattaacaacaacaacgtgaacattaatcaccattgccgtaataatgtcccatccaaaattcatcacaaagtaagcaaacaacagaataacaatcacggaaatttcgccttcaacaataaccacgaaaggagtcatcaacttcctcctgacagagagcttcttgcggcagcgaaacatcatttctctagaccgccaacaaattatcgaccaaccatgcagtttaaaagaggagaaattttaaacccatatccggcgagggaggcgccccggcagtccgttgcagtaccaccctagaactggacgacggaaggatcttcaactggtggatcttgtgaagcatgcggtgcatgccggcattcgtgttttctacggaattgacggacccctcagaggcagaaaataattcaattcaacccggtgaagctaatcagcacttggtaacaaataataattacaattcaccatatgatttaacagacttaaataacgaactaccaataatttcttctgaaacacagccaactgaaattttaatctattgtcagaactttaatcgcatgaaaagtgcttttaaaattaatgaaattcataaaaatatattaagttcatcgtactcaatcatattgggtacagaaacaagttggaatgatgatgtgaagagtgaagaaatttttggtagcaattacaacgtatttcgcaatgatcgtgacttacttttgacacaaagaagatcgggcggaggagtcgtagttgcaatatcatcaaatttcagttttgaaatcattgcttcacctaaatttaaagaatttgagcatgtttgggttaaatcaaatattggtaacgaaactcatatttttgaatcagtttactttcccccagatcaggcttgtaagtcaacatacgaaagttttttcctgatagcagaagaaatcataactcaacttcctcccgaaaacaaggtgcatatttatggcgatttcaatcaacgtaatgcagatttcattcctgatttcgaaaacgagagtattctattccctgttgttggcgataatgaaacattgcaatttatttttgacaaaactgcatccttaggccttcatcaaataaatcacgtaaaaaataaacaaaactgttacctagattttttattgacaaatatgcatgaagatttttgtgtgagtgagtcaatttcaccattatggaaaaacgaagcgtttcacacggcaatagaatattctatgtttatgcatatttatcatactcctcaagaatatgtgtatgagaatattttcgattatagtagagccaattatactaatattagacttaaattagataacgcaaattggcaatctgttttgagaaatcaatataatattgaatgtgcaatagaaatcttttacaatttattgtgggaaaccattagggaggaagtacctgttaagaagagacgaaggaatcacaactcaaaaaatccaatttggttcaacaagcaaatcataaatttgagaaatcgaaaacaaaaagctcacaaagtttacagaagatataaaaaaccagacgatttagaaaaatatttggttatttgcgaccaactcaatttagccatttctacagcacttaccgagtacaacataaaaactgaaaatgaaataaagtcatgtccaaagaattttttcaattacgttaaatctaaactcaaatcgtgcaactttccatcaacaatgactttggatgaaaaagtaggaaataattctgaagatatttgcaatcttttcgcaaaattttttcaagaaaattattcaacattttcggaaaacgatcgagattattcttacttttcacattttgctgactttccgagtgatgttggcgttaattctataaatgttcaagacattttgtttggccttaaaaatttggacgccactaaaggatcagggccagatgaaattccacccggattcattaaaaacttagcaactgaactcacaactccattattttggttattcaatatgtctcttcaaactggtcaatttccaaaggtatggaaaaaatcattccttatacctatatataaatcaggtaagaaatcggacattcgaaattatcgcagtattgctattatgtcatgtattccaaaacttttcgagtcaattgtaaacaaaaatatgtttgcccaaataaaaaatcgtataacaaacgctcaacacggctttttcaaaggtcgttcgaccactacgaaccttctggaatttgtaagttactcactgagtgcaatggataaaggttacttcgtaaaagctctttacactgactttagtaaagcatttgataaacttgacattccaatgttgactttcaagcttgaaaaaatgggaattgaaatgagtctcctaaagtggatcaagtcctatttaaacgaccgtcagcaaatagtaaaattcgatgggaaaagatcaaatccaatacatgttacatctggagtacctcaaggctcacacttaggccctcttctttttattttatatgttaatgacgtttcttatattctaaacaaactgacggtccttatatatgctgacgacatgaagctatttttagaaataaagaatgatgacgatcataatgtttttaagaatgagatacagattttctacacgtggtgctgcaaaagtttattggaattgaatataaaaaaatgtaacctcataagttatagcagaaaacgaaccacaccaaatatgtctattgttttaggaaacgaacatgtaaaaaaatgtgataaaataagagacttaggagttatcttagactcaaaactatcatttgtagatcactataatgcaataattcatagagcaggaaatatgctcaatttcataaaacgatttggccaacacttccgtgatccttacacattaataatactttatgttgcatatgtaagatcaatattagaatattgtagtattgtttggtcaccttacacaaaaaaacatgaagaacgtatagaatcgatacaaaagcagtttttattatacgcactacgtaatttaggctggtcagtacttcctctaccatcatatgaatcacgatgcatgcttatcaatatgaaatcactgaaagtgcgtcgtgattatgctatggtttcttttgttaacgatattgtttcacagcgcattgattctgctgatatactttcaaaactgaatttttatactccaactcgtcacttgcgcaatcgttacttgttcacagtaggtcatcatcgcacgaactacgctaaatttagtccgttgaatcagatgatgactatatataatcagcattgtgaaatgattgatgttaacatgtctcgaacaaaactgaaaaaaatacttttttgatatacaaaacaatagtaactgaggaatgtattatgaatcgagtatactcaacaaatttatagtatataaacaaatagatattaagaacacaatgtaatttagaatggtccacaaatgcttgacgtcaaataaataaataaataaataaataaataaataaataaataaataaataaatttgtatagcatagcctactcagctatatacataactaccacaactccttttctataacgagagatggtcttgtatgacattttttcagcgattttcaacgtcgttcctgcgtataatcattcagatcaatcctgtggttgctctcttttatgcaatatttgcaacttttatggagcacgtagatctctttttatgaattttccacttgaacttttactcatctttttccttcaatgggaaatttatttaccatagaaacccgaatttatatccggtttcgacatccgtatcctttcctacctttttgatgtccatttttgccttttactgatggattttcatccgccctttaagcatttcccttcattgaggcgagacatgcttgccttctccggaaggattttcatcctccgttaaggcgtttcccttcattgaggcgagacatttctttttccctcgagtctgatctgatgagattctatcttccagaaaatcatacgtttatagttaccctttatagatgccttgagatctattctgatccaactttcgactggtttatccgctgttcttgggttcttgctcgtcgccaatgtggtacttgtgcacttgacagattgaatgataatcctcatttgtatagcatagcctactcagctatataccagtgttgtgaaaaactcaatttctcataactcacgcttgagatttttcaagcgtgagttgtcaatcacgcaactcagcagtcaaaaaatcatggatgagttggctcacctttttgactcattgtctcatatttccacagtttactcacacacggcaataatttcttgttagtctggtaaaattatgttaatactttctaacgtaaacaacaacattcgggtttcacgagtttttgctgggttttgcgactgaatcatttttcacggtttgaggtgattgagttgattttgcatcaaaatctcaagcgtgagatttgcgaagcagatctcttatgagtttgctctcacgggagagcgtattgattgagattttgagtgtgagtctatcaacactgctatatacataactaccacagtagatatgggaaatgaacgtatttttttaaatgatactattaaaggaatgaaaaaaaacttataagcggtttcttcaccaccgcttaggccttaaacctggtttaatcgtattggtaaacctggtttacggcctaagcgaaggtgaagaaatcggcccttagtgagatgtctgttttaaattatgttctatctgttttcagaaagtgcaaaacagtgtctacttggctatgatcaggcaagtgctggacactccgtactactacttctcgtacacgtatgatgtgacgcacactctgcagcgattgcactcgatgccaccggatttcatgcagacgggactgtacgatagggccgattcgcgcttcgtctggaatgggtacctgttgaagcacttccatcggccggagctgcggcagtacagtttgccgctgatcttgggatgtaagtacctatgtcactaattcgattgttcccctggattcaacttctgggaatgttaatcaattcgttaattctaattcattaaaggctcaataatcataattctcatttcagtcgtctcggtgaacgacgtcatggtcaacaatcacagcttccagtggattctgatgtctcgacggtcggtccatcgtgccggaacgcgtctattctgccgaggaatcgatcagaacggcaacgtttccaactacgtggaaacggaacagatcgtcgatgtccgcggggataagatatctttcgtgcaaacgagaggaagcattccgttgttctggcgccagacgcccaaccttaagtacaagcctcctccggagttggttgccggaagggatcatctgatcgcatgttccaagcacttggacgctcaattgatccaatacggtcgacaggttctggtcaacttgattgaccaccggggagccgaagatgtcctggagaaagccttcgctacaacgatttccactctgggcaaccaaaatgtgcgatacgaatcgtacgatttccacgccgagtgccggaagatgcgatacgataggttgcacaacttgattgccagattggctcatgagcaggatgaattcggggtgttccacttgagaagggatggaactctgatgtcctcccaggatggcgtattccgtacgaattgcatcgattgtctggatcgaaccaacgtcgtccagagtatgttggccaaacgtagcttggagcagagccttatcaagctgggcgtcctgaccaccggacagcgaatcgatccaagctcgaccttcgagtggctgttcaagaacgtctgggccgacaatgcggatatgatttccacgcaatactccggaaccggtgcgctgaagacggactttacccggaccggcaagcgaaccaaaatgggcctcctcaaggacgggtccaactctctgacgcgttactacaagaacaacttcaacgatggcttccggcaggatgcgatcgatctgttcctcgggaactacgtggtcaaggacggcgaaggcctcaccgttcagtgcccgctggtgatccagaagggctggaaatatggaacagtaagtctctgaattaacattcctcttcaaaacacttagaaaagtagtcgcgaacactgaaaacaatctcagaaacattaagttgaacccacaaataatttaatgattagaaatactctacatacctcagattatttcaacagtatgacattctctataatctttctgataacaaagataatgctgatagcagatctcttttcactcagagacttggtaaccacttttgtaatgtaaatctctaaaaagtctctattgttgatggaaaatctttaaagtctcttttttaaccaaaatggtctctcacgtttcactttctcacaatcattccctgtgcaaaattctagaggctccagagagattttcttagaccctcagaggttttttagaaatttatactcagttcctggaattcctgtactgatctctccagagatttctgctggaatacaaaagaacatcgcccttctcccaggaattggtctagaaatttctagtcttctctaaaatacccttgaacagtccaacgctactacttctagattctagcgccacctacggaatgaactcctaatcaatgctggaccactttgccgaagacaccaaccttctaacgtaccaggatcttcagatatagaagatggaagaaaagctgttactactagttgtcacctgttggatgaatttgcaatcaggattatttctgccttgatctgctgaacagctttgttgaagacattaaccttctagcgtatcataatttctagatataaaagatagaagaaaagttgtttcttgtgcatgttcctctagacatattccatatttttaaatatttttaagtttctctattactttatgagatttgcttgaaaaaaatcaactcggacctgagatataccgttttcaatatttgcgactgcttttcgatacactgctttcaaccagtactgacctcccgaatctctctttacagttccccgtggttctgctgtttgcatttgccatgttcttcacgtcggtggtctacccgcaggagtacaacaccgagagtctgctgttcgtgctgttctggggctcgatggtgggcgtgaccggggccggcatcctcaagtacggcgtggagttcgtcgactggcccaaactggtgccggcgatacgctccagcggcaagatggaagcctgacggtatcggtaagaatggaagacccccgaggggggaaaaacgtccatttcagcattcggtgatttaaaaatggtttttcaaaaactgattttacaatatatggtgggaaaagtatcgaatttgtaggtctcttaaatggttccagttaattgaatttaaatacacgcttctagaatccttccctccccctttccagtttcaactattccaacggtgaatttcaggcgacgattccaaaaggcaattgcaataaaaatcctagacattcatcatgaaagtcggttgacgaatggatctttcaatagaagtgaaagaaagccatacattttgagcaggacacccacatctgagggctgataccccaaggaacaattggtagcttttaagatacttacgtgcttaatacaagctgcatagcagcaaccattgctgaacacatttttagttgaatcatttattgaataaaattaatttccgctttagaaaaagctgttattccacttgcagtttgttttttgaataagagctgaataaacctccgaaaatgcaaatatagtagcttttgttctacatcacataagaagtttaacaattgggtgattaaaagcttctataggttgtagtcatcattttaatagaatattgaacatttgattaacaacaaatcgtacaaaagtttcagtgtctaatacttaaaatgttgaccagcatgattagtaaaacttataaacaatgtgaataacagtatatgagtatgctcttattcaagaaaaacatattatgtctttttatgttattttcaaatgtttcaaatgtttttcaaatcaaatccaagacgtgtatgcgatggatggattaacgtaatggacgtaat

SEQ ID NO: 102 - DNA, 36230 bp, Aedes aegypti
ttgcacgttcaaggatctaattgtgctcataattcaccttcagtttttaatctacacaccagcttgaaattatatttacccggagtatagaaaacttcgaagaataatcgctgtattatgcagaagtttgaccacaatcattaaatcagaagttaaatacatgactattataataaaaacttgaaaaacattgaatttctaatcaacactacaaaatacagcgatcaaatgtctaaaattatcgttcccttgaaaatatactcccaagcccagggaggcggacatacctatttttttaattttctgaattctaaacatctacctcaaccgtttcaggcaaatcccatcgcaaggcaatcgggcggagctggttctcacagccctccaccacaacacgttgggaatcgatgagttcctggggcaggttgtgcttcccctcaacgagatggacgtgtacgaacggccacgctcccgatggttcaagctgcagagtaaaccgggcaaggagaagaagaaggaacgcggggagctggaagttcggatagctttcaccgtcaaggctggctcgttgacggatcttagcaaaaaagagaagaacaagagttccatcagcaatctggcgtccaacgttggaggttccttgcttagtattggtgctattgagaagcggaagagtcttaagaagtttgccaaatccttgggttcaaaggttcacataagtgggattgggaaaaagaaaaataaggatatcgacccggcagctgatgatgggtcttttacgggcagctattcaagtatcggtactcccagtggattacagtccagacaatcacgtcaaaccttcggagacgcggatcccggtgtgatcagcgaagacgaagatgaatttgtatttgacaatctctcacataaaagctcgggaagctcgttgaacattcgcgcccaaagcggtgcaggacacatgttgccaaaatccacaacacaatcaagcgcttcaacgccagacgagacgaggaagcataaatcggttacattgcctccgtcgaaaccgccgaggttactgtcggaaaatgaccccgaagcagcccctccagccaaggtcgacgaatgggaacagaagctttacggtaaacacttagacatcggtagcacagattcactgaaaagaagatcttgggaaagttcacgcgtaatgctctccgtgcaacaggaggaagatgaagaccaacatcagaagaaagcacctcaagaggcaccacctccggtaccaacgtcagtaactgctccgacttctccaatgctcactgataagtccagtaaggaagactcggaaggatacgataaaccgaaacctctcccccgggtcggatcacaggacatcagcaaggttagtgataagttgattatcaacaacgctcccataaccagtaacagcatgagcaacagtcgcaaatcgatcaaccaaccttccccgaagttggagaaacaagatagcagttcgttcacgaaaaagctgaaacacttcatcaaggaccaccgagcggaatcgatggagaacctttccggcagcaggaagcaactgaatggtacaaagcaccacgtgaatgagcggatcataatcgggggcgagaacggcagcaacggaacgggcgatttgccaatggcgttcctgacggcgcgacagagcaaactggtcacggaggtgtcgccggagattctcgccaagtacgagggcaagacgcgcgaggacatgatgaagattgcccacaatctggagaacgaggtcagctaccagaagcagaaggtgaaggagctggaggactacctggacagtttgctgctcaaggtgatggaatgccaaccgcggatactgcagaatccgtaccagaaggcgaaccctaccaagaggtgagttgcatgggacggttggttcctttttggggagagtgtgtttgtttggttgagggagtgtgattctctttttttcttgaccccacagatatataacatatacagtcgaagcttgttataacgacatcgcaagggaccgtcgtaatagagaaaagtcgttgtagagaatgattataacactgaaatatacttcaagagacgtaataacgagcttcgactgtagctttaatgcagtgttcttataagcatgtctaaagttattaattgataagatttctattgcttacaaacgcatgcgtatgtatttgtaattactgaaatccaggggcaaattgatcacttttccacaactttttgtcatagtttcctttggaattcaaaaatttaaaaaaatatttcggtaaaatcagtacttcattaatctctatcagtttatgtgatcgattttttatgaaataaaattaaacatttcataaaattagttttaatataaaaaattgaaaatgacacattggggcgaaattgattactatataataatgcatattttagaatgtaaaatttccctatctactaaatttggatctcctgaactgatgtctaaatttgtacaactcatatatatcatcattttattggaaaattaaactttgtaaatctgcataatacgcctaaatttatgcaatttcccttgaaataagcacgttattcaacaataaacggtttttacaagcaaaaaaactattcttgtaatgctgtacgatttcagaaatgagttcagcagttcacactgaagcttacacaacatttttaacactcaaagtttgcatgcaggcttagcaccagtggattgtttagtaccgacgtttccaacagtattgctaacaccttcgaaaactgtaaatatttctatgcaaaactgacctgaataaaaaaaaatagtttaaaaccatcattagacatctataaagtagaaaacattgaatgtctgtgatggcaacgaagtaaaaagcatccttgaaaggaaatgctttttggtaccgacctgatcaaatttaccctagtgatcaatttgcccccagattacggtactatgcctagaaagtcgataaaacggaaatggaatctgtcatctctgaattgtaatctgagctaactaagatgcaggttttgtttgaagatgttgaaaagtcaagctatcccatgactgctagcatgattctttctagagacttggccactattgtaatgcaagcctccaaaaaaatctctggtaaatacaagtgtttttatttaataagctttttttttgcttttcgtcgacagtggtacaaattctgttctcatagctgttttttatctaggattccatctcttacagggcacccttatattgaattcgccttctttcgggctatttgaacacgtcacaaacaatgtgctttctccgagtattcaattgttatacctttgtaaggttccactcaattggcttagggccttttaaggcgaagtaggccgtcattgaaatttgtacgcgtcgttgatgattgctgctaattcatctcacgatttcgaattaaagaaaatcagttggttttgtactgacacagctgaaaaagtatcagcatactttatgcatgttagcgcgtacagtgatactttttcaagtcaatataaactatcaaaactgagttttatcactttgaaatgcaagctgaaaagtcatcattgttgccaaaacgaatgacgggctacttagccttaacattgtttagtgatttaacgcaaatggactaacattcaacaatcaacaaaaaaaaatgtaacagggttatgccgtttccagcggtcctctccgcaaaagcgatcgctttcgtacaacgcgtaaaagtaatcacgtaacggaagggaaggaagccagccccgaagcaagctgcgtcggccgaagtggacgagaggagatccaagactattcgtacgcagtggtaataattttagtaagttgaggcggctacgacagttggccctgactgcttcacagtggggcttgaaggtaaggccacgatcgaagaccttttgcttttgctgtctcacgaacagggatagcttggttattgatgacgatccactgaccctatgccatgcctggatgagcatatgtggcaccgaatgctctttgaagccaccatagaaaaatcaacggagtcagcccatttgcctactcgaaagacggctgcttggtcttttctgcgtgtagctgcgattgtccgtccagacactactattagtatatcgttcgcgtatacaaatatttggactacggtagggagatcttagaaaacgccgtccatcataaccaagaacaggattaccgatatccttgcggaacaccagtattcttcttaaaggatgcagactttgtgtctcctatgactaacctgaagcaacggtttgtcagaaaatttcggataaaatgcagaatatgactggaaaggcctcagctgaccagcttttctaggacgaaaggcgtccaagtccgtcgaaaggcagcaagtgagggaaattggtcggtagcttgctgattctcgcatttgatttgcgggtttcgggatagtttagagcgtattgcagttctcctacctgcttggttgatggaaagttggatgttgctctcaggtacattgaagttgactatgtcatcggtcgctccggatcgtagctgttaaagtgaagatgaatcgaagccaaaccttaaattttcaagagcacaaatctaaagaaccaaacatccgtttaagctgaaaacttaatcgatcggtcacattctggtggtgaccaatcgattaagttttcagctcaaactagtggttggttctccagatttgtgctcttgaaaatatgagatatggcttcgattcatcttcaccttaaaggcagaaaaattggcgaagtatttgccaagaccattcgttacagccgttggttccgtagtaaggtttccatcgataatgagtgtgggtggagcggcgattcgtttgccactaagggcatcaaagatcggctgttgtttgtgtagcgttaatcatcgaaacttcaaaagcagtttttttgttcaaaactaaaaattattcgatgaaaatgtgttcactgtgtttcggttggggaatagaatacagtgaacacattttcctgttaattttcttgattttgaacgaaaaaactgcttttgaaaattccaaaatcaatgacggatcctgcccccttaaggatgatcaagctccattcttttgacgacatgaagcgcttttctgcgggctttgctagcttttttatatctggagaccaccaacggaatgccttccggccaggcttattgcttgttttcgggattggaacatttgccgcttaggtgaggacggtggagaactcggatttgagtgcggaaacctttatgttgttattgtaagcggcccagtctgcctggtcatacaactagtgggatcgtctagttgtgatgggagactcagcggctaccgagatttgtataggatggtgatcgcttccgtaagaggcagcattagcataccgctggactcccagtgaatcatgtatcgtataagaatgtccatccaaaatcacatattcatgcgtccaaaatcagaatcacacaagatgacatattaagcgttatcaatgtcaatacaagttgtatataaatccccaatacgattcataaacgacaatctgtgttgacaacaaaacatgtcgtaaatagtgcaacatagaattgcgttatgtcatataaactgacagatcatatatcaatccagaaagcatcgtatgaaatcgcaataacttagcaaaaattgccatccaaatttggcatatgctgacgatgggcctcaaagaacaacaaagtatgtgtcgctgtacatgaaacatatattaatattgtcaaataaaaaagataatgttatgttacccttggtggtacagtggtcaggtgcctgattcctgatccagaggtcccgcgttcgagactcgctggaaacattttttttattttcatccaaattttgtggcatcgtatacctgatcgcagaaagtccgaaaaagtcgtgccaagtacgcatgtagcctccactttggtaggtatatagccttttcgtgcattctatacgattgaattgattcatatagaatgatgtataacaaaagttataccaaccaaaatgttgactgggctcccaacggggaacggctgaaacgtcgattgccgttgaataaagaatagcgatatcattgtcttcgaagaagtcaagcaaactattgcctctagcgtctatacgaaagcaatcccaggcaggatgctgtgcgttgaggtgaccgatgaccattcttggttccgggagttgaatgcatttttttacctcccagcgtggatcaagtacctatattcgcatataggtaggtagacgcaagctacagatattggaatactttcctggagcttaactccgactactggtagttcagaatcgatgttgagaatggcgaacggaatcgattttagcactccgagagcgacagagcggcggatattgccgattcgcttcagagtccaaacgtatttgccaccgaggaagcggttgagctattcgattgtgatccggttgatctcagtgggtagagcagtgggtcgttgcttatcaggatctcaaggtcgcctagcctgctgaagaagccattgatgttccactgtaagcagaactttaccggctttggtaatgctggaacggagtagctactattggcgaatggaatttgataacgaatgttatcattccacaaacaaggcagagcgcttcatatggcaggtccgggagttgaatccaccatatgcaggagtgtctcggcggcgggaaaaaagggttgacaggatccgatagtcgacttgttctgtcatctgaataggattgtttgttggagcttggaagattccttgcgtgaatgtagcttcgcttcccacgtcgtctattggggtagcgggtagagcccgacgcgtccctagtccttgaaagtcttgactcgtcttgagtagactggcccagcttagtatgggagaaaattgaagttgtttaattccacggggcaccctccagaattataccttagagttaggagaagacttcctgaaagtttcagctcatttggtcgttccatgagctggcgcatttgaattgagattaatatgggattttcagctcaaacatatgggattcagcgcatcatcgaatgtttggttcaggaaaatcgttgatcgcgttcaattgcacccagattgtcaaaaacactacttgataccatagcagacaatattgtagaagcttgtatcatgattaaaattgataaagttggtgttttaactatttgaagcagatttgctaagctcatgctatactgctatgtatgtcctcaacatagccactaagcgcatcatagccacctatgacgctgagcgtgctgctacacaacgcgcatgcctatatgtgactgtacgggaggctgatctaagcctaactttcaataactgaaatgttaatgaaaacgagcttaaacctagatacaaccttctgcaattgtgttcatttgggtatcaactagtgtatttgtcattctgggctcaattgaacgcgatcaactagtatacggaacgaaacagtgacattgggtcaattctcaatatatttggaacgaacattccctacaaacttcaaattgaatgcgccagctggaggagcaaccaatcgagttgaaattttgtgagcgcttttttcttaccctaaggcacatatctagggggtgccccgttgagttttaacagattttggttttagggccagtctagtcttgagtcttgactcccacgtcgttcagggttgcaggcgtaggtatgaaacttccttcttaaggtctcctccagcgccgagtgttttccgccagttccggtatgggagacgtccacactaacgggaccaggataagcgttggttgatgtaggccatcaaaaccagtttcagtcatttttgtttctgaattggtcagtcccattggtttcttacggaagtaaccaacttaagaatttgctggccaaattagataggtagagcagttagaatttgtagaataataaattgtttccaatatactttgaacaaattcgtaaaactttgttcaatccactatggctacaattagcgctacagccaaaaccggtgcttctaccctaccataaatcttggaagaaatctcaggaataattcttaaaagcatctcttaaccacaagactctaactaaatgctgctagaacagctgctccaattgtctttctataagtgaagaagaagtgcatagagaaaattctggcggaacagttaaggcatttattacgaaatgcacatagaattaggaaaccacgtagaaacttatgaatgattctcgaaaaggttgagtttgtaatggatttttttttctggaataggtattgaaattgtttgtttgtttgtgctcaagattacccgagtttattttacttcgtttttgctcaggatgtcctccagtgattccaacaaatattcctcctgatattcttaaagggattcctttattaacatcgttaggagagaatccaaaactcttgttggtattttttctcaatgtttccagtgatacatccggttagtcctccaggaatactagaattgctttaagatttcatccagagatttcttatggcctgtaggaatatttcatggtattttatttatgatcactttcccgtttgttatatattcccaagggattattccagattttccccaaagaaaacctttagagattgttggaggattggccaaaacgctcttctgtttctttctggcgctctgtcccaactccttaatttggaacatgcatacgacagacaaacgaatgatttttaaatgattgttgaattgttgattccctattcatccctatacgtgtttttagatattacaaaaatacagcggtaagacaaatcaatatgccagcagttggaatccttaattatttaagttattcgaattggatttcagaacagtattttgtttgagatctttgcagaaatataactgaactataatctcgaatagagctaaatgagagcaaatctttctccattagtcgaattgagttgctatctggagcttttttttattatcatggatatatgattgagctttaaatttgagtgtttttacttatattaccgttctaacggttttggaacatttttcgccattttcattgaaaaccttcttcgtcattggtccacttctaaatcaccacataaaatgctgaaaatttgacagaacactattttcatcataagattgtaaggaagatattattctatctccccagtatgcactttgtttaaaaatcttatgaattgaatgagtgaagccgcctctagttgtgcgcatgagattttcgaagcagatttcttatgagtttgctttcacgagagagctcattggaacattggagcaataacataaatagggggagatcccccagtgccggacagcacccaataccggacaaagtcgaaacattgagaaatcatggtccaatcaagatggtgtattagtagaaaacaaagcttttatgtagactaatgtttgcgtagaataacacatccttaaccttcgggctgtcgcgctgttgtactttgtacaacagttgtgatttatatgctatcattttgtaacaaagatatctatcgacaccaaaccaaaatgtattcctcaagaatcttcttaagaacaatactcgacagtttttatttacagtatgaccctttataatacggtaaaatcaacaaatgtacatggaagtcgcataataatgaacgcactatgtacggctcgaggaaaccacagtttgaaatcgtcatatctcgaaatccagataatatagaaacttggggtctttagtaaagtttttctgaaggtgaagcgctatctgatggtactttatttaattcggaatataaccgctagatggcactagtgggcatggaagttttacttttgttttgcagattttccaggatcctgaccatttagaaggatgtcgtcttcgccaaagttgtttagtaagttaaggactatcatttttcgagctagttgattcaaaattttgccacaaggcggcgctagtgagcatgaaacttttgtttgcagatatctcaggagcctgaccacttagaaagatggtgtcttcggcaaagtagtttggtagctcaaggactatcattatttgagccaaaaaatacgatattttgccatcaggcggcgctagtgagcatgaaatttttgtttggcggatactgcaggatcttgactttttagacaggcacctttggcaaagttgttcagaagctcagggactatcattatattaataaatctctaactttaaggaataaacaaagaaaaaatttgagctactgaacaactctgccgaagacaccatctttctaagtgatcaggctcctgagatatttgcgaaacaaatgttttatgctcactagcgccacctagtggcaacattttgaatcaactagctcaaacaatgatagtccttgagttaccgaacaacttttccgaagacgccatctttctaagtggtcaggatcatgagatctgggaaacaaaagcttaatgctcactagcgccgcctagtggcaaaatcccgaatttcttatctataataatgatagcccataagctactgatcaactttgccgaagacgtcatctatctaagtggtcagactcctgagatattcgcaaaaccaagggtgttgtacaaagtacaacgcgcgactactcgcgttacaaaaattcgcgcgacgaccgaaaggttaaaatatgcatgccttttttaaaaagtagaaaagtttgaaaatctttaaaaaattgacgtgttcacttaattttgagcctatttagtaaatattttgaatatgaaaaaaatagtttgaatcccgtaagcatgatcgaagatattcctaatttgatagtatgaatgtattttgtaccataattgaactaaatatggacagattacaattttggttaagcacctcctgtccctcagtttcggacagcatgatttgttatatgatatctttgtaattattgcatcagtgtctcagaataccttcatttttcatgggttccatcgatcatggtatcaaacatgcaataaaactaagaagaatgaacattcagaacatcatcgtaaaatgtgctatttttcatcatatatgaaagaggtttttgatgggcatcttgcaaactaagaaaaactcaaattattcttgtaaatgttgcaattgcattgaattggtaattataaactattcctatagtgtacacattcaatgatgttcaaatttacagaattcgaggcatttccagatcgtgtccggtattgggtgccacctttcgagatcgatcaatttggtactaaaattcatcatcaaaatgcagtgtcaaaattcatatttatattttcaaatttatttttgtacactataaaaataataatatttatcataaatgggtaacacgcccataaaatcaatatttttcgaattatgaatttagtggcttaagtgtccggtactgggggatcttcccctacctttttctactattgacataattggtactatagcgataatgacatcttctaccctatatgtttatacaaaaatcataagattttttttaacttgaccttctccttttttttcaagtaggttgttctccatgtcatgccaaacaggcaagggatacatagggtgtcccagaaagtatggacacgacttcaccatttcaagactagtgaagataaaaatctgatttttacacatttgattactgtacccaacaagagtagattatgattttttaataaataattcaattaataatgtgttgattacgtaacatttctttgaagtatctcttatcagtcttgcacaaatcgcgttatttttgagcgcctttgttttataaaatttgttctgtgtcataaagtgcgtataataaaaatctgacaaaaatatatttatcagcgacgatattataattgatcggactatcacttattcagattgaaattttaaatttaagcatgtaaaatttgtattggaattgaaaatcctcttctagccatggtcgatatgaaaatggtcaaaaaacaaatctttatatttacgtaaaaacatgaataaatcaaaaattaaagttgcctatccaagagaatagggattaaactttcgtaaatctgaaatgtacctattatttttattattatttaaagtacctgatgagtcataactttggcgcggtaaatggctgggcatggcgtaccattggtacctcgcgtacctgcaggaataaaatagacccctttgtgcggtccttagcctcttgcccagcaactcctacccctacatcctcgtggtactggccggggtacgagtaaccttggggaagatcgggtaaccaacccccggtgggaactttggtcgtatgctgacagggaagggggggtttgcttctgcaaacctggagcgtctgtactccacgttaggagcggctcacaacagcgtctgttccccatgtcaggggcggctgatcatcgtccgagtgccagagaaggactctaagctaaactgcgcactatggccctccgaacatttagggggaatggtcctccgggggttggtgtcaggccctgtaagccaaccgtaaaaacacatcagcacaggaacgtcaacgagagaatacggaccggaacaatcggcaaagaccacagcgacgaaaatggactagcgattggaaactcggtacgtggaactgcaaatctctcaacttcattggaagtactcgcatactctccgatgtactgaagacccgcggtttcgacatcgtagcgctgcaggaggtgtgctggacaggagcattggtgcgaacgtttagaggtaatcataccatctaccagagctgcggcaacacacgcgagctgggaacagctttcatagtgatgggtgatatgcaaaggcgcgtgatcgggtggtggccgatcaatgaacgaatgtgcaagttaagaatcaaaggccgattctttaacttcagcataatcaacgtgcatagcccacactccggaagcactgatgatgacaaggacgcattttacgcgcagctcgaacgcgagtacgaccgctgcccaagccacgacgtcaagatcatcataggagatttgaacgctcaggttggccaggaggaggagttcagaccgacgattggaaagttcagcgcccaccggctgacgaacgagaacggcctacgactgatagattttgccgcctccaagaacatggccattcgtagcacctatttccagcacagcctcccgtatcggtacacctggagatcaccccagcagacagaatcgcaaatcgaccacgttttgatcgatggacggcacttctccgacataaccgacgtcagaacctatcgtggcgccaacattgactccgaccactacctggtgatggtgaaactgcgcccaaaactatccgtcatcaacaatgtacggtaccgacgcccgccccggtacaatctcgagcggctgaaacaaccggatgtcgccaatgcgtacgcgcagcatcttgaggcagcgttgccggatgagggcgagctcgatagggcccctcttgaggactgctggaggacagtcaaagcagccattaacgacgctgccgaaagcgttgtcggatatgtggaacggagctcaagaaacgattggttcgacgaggagtgccaggaggttttagaggagaagaatgcagcgcgggctgcaatgctgcagcatggtacgcggcaaaacgtggaacgatacagactgaaacggaaacagcaaacccgcctattccgggacaaaaagcgccgcctggaagaggtggaatgccaagagatggagttgctgtaccgttctcaagaaacgcggaagttctatcagaagctcaacacatcccgcaaaggcttcgtgccgcgagctgagatgtgccgggataaggatgggagcatcttgacggacggacgcgaggtgatcgaaaggtggaagcagcactacgatgaacacctgaatggcgcagacaacacaggcacagaaggtcaggacagcgaaggcgatggctacgtcagcacagcggacagcggaaatcaaccagctcccacgatgggggaagttaaggatgccattcaacagctcaagaacaacaaagccgctggcaaggatggtatcggagccgaactcatcaagatgggcccggacaggttggccgcttgtctgcatcggctgatagtcagaatctgggaaatggaacagctaccggaggagtggaagcaaggcgttatatgccctatctacaaaaagggcgacaaactggagtgtgaaaattatcgtgcaatcaccatcctaaacgccgcctataaagtgctatcccagattctcttccgtcgtctatcacctatagcaaacgagttcgtgggaagttatcaagcaggtttcatcgacggccgctcgacaacggaccagatcttttccgtgcggcaaatcctccagaaatgccgtgagtaccaggtccctacgcaccatttgttcatcgatttcaaggcggcatacgatagtatcgaccgcatagagctatggaaaatcatggacgagaacagctttcccgggaagctcacaagattgatcagagcaacgatggacggtgtgcaaaactgcgttaagatctcgggcgaacactccagttcgttcgagtctcggcggggactacgacagggcgacggactttcgtgcctgttgttcaatattgcgcttgaaggtgtcatgcggagagccggacttaacagtcgaggcacgattttcacgagatccggacaatttgtttgcttcgcggacgacatggatattattgggagaaaatttgaaacggtggcagatttgttcacccgcctgaaacgcgaagcaacaagagtcgggctaatggtgaatgcgtcgaaaacaaagtacatgctggttggcggaactgagcgcgacagggcccgcctaggaagcagtgttacgatagacggggataccttcgaggtggtggacgagttcgtctacctcggatccttgttgacggctgacaacaatgttagtcgggaaatacgaaggcgcatcatcagcggaagtcgtgcctactatgggctccagaagaaactgcggtcaagaaagattcacccccgcaccaaatgcacgatgtacaaaacgctcataagaccggtagtcctctatgggcatgaggcgtggactatgctcgaggaggacttgcaagctcttggggtattcgaacgccgagtgctaaggacgatcttcggcggcgtgcaggagaacggcgtgtggcggcgaaggatgaaccacgagctcgctcaactctacggcgaacccagtatcgtgaaggtagctaaagctgtaaggatacgctgggcagggcatgttgcaagaatgccggacaacaaccctgtaaagatggtgttcgccacgaatccggtcggaacaagaaggcgtggggcgcagcgagctaggtggattgaccaggtacaccaggacctggagagcgtgggtcacagtcgaggatggagagaagcggccatgaaccgagggaatcggcgaaatattgttggcgaggctttatcaagataattgatgtaaagccaaataagaagaagaagagtcataacttcgtgatgtttttttttttgtaaaacatccttattacaatgtacttgaactcaccacggcaaaatattttgataaaaacatatttaactagttatttttcaaccaaaacaaaatgtaggatctgtgctgaccacgtaagaattgattttcctaaaaaaaaaatgttcaatgtaaacgatcactaaaccaaacaaatttatcacagatgctggttgaaatagtctacagaaaaatacaaaaatataacaatatttgattgtttggaaaagtactatgattttcattaccaaagtcgtgcctatactttctggaacaccctataattctgtttatgccaaatgaccgttattccaaatgtccattatgccaaatgaccttatgccaaacgactttatgctgaatggctttatgccaaatgatccgctccccaaatggtcaattcgccaaaaaaaagaaacatgccaaatgaccttctctcttgttttatcatacccttcaaccctaccctaatatgttatgtatatattttatgtgtgttatgattttaattttgaattgcttttttctcgttttcagcctactcagagctagctatcttaaggaatagaacggggtaatttttatgtacataaacaaccgatttcgcatcctcatttattatcatctgtttttaacatcgattcacgagagattataaagtcaatctcaacatgttcagcacatcacactttccaattctaacactcctccaacatctagtctatcagtgttgtagcctgcgtgacttaaaccggattcacacctcatttctctacttacagtggatgatttgcccttcttccttacagcagtttgagccagcagctgatggagtgcgtttatctgtagtctgagtaccttaagtggtgaccgtcgcgctacacgcccacacattgttaacgaatgttaatcgtccactactacctatactaacaacagaactgattgtcatcgtgtcgcggtaagcatagcctttgaaattccttattctaaaatcctacaccactactgtcttaggttgtacaagtgctttccctgatcgttgagtttttcttttaaattttagacgaaaactatgaaaagacaatatttctttattatacaagacattcttaagaaaaaaactcagaaaaaaaaacaaatagtaaaattgtaaatttcgaagattgtttttttaatcaacacctaccaatcacttttttaaatgaatatattttttacactgtgcaacaattatccactctgtaattgttatatcgaatatacatacacgataatatacacattaaaaataataagagtaacccgccagctcagttgtggcgtcattcgaaaattagaaactgaatcaaatccctcgtaccgcagaaggccttgtatttattgatgccgcccgagattggtatcgtactaaaatatacaaatcgtacctttaaagctgaattgtattgatgattgatctgggtccataatccgcactttatgttcccgtaaagtttcgcgaaggaaaattctcaatcggggcgatggtcgtgatgaacaacactggaatcattcgcctattttgtatgcctattgtgcgagtcttgacagtgcagactagataactttattactgctactgaatgaaggtacaggtacaccagacgcaggcaattatacacattattatattgatttaacagtaagttcggaaatacatttatctagagttgagttatgaagcaaaataaaacggttgagcgttatttatgatgacattgtcccttttttttacttattcatttatttacaaggctcaagcgccagcaggcataacggagccgaattcatttgaaatcttttttacatttcgttttgattattaatatctaaggttagcttcggggaatcgtaaaactcgcggataagtcgagattaaggagaacaatattttagggaaggataggattgagggatcattccgtcagcagcgtggtattctggcatctttgcagctcgtcaaacttcgagtggacagaacgaaaacctgtaacgacaagcgacaagcgagtttcgagggggcacaaggtggaggaacaaacgacaagacggaggaatcaaatatggatttcggcttgcttcgaaaatttgtacacaagctccatatacacaaggtcctgcttacccaacacatctctaatgtcttccttttctggtttcccttgggctctgagagatgcactaaaaacagatctgacaaagtcgtattcggggtattcccacaccacgtgattaatatcttgattgcctgcatcacagctacagtgattgctattggtgagccctattcgatggagatgcgagcctagagcgtagtgattggacatcagtcgacacatgacaccttgataaagtctcgactgaggtccaaccctttaaaccatggtttctttgatacctgtgggagaatggaatgtaaccatcggcctaattctgctgcatcccatttttgttgccaactgatcaaggcttactgacgagcaattgagaaaaaatcgttgaaaggatttgtctgtcataaatatcgccttccatagcgcccaccttagaaagagagtccgctttctcattgcccggaacggagcaatgagatgggacccaaaccaaggtgatggtatataattgattagatagagcactcagtttagatcgtatttcgcggaggaaatacgtggagtgctttaccggcctcattgatcgaatagcctctatggagctgaggctatccgtaaaaatgaagtactgatcagagggaagagaggcaattcgctctaatgtataatgtatagccgctagttctgtgacgtatacggagcaaggattttgaagtttatgggcggcgctatgaaattcattaaatacaccaaatccagtgggatcatttgtttttgacccatcagtgtaaaacgttctgtcgcaattgacgtgaccgaacttgcttgtaaaaattttgggaatgtgctccgatcggagctgatctggaattccacggatttcatgcctcatggtcagatcaaaaactacagcagaagcagagaagcaaccatgataggggacattccaagaagggttaacctccagaaccatgtacgaatagtacagtgtcataaattttgtttgaggatttcgttcgattagcttttaaaattgccaattaccaaaggattttgcacctcacaacggttgaggaacctaaacgacagttgacattgtcccttgaagaatcctcatacgaacttataaacggtgcattagaaccgcaggttttctggggccgatataaagcccgacttctagcgatgacacgtccccgtatatcacgactgattgactccatgtttcacggctgatcgtcgttagcaaagatccaaggttgtccatccgtataatcagcgaaacaaataatttgactggatcctgtgaaatttatgaagtggagtgatagtccgacattttctcgcaatctctaatcaattttgttaggttcatttaaaaaaaaacttgtcgtccctgatcaattttttaacaagggggaaatctgcaatcagatccatgagaaggtagctcaaggagtgtggggatgcagcatcaccgacgacccactaaaaccggcccatgcactgtaggtgagcaattctcgctgaattgctcaagtggtgtacagtgcaccgatattaccgttggcctcagacccttatctccccggaaccaccttacgctatttcttcggggaggggccagtgcatacagcacttaacacatgtagcagaaataacttactacacaccagcacaatatgaaatataaataataatacacaatataaatcttcgagctgtttagtagaatacctataagtagatgaaaaaaccgaatttagtactataccatttaattccactagagcttgtatcctttgacagatatgcgtatttcgacctcaactgtaaggccgttttcagtgtcgtgtactagactcttcctgctacttcctgcttccggctgctagccaccagtttctcgatcgccccacttttccaagatcctgctccacttagtcaaaccacctagctcgttgtgctcctgttcgtcttataccggccggattcgaggtgaacaccatttgttgttcggcattctcacaacgtataacgctcatcgtacccttccagctttggagacttcctggatactgggttcaccgtagagttgcgcaagctcgtggttctgtaaagtttatctcgcaaggaggacgtgcgtcgtatgaagaagcgaagagttttagggcaatcagtctgacctcttttcttctgaaatgtgtggaacgcattatcgataaacatccgtgatgtttatttggcaaacatgcctcttcatgtcaatcaacatgcttgccaacctggaaagtccactgttaaagctaagtatgctgttccgctcaagaaaagtaaaaatttctgcggaagaaatggtcaagaaattttctacagtgagctctatttgaaatgacatgtcttttcaactgcgtactgcgatcaaagaaaaatgcttttcttggccatttcttacaagaaattctccacgcattgagataggcgattacttttctgttgaagtgcatacttcgcttaagcctgattcgctactgacaagtaatttcttggcctatcttgatgcatgagaaattcctgcaaggaattgatcaagaaagcgctttttttctaatcgcagtacgcagttgaaaagagatgtcagttcaaacgggagtggctgtagaaaatttctgcaaggaatgggcgagaaatttctttagcgattcctgttcagcagcaaatcaggctttactcttttacacaaagttgtatacgatatcgagaaagcatgcgctcagaagcaatcctgcttgggtgttttcttggatattgagggtgccttcgatagcgtgtcttgggatgccatattgaaagctgcacggaacaatgggctgactacaatgattcgcaattgaattaatcaaatgctcaaaaaccgacatctcttttcgacattgcgtcaagcagcgattagaaaattgagtgcttgtggatgcccccaaggggaaatcttgtcaccacttttgtggaatatcgtagatactgaggcaacttaaccttcgggctatcgtttgaaatcgtcatatcttaaaatccagataaggaacgcgggggtctttattaaagttgttctggaggtgaagcactatctgatggtacctcatttaattcggaatttgaccgctaagtggcgctagtgggcatggaatatttatttttgttttgcagatatttcagaatcctgactatttagaaggatgtcgtcttcggcaaagtttttagtaagttaaggactgtcatttttcgagctagttgattaaaaattttaccacgagacggcgctagtgagcatgaaacttttgtttgcagatatctcaggagcctggccacttagaaagatagtgccttcggcaaagtagttcagtagctcatgggctatcattatttgagccaagaaatagggtattttgccaccaggcggcgctagtgagcatgaactttttgttttgcagatactgcaggatctcgactttttagacaggcaccttcagcaaagttgttcagaagctcagggactatcattattttacaaaatatcgaactttaaggattaaacaaagaaagaatttgagctactgaacaactctgtcgaacacaccatctttctaagttgttagactcctgggatatttgcaaaaccaagggtgttgtacaaagtacaacgcgcgactactcgcgttacaaaaattcgcgcgacgaacgaaaggttaataattgcggttttccaacttatggatttgccgacgactatctagctttgatagttggtatatgcttaagcaccctattcgacctgatgcaaagtgctcttcaagttgtcgagagttggtttcgccaatatggccttttggttaacccgaataacacatctattctcgcgaaacattactaaaggacctatctaacattgagaggctctctttgtttactttctctttcattaataactgagtcacattaaactcttctgttgcgttttttgtatgaaacgctagtcaaggaaattgattttcgatctatagtgaaaaacttcccaaaatctttagtgttccactgttatgatcgaaagagaacgagagaagagagaatctctcatttgtacataggtcctttagtaatgttccgcgagtattgttctttttacggaaagacaaaaccgcgatggaattcgacctttatgtctttttggaactgagtttaatgtgactgatcatagcctttggtcaatgccggcgaacctttggtaaaacctcgggcctcaaacccaagtattcaaatagatttacacaacagttgttaccaatattggcatatggatgtcttatgtcaggcctgcccaacctttttgaaccgcgggccaaatcacaaaaataatttcgtgtcgcgggccaaattaaaaaaaaaaacaaatattcgcttaaagtgtgacaaaagtaaataaatgaagttcataaaatctgacaaaaatcagttgatgaagtaaattttatttgaagaaatcgggaaacagaaaattcctgctagtcattctgctggatgttgtgagagtttatttcaaaactatttaataatctcttgcagaatattttgaagaatcaactccaatttttttttcaattctgtgcaaataaagctctggattttatagaaattattcttttaattttgtcagaatccgacccaaaatgtgcttttacgaaaattttggtcagaatttccaggattttactagagtcgtgcctaggattccttcagaatctcactcaaaaatcatttcgaaatgcaaccttgaaaacgttgagagtgctaaaaagcactgttgtgttgtgaaaaactcgatttctcatatctcacgcttgagatttttcatgcgtgagttgtcatttaaaaaaatcatggatgagttggcgcacctttttgactaaatgtctcgtatttccacagtttactcacatacggcaataatttcttgttagtcttgtaaaattatactaatcatttctaacgtaagcaacaacattcgggtttcacgaatttttgacgggttttgcgactgaatctttttttacagttagaattgattgaaaaaaaaatgcgaaatcatcaaaatctcaagcgtgagatttgcgaagcagatctctaataagtttgctttcatgggagagcatattgattgagatttgagtgtgagtctatcaacactgctaaaaagtatttccagtaaattcaggctagaagtctatggaatactggtaaaaaatctgtgccgatgttatccgtgatagtcgtttccagaattctaaaaaaaccctgttcaagattttgtaaaaagcctgtcttaaaattaagtagctaagaagatttaaaggacacaaaacaatttaaataaattataaggttgatattaaattggaaattaagtaatttctaatttcaggttggtaggatagtcaatgggccaaatttgagaagaatcttcgatccctccgcgggccgcacaaaaagaggtcgcgggccggatgcggcccgcgggccgtacgttgggcagccctgtcttatgtggtggcaaaagagcgaagtgagaacaatccaatccaaattgggccacctccaaaagatgtgcttgatggcgatgtctggtgtgttctctacgactcccacgacaacgcttgaggctcttttcgacgttgtgccacttcgttgtttccatttttggtggattgggacaaaattgtccttgctccaagtgatctcacaattgattgtcactttccttacaggacatttactacataattcccttcacaggaagagtggacgtctggctatttgaaaaaaaagtatatcaaacaatatagtatgtaatactaaaggctcccatcttgaaggtagaactggtgcaggtgtatatcgtcgtgagctaaggttgacatagttttactcacttggcagacactgttccgtttttcagcacttcagcagcgcgtaatgagtgaagtcatatacttctgttcagatagtcaggctgctataaatgctcttgcgtcggccaactcaaggtcgaagcttcttatcgcatgtcgaacgcaaattgaggaactgcattcagtcaactctgtaaaccttgtatgggtacctggccattcttccatcgctggcaattaattggctgatgagctagctcgcgaaggagcatcgcatgacttcattggccctgagctttagatcaattcttgggcaactcaacacaagcaatattggaatagtttcgagtcgtgtcgtcaaacaaaagtgtacattactgagccatctccaagggtggcgaagtatttaacaaatctgtcaaagcagaattgcagtctcttggtcagagcgttgacaggcctctggcaaatattcagcgtgctgactcatttgtgtgtgatagttttgactccaattatggaacttcgtatcacctatgatatgtaactgtccagtttttgtgcaaatgcgattacaattacttggtaaacactcattaagtgaaactgaattcagaagcctgaatcttcaggacattctgttatttttaaccggctgtggtattgagctataggctctctttacgctcatgcgttttgcagtacccttttaagggcgttgttcgaacccattgtggtatggagctacatgctctcttttcacttatgcgatcttccctcttcaaatgatcccactcatatttcctaccatctttcccttccctttcttctcccatcgggtagatgatgaaataaagcctgtccacgataaatttcggacacggatggcgggtgtaccacagaaagttcgagaattttacagaaagaaggattaacatccttgtcaactgtttattttgtagatataactcttttattctgaaaaaaacaattgtttttgttgaattatgagtaacttttttttgctgccattatttgggtgtccgaaatttaacgtggacaggctttaggctcaaatatggcgatggcacaaatatcccaactggtgggaatatgcctttgtcgatcgcccgtccacaaaaccggcttgataactttccacaaatctgcttgctagcggcgatagacggtagaagatgatctgggaaagcactttataggctgcgttaagaatggtgtccgctcgacagttctcactttctaacttgccaccatttttgggtatattagtccctctatccactcctccgctggctgttctgtatcccagatcctggctataaatcggtgcagacaagtagccaacttgtccggacccatttcaataagttccgcttcaaaaccatcctttccagctgctttattgtccttgggctgtttggtagcatccataacttcacatattgtgggagttggcacgtctccctcatccgtcgtactgatgaagccatttgctgccttcgtcttcctcctctgcgccgtttaggtgttcatcgtagtgctgcttccacctttcaatcacctcacgttcgtccgtcaagatacctccatccttatcccggcacatttcggctcgcggcacaaagcctttgcgggatgcattgagtttcttgtagaacgtacgtgtttcttgagaacgatacagctgctccatctcttcgcacttcaactcttccaggcggcgctttctatcccggaatagatgggtttgccgtcttcttttctgtttgtatcgttccacgttttgacgggtggcttgctgcagcatcatcgcccgcgctgcattcttctcgtccaaaaccgtctgacactcctcgtcgaaccaacccttccgtcgatttccttccacgaacccaatggcaccttccgctgcgttattaatggctgctttgagactattccagcagttctcaagaggggcttcggtgagctctccctcttctggcaacgctgcttcaaggctttgcgcgtaatcagttgcgacttcgggtagcttgagtcgttccagattgtaccgtggtgggcgtcggtaccgaatgttgttcacgacgaaaagtctatggcgcactttaaccatcacaaagttattgtcggaatctatgtttgcgtcagtgcaaatgtgatccaagggaccatcgagttagccatgaaaatcaacttttaccatggttctctaactcgatatcgagatatgaaacatcgagtaaggagagttggctgtatgaggaatacagatgtcttcaacaaagatcttctctaaaaacaaaggaagtctttatttcgtcgttgctatgatgccgaaaccgcggtccttcagcacatcagtgagtatgtgtagaacatgtaaaaagtgagtatttggtactaaaattaccaaatttgtaatagcacagtatacctacattgtgtaaaacgcataaagcgaattcttgtaagtgatcatttcaatctaatattcataaaaaatatattttttgtctcgatctctccacatctcaatggtccctcggatatcgagatgtggagagtcgactgaaacgacatcttattaagtcccacccttatttagtctcagttttgaggctgacggagggcggccgattgtctaatacaaggtcgcaaaaagagcagagtattgggggtgtatttctagtttagtcatgcagaataaccctgactgggttttgctacaagaaggatcattcggacattagacaaaacctgaaaaaggtattattttaacagttatctttattcttcataattatcatataattttacagctgcgttacctatttattctgaaaagtaggcagtattagttaatagtttacgacctattaattcatatactagtaactagttgcgttatggcagttccgggctattgatataagtagagtagttataacacagtaaatatcattcggagtaacgctgtatcgtttatcagtctaaatatcacacgaaaaaagaacatcattgtttagagcttttcataaaaagagcgaccttatccgaacttaacgttaaaaacaaaattaggcaaaaacaaatgaaataattgatctatccttttgagttcactgctcctccgctacccctccaagtttgctcagattcagcagactacgccgaacgccagcctttggtcccatcccatgtcctggcaaggagaaggaagaagaccccattgacagggcggctccatgattgaacgaggggttgtgagaagcgctaccaaaaaccggcgtgtgtgagtgatgcggcggaaagattagggacggaacctgtggtgaatttaagtgatgggactgctggaagaggttactctcaccgaagagacttcgaccgctggtcgagtgatatgacggacggctgaaaaacgacccatgggaggaaggaatcggcgaggattgtggcagcggtagatggaaggactgattcagacgaggggttggctgttggaaggcggccgatacgctactcgcattcgaggcaaagatcccggccggttcggagaaaagtgatacccggtcgagctcaacgccgggaggttcttccggcgttggacgccgtgttggttgagattcaaagccggaactctgagacgacgtgcgcgacatgtagggatgggtaagtgtcgcgtcgtgtgggttttcgccgccttgtttctgcggagagcttccccagtagccaccagcgatccaggaacttccggactccgctacggtacctagttggggaggagagagcgttaccttccgttggcgcagggaaaacccgtcatcgcggtcaacgtgatgcgtggtaaagggattgtttaccattgtgagatctttccgggaaaccgacatgcggccactgatactcaaccggtcgatgtcgtccccgaagcggtcttcctccacgagagtcgatttgttgaggcaatttgtggagaagccgtatttgctgaaaccgtaccccagggaggattcgttcggtccagcgatggcagtggtgaaattgtccaccgaaacggacggagtttgacccaagaggctagagcgactgacactgcggattgactgttcatggaaggtggaattcagccggtttacgttcaaagctgacccaccatagtgggatctgggcgagtagatctgactgctgaacgaggtatcgaggaaaggccgcaaagtggaagcactgagaacagagggactaatggatttagtcgtgtccattgatttggcactcatgttgtttcccgatggtttctcctgttggtactcctttcgagagcagatggaagcatcctgaagaatggaactgctgtcatcgatggtttccgagcagtcggcatcgtttccctgctgggagtagatcttgtgaaaactggagttgacgtcgtccgagggcttcaccttgggggccgtctttccgatgcaaccgagggccgccagcaatgagatcgacgccggcagcaactgaaacgagaatttaataatgtagtacctacaatagttttccaattattggtcggtgtgtaatcagactggaccatgtgtttttactggttttcggaagacggtatgtttgggggggtgattgggattccttattgggtgattgggtcaactttcaagttaactcatgagacaagttttttttcgagttttaagagtttatctttcgatatctaggagggaaacgattccgaatcagtggagtagcagacctcctaacttctaaaataagcttattgtttcaaggaatctaaatgtctcatgcgatgaaacctgttcacagtttcaaaaaacgactttgaaccttataagtagaagcaataatttgatacgctggagtaccgatgcatggtcataatcagtatcattcaatcagcttagtgaccgaacctgattaagggacgcgcttttgagagtttaatagtgacaagctgttttctccaaaaggtataaatagcggtatcgtttgtataaaaaacgactacttcattatttctcaatggaccgatgcacgagttcactaatttgacgtttgagcggtgccgaattcactggttgctatggacacataaataatacggcaccgctaaaacgtcaaatagtgaactcgtgcattggtccatagtaatggagtagaacgacatgcactaaacaaaggacaccacacagggtatggaccaatgcacgagttcactaatttgacgtttgagcggtgccgaattcactcgttgccatggtatcgtaaataacacggcaccactcaaacgtcaaatagtgaactcgtgcatcggtccataccacaaaagatcaaagaaaactgttcgcagtggttcatcccgaaaagaaacagtatgtgaaaatttctggagtgcacaaagattttctggagcaaattctggacgaattcctgggagaatttgtggagtgatttcgtaaagaattgatggcataattttgtgaagctccatgatttctcttaagcttcaacacaatgaataaagtgttttttgaatattcagcacgttctgttattcaatgataaattgcgaaccttgctaacatatggctgtgtatgctcttagggtttattcacaaatttcataacgcttaaaatggccattttcgacacccacccaccccttcgtaacgctttttgtatgtgtattttacaaattttgtatgagccgtaacatcatgaggacacccacccacccccttcagcgttatgaaatttgtgaatgagcccttaaaatacacacattcaaggcgaaccagccaagggctgaaagtctcgataataaagacaattcattcattcacacacattcaatctctaataagaaaattttcactaacttcacgtggttagaaaattggcgtaaaattgaggcccacgttgagctaattctacaacttatttatttcagtttcccttaaaagtaaagaaacttatttttcgcgattttttcccacaacaaatattgaaataagactgcatgccatcaacttgctacggagtggagtaggttatagttgaaatgtaaacaatcttttgctcttttattaaacaagagttaaaaataaacttcgtatctgtcgtaatccgtcgtaatcgtaatgggttgtaaaatggtgagtcgacaaccaggaaggagcgtccaacatagctctggtcctcgcaagtccctacctcacgcttcctcgggtctaacgatgacaaagaccgccagctaagggttaggtacttaactggtagtgcaacctgggcactgttgtccttctgacatcagctagagtgagggggtgcgtcccgagcgtctgttcaccaggaggtgcggctcaaacagcgtctgttctggtatccagcggctgagtatgaaatgttgtatcacgtcaactaacctaaggtggcagccccatcaacgtgatgtaggtagcgcaatcccggtaaggtagcataccgaatttctcacctaccacgaaaaatggagaaagaagaaataacgaacgatattttcggcaaccgacctggcaacgaaataaggactatgaatggaaacttggtacctggaatgtcaggacgttaaatgaacccggacgagcgagccttttggctcgtgaactgcagaaggttggagtgggcgtggccgccattcaagaagtgcggtggcctagatctggagaacgtgaattccgggcggttgatcccatcgccaacactacgttcaaatataacatctaccacagcggcggcgataaggcagaacatggagtcggtttcatagtgatcgggaagcagatgaaacgcgttatgaagtggaaaccgattagcgaacgaatctgtgtactgaggatacggggcaaattcttcaactacagcctgatcaacatctatgcaccgacgaacgacaaacctgatgacgtgaaggacgcgttctatgaaggccttgataaggcctatggagagtgcccaaaacacgacgtgaaaatcgttatcggagatgcgaatgcgcaggtcggaagagaggactttttccgtccgatcatcggtaaggagagtcttcactccgttaccaatgacaacggcctacgactagtgactttcgctgctgccagggggatggccatatgcagcacctgctttgcacgcaaggatattcggaagcacacctggaggcatccaaatggtgatatttgcaaccagatataccatatgttggtggatggccgacatttctcagatgtcatcgatgttaggagtttcaggggtcctaacattgactcggatcactacctcgttgtcagtaaaattcgagcgcggttatcaactgtagcgaattcaagaccacagcgaacaatgcgattcaatatccagcgcttctcagcagacggtgttacagctgaatactaccaaaagctggatgagcggataagtgaggtcaatgtgagcgataacctcaacaatctatgggatgcaatccatggagtggtgagtgaaacagcgcgagaagtgataggtactgctcgaagacgccccagaagcggatggttcgacgaggagtgtcagagggtgacggatgagaagaacgtggccagacgtcggatgttagtgtctggtaccaggctgaacagagagcggtacagggaagcaagatcagccgaaaagcgaatccatcgcaggaagaaaaaagagtttgatgagaacgtgatagccgaggcgcaaaactatatggattctatgaaactgtcaatggcgtgcggagaaagtcagtgccgtctcccgtcatgtgcaacgaccgtgaaggtaatttgctgacagataaaacgatggtgactgccaggtggaaagagcatttcgaaacgttactgagtggagggaacgatagagcatcggagaacagaatgaacatcgacaacgacggtcaagctgtggagcctccatctctaaatgaggttaagaaggcgattaaagagctgaagaacaacaaggctgctgggaaggatgagctcccggccgaacttctcaagcacggtagtgagcagctgcatataataattcaccatatactactaaggatatgggaggaagaagaactgtctgctagctggatggatggcctcatttgccctctcttcaaaaaagggcatagattggagtgcgccaattaccgaggaataacactcctcaattcggcgtacaaaataatgtcacgtattctgttcaatagattgagaccgcttgaagagtccttcgtcggcgaataccaagctggttttcgtgagggccgatcgacgtcggatcaaatgtttaccctgcgacagatcctcgataaattccgggagtacaacttgcagactcatcatctgttcattgatttcaaggcggcgtacgattcagttaaaagaaacgagttgtgggaaataatgatggaacatggctttccgacgaagctgattagactgattcgtgcaacgttggaaggatcgaaatcaagtatacgtgttgcggatgagatttccacatccttcgtcaccttagacggattgaagcagggcgatgcactttcaaacctattgttcaacatagcgttagaagaagcaataaggagagcttgcgtgcataggaatggcactattatcacacgttcgtataagctccttggtatggcggacgatatcgacataatcgggattgatcgccgagccgtggaagaggcatacgtgccttttaaaaaagacaacgcgaattgggctcattataaataccacgaagacaaagtacatggtcgctggtagacatcgtgggcccataggtgatgttggtagtgaggtggtgataggttgtggatatatatttgaagtagttaaagaatttgtgtaccttgtaactctagtgacttgcgataatgatgttacccgcgaggttaaaaggcgtattgcagctgcgagtcgggctttttacggacttcgtaaccagctaaagtcccgcagcttacagacgaagaccaaactcgcgttgtacaagactctaattcttccggtagctctgtacggccacgaatcttggacgttgaaagaggtcgaccggagagcttttggggtctttgaacgtaaagtgctgcgaacaatactcggcggtaaattggacaatggcggcgtcgcatgaatcacgagttataccaagtctataatgaaatggatattgttaagcgtataaaacacggcaggctgcggtgggctgggaaccaggaagaggccgtcgcctccgtggaaggccgcgcaccagatggctttttgcagttgaggaggatttaaggtcgcttaacgttcagggcgactggaagcgattggcccaggaccgggtccaatggagaaggcttcttcattcggcgtagattcaacgcaatagcaaggaattgttatgactaattgttaacttatgaggaagtcttaaaggtgtcaaaaattctgcaggattttctggaagcattctttaaaaaacattgatcaaaatcattgaagaaaattgtgtaagaatagtcgggagaatttcggcgagtttggactatttagacagtggggcaatccgtacaaagaatccggtatattccagattcctcgtccggtggaaccttgtccttaaggttacacagtaggtcacgtatggtcttgtcgctcttgtgtgccacttgcagacactgaccatgttaaattccatacacaacacaataaatttcacgataaaaaaagaagtggagagaaaccttttcttttgaaaaatcgatggaaaatcaaaaggaaatacaggaatagcattttgtaaaaaaagagtaatccctgtggaaattcctggttggatatttagaatcacgattcacagcatggagatgaacaatagtgattttgaagaccatttttcttaaaacagagacttaagagacctttcactagaaagacgaaacttttttgagacttgctttaaaatagagaccgagtctctaaaaagagacctgctactagcttactaaccccatttaccaactcgctccgtggtaaccttgattcgcggatcttgtctaaggtaccgtggggcaagtgggtaatggaattcgcatagttgagattcttccaattctagagactttaaattgaaacaaatgaggttgtgtatattttttagcttgactcccaccatatataagcagcatgctgaaattgatttttatgaaaaattgaagaaaaaaatacagaaaaagtttttgaaaaatgtctccttacaaaagtggggcaagtgaaaagtttaccgttttgagcaataaattcaaaaacaaacagttatattcacgatttctattagctttaacacttgttaaggtttcccaatgaacaataacataagtaacatgtaaacaaagaaaatgttattcttttcaattcaattttcttctgtttagttatgttagttgaaatgattcgacaatattataactgcaacatttccaatgttagttcttacattataggacagcaattgcatttctgctctgtagaatttctaccgctcgttatttgtttttgagaaagtcggatatgacgtcggataactcttcgggagaaatcaaacggaatccttcaataacgtatttagggtcttttttatgtggatagacctataccccatttttatgtttagaactagctttacatagacattccacgagatttccgtgtgttctccaatattgcaacttttcagtcaacgtcttccttttaattggctgcccgaagtagacatattgatattgtaatgtttggcaacatcttttagagaatttccatgatttctaatagcttttaacgcttgagtatagtgtttcttgaattatcagcacgttcgctactaaacacaaattcaatctctaatgataaacttttcacttgccccacctgataagaaaactgacggtgtttaaatttagttatttttaggtctacgtcgaattaattctaaatttttttttattgcagtttgaaactgtcacagagtagacctgcgcgccgaaatatttttaatcggcggcggcgtaagagcatttttataccggcggcggcgacgtcatcggcgtcacgccattaacaagtttcggcggcggcggcgtgcatcggcgtggagaaaattggacataaaaatgtttgagtttgtcatattttttccggagttacggagcctacttcttagcttagttttctacaagcactttcacagttggtaagtaaaagttttccttgcgaaagttgccctttttggtattagtgtttcgtgtggctggttcaacgatactttatgcccaagaaaagtatggctatttccttatatacgaaaaaatcctgaactagccgggcggggatattaccattaggctaagaaaggctctatgtcctaaaatgtcaagaaaattacgtcaaaaaaccctctagactcgaacccacaacccaaaccccaagatcatgctaaatattttcgcgttgaatgctagataattttgtgtgcataaatataaattacaattaaaacgatgaaaaagttaatgtattatcacaataatttaaattatagcgattggaattattgtcccatatgcgcttatctggaataatctttaaaaatctctgaaaaaaatattttcaacaaaccctgaagaaaaaaaacttggagaaatttatggtgaaatcctttcaagaaaacttatggaaatatttttggtggaaaatacctgaaacatcccctggtaggatactaatctaatatatttgaaaaaaaaaatcattattatcaatgtttggacaaaatttaaaaatagttcctggacgaatccttgagaaaataattttgaatcaggaaaaatactcgacgaaccagaaaggaactcacaagaatgtttggtgaaattaccacagaaaaatgtgtgtgatttctcggggaatctttggaaatttttcgctggacttttgggaaaactattcgaagaactcttgcatgagtgtttgaagaattctcaaagtaatcctgaaaaaaaaatcaagggccttattgcaattccaacaggaatatatgtgctagtaaagacttgcttggaaggtgttctgcagaaaactttgaaggaacgcct

SEQ ID NO: 103 - DNA, 19252 bp, Aedes aegypti
gattggcattcgacataatgatacaatgatcaattggcaaatacagttcttagttaatagttgaagatgttcccatagaataatgagttgagaaacaagctatgtcaccgttaaaccgtaacgccagaacccactgctttcgttttacgtttcaacgttggtaaatttggttttacgaatggaaatgatttccctattggccattcttttctgttcattttcttttaaagagaaagcaggcttctttatagcgagaagagctttcgatgatcccctacatattttcctgaacgttggaattcgcactatctgtggaatatctgtctcaaacaaagtagatccacccacaacgtactgagcatggtttatgcgcgattgtttgctcctgactcgaccgaaactgcacttttcttcatttggtggtgtggtaatagtgcttttcgagatttctgtttgaagcaactcctcgggaaactcggcctcatgcagtttcctcttcaaaccactctcgtctgcaaccatcgctcactcgaaaagttgaaaaatgctctgcgggatcatctcggccgataacgtgaggtttcagcgacagatttcataatgaagtccgagcaaatgccgcctgctaaacctatcgtctgcactgcaatgctgcaagtaaacttggcataaatgaagatgttttgtgaaagatatggatttgttacttaccttttcggctcattttcttatgttgtggttccattttaaataaagaaattcagtcctcaaaacgtaatgcccgtatgtaatgccaatcagattaacttgatgataacaatctagcgatgttccactagatgcaaatgattcacgatctgtcaaaaataagtctcctctggagtagacttatttttgacagattgaaatcgaaggggaaataattttcgaactgtcaattttaagttcgatttcaatttaattcgccaattgagacagaccctaagcgattttttgcgcatggacactagggtgcggcttattttccaaatgttctcaaaaccgaaaattcgtgtactcatatgaattcaaatcatattagaagagaaaccgcaaaatttgagccaaaaatattaagatttaaatattcatttattcaccgtctttgactacaggtcacacagactggaatttcaatattatgtactttacttaaattctatctattatcctattaacaatttaggggttgcgcatgcgtcttgaaggtgaattttcaagttataaaaaatggccttcagtgaagtcaccataactttggttatttctcaccaatttcaaaaaatttagcataattattttcaaaattaaatttatgaaaaccttgtaaaacatcaaatttgtcttaaagcgaaacgatcctttgttaaaagtagttttctcgaaatgtttcttcattttactggaaaattcatatttgtttgaccataagttcataaaaactcaacctatttcaaacatttgtacagtcgaagcttgttataacgacatgacaagggagcgtcgtaatagagaaatgtcgctatagagaatagtggtaacattaaaatctttttcaagggaccgactgtacatatttttgaagcaaaaatagttgtttccatactgttcatacaacatatgtttctaaaaaagggttttggcttagttttgtaacaaaaactactcaaaaacataattttttaaagaaataatggaatttctttggattatttgtgtttttttcgccaaaaattacattttttctattaaacttgtgtttataaagcattttgttttaattacgagttgaatagtgcatatattattttaacatgagcaaaaatattattgtttcaaaatcatttaaaagttgttgacaagtccatttcaaaggtttatcaaatgaggaaaaccagtttcagctttaaaaatattgtttaactgacaaaaataaaaaaaactaacgtttttcgttaagaaatcatggttttgtgcagtttttgttgaataacttggacaaatcatttttttagtgaaatgtgtcaaatgaaaagtatgtaattaattaagtaagcttcaaaaccatgcaagattgggaatcggttgagtattcatgaagttatggtcaaacaaagatattattttagtaaaatgaggaaacatttggagtaatctacattttattgaaactagttttgattttacacaaactgatgttctacaaaattttcataaatttagtttttaagataatggtgctgaaagtttgaaatttggttagaaattaccgaagttaaggtgacttcactgaaggccattttttagaatttaaaaatttaccttcaagacgcttgcccctttaatcttaatatttttggctcaaactttgaggtttctcttctaatatgattctaattcataagagtacaagaatttttggttttgaaaggttttgaaagataagccggcaccgtaataaacagtagtgtgagtagcgaataggggcatgcatgtaacccattcaaacgcaactctgaaattgaagtaatccgataatcgtgttccgtggatttttcttgcagagcacaacattatgaatcaattaaccatgacgacacgctgcaacttctaggctggattcgcacttgctgcaagaccatgacatggcaatttttacagccgaaatgctgccatagtgagaatacaaaaaaatattcgataaaataaatgaaaacgagattaggcagcgtccatttatgacataacgttaaaatgtacaatttatgacctttcgttgcggaggggggtctttgcatgaaaaaaaataaattttgtgtttgagccgcaacgtttgagtctactcccctttcccctagagcgtttcgtaatttgtggacggtgccctagtctgcataaatttagtggcgttgtgtattcaatttgactctctgctattctatttataactgcaattctgttctcagtgtagtctgtatttttctgcattggccgtttcaacaagtagaacataatgagtgacgtttaatttcaggatttgtcaacaaatacgaaatgttaccaatagtttttgcgcagttttggattgccgaagtgaacatttttgttgccgacaatagtaattgcattgccgataaaaaaaacaagtgcctcgtgactttggtgaggaaaaataaaagattaagagaataaaatagtgttttgtgtataataattaacaaatgaagagtgctcaagtgtagttaaagtgtctgctgctaattgttgtgctctattgttgcgtaacattgccctcttaaaagttcagctgcttaggctgccgacaatacgtaagttcccctaatttggattaccatagatcacacgtataagcagtgctcgtccaagcaaccaaaagtacgggcaaggaatttctccaggtaatcctcttgtaatatctttaggaattcttccaaaactgcttcattattccaccaggtgttcttctagaaatttaatcaacattttgtcctgtgatttaacaagaaattcctgtaagaattcctttataaattccttccgaaagttcacctggaattcctcatgggattctatcaggagttcctacagggagtccatcagtgattcctctgagaggagttcttcttcttcttggcgttacgtcctcactgggacagagcctgcttctcagctcagggcatttccacagtttttaactgagagctttctttgccaaagttgctatttccgcattcatatatcgtgtggcaggtacgatgatactctatgcccaagtcaaggaaatttttattacgaaaagatcctggaccgaccggaaattaaaaccagaaaccttcagcaaggttttgctttgtagccgcggactctaatcactcggctaaggaaggcctctagaatcaggagttattctagggaatgaaacacgatttcatccaggcattccatcaggagaacttctaaagattcaatcattaatttcacgaaggtttatttcaggggttttatcaggactagctctaaggattccatcggaagttcctctaggaattccatcaagaattcttctgagggtttcatcagatgttcgtctagggattccatcaggaattcttcagggatcccacctggaattcctccagagattcgatcaggtgttctttcagggattgcacctggaactcaactagggatttcatcagaagttggatttcatcagaagtgggattctatcaggaaatatttcagagactccacctggaatttctccatggactctgtccgtcgtttctctaaggattccatcaggagttcttctcgggattttaacagaaatttctctaatgattccatccagagttccttcaagaatatctttacaaattattccaaggattccttcaggagttcccccagggatttcatcaggagctactgtagtgattctatcgggagtgcctttagggcttctggagatttcatcaggagtggaaagtcaaaatgcgttttgatcctccagggattccatcaagagttccttcaaagattccacctagaattccttccagagattctatcaggggtttctctagagattccgtcactagttattctatgaatttcatgggaaatttcttcattgattccatcaggaactccttcaacaatatattcaggatttcctccgaagattccatcaggagttcctccagggattctatcaggaattccaatagggattctattagaagtacctttagggctaccattagagttcttctgagaatttcatcaggagtttctccagaaattccaccaagagttccttcagagattccagctagcatttcttccgacattctattaggacttcctccagagtttatatcaggaagtcacctaaaaaatccatcaggatcttctagggatatcataaggaatttctctaagtattccatcaggagttctatcaggaattttatcaagaattcctccagggatttcatcaggagttcctccaatgatttcatctggagttcctgtaagaatatttttagaaattcgtcaggaattccttcaggaatcatcattaaattcttcagtaattttaacaggagttcccttagcgattccatcaggatttcctctagagattgtatcagatgtttcatcatagatttcacctggatcctcgagggattacatcagaagtttcttctagggataacatcaggatctcttctgggaattacatcaggagttcttctggagaggttttaggggtttcataagcattttctttagacattccacctggaactccttctggaattctatcaagagtttctatagggattccatcaggagttcccctgagtctttcaataggagtttccaaggatttctatcagaagttcttctaaggattttatcaggagttccaatagggattcaattaggaattcatacagggaaaaacaacagaagtcgtttttggcatttcatcacgagtttccaggggatttcatagggagttcttctaaagactatatcaggagttcctctagggtttccattaggagttccttcagagattccacctggaatttcttcaggaattctatcgagagtttctctaatggttctatcaggaattactccagggattacatcaaaagttttcgtaggattccatctgaagggttcttcaatagattttattgggaatttccaccagaaaattctaccagagtttcgccggaagttcaaccataaaacacttcaaaggtgttactaggattgtgctttaggattatcaataattcctccactgatatttactcagagtttcaaacaacacatttctctaaatgcctcaggataaatctctaaagtaaacctaaattttttttttcatttctgaaaaaaaaaatccatggagatataaatatcttcagaaattcttggaggtatcaccaaaaaaaatcaatagactaattcttagagagtttcctggagagattccttagtatatttctggaagaacttcaaaagcaatctctgaaggagtttctgaaagattctctaaggtaattcgtggtagattccttggaaaaaatccttcaagaaatactggatggaatttatggatgaattcctttaggaatgctcggagaaatttatattagattgaagtaattcctgcagaaatcccaggacgaatacctctctaaagaaattcctgctaatcaagttttgatgaattttttgcagtatttctcttgaaatctttgaaggctttttgatggaattcttggaggaattgttgatgaaatctctggaggaacttgatgaatccttaaaaaaattgtgggtcgtatctgtatagaaatgcttgaagtttcgctggaggaatgcttaaatgaatctttggaggattttttggtggaattcttgaaggaagcattggatgaaccactggagaaataccttgggaagtatttgtatagattcctggagaaatctgttgaaaaattgctagaaagaatcgctgaagaaattcctggtggattttctggtgtaactcctagaggaatttgaggaggagtcctaggagcaagcccttgaaaaagtcctggtgaaatccttggcggaatttctggtgatgattttttttttgagaaatcccttgggaaatatctgaaagaattcgtgatgcgattcctgggtaacgcgtgatggaatccttggaactaacttctatagaaatttctgaaaaaatctttgaagaaattgttataacaatctttagcaattctaggaggcagccttggagttagcccttgggatttttttggacagatctctgaaggaatcagtggttgaaatccagcataatttgtagaaaaacctctaaaggaatcctttgaaaaattccacctgaaggtatgcctgaagaatgttccccgaagaaatttctggttgaatctgtggataaatttctaaaggaattattgataaaatacgtggtagaatcccaggaagaacttttggtggaatccttagtatagcttatggattcctggaaaaacttcgaagcagaataactagaggaaacgactaaaagattctggatagaatgtttgaaaaaaaaatcccttggccattcccatatcaatgactgctcagaatatttcccgaaagagacccgtcatgatttatgagttttgccggaatatttcgtacgaattataactggaattcctcttaaatattgatttcttccggtacttaaatgttgaaagttcttctcttccttactgcgattattgccagaaaatcgcgaaaagattctccctcacagccactgcattcaaaaacataataatcacatattcactagactctcggcaagtctacaaacatgcgacgaaatatcgtgttgctgcaacaaaccttgacagtcggtcaaacggttgtatcaacataagtcggtttgactaacttgggagcggagtcaatgttggtcaaaccgtctgagcgtctgtgggctgcattatgtgattctatgcagccccctttaaagtagttattcggaacttgagttcacagagatgtgtttgatccttcgatcttgacgcttgcttctacgggggtgggcgatgagggcaggatcaaacatgttgcgcgttgttcgcgtagtgaaatgaaatagcgccgcggatcgttagtagtgttggatctattgatcgcgttacttgctcttgcgtgagtgagtgacgaacacttgctcggtgcactatgcgattatcgaattatatcgcgaatccgattaggcgtgattatatcatggatcacatcaccaaacattggtgactcccagatctctacctctacctcccactaacccaatatcctttccatgacaactgtggagatgcagaggtatactcggtctctagtaacaacggttgtctaactaatattcctttccttccccgatgactgtaaggacgtggccggcgctgttattgacttttaatatttgagctctcgatttgtgcacattgaagaatggtaagctaatcccaagccccattcattaataccctgtgcaacatcgattgttctggtcaatcacggagtagcaactgagcaattctcgctgaaaccaggccgccatcggcacccatcgttagaattccaatgttatgtcacttatcgctagttttcgataaaacttaagggtggtcctttttgttttctcgcattggtggacccctcgtacgccacctaacttaacagtttgcgaaaaagcccatttttctataaatcttgggtatttcttcacgtgatatgtctcatattccacttggaacacatagcaaacttagtggcgtcgtatagagaaaggatatagctttcatttgatattaaaaaaaattggcggccattttgaattcggccgccatcttgaattttgtttaaaaaaatcgatttttcaccattagcgcaccgctcgttttgaattctgagatcaccatcagaaagctgaggaaaaattgcgtaagataggctacagaaactaggtgagcactatctatcaaatgaacgattttctaaatcatattgtacggttttgaagtatatggcgagtacaatcaatacaaacatcattttttgtacaacaaagaaataagttttcaacctttggtgttttatttgagccgattaaagaataagaatattaattttagtgaaaaatctggcggccatcttggtttaaaatagtagaatgagttttcaccttgatagcactcaacatgttgactttaattctatcgttacacttacactcccgtgcataagtttgggttcaccccttaaaaaacatgcgaaactgttctgtccatatctctgtgattacacgttcaattgaaactcttcaagccgcattcgaaaggcaaagagttattcttacttcgtatgtatttttccaaaaacattctttgaactttgcatactaaatttttacttgaagttgttacattttctgaattttgtacactaatttttcacttaaagttgttacatttttcaaaaaacactgaaaaaacatagctgatttcctcagtattggatcgaacaaaatttaaaaacaaggtgtcattagaatcgtaatcttatattctttgaagagaccccacgaaattttggcggaaaaatctgcaaagtaatcaaaatcaattaaacagttagtcaagtcatcgtgcaaaagtttggattcacctctcagcatggtgtatcgtgcaaaagtttgggttcacctgaactttctttaatgtgtgaaatctcaaaccaatcatgtacgcgccattattgccctcggctctaaggggaaagtgactcgattccctgaagtaattagaggacgaataactgaacaaagcgtgcgaggtgctgaggatctaacaaaacgtcagggaattatattgtctgatgtgagagttcgtggatgttcgcggagttccaagaagactttcactgatataactaactacgtgcaaactagtatgtatcatgggcattgtacctgccccacgatatacgaatgaggaaatggcaacttttgtagctctcatttaataacagttaaaaacactaagcttagtagcagactctatcccaaaagggggcgttttcccaagaatgagataagatgaatgcgatcattatcgttattgtttacaaaattgtcaaatttttcttaatgattttgtcgtattctgttggaaatcttcgccacatattggacagtttttttctgacattcctagaagatttcatgacctttggtggatatctatcatgatccttgatggtttgatatgtcgtcccatgcaagatcgtcagtgaaacattatccaattcccatatgaaagatcattaaccaattacttgcaaacactttcacaaacttcagacgaggtcgcaactgaattagtatagatttgtgagttgttttttttatcagagattcctaaaccgcatagtttattacaagtgttcaagtgtagcggtatctagataaagattcttcgcctgccagaaaccattttacctcgggactcattttttaagaatagcgttggttcgaattctctcattcccatgatagccccagagcattaatgattttagataaatacgagacaaatcaatttacatggatactatgcccacagggaattttcaaacggacccctgataaaataacagagaaagtgaggatgttgtaccactgacgattagctggtcgtccagtccattttttataattggtacagaatgcacaggcatccctggaaccactcggcaaacttcttctcctagtcgaattaaacattcttacaggggatcagcctctgcaggactaaccttctgtagccgacttttgccgaagacgatgtaatgacgttgaacaagttgtacgatttatgaacgttgcagacgacattaatcatttcatggagataagtaaaaacgaacgacctacaattttttaaaaaacgaaattgacgctttttcatctggtgtaacaaaaatctgttggactacagtgtaaaaaaatgcaactctatcgcatttacgaaaaagcaacacataatcaatgaatcaaaccctaggtggtaaaactgttgatagctgcaatcaggttagggatttaggcggtatctttgacgctacgttatcatttactaaacagtacaatcatgtaatctataaagctaaaatatgctcagattcataaaacgttttagtttgtattttaaagacccttacacaattaaaacgcagtacgttacatatgtgaggcctcccattgaatattgtattatttttcagccttaaatcaagatgtaccgtgatgctacaatatttcgcacatgctcctattttctctcactgttattttatccatatttgttggtacatattagattatataattgcatgttatgtacatgtttttgcacggaattttttaaacacggccgtgcaaaaaaaagttttcgtatattttttttcgtcaaaacattatttttacaagaaacgacaaaaaattgtggtacttttttttgcacggtttttgaaattttaaacttaacttctctgtttctattcgattactgaaaaatagaaacttgttttacattaacaattttaaaacgaactatgctaaacattgtgatgtaattattataaaaatgagcgaaaacttgtttaaaaaggtaattctaaacatacaagtaaaggtccacgaaatgattgacgacaatagatataattgtagcataatgggagacagccgtagttactgcatcacagcactcgacacccccacactctggaatacattgtcctgggacgtgccccctccgtatgtagtgagcattcgatctctcacagtgttgttgaatgtaatgaatatcacgttactttgacaattgaatattgcggatatcttctatccccgtggaaaaaatcatcggaaaatgtttttcctgctgactatttctgaattgctatcatatggccatatatcctttcagttttgccaaatttttgacatttgctcacaacattcaaacgcgtgctgtttttatctaagttttgtatttttacactagcaacgcgtgtaatgtctctgttatctctttggttgaggcatcttccattatgatgagctcgatcagcgttattcgggacatgccacacactttcttgggaaccgcacttgttactcttaagcacttaagccaatacgtattttccaatcgcttcaggatccagttagttccaagcgctttcaaccaaattttgacctcaataccttagtatggatagtgcccagggggagtatacgcaacgaggtgcgcctaccgttcatgttttgtgggtgtgttcgtgtagctcacaacgctgctagacatcccgttgtttgagtgttgaaaagcatcagcatttgctgcctggcgtagcccgcgatttcgacctgtgctgtttgggacggcccgtgtgattgttaggcgagctttgtttgtagttgacaggcgtacacccaccctgatagtgctacgcctgccaagagcttacgtttaatggcaattactaaaaatggtccgatctcggtttttcaagcccataatacgacgagttcgggtttgaaaatttaaaattttttgggttcgagttcgggcttgagaaaagtcgggcattgtcggttttatgtcgggattggtgagtattatgaacagagcaaacagcttgaaagttttattgttcgtcagaaataatgaatttgacatttttagaattcaggttttctcacgaaaaaaagggtcggattcggatttggatttggacaagtccgcttactccatctatcttcaggcggcacggaatgtcattataataatcaaaaaatatcctgtctatttgaaaaaaaaagcaaatctcaggttccactgcatatatcgatttgaaaatgtagtgtatcattatatttacttatatgtagcggaatttggggcaagtgtgccaccttaagcaaattgttctctaactttgtctgaagcttataaaattcatcaatttagcctcatgatgttagtttcacatcttttcgtaaccactgtgccatttaattagaaaataatttcataaagtattagttttggagcttctcaaatatcatccaaaataacctatttttcgacactatggggcaagacggccaccgaatgaacatcgcatgtaattctacttgtaatgaaattttctttatttcctattaatattacatacaaagcagacgctaatcgatagtttaaaaaataattttgagtttaccgtaataaggggatgctttataactaggttcaaaacatgcgtaactccctattactcaattcgaacaactaaaatggttatttttgtctccattcaatacaatatatgtattactcttatattacggcgaatatgtataatattgaactagatcagcactaaataacagtaaaatattgatgtagataagtaaaacggtacttaataagccgaaaaacatgctattattgaaaattttgaaaaaaattactttgggggggggggcaaaaatgtcagttattcccctactatacttcagaaatcactactggtgcctcattttggtttattattatggttttgttgatgatgtttacatatttataaatttcactccaacaatttttgtttaccaaataggtggcacacttgagccaataaatatacatttcaaccgaactggatttcgtatgtgaaactaaatagttttttttgttcaatagccacaataacttacacattcatagagcttgacgatgtacagtacgtttgaaaaatctgttattaatttacctttcaccatgcttgaaacaacgaaatcttatacaaatcgacgcaaatttggttgtcttagcaaaagtcgatgtaagtacgtgaaaaacagagcaattttcatcatattttgatcaatgcactgtgaactataaaagaacatattgttaagctcaaagagaaaatatataagggtaccgtggggcaagtgggtaatggatttcgcatagttgggattcttcaaattctagagaccttaaattaaaacaaatgaggtcgtgtatattttttagcttgactcgcaacaaatataagcagtatactgaaattgatttttatgtaaaatcgaagaaaaaagtacagagaaagttttcgaaaaatgtctccttacttttcacttgccccacaggtggggcaaatgaaaagtttatcgttttgaccaataaattcaaaaactaatagttacattcacgatttctattacatttaacatttgttaaggcggcccaatgaacaataacataagtaacatgtaaacaaagaaaatttgattcttgttacttgaattttcttctgttcagttatgtttgttgaaatgattcgacaacattataactgtaacatttccaatgttagttcttacatcatgggacagcaattgcatttttgctctgtagaatttccaccgttcattatttgtttttaaggaaagcggatatgacttcggataactcttcaagagaaatcaaacggagaagttccatgatttggccatgataatagcatttaacgctttgagtataatgtttcttgtattatcagcacgttctgttgttctatgataattacgaaccttgtatacttatagctgcctaaagagaaaacaccaattcaatctctaatgagaaacttttcacttgccccacgtgattagaaaattgacagtgtttttatttagttagttttaggtctatgtcaaattaattctaaaactttttttcttgcagtttaaaactgtcagaggggacaacttagaagtggtacagaaaattattttccgcaacttttttctactgaaaatattaaaataagattgcacgccgccaacttttatggagtgatagttgacaggttaacaatatttcgctccattatgcaataatggttgaaaaatctcagaaatcttttacctatcgtaatgttctcaatggcctcaaaggtttacgcataactttaatacgttaattcacattttcagtaaaatataccaattattttcacttaccccatttacccacttaccccgcggtaccttcttgtagtttttataaaaagtgggggtgcccctatggcacacttgccccaaagtccgctagtgtacattccaataaattgagtacggtgtactcaagctcgggattttcttatacaaaaatttgatgataatgattaaaatgtgacaaaagataggaaaaattgcatgacctcccgtgttatcttaaggccgcacgggacgtcatcataatcaccctatccatttgaagaagctaatcccaagaagcactccatatatcgttgcgaaaaatgtatcactatgattctatatatattgtgtgcacaacccaatacattttcagcttcatcggttgactaaaactcgagatttgcttccacaaagttttgatgataattgttagagtgagacagaagatagggaaaataacacggtctcccgtgtcaccttaacacccgtcggaaagtttgccattatggcggcgcttatattaaatccacatcaagcggcggcggtaatgcgcagaagatatgcgcgcaattcaaacgcaacgtaaaaattcaagtaggcttggatttcttcgtccttcaaggacacaaatgtttcaaatttgctaattctgaaatatttggtgattttcattaccactgcgacggtaggtatatcgacatttttagataatcgcattccgtggatttatcttgcagagcacaataacattgtttgctatagtactcttcgtagttcgtcggatagaaaggattaaatgaaaatatgaaccacaagggtattgtgtatttggaactaaaagtcatttgatttataaaacctaggaagatgatttttttagttcttgattctgtccacaactctgtgaagttcaagagaccttgccagtttaaaggaactatcctcaagatattatttttaagtgttaagaagtatcatttgaacaatagttgtttccgaggcatctataaaagcatattgattccatttcgcttccctattcgtaatgctcaaaaaccagaatgcacttgtagacttccactgtagataacgcatgaagctaggataatcgatagcgttagtaaagccgccttccctgcatcagccaatcgaccagaatgacagcaaataacgtaaattcgttatcctttctcttttttcttttatatttgaatcgaacacgtcgcctcgtcgcttcccttccattacggtttgcgtgtgctaaattgctcaccggaaacatattttcgaaattggcaattgcgttctgtagattcgcgctccggccggtacggcaataacgcgtacgccagcgaccctccaaatccgtgcgaccacgcccacaatagtatcgcgccaaaccgcagccaccaacaacacgacggttaccaccaaaacgatccgtagtcaaacaccggccgtggtctcggtagcagctgctgcagcagcagcggccgctgcggcatctggttccacggccactcaggtcaagcaagtgacagcaattagtaacagcaatgtagtcgtcgcagcctcaacaccatcaacggcacctggtcttgtagtgaccgggacacaaccgttgccagcgttagcacttagctcttccgccgtggccactttgaataatgctagtaatagtaatagttctacgagtttgatcagtacaagcatcccttctacgacgaccgtagttgtcagtacggctcctagtatcagtactgcaatcactagcagtattactagtaataatagtagtgccagtcaggtaactactgctagcactagcagttcttccaccacggtcaccacttccagtagtaaatcaagttcaggatcaaaatcacagggctcgtcggcgggcacgaaaaagaaagcaaatgctagtgctgccgtgagttctgttgatcctaacgatccgacagcagctaagaaagcagcctctatgcaatcctctttttatcagcatcacgtgtcttcctcaatgtacggggatgatgatatcaacgacgttgcggccatgggtggtgtcaacttggcggaggaaacccaacgaattctcggttcaacggaatttgtggggacacagattcgatcttgtaaagacgaaatatttttgcacatgtcggcgctgcaagcgaaaatacgggggattgtcgcgaggcacggactggaggaaccgagcagtgaggtcgcagtactaatatcccatgcctgccaagaacgactgaaaaacatcgtggaaaagttggccgtagttgccgagcatcgaatcgatattatcaaggtaggtccttattggaggtttagaatggtggtgatttaccaaaagatgtattttgaattaggttgacccacggtacgaagtgacgaaggacgtacgggggcaaatcaagttcctagaagagttggacaaggcggaacaaaagcgacacgaggaacaggaacgtgaaatgttgatgcgagcagccaagtctcgatcaaaaacggaagatccggagcaagctaaacttaaggctaaggtatgttggagtgattgttgtggtcaccagtttgctcaaacgaagatatttctatttaaggcgaaggaaatgcaacgagcagagatggaggaacttcgacagcgagacgctaatttgacggccctgcaagccattggaccacggaaaaagcctaaactggaggagggagcaactacgactgttacggttagttgtccagcacttgtttcggtcttcacatgtttttcaactccgtttttctgtttttttttagcctggtgcatccggcattggagtgggagcaagcgggaagaccgccaccccgttgaggcctcgaatcaagagggtcaacttgcgtgacatgctcttctatctggaacaggagaaggaaagctgcagaagtcaaatgctctacaaggcctacctcaagtgatcgattgtggtggtaaaacagctaaaaatggtgataaaaaatatgacgatcgttctctgctgaagccgtgaacggcgcccaaggtaaggaccaaccaccgatccacgccgccagcgaaggaggtttaaactagaaatccggtggcaagtgtgtttcagcttggaagcgcgcgaaagaggttttggcccaatcaaaatgcgtttcatggtcagttcaggtcagatgtcaagagtcagaggaagattggagcacagtttgtgtaaaagtgagagcgaatcatcaggatgtttatgtgtatgcgtgtgtgcgtgatttttgagatttttttgtaaatatttcaattggccgctacggtggaatatcaggaatcgtgcgcatgagtgatgacgagaaggatttgccgggtagaccagtttggtatggattcgccgaccgaactgtttttgacgttttatttaatttggaaaactaacttcgaaatcaagtgtacagaaaacaacacattatagggtaaagtgcacgagcgagtctaggtatgtaggtaaaacagagaagaaaggaaaaaataggtctaaaatagtgaaaacagatttaaaaacaattgtgtaattaattttgagtcctctagagctgtgtgcttggcggaacaaaagaaaaaaaaaactggtcagccgcaagcattgtttttgtttgtttatcattttaagtctatatcgataggaacaaaataaaactcaatagaaatcataaaaaaacattaaggaaaacaaaaatctgaaaatttcaaccgaaaggataaaaaatagtttatatatctattgaatcgccgttttctcggaaacaaaaatcgatatgttataaattatattgacgaacagtcaatgagtaacaagctttgtttgtgattatatcactaaaaaattaaaagaaaattaatgaaaaaaaactaaaattgtttatgtgagcgaaagtggatggatgataatcgtttatttatgtttaatgtcttttcattcaaatttaatttaatgaaatggaaatcttacgaaaatggcaaaaaaaacaacagaaaatgcaaaagaagagatcaacaatagagatacattttcttataaaaaataaactatgaaaagaaaatgaaacgattggcttgtggtatcgcttgaaagaacattccctgatttccacttttgatttgtaggtactattagtgcaccagtagtcgctcatgctcctataaccgcccactagtgcaaaaagtgatttttcgtggaaaaatgcaattactgaaattatattgtagagtttctacaacttatttttgatggtttgtagatttagagcttgaaaatgttcgttcaaaacgtttatttttatattttggttaattctacgagtggcgtgaggtgacaattgttggtctcgtatagtgatgtgacaattatcgactcgagtaaagtgactcgccgtgcaaatcaaatggagagtcacttcaatcgagtcgagtattgtcac

SEQ ID NO: 104 - DNA, 2350 bp, Aedes aegypti
tttcaccagaagtaggtgcatttttgttaatttaaagacggaataggagttgcctgtgacggcaggcggtttgccatatgatttgaaacaattagaacggttatccgtagaaagacaattttatggggagaagcggaagctgcctgctgttggaaaagcaataaatattctgtttaaagtttgaaatttccagaaaaccacaccgaatgaatcaagcatatttctgattatgtacaaacttgatcgggtagacaaacaaaatttgaagaaactaaaacatttttcgctatgcgtatcgtcaaatccaaaatcataaccagatacctatatgtaaccgtggatggcaatcgcagttcaaatagagatagacgaaaccgaaacggtgtggaaggccatccgatacgaaaacggaatagcaatcggacaatgtggcattagcaccatcgcgatacgtaaaatactatgtggcaaagaatccttaaaagtggcgtatcacctatgttgccttatgtagccgcgttccgtcctgttcacgttttttattttcttttccaactggcagtggtcagtcactcctagaccagcgtgttagttcatagcatgaaacgaaaacagcggagatacaggtcgatccccctccgaaaaggactaattgcataactcctcacactttgatcttgtgctctatttccccaacagaaccacgttcaattcgcttcagctgcaggaactggaacgagccttccagaggacacattatcctgatgtattcttccgggaagagctagcagtaagaatcgatcttaccgaagcacgtgtgcaagtgtggtttcaaaatcgacgcgcaaaatggaggaaaaacgagaaggggagtgccattgaagacggcgatggagaatctggagcaaatgagccgagtagtgggagtccttcaggagcaccaacgcgatctacgtccgaggatgctccaaacaacatcaactatgataatgtatcacaaaacattagcctcgctaacatggggttgaatcttcaggagaacagctcacaagtgcatggcttcgacaacgatggaaagctaaacttagggcagatgtctcctggacggatatcaccgaatttgttcctgaacctaaattttgatcacataaatccagtcgacgggagaggtggtaatctgaccttcgagtggaatagttatccaaccaccagcacacaaaacagacaaaactccacattcccttgcaatgtcacggacatgaatggtatcatttgcaatacatctctcggatctacgatttcaccttccgccagtggtccttcttcatcatctgtgaacaacggccttcagtacatgaacattagcagtctggtgaattcttcgccaccttcatcctcttccgtctatgacgacgaaatgaagttcctaaacgttgatcacttcaacatggacagtttcaaaagcgaatcgctattcagcctcgatcacaccttactgactgctagcgatcaccaatcccaccatcaaagtcagccatcccagacgcaacaccctttggacattggctgccaacatggagaaaaggctcacctcggtttggatctacacaatttcaacctgaacgaccccactggacacgatccggataaagcggacaaatcgccctcagaactgttggacttggagaaacccataaatatcaacatcaacgtagaaagcttggaccagttggatgatgataaatattgatgttaggtgtgctattagtgtgggtaatggtgaccagttttctcagatcaaagtgttttcggattcattttgggctttaaaacagtgtttagagtttgggcgcgattggtttcgtcgatgcacacacccgattgaaatttctatggattattgtatggaaaactctgctcttttagacttctgttattggagctcccaattgcattgaaacaaacttcataaaagtattgattagaatgtatctaacaactttgccaaagaacgtgctgaaatggctctgaaaaaagttacagtcctccaacaggtaatgctcaaatcacgtgtatttccaacactgatgagcaccaagaagattcatattttttttcattaattcttgattgttatactgttgtaaaatatcggaataatcattgaatgactcttttacttgcatacgagctcaatagtgttgaaaaaaagcttgaaacttgaacgctgcagtgttggatgaataagcgatattttgcatattagggtaaggtggggcaaaagttcgacctttgtagaataacctggaccttcaaaatagttactacaattctgttgaacaaacttatg

SEQ ID NO: 105 - DNA, 50938 bp, Aedes aegypti
tgaaggatttttttttcactgggttagacaagaaattaatattttccgtagtgaaaattaaaatgaataagtatcactgtgcagcgatatgagacagaatcacaaacaaataaaatcaataccaatttatgaaaatcgtgattattgtgactgacattacttctgttaaccaagaatttgctagacttccccagggcctcctccagaaaaaatcctagctgcgccaatgctaagttagttatttcactcaaaaattagtttcttccactgcgttgtttatatgtatactaatttgaaataagaaataaacttttataccgtcacattatgtaattcccagatatgattacatgttctaaaaaattttaaagcttggaactacatttttgtatttgtttccaatgaaagaacaaaatttaaaaaaaactgacatatttttcgtacaacaagagggcaaacattcttcatatccccatgcatttcaaccctgtgaatgcaacagctgattgaagtatatgtattgcaccgtccgaacgtagccgaagcgtgtgctcagagtaatggttatacaaaaccaccgacggaatatagacaccattcagtcgtgttgaggcagttgacgacgtagcaactttagctttctcgatctctcactcccaaatcgttgtcggattggttcgaaactgagtcgggtttgattgagtgttgttcgtgcaccataaggtgaaggacagctgcgagcggtgtggtggagacatatgcatgaaatataagaaggtcagcagattagagaagagagagcgaaaatccagtgcatcaataacagcggcagccgggcgacagctcgacacttattagttgcggttcaatctcgtgttacgcatcacgcgaaatagatcgttcaaggtttttggattttttcttcttaatgcattagttatcatttttatgttgaacgaatagacataaatttgaacattttaaatctacgattgttttgaaatctcgaaaaatcgagctgagaatattttactggagtgttctgttgaatgaattatttttagactgtggaacttgtgcaacagaagaaaagtagggtgatcaaccaagtgagtcaaccaaagcacatgaaggaagtttcaaaggtgattggacttgactgtcagcgtctgctgtgtacatgaagttatttctttgaattagtctgattaaagaaactgtgatcagtgccggcaaaggaaacacctaggcaagtgcgtcatatattcgtgaaaattattgagcgaaacaccggaagctataatcagcttgttttcttgaaattcgcctttgaattgaaaacttactcaaagaagtggaacgagacgagccgagctccaaaggcgggaagaaaatagagaccgacgaagtgggagaacaaggtgaacatctgcctcaggaaagacgaccgggaaacgtaaacatatacatacgggcaaaagtgcagtaatagcaacagcagcaaagccaatctatacacaccggaaaagcgagaagaaataagagaaccacaaaacagcgaacgggcgtcatacggcatcggggcctacaatcttgctgcagtcgtgcgtttacgacctactccaataacagagcgcagcgcgcttaagggcacgtgtgacgtcctacagaacacaacccagtttaaggtgagttttgggattctgatgcatgtaacgattttctgtttcgtgttttccgttcgaaacacgtttatgtataccgccgatgcatttggtagggtaccttgtgtttgtgctacagatccttggctataaattattcatttccttccgttagggggtgtatatcctttgtttataaggtttccaatgtttccggcatttcaactgcaatggatggaattcttctaacactgcgtataaaacatatcttgtatcctgtttaacatacttctataaatagaaatcatattaatgttttactatcatgaaaaacatgataaccttggactaggtatcacatgtcaaacaattttaaataaaaaaaattacttcagctgcagcctaagatagccatattaacgatcgtgttcataatcgtcatcatcaaaacatctaaagtcatttttctgcggataaattcagacacaaatctcccgagatctgcacaatctgcacatttgcacaaacccgcaccccaatgcatacgaagtacctatattcaaaattaaacacattctgatgcaatcataaaagttggaaatgttaggaactgtatttaatgaggtctccggtcaacaaagttagtagtgttttactttgtaaatcaggagacgtctgatacgattagttgtatcggtccattcaagaatcggtgagaaattttctcggccttttgtttgttgtggtagtttaaccgaagtaataagggaccctccttagctcttagcccttggcgcgggaagtgggtaggataggtaggacatgtactacgcacaaaaacacctgggtaggacagtcgaaagattgtcctacccacgattcaacaaaaatatcagcaaaaaaaccctcacaaacaatctgttttacgatcattatttgattaaattttaaagggttcgtcgattatccctgacagcccagttacagtaaaacatgaatctagtctcaaatctcttaactataatcatttgtacaaattggggccatttttgtaatcgaagtaagaaatttccatattttgttaaactcctggaagtatgcaatgcattatttgctctaagtaattctttcgtttatgtgcgaaatacacttttctatattataaaaacgtttaatttatgttgaattcgatgtctacacgtgaatatcaatcgatatctttcaacgaatattattgtacgccaattcatacagataataatggtgtttaaggtgcgtgtttgagctaaaaacacttttgtatgtgaatttttctataattctgttattttattacctaaaactaatccacgttctccattatcattctacaatcaagtttcaactgcaatgatgccgaacaatagttttgttgtcgattttcatatttttacatacccattatcaaagttaccccaaaaccgaaaatagacttgcgattatatgaagaattacaagtccactcaaaatgaatcttttagcaatctttcaacagcaatcgataactgagataccagtacttgttttaaagatatattgctgtttgcatttgggatgcaaatcaagactaaacgtcctccaaatgcggtaacgcaaaacaatcaaaggacacctagcaacgattaaataaatcaccgccgccctagcaagaaaaatctatctttgacatcgcatttcttgtgaaaaatcttaccgcgtttggtgttcccgcatttgatatttgcatttcaaatgcacacagcaataaaataaaaatctcttaaacagaattcagaaatatttagattttcttccaaaaaactatcaaagttaccccgttttacggtacttattcttatggaggatggaatacatgatacaagatttttcatggtattctcatgctcagtaaagcgtgacatggtttgtgcatgacgccctaaagttctggctcgtgagaagaacggttaagaatatctaaagtagagatgctgggaaactaaagccctcagtacactgtttgtcaagtgtgcaaatttttccgcacgcataaaccaacatgcaaacatcggtctcaacaatgacaaaacatctgaagtgtcaagtggatattgaagtgttagtttatgcgtgtggaaaaatttgcacacttggcaaagagtgtactgagggcttaactataataatcgctacaagaaacttctttacccgttagaaaattctctatggcatttccgaatgaatcaatggatggttttcgaaaaaatatcaacagccaggtagaggtctagaggtctctaatttcctaattttaaagcacccagttactactagccttgtaaagacagaaagctttcttagccttatatggttcaaaaacggttcatacggtttgcgctgagaagtttaccatggcgtgaccctgcaaacctacctccctatccagataggtgccaattactcaatctggacacgttggaacgtcggcgtaatattgcacagatttccactgcagctaaaattatcagtaacgaactgaacactccagggttgctatcccgaatcgattttcgcgcctccagatggactcgcaacacagcagtgatccaacatcgatttcatcgcaccactttcggttacaacgagcctttttctgcaatgttaaggaccttttcaattgtggaagaggaatatgagttcggtgaacctgctaaacgttttgtcaaccgtattatgcgattacgactagtgtgattctcactttttgaatgttaatgataatgtattgttagttatcttaattgctccttttattatcatttagactaataagtccgatgagttacaataatcaacaaataaacaaatggtaactactggcatgggaaataaggataatataagcaaagaaatgtcagtaaaaaaaacaagttttgagaaaatctactccaaaatgtttctgcaatttttcattttatataaattgaagttgaaagcctgtctgctaagaattctaagagttatttttttctgtttcgcggaaaattatctgaaaacattgttagaaagcttggaaataaaagaactttgtcaactcaactcaaaactatcaaaaatgtatcctacactactttacgtttgggctcctcaaatatagtaacattcaatttccagtccagggtctacatttctcttagctgcactgtacacgaaatatttaccaacgttgggtaggacatggttttgaacgtggacgcgccactgatgaacatggtagtgttttacggtagttacattataagtctatgcaaaacatagcaccactctaaatttccagacttgggaaatatttggataactttagtacgatctggaattgttaaaacatgagaaagttgacataatcaatatacgtctcttcgttcgttttctaatctgatgtaaattttgtttttgtaaaattaaagtttttttgactaaaaaccatcaaaggtcgacaaaactgcgtagcatatcacacatttcttatttcaattcccctatcaacgtgtatgcctcacgataaaaaatgagttataaacatttgttctggaaattgcatttatatgtaattaacagttttacagcatttgttatcatatgaaaatatttcaataacaaatgctgtaaaactgttaattacatataaatgcaatttccagaacaaatgtttataactcattcattttacagtagactctccatatctcgatatcgaagggataatcgagatagggagaaatcgagacatagaacacagttttaatgaacactatactagattgaaaattattccatttccaagtaaatcaaaaacaaacagacgtcattttgtctacgcaaattgttttgaatccttaaaatctagtctagtaccgtttgataatgggctcaccgacatatggagaggaaattggggtacgaaaactacatcgttatagagatatatcgagataaagcctgtccacgttaaatttcggacacccaaataatggcagcaaaaaaaagttactcataattcaacaaaaacaattgtttatttcagaataaaagagttatatctacaaaataaacagttgacaaggatgttaatccttctttctgtaaaattctcgaactttctgtggtacacccgccatccgtgtccgaaatttatcgtggacaggctttaagaaagatatcgggatatggagagtgaaatgtatgcagaatgaagggaccgaaaaaatcatcgacataagagatgtagaacatcaagatgtggagagtcgactgtagttatatttatattatagctttcagaattgagaaataaatcttgaaattttattcaatactctctacgcaaaattatattcttcaaaccatcaataaaattcgtattcgagtgacacattgcatcctcttgatcaggaagaattaattgttcaggggtaaaaatttcattaagattcatacacattttcaaaaataatcgaagatggaacgcaaaagacatgcaaaaaatctgaagaattttgtagaaaaccccaaaatagtcgggaggtataatagcaaaaaaataattcaaaaaggtatttacagatatattcactcacaaacaacttaatgattcaaaaagttatctgcggttatggaaggaaaacatcgctggtttgtcactagagtagtagaatagaatttcctcattaaatcgcacaaagatcccgtgaagttctaacccgactaagccagttaccattacagtcgtgatgtcatagaatggtattagcagaataatatattttttagtgagaaaagtattaattcatcaaattgtttgtatatccaaccgtttaaaaaataaggcatttatcaataaatcttagaaatattgcgcatttatttcaccactggaccatcgcagaagtttttacaagtgcgggaacgctaataaaagtgtacgattgcatcaaatcgagtcggtgtcttcagcggagttattaatcgcagttcaaagaataagtgctctgaagacaccaatatgattcgatgcaatctcgcacttttattcgcattttcgcacttatgaagccgcacttcgcagtccagtagtgaaaaaaatacaataaaagaataagaaacacttctgattcagacttgttcttgaaagaaatgggaaatgggttagataatggaactgtgcaaaaatttatgggtggatctaagcaaaaagttggaaaactcaaccaaaaagctaatacataaatattttcacatatttttcccttgaagccttataaaagtgctacaaaattatgcgctaagatttttgtacatttggtcctattcgagaaatcaatcattctgtgcggccaaattctaaggtggaacatatgttgatgggatcctcaaaaaaaactaagaaaactaataaaaatcatccaaatactccacgcttgatgtccaacccgtaatgctgccgaattttcattgagcctcagatggtcgtgcacaaaaacaaacggtttctcttccggttcaaaaattgttaatgacaccagaaagcgtcacaagcgtaccaacagcctttggagggcattggaaaattaacactcccccctaatctgtgacaaattgtatcaaaagcgcatttgccgccaagagcaaacgtgtgaaaatcgtgaccgcactcaacggagaaaaccgaagaacactgccaatgggaaaagaaacaagatacaattagattagacatgtctttcgtcattcgtctcagtccaattgctttcgacacccgacgcatgtggattggtaatttcaaaagacctacaccgccaccagaggcagaggccccccgactgaatctaccatccataaccagttttcaggttagactttcatgttgtcgccataccccaccatagcagtgatgccacgtacaaagatttttctgtaattacacatatttttttctgtttatggctacataattttgagatagacaagaatttttgtaatgatttaatattgcacaagttttgacatgattttgtcacttttaaaagtaagaatgtttttattttgtacaggttttaaatgcattttaaattttaagaatcattctcgcgtaacttttcaaaaaaaacctatgtagcaatgagagattctcctctctctctctctctctttcgattataacagtgcaatactaaagcttttgggatgtttttttttttttttttctataatttgaaatatgtggcaacactgcaccgtagacggcgacgaggacgaccacaacggtgaaggccgcctttctgcgcacatggctgctgccgatcgatcgaatggtggtggagagccagattaggaggggcttattgattattatatggcaatgatcgtatcgacatatagaagagaactgtgtcagcgaatgcttgcaacagtaaacacaactcttgcccaaacagctgaataaggccaaaatttatgggcgcttagaactgggcctttagaacgataatcaacctctgcacagaggctttccggaatggcaaggaatccgggccaccaaactctgtttagaaaagccggacaaacttacgcaaccagagggcaattaacgatcgtcagttgatggtggctaacgatcgatgtcaggaagttgaatcgaccaattgtgtgtatgatgtggcatggcgtggatgtcgtcgtcgatgcgtttgctgcaggaaactcacaattaagcccaggaaggtcctccatttcggtgggtttttttatgattagtcaccacttcgacgactatgtctttctaatcgtcatttgagaagcctaggaagtcgtttgaagattgtttgattaaaaaagtgcttggttgatgagaaattttgtggaaacttttgtatcacaaacgattggaaaaaatcttgtcgaaaatacagtcaactatctataactcgatattaaaaggcccatcacgtgcaccttatacacattacgtaaaactgagattgataaaaaataattgtttcaatcctgaaatcattagtctacgagctcttggtacatcagacatgcaagattaacaacattttgtaaaaataaatagacacaataaactgtaaaaactgagaacaatgcccccatataatcatgggtgtccgattaaaattatacattttaaacaccatgacgaaaaaccgcagcctactgcaacggttaccttcagcaacggcaatcatgaagcaaacgaattcagggcaccgttgctcacattaattatcgcgtggagtatttatgattcactgtttcgcgcgcaagaaggctgaggtttcttgagccaacaccatctaatagcacattcatcgccacttgtgcaaattctgtagcttcctttcacaaaacagctaacacgttggcggatttcatttggatactcgaccaacgaaaaattatggaacaacggcctcgcagatacacaaatcatagaagtacgtacatgtttcaaatgaatggtatttgtttctctcttgcagttctatcatgagcaattaaaagaagatagaattaaatttgtagtgagaattcgaattcactcgaattacattaccaaaaagcaaatcgattagagcaatatcaatctcttcaaatagcaaccaagctcctacattccggagccaaattcgattgcttttgcctttccttatttcttccctttacgactaattttgattggattgggaattgcggatttttaggtgcttaacgatcgatcatccatatgttttcacggattttgcgatgaaattgattcgcctatgtggaaacggtttctcggagtagactcgttcgaatatgcgctctatgctgctagcttgcctctcaaaatagcagcggataataacgaagtggatttgcaattaaatcattacccccaatatctgtacctcatttcccctacaatgagcgacttggattttgtttctctttcggatcatttttgcctcatagttactagcttacagacagacattggcgtaaataaagggcatccaggagagggattccctgactcaaagctgacattccctagactcaaagatggcttagtccagaaaatcgtacaaaaaaaacattggtggattgttaactctatattagattcacatttttcacaaactttcgctttatccattggtaatccaacaatatcaatagctttgaaatgtattgtacatatcgttgttagaaaggggaaaaattgtgctaatttgtgtgtgagaagtcttcgtcaaatgttaagaatttgtctttgttttagttcctggagctcataatattctgaagtagatacaataggatttattaagtttatgtagacgaggagtacgatgttgtaatattttttcacattttatttcattttagtactttagaagatacagggcttaaattcaatgacataaaaaaacttcagaagcgccagatatttagttcatgaaaaaactaacgttatactcaaaaagttgcttcttagaaatgttacgataaaagtttttgggaaaaaggtcccaacgagacggtggcccagatagctgtagcggaaaacgcgcatgaccatgctgagggtcgtgggttcgaatccagctggtcgaggatcttttcgggttggaaattttctcgattccctgggcattgagtatcttcgtacctgccacacgatatacacatgcaaaaatggtcaatcggcaaagaaagctctcagttaataactgtggaagtgctcataagaacactaatctgagaagcaggctttgccccagttagtacgtaacgccagaaagaagaagaagagactgtggccccagtcccaacaagactgtaaatccggccctggttgattcttcttcttcttagcattacgtcctcactgggacagagcctgcttctcagcttagtgttcttataagcacttccgcagttcttaactgagaactttcttgacaaggttgcaattttcgcattcgtatatcgtgtggcaggtacgattatactctatgcccagggaagtcaaggaaatttccattgcgaaaaaatcctggaccgaccgggaatcgaacccagacaccttcagcatggctttgctttgtagccgtgaattctaaccactcgactaaggagggttctcgttgattgcatcatgtaatgaatattttcattaaaagcaatattacatccacgttcaaatcagagatgcatttgaacgcgttctgttcgtgttctgttcaaagcttgtgctcacgagagccgtgttcaagttcaaacaatttggatgtttgatcacagtgcgctgttcatctcgtggcaaccgttatcgtcattatttgttttctattatgtggtgcaccgcaaacacaaaaaccatttcgattcatcgttggattattcctagcaagtaaaaattcattgtatgaaatatattaagacatattttagatcatcatctctgtttcagagccattctttttttaaattgaataacgcttgaacgctggaattactggttacacaacggcgctgtttgagacggtatttctaggcttgagcgtctcgggatgtcattcgcagttgcatattctcgaatattccttgactcgctgtaatcggttgcgggtcagtacatcctgtttaggcgcaaaatataatctatatcgtataacaatctggattttatgaataaacttttgctatacaaatttgaaatttgcgtttttttaccgcccgtcatacctcgtcattcataacaatacaaataatgaacagctcagtctatgtgtaaattggtacttaagtgttctgaattttttaaccttcatgtgtgcgattccggtgcatttatcccagttttaagttgccactgatcgtactagcttgtaccaaaatcgtagtatatggtttggtcgatcgttgaaggtcgagatcgagcgtaagaggtcgaaaaacgtaattgcaggaacgttgacaattttggagatcacaactccatgatcaatctagtcatcgtgtgtgtgttcaataaactgaacatgaacacgagagcaatcaaaggatcattcgagaacgctcacagaacatgggcgttcaaaatgcgtctctggttcaaattattatcaaattattgaattgattgaagacagagtgctttgtgaagcccaagcaggacagtttgcgtcgtccgattgattttgctgacggattcgcgcgtattttcgttgccggagattattttttcccctgttttgaagcgtcttgctgggtagtgcttcgtgaagcccaagcaggacagttcggttttgcgtcgtcggattgattttgctgacggattcgcgcgtattttcgttgccggagaattttttttttccctgttttgaagcgttttgctgggtagtgcttcgtgaagcccaagcaggacagttcggttttgcgtcgtccgattgattttgctgacggattcgcgcgtattttcgttgccggagaattttttttttccctgttttggagcgtcttgctgggtagtgctttgtgaagcccaagcaggacagttcggttttgcgtcgtccgattgattttgctgacggattcgcgcgtattttcgttgccggagaatttttttcccttgttttgaagcgtcttgctgggtagtgcttcgtgaagcccaagcaggacagttcggttttgcgtcgtccgacccaaggaacaattggtagcttttaagatacttacgtgtttaatacaagctgcatagcagcaaccattgctgaacaaatttttagttgaatcattaattgaataaaattaatttccacttataaaaaagcttttattccacttgcagtttgtgttttgaaaaagagctgaataaacctccgaaaatgccaatatagtagcttttgttctacaacacatgagaagtttaacaattgactgattaaaagcttctataggttgtagccatcatttaagtagaacattgaacatttgattaacaacaaatcgtacaaaagtttcagtgtctaatacttaaaatgttgaccagcatgattagtaaagcttagcttagcttagcttagactgactacacatatcaatggttgctattccgtgattgaccgaagtcagtgaaaatgcacaaagaatcaactagaagttcggctgggattggccataatcttcttcagtgtgcataattcagtgcctctatttatacagggtcaataacggcgccggccacgtccttgcagtcaggtgggattgagggaaggaatgttagtgtgtaacctttgctatttggagaccgtgtttgcctctgcatctccacaaaggttactgggagggatgtttgttaatggggaggatcgttgggtcataggattcactttgataagcgattagaccatgataaacaatgatttgtgagatatatacatgcttatacgtaaatataatattttcatttgatatgaacaatttctatgtagaggaaaattatgccgacacttgaggtgacgaaccattcaaagtttgttgaacaaatacctaaatgtaacattcctacagctgtcaggacgaaagcatgtgttattatattttactaatttgaaaagaaacaaaaaactcgattggttgggacatcatagaacactcttattcttatgtcgacacttacagtggcgaaccatccaaagtttgttgaataaagtgaacctttcgcaagtctacacttgtagtgtcgaaccattcaaagtttttttaattacaaaaataaaggtatataagaggtgttctgaaaaaaaaaaatgttaaacataaataactcatgaatcagagtttgtgtcgacactcacagtgacgaaccatccatagtttgttgaaaaatcatatttacatcccaccattgtaacgattgaatgtgcagtcatacatattttatagattagaaatagtagcatgaaacgagctcaccaattgatccgttatccttgactgagcagccacaatccactttcggcttcactcgtttactcggctataaaaaagcactcaggaaaaaaaaaaataagcgcgcgacccaaaaagaataaaaaaaactgttcgggctttcttgacgcactgcccaggagcaagcgtcaaggtcgaaggatcaagcagaactaaccgatcgcggcactttttcactttcttcaaccgaactcatcgatcacgccactttttcacttacgagaccgacgcgcgacatgtttgatcctgccctcgtcgctcgccccggcaaaagcaagtgtcaaggtcgaaagatcaaacaaaactaaccgatcgcggcactttttcactttcttcaaccgaactcatcgatcacgccactttttcacttacgagaccgacgcgcgacatgtttgatcctgccttcgtcgctcgccccggcaaaagcaagtgtcaaggtcgaaagatcaaacagaactctgttgaccagcatgattagtaaaacttataaacaatgtgaataacagtatatgagtatgctcttattcaagcaaaacatattatgtctttttatgttattttcaaatgtttcaaatgtttttcaactcaaatctaagacgtgtatgcgatggatggattaacgtaatggacgtaatggcgacgtaatggatcaacgagggtaatgttcgaatcacattggattaaaaatatcaaaattaaaattttccagacgtagtgatcatcatctgcgacgttattgatatcggaaaaagttactaatcataacattttcaatgataatcgaagtataaataataatttaacaatagttacatgaaagtggttacccaacttacagtcaagtgccacaaataaacatatatagttaattattgttgaataatggtgacaactgaaaaaatgccctacaaagagctgagaagatggtatttagatccaaatttaagtcaatgttcaacatttttcattggaatgaataatagtagaatcaacacttattaaacttctccaaaaaaaatatctgccgacttgtcaagattgttttactaatgagttgaacaagtcatttttccttctattaaagagctaatattccaccaaacaaatataattgtgtaaacaaatgtacaggagacgaactaacgttttggttgcttcgcacttcagctgtttccatgtttaacatgaacatgattaaaagctgaataggtattttataaaatcccaatacaacatagatatatcatccgagcaagtcatccaaagaagttcaaaataacgattactaaacacattgttcagcaacaaagaagccttacaaaagaggtcacaccatagccaaatttttgaaaaatggacaaaatatctaaaaattgcgttgtattcctaatatattgcaatattcaacttactactattattattatttatctttatttgagtggcttttcgcccttggcgaatccaccactaacttactaatatataaaaacatgttggatacaattataactgatgcttcctcaatacaatattcaattatgtttagaaaatattttgaatcagtcttctgacataggattattgattgaaatatattttaaatttgtataatgtttaatagatggaaaaagtacgacaaataaaatattaacctagtagaaatattatacatttaataaatgaattttggtatagttagatgaacaattcaattaaagtttcaacaagttaaaacttattatgaaatttgattaatcatttcagactgtttttaatttgtgaataaactttatttttaaccagcattgaaataaattttctcactgtgcgctataaatagccgactgagttcagctcgcatcagtcgcatcagtactgaacagcatagcagaagtaatgcgcttattcagttgttgatcagcatagcacgtgttgattagttattgttgaatagaagctcaagcatggtcaataatcagctacaagaggtttatattgggcactggaagactgatatatgaattcaaggatggcgcagatggcaagttataccgctgacgatgggaaggtctcgagtttgaatctagtattcaggtaattattaaaagtgtggttattaattcatggtaaaggtatacaactgcatttgatgtatacagtgttagctatttttagtcatttatttgttttcaatcaattttgtggcagttgaataaaaactgagatgaatgcttataaagcgattttgaagttgtagaataaagtcaatatacaacgacacgctttataacttctccaaatttgtgtgaacaacgcctgaacaaaggcttcacttggaaataattaaaatgttgttaaacatgatgctgaattaaactgcaataatgtagtttgttaaactagcgttgttaaatcatcaattcttattaagctaagtgaaacctgaataaacatcattacaatatatgattacggtcactaaatgataagaagcttaataatttcgccagatttgcttgaacaatgtgtgcgtagcagctgcaaagtaatataataaagcaactattcagtatgtagttgtgaaaagttgcttaataaatgattataaaataggcaaatgtttcttggggattgattttgctgacggattcgcgcgtattttcattgccggagaatatttttttcccctgttttggagcgtcttgctgggtagtgctttgtgaagcccaagcaggacagttcggttttgcgtcgtccgattgattttgctgacggattcgcgcgtgttttcgtcgccggagttatgataacatattttttcttgaaagcgtaacttttatgtaatattaaaacaaactttgtatggttcgtcactataagtgtcggcattatgcttttttcttatacaacttcaatatacatatatttttctctttttgacattattaaaaattatctcttgaattgttggacattgtgaatgttgacgtattttctaaaacttctaccatatcgagacaaaatgcacagtaatactcatatgtaattttcaaacaaactatgtatggttcgtcactacaagtgttggcattattcctgtttcatttaagttaaaatatatacatgcaattttcagttttcgtcattaataaaaacgtcttttgaattgttcgacattatagatgttgacgtattttttccaaaaacttctcgagacaaaaatacaaaactagctttaaatacaagtcgtatatttcccccttatccatggatcgcatcaccgaccagaggtgactcccagatcttttcctccctcactaacccctcccgtggtggttgtggagatgcagaggtattctcggtctctagaagcaacaatcattacaccctaacattccttccccatcccaactgactgtaaggacttggccggcgccgttattgatcaattatattagatctgctaaaattgcacttcgagagtaagcggaaactcccatcccttattcatttggatcgtagtgcaattcttaccagttccgatcaatcacagagtagcaaccattgacatgtacagtcagtctatgctatgctaattattgaattgattgaagacatgtactgttgaagtaactggcagaaaacttatgccagttctttacaaatgatcatcgaacttaatgatctccatttggcaagggtcataatccccctagatctgctttcttttaacgcccctgcagtcagagatcggatgagccagacgtgcatcagcagcagaagcggctcatatttcccgtggctgcccagaaaagaaaagggatttcccgttcggcgcgcggctgctagttggtaacttctcacacaacagcgcgaagaaaattgaaatctgtagtcacacagatagaggaaacacatttggccagctagtggagcagaactgagaaaaccaccaattctccacagagcgttgtaaatttttaataattccatccgctttctcagctcccaactgggggaggggagaagacgccgggtgcattgttaggtagctgcttgcgcacactgggccaaatacctggccatatgtcgaaaaatattttgccttatatttttctgagatgcctacttgacgatatgctacattgggttgttatattatcaatataattaaactgattgtttaattgattggcacagttgtttttattaatattatttcattcgctgtataacagcttgagcttgagcttgattggccgcccgtggatgctactccagtatcgccagatcagctgcacttacacaaggaaccaaccgaatgactgcttgggactaacaggcatcctcagtgtataagtgctggtgatcttctattttttagcgacaatggtgcctgccacgtcagaatgcagaccaatgtggggaagggggaggaattgatgatgcattatactggctcccacgtagaccgtatataccactgcatctaagccagttcatgcgggagtgtatggattgggggaaaggcatggcagagaggtatgcttttgtggttagcagactgcctatgtatcaggcgtaaggaaaggcatgcgcatggaagaatggaagcgttacgtttccctaacgtttcagtgtaaaaaaatttccgtaatatacgctgaatttctctatgcatcaataaaacattagtggaactttcgatgtgttgtgctttacaatcaatcagtgaacaaaattaagaaatttctaatcacttatattgcggtgatttggcgtaagcttataatgcgtcacgtctattaacgatgaaaatataattgacactggaaataaggctaggacgttatattataaatatgtaggaatatgacataacaatggattaataaataatctcttactgtgcttatcaaatcggccatgagaattggagggtcttgtttcccgggctcgaataaaaccagagattcgggattttatttttcaaaatcccgtcataaaatcaaattctcaaaatgtgactatagaacggtcaaagtagattgtgaagcaaagtttagttttatagagtagttccaccgtgacccaaccagggttttaagatacagtagaattataattatcaaaaaacacaatgctatcttaaatttcatttttaaatattgcaccttcacattcacctgctttcaacgtcaatttaatataaatttcaatcgtgatgcgtaaaaagtaggtgatatcaattttcatttataaaaacttatttacattcgttgtcttatcaaatttgcatgctttttaagagggttggtatgatagcccttcaagcatgttacaccaatacaagtgtaagacacatcgggacaaatttaaacggctgcgagaagttaaaattgcaaaataacgtagaaagattttaacatgattacaaatttaactatcgaaacattaggttgacaaatgatacaaattttaagcgtaacaaaacaatgtgaaatttattgacataatattcaaaaggttacatttcaacttgcgctaagtattgaattacttaaatattacccttagtactaatcgagaaattattaaacaaacaaatttgaaaattcactacggatttcaaaataaattaagcattcaaacactgcaaataacattaagtgcaaaagaaaacaaaatttttcttatattttatttaaattatgaagtttttaattttttccagtttttttttaattaagttggaaattacgttacttgtgtaccagaaaaaataccttttcaagcgtaatataacttcaataaaaccattatttagcaagctacaagcaataataaaaaaaaaacatccatgtactattaatcaccagagcaacatgccgtttcttttgtgatataatttcaaaattacacagtagtattttctagttcaatattcaatttcgggaaatctcgggattttttagatctagggatttcccggaatatttgtcccgaaattcccgggacaatatcctctaatgagaatttaccttgttttcaagcttattttatttcaggagctcaaaatatattgttgctttgattccgcatgtacagtattggacaaaacatttgcaactttttcgattttccatacaaaatgacgaactttgataaactatatctcagttatttatggaccgatttgaatgaaattttcacagaatatcagacataacttgaattttaaaatatatttttgagtgattttttcaatcgcaagttgaaaagcagtaacggtttggctaaagtgaattttctgacgattttttataaaagacataactgaacatattgaaggaatagctccatggtatcttcagctaagttgtagattttgacgagattaataagtttgctgaaaacagttattgtgtagggctatcagattttgagataaaaagatttgaatttttcgtccaaaattacactttagtcaaaccgttatttcttataaactcgtgattggaaaaaatattcaaaaatatatgttaaaattcaagttatatctgatgttctgtgaaagtttcattcgaatcggtccataaataacaaagatctagcttatcaaagttggttattttgtatggaaaatcaaaaatgttgaaaatgttttgtccaatactgtagctatggtgatactgtagcttttcaaccatttacatttgtttaaaagtgaaacttacagctcttgatgtcgtaagggtggtaagtaatggtgatatatcctgaacattacaagtccagcgttgaaatgtacatatttggaagtgatccataattgttgaaaacaaacatttcctggttcatattcagaagggaattgttgcaacagcattcagtatttagaaatcatgaaccaggaaaaatgttgttcaaagatgaaatcttttttgtttctcgatatttttgcaccatttttttacaagctttaaaaaaactcttctagtttaagaatatgtgtcgatattgataattggtcatttggatccggagatattccaaaattccttggggaaccgacgcgttgccattacccacttaaatatctcaggcaacagaatttttatcatattctgatattcactccacggaaaaattttaatttataaagggccactcaaacgtcttgaaacattttggtcatgaaatcgattctgccattcccatgttcgcagcggcgggcgaagcgctagcgaaaaattgtagaaatgaactcaacccgcgtagagtactgttagctaaatcagaattctttcccacttccaccggccagcagacgaaaccatatgcgattagtttcatgatgatgatgaaaatgatgatgagctgaaagtggattagcgaaaaaaagaactatcaagattgatgggaaaagcgatttacgtgcacttgaaagccacccccaatgcgagattacccgaagagtagaaaagagatagatgatagacacgagaatgggtgtaggtagccttcgaacaatggatcattgttgtaatagactgccagatctcacaacagcaggtgagatttggttaagaaatggaacataatagacagccgcaaatgaatgaactccatctatataccattatcaatgatatagagcgagtcgtgtggcgcgtacaataatagtgggaaattctctttcctgttggcggctgtctgccattcaagtgcatgatgatgacggagcagaggtagttgaaccacttatctatgcggcggcgcttctcgcccgtttgcgtattcctatacacttatttacgtaccaggtgaaatggaatggaacgttaattggaggaatgcattctggatgtggataacgggaaggttttcctttcgggtgatttcgctgtaggcttatacttcatacttcagggtgcctcttgatgatgttacgctgaatcattatcgctgtttaattgaaaattgttggcaacctcattttcatcggcccttttgcttaggaattgatgtctattagaacttgattttcaaatatattggcattttgcgtcagaatggacaataatgatcaactttcttaccagacagttttgaagaaattaggaaagaacatatcaaatgggcccatctgcaaactaaagtcctgggtggccacccaaccaaaattcgcgaacaaccggtcatgctgaaaagacgcgctcttgccccctttccactagtatattgtcgaaaactattccctaaaattgatatgctacagatttagttataaaaaaaagtaaaaccttggaaaaaaaacaataatttcgcagaaactttgatttgtagagtaaggtggggcaaaagttcgaccttagaggtataatcaaagtttccatgaaaataatagcagatgaaacaaaacaaataccatatagcgaaccttcaacatattggctataactttgctgaacaaacttgtgtcaaaatatttacccatttttagttataacagtttcaaaattgattgtcttaaacgaagttcgaatctagtgtggggcaaaagttcgttggctaaaacacaaaatatcaatacttttatgccaggcatactttataccagccgtaaacttatgtttgccgaaacatacacaccaaattttcatcaaaaaatgcccaaaacagggttaattgtaatacacccaaaaaatagcagtttttcgccaaactaagtgaaaatgtaaaatttttgtgacatttttcgcacgatcaggcaaatttcgctaaatttgaagataatatgtagatttcaagaaatttgaaaaattttccgtgggtttatacatgggtcgaacttttgccccgcagattcgaacttttgccccactatgggccaaaaattgattccaactatttatggaaaaactaatacacgttaaactatccttatgataggcctagaaacgcccttacataaaaaattgaaaaaatattttatcttcatttggttccatgtatcgaaagtttgaccaaatattacaatatttacgtcgaaaaacaacaaatagccataacttttccaaatctcaatcgatttttatgaaatttggagtgaaagtctcttacttacattcgaaccaccatgacatttctaagttttgatttgatttgagctagaaatctgaaaaagaaactcttgccccactttactctatgcttcagaaatctcatatagcattgcaaaattcgatcgaacatcttcccgttgatctttttctatctataataaaccattatcccaactgattgcttttccgcccctattctgcgcttcattcatcgtttatttaccacggttggcaaagtgctgaatgggggcctccaaaaaactacaagtcgagttgcatgatcggtcattcatgctttaatactaaccggcacaccgtaggcgtagagaatcctaccggaataattgtatgtgatgggaaccgtgtacacaatggcacacataccgtctcggtagaagatcgacaggaagacacaacacagccctaagctcggctggacaccgggaagaagacaatcctcaatgcggccaaaggaagtgggaaagaaaagctcaacaacagcccgtaattcagtagttaataaggaaatccagtgtgtcgtctgttgtggtatatttattttctaatttataaacgttttaattgtcctccaggaaggcataccggaaaacctaaaatgccgggagcgtaaaagaaagcattcttatgtcatccgccagagagggatctccgtagaaaatagaacgtaatttcttaatcaaaggaagtgcacgattggttgactggtcgtttgttaaggtatgtgttcaaagaatcaaagcaattgtgggccaccggatgaatgtccattttctgaacgtcacattcaacttggtctggtttcgattaagcagttactgcgggcggaaatctattaaaataccgcctctaaatcatctgcctgccgtttggttcctacatactcgccttatacctatgcttgctgaaccattaaaggtgatcgtctgtcttcttgctgtggtggagacagtagacagataaaatcggatgcaacgttttgcctctgtcactgctactgatgttacaacatggtctagctacctctgttctgttcgattcgtttcgtctattcctgggtattgtaaaatggggtgaagttgatcacttatgggcgattctgttctataaaatccggtagaatttatatgtaatgtttatcgaactatgtaataaaatttcggatttagagaaataattaaaacaatttaagaaaatgaaaagttttttttattacggggaaaagttgatcaattactgtgaaaaatttccaataataaagagataatcagaagtcttacgattacttgttaagtcgataaattttagctttgaattttgtaaatcactgaatacactacgttaaacgcctaaaggtaaacaatttcattcaatacagctgttagtaggaaacattgctttttttaattaaactttaaggtaaaatgcaaatgcagaacttagttgaggattcatggcttgtatagataaaacaggttaattgacaaattcatttcgtaatgtttgaagaagaacttcccaaagcttcataaggcatttccatggtttcaacccaaattacggtatgtgatattcttcggtgctctcagctctcgctccctgcgttcgatcaatccacacagatcatgaatccagaacggaagacatttcttaagccgcagaccgtggctaccaaaggggcttattaatatcactgcttattatcgagctatgtgttttgtttgtacgttcaatccacaccatatttaaattagatttcctgtttccctaattgcttaattttattagccggtatggatatctccgacgtcggggatcactcggcgagattcggaacacttgtgaaacgatagcacagcgtagtcttttttagacgcgagccgagccgaagagcatgagtgcagctttgttgtcatatgctactcctcttccgttccgagagaaggcctcaatgaacggtgcgcatcatgtcgtgcgtggggacaggaatcttgccacttgcgtttccggttctgccagacagcgctgcggatatgcaaacgggttgcgtgcttcgagctgtggtcaaataatcaacatcgcagactgatggtttatatatgtaggtagcttcaatttataggcacttgataaactcaaacttaatctgagaaacaattattttgggttgtgatgaagcaacatgttaaaagaaaaacatgttttacaaatacatacatacatcaatctcagctttttctgggatatgctaaaatatagtacatatggtcttatcctctggcgtactaaactaactcgggtccagagcacgtggggatcatacgggagcatgtcctctcaagtatcacaattcgcagaccgagtaaagttagtacaccggtggtttagaccatatatgaagatgtactaaaattttgcacaatttgcatttaaagattgattaaccattcaaataaacaacatcttttaaaattaacgtttgatggttttatcgaaattgtcatatatttcaaaagccattacataagacacaattatttgaaaattcaatattatatgtaaaaacattttcttatctgaaaaatatttggcccattttttaatttcgcctataaggtgaccatttttaagaacgatggccaaaaaatcaagatttgttttaatttttcagttatgatttgtatatttttgcttttttccctatattagcgatatgtttaatttaaaatttaaaaaaaatacaaacctcaccttgccaggcgtattgtagagctccatcttcgtcggtcttgggcgaaacttctccagttgccccgaacgtttagggtcgccaggtcctcttctactgcgtacagccagcgtattcgtggtcttccccgaagccgccgacctctacccggttccctgctgaatattatatttgcaattctttcttccgacattcgcactaagtgaccagcccactgaagtctgccgtattttacacgcttaataatattcgcatctttgtacacttgatacaactcgtgattcatgcgtctgcgccacacaccattttcgagtttcccaccgagtattatccgcagcactttacgctcaaaaacaccgaaagctttctgctctgcctctttcaacgtccacgcttcgtacccgtaaagagccaccagaagtatcaatgttttcttcttctttctggcgttacgtcccaactgggacaaagcctgcttctcagcttagtgttcttatgagcacttccacagttattaactgagagctttctatgccaattgaccattttgcatgtgtatatcgtgtggcaggtacgaagatactctatgccctaggaagtcgagaaaatttccaacccgaaaagatcctcgaccggtgggattcgaacccacgaccctcagcttggtcttgctgaatagctgcgcgtttaccgctacggctatctgggcccctataatatcaatgttttatacagggcgaattttgtttccatttgcaagctgcgggacctaagctggttacgaagtccgtaaaaggccctattcgcagctgcaacacgtcttttcacttcgcgggaaacgtcgttgtcacatgtcacaagtataccaaattaaacgaattcttcaacaacttcaaacacatccccattaaacagtacttcagcacctacaccaccaagcgtgactctatctctacctgcaaccatgtacttcgttttggtagaattaatggtcaggcctatcctcgctgtctccctcttcagaggcacgaaggcttcttccactgacctgcgatcgattccaattaggtctatatcgtccgcaaagccaaggagcatgtgcgatcttgtgataatagtgcaatttctctgaatgccagatctcctaatagcaccctcgagtgcaatgttgaacagtagattcgaaagtgcgtctccctgcttcagcccgtctaacgtcaagaacgaggttgacacctcgtctgcgatccgaacacttgatttcgaaccatccagcttagcacgtatcagcctaatcaaattcaccggaaaaccatgttcagacattctctgccacagctcatttcttttcactgagtcgtacgccgccttgaaatcaataaccagatggtgagtctgcaagttatactcctggaatttatctaggatcactcgcaaggtaaacatctggtccgttgacttagtcgagtctagttcacgacactgaagacggccttacagttgaggtcgaaatacgcgtatctatcaaaagatacaaactctagtggaattaaatggtatatataaattcggttttttcatctacttattgtccgtttgttctttacatgatgaccacggtcatagccatcacaaccatccacctttatcagggctttggacctgtagctctggttctcaatagtttcaagttctttcagacatgctactatggtgagccgtcatacgctagcagtgttatatacatagataattaaaaaatcatattatattggatcgttggggtagttaagttcctaagagttgtaccattatttcgactgaaattgataaatttccatgcgaatttctaaaaatgttttctataaaacgatatttttgtgctaacaatcgtcttcaaaatgcaaaaaaaatgtagattctaagtgaaatcgataacttctcaacgcgttgaaagtttgtttaaaaaacaactcaatatgcataatttgggcgttcgtaaccaaaatagggtgctcctgtgacagggatagaggcaatggtaacaggatgcggaaaaaaaaatattcaaacatatgtttttatgtctgaatacgtcattcggaaacttttctactccattcacgtataaaataatcttagaacctatcaacgataaacttgcgacgatcgatgcgccaccatatttcatataaccgagggtattagaactaacttggaggtgatgctttggaggttatttggcaatttggaggttaaaatcccctccaaacactagcgattttgcggtgggatgttgacgtttgatgacgaataaaaagggcttagaatagtccaagatattttcgtaataaggaaattttcgcgacttcccttccctgggcatagagtatcttcttacctgccacacggtatacacatgcaaaaaaagtcctagttggaacgttgagattttattatattacgaatacgaaaacctttattgagatcaaatgaaattaactatgaaatatggaaaaatataaacataataatatatcaaataataaatatatacggttgcttcgaatactgttcgataccaacatccacaaaaattgacattaaaaaaagatcatcccggtgttgcttcagcatgcgtattacggtattagttacgcgacgttggtgggaagatggaagcccggccggaagctcataatcgcacacagtacacaatagtgcttgcctacagctacctatatatgtcggccggattcccgtctgcgtctgcggcaccagatgcggttggcggcggatggcgatgatgtgttatggaagtgaatcaacaaacaatccggacaaaacaaaactcgaaagaaaaagaaaccccactatggcttgcgtacatatagctttccacccgcgtgtgctatttgtgctccatcgaaagccacacacaaaaaaaaaccgacgggatcgtataaacaaactcgatactgccaaaagtaaggtagtttcgaaaattaataatagatttcctgctcattaaatagtggttttggggtctcctaggagcagcgattgaatgagcagatgatgactaagtacttttgcggattgttgcttctttgccacggtcagttgaccagtaagggatctttgccgaatggaattttggtcgctgtagaaatatgaaaccgacagttgagcaattttcttgagtaactataattttttaagaacctagatgataaaatttgaaaatattttcaaatgcgtatttggtactgactatgccttgacctcctgttgaccaactgcacaaaaaggctttaggacaattattcgaatgacgtttggtcgaatttacagtattgcaaatgaaaatggtaaataaaagttatgaacataagattcatcacttattatgaattacaacttgtaatttacaagcatcaaatgttgattaatttgctcacaatcgttcagcagcaacgcgttcatccacctcgacacacatgtttgctcagcgatcggatgtcgattttcccaacatttggaggaaattcaacaatgtgggaaacaaattttctccacacgctacatccgcaatcaaagagtcaaccgcctgagtgccaccccccagacgacagcggcacggcgatcaaacgaaaaacaaaaaatgaaggctagggatgtttcctttacagaccctcgtcatcatagagtcggagaagatacccgagcagaatttgatttcaaaatctcatcaaaattagataaaaaaaaaattattttcttataacatattgatagccgtttttgataaccatttgttttaagatctgagtctcacttcaaagttttatataattttgatatcccgaattcaaaatttaaattttattattaggctcatataaactcccagaaattatatgaaaataaaggtacagtgaaattttcgtgagagaatatcctaagactcgatttggattcattaaatcatactgaagacaaggtttcatgaataataagatggtcacctcaaacaattttcaaaatataatctttttcataatttcatcaatcgatttttttgtcaataccaacacttagagttgactcgagagacacacttttttctagataaattcgttgaccattcaccaaatagacaccatttacaagatctagattaacccatatttttatcttatgacaggattcaatattgcaggactgaatcatgatattttctgaaataaattctatagattatataataatatatcaccattgtagattcaatttagtttgagatcacaatcattgctgacttttatttttatgtttgtattgctaaataaacaaaataaaactaattaaataaaaaaataactaattaaataaaacaaataagtaatagattacttatgttgattattattattatctttactatcgaaattttcagtcataggctggtccatctcctttttaattttatgtttttgataaaaaaaagtttccgatttgacatacactcaggcaaaaatactatgaatatccattattttcccttatgtttatttgccacaagaaatcggtaagtatttcattgattcaccttatgaattgatctgaattatgccaatgtggtgtcttgcttatttcataaaacagcattatgaaaattgaaatgataatttaagaatttcttctattagcagtataaactacattagtttctttgacactaattattattccacagttcgttttttataccttgtggacaatacatttcattctgaatatttacagaatttcctatgtgttaattcattaatattaggtaactgatttcctaacgtgtagaaatcgaatttccacctattttgtcgtgttgctactcaatttacaacaatatgaagtaaagtactgatatatataaagctacgacacgacgaaggataaaaattcgatttttacacgtttttacagccattttctaaagcaaaacagataataataaaatatgcaatacatcagaaccttaattctccttttattaaactaattttccttttttctgattttttttacaatttccacctttgtgcattgccgtacttccttcccccgtaactagacaacttattacctttgaaaacatcagaacaaattgatggtgcttccgtacataaatccgcaatcagcgtcccatacaatgcttcaaattgcaattttttataattgcaaccttatgattttttcacactagtcacagctatgtgaaacataaggtggcctaatgaaattgatacacgttaatgaggtctatgatgctttgcaattatgcttttcatcgaactaatatgaaatccataatagccttatgaaagatggtatcattgaggaaatgactaatgacggcaatggaaatcataaggcgcgcaatgaaatttgtaaatgttcattatatttaactattttctcaattatgattaccattttcacgatatgaaatccatattagccttttgaaataggtttttatagatttttcattgcttcataagggaaaatttatgaaattcgtcaattaatttgcctgagtgtagtgctatccgaacttgttattattctgtatatttttattaaaaattttgatctcatattttgttaagatttttttttgacttgatcagagtactatcatattgagttatcatatacgatgatttcacaacatcaaaattagttataaattagttctcattccctgctcgggtagacattgaaaaagcaacaccatccgaattagacgggtgtacggaacgaaagaaaacaaaaaatacgatcggaacgccatatgacggatgattgattccttggttagctactatgttgcccatctttggacaaccatagattaaggttaattctttccgcttgctacgcagcagtgacaactattgttacgtattggttcagtggattaaggttgcgataatagaaataataaaccatagaagaataatgtcgctggtgttccctttgttctcgctcagaaacatgatgggtacataagtgtcaaactgcatacattttcgcgttgacatttatagccccgcctatctcagccagcaaaagatgttcctactgcgacattcttcttctatggtttaatacttattacttattctattgttgcgattccgatttcgattaaggcttccatgcgaacgaatttttaagacatgtttcaggactattctaacattttcaagccgacgacatccaataagctgcgtcgacagattttgttcaaaactatttgaatataaattagggaaaaagttttaattttcgacttaagaactgttcattttataaagtgcccagacaaccaaaatgtacgtataaagaaatcacctggaggctttgtatgtgcaaaatttcacttataagatgtcgcgaaaaggccttctacgtacaaaagtggaggcgatatacgtgcatatataatgtgatgaataacagcatacaatgcgagtgtataatttttataccgaactaacctgtgatcttatgcgacgttactaatgataacaaatgttaatttgacagctgctacggattgatgcgacgtactttgtacgattgtacgtgacgaaacaaaatgtataaatgaactcagaaaaaacccgttttatgcgaggaagcttgtcaatctgacgattttattcaccatgttttgcgggtttgatgtaatttgtatgaattaacgagttataacatgaacttgtatgcgatttctggttgtctgggtggacaccttgtgcgtgctgtatcttttaaatttatcaatgaaatttcaattggttttctgtacatcgttcgactagtattgtacaatgttgtgataataaataaaatctacaaaataattaaatttcacacgaatatctaaaacgtttaaaacggtcgatttttggaggttatccaaatcaatgattgttagaaattggctggaaaattcaacaatctatgttttttattttcaaaaaaggcttgttctgcggaagcattatcaatcagaagcctgatggagaaaatcaagtaatttttggtgcaacaattttacatatataataaaataatatttttagagaaaaatattttaaatttgaagggaactgatatgagtagaattttttagtttaaagtgcgtcctgatggaagtgctcatataatattaatatgaaaaataacttacgcctccatggagttacttatatagtccccacgactatgacttttaacatttaaagcacaatagaaaaacaattgctttatttttagaagacctttcaaagtaccatgacaatcatcaaaattggcaacactgttgtaataaaatcgattttatttttcgcataatattttcataataggtatattattctgagaataccaactaaaatatttggagaagaacgtttacaatttactgaagatcgataaatatgcgtacatgattttaaaagtgtgagactttttagtaaaacgaccataaatagtaaaatgtatacttaagactgcggtttaaactcacgatttagctctcgtttatataaagatagtttcttaataatccaaactagttttgaacacgcttgttacttttctcttttgctgggggtgaaaggatggtgtatcagcaaatttggccataaatcgataaatcactaaagttacctaatgtcaaagaaagatggaatataattgattttttcaaagctatacatttagtggaatagtaaaggatacaaacatacaatttgttcataaaaatgaggatttttgttttgcgaaaaataatgctaaacttaaatgaacagctttcttatgacttttcggaaaaaatatttagctcttcaaccaaaagcattttctaagatattatattttcatagcattgtacaataatagttgaacgatgcactgaaaaccgattacgattatatcaataaataaaaaaatatagcttacacaaactgtccactttataaaataaacagtccttaaaaacatcatttgcattatttttgtttcttaatacaaatttgggtctcttactctaacaaactatttaccatccacaataatcccaaagtcctttttttcaatagattttttgcttcaaccgccagtgtcttcgggaatctagtaaacaaaactgaaattaggtcttaaattattcaatgcaattccgcaatgcaattaactgaccataaccgcataatatttgtaaaattcgacaaaagtaggtattgaggaaatggagcaccaaatgtgttttttttattagtaagtatactgcccttctacgcctacttgtcccatgttttatgtatacctatgtaggacaaatatgcgtagaacggcagtatgggaagaaaccaaaaattctaaaaattagctagatcacaacaataggatttcgttcaacttcgtcgtaagcgctattatttgtcgtataaaacttaaaattttctactacggcggatattcaaacttacctgcagcaaagtttcatttttcaagtgtaattttgcgaaagctattatcgttcgaacacttgtacaacaaaaatgcaataaaactactatatttcgataaataaattcaattcaattattaacttttcactttttcaccgaaatcgcatggacgaacacgatttgaaagaaatgctcagcggtcgataccagtcacaccactttataacacaagtttcttctcaccccctgtgtgacttacttcgccgagcacttattttcactatggaaaaccttcgtactccttcactgaaagatttcattccaatcacacgccgtaaaacgtctataattcacgtaattttatgaaatttcctcaacgacagcgtataatggaccaatgcacgagttcattatttgacgtttgaacggagccgtgttatttatgtgaccatggaaaccagtgaattcggcaccgctcaaacgtcaaattagtgaactcgtgcattggtccattgagaatgtaagcaaagttcaatccgtcgtactgagaaaaaaagcttgtgcgcatcaatgtgtgcgtgatgctcggcataaacaaatgattcctttgatagtgttcttttcgctgcactgtgagcagatgtcatgattgttcggtcaaaaagaattgtgtttatatgtttgagctagaatttgatggcgaacaatgaatttcaaaggtaattaatatattccatcatgctgaaggaatggagggagatgcccgtagatctatgtattctagtaaaaccttttataatagcgttgatgtgttgtattgtgaccacttactgtatcacattgagccgtaagttgtgagacgaatctgaaaactgattgcgacagaattggaaacgatacgacgaattgagaatacggcaagatgcaatttcattgcattatttccaaaaaaatgatcaagatttatcaaaatcttattgtataatgcgaaagccgttttgggaaagaattgtttggcattggcaaattagcatcgttcactgctatactgggaaaattgcaggtttacactgatcaaagctcaatacgatggatactagcacatcaccctacttattcgaagctgaaattttgtacttctcatatcgcatactaggaggatagaaacttaacccctctaacggcagcttcatttttaccgcaaaataaatattcaaatctcttctagtttaagaatccgtgtcgatacgattacgaaaaatcgcaaatcaacaacgaaatataactagtgatctattgaggttattggttagaatgacatgataaataaattgtgtgatagtttttgtttgaaaatagatggtcaaccttgtggtcaactcatttatttttaaaagccgggaaaacggaattcacgggaaattcaaaaatcccgggaaacagaaatttatttcctgggaaacgggaatgttcccgggtttggaaactctagactggtggaagataactttttcatatgaacctttaatgttctcgggattggaaactctagactggtggaatataatattttcatataaacctttcatgtctctaaaccttcctcatcaaaatggctgaaaatatgacggaactctattttcatcaacacgatcgtaaagaagatatgggagctgaaattttcaaactttttgcaattttaatcgccccaatggcttaacctaccgacctatctttcagaggggtgtaggtcgttaggccgaatgtaattaggatgaagacctaggccgaaagggtcgttagaccgaaataacattcgatcatttgctactattttaaatggctaacgcattcgtgtttttttccttcttttaatcaaaagctgttctttctagttacatttcggttaatttgggcttcaaggtaatgcaaattatcttgatctaacaactaacaatccatttcacctgaaaattcattcggcggcttctaggtgatcctgacctatctctgttaattaccctgttaattaattaataattgaatgccgttaaccctctaatacccaaccccgcctttagacggggtacactttggaattttgtatattttttcgtagctcggaaatcaaaatgtttttatttttggcttatactttgactcataacaggcatattagaaaagttttttatgacttttgaaacttttttgtatttttagaaattgtttgaaaaattgcattcttatataacctacaaatgcctggggttaatttaacgtgtaatataaaaaatcgtagcttttatatttttctacgatcaacctatcacaaaaaaagagcctggtggtattaatataatctcaaacctgtttttccgttagttacacggaaaataaaatacgctccgaaaaaatataaaaaatttaatgtttttaaaagtgccgtaaaaatttaaatttttattattgccaaaaatcaacaactagaaaaggcttcaagaaaaaatgtaaaaagctagggatgttcaaaaataaaaataataaaaatcaaaaaccaaaatttaaaaatttgcgaataaaaataaataattgccaaaaacgtgtttagaacgattttagataacgaaaaataatacttaaatcaaaaataaaaatttgggtattagagggttaaaagatgtttttgtgtttgtcccaatcagatatacctattcacaatcaaagtaagcgtgttttggcaaaaaacggatagaaatagagagttccttcactcatcaaatcacgcatttttcaaagcttaaaaagtgttttatagactactactacatcaaacaaagggacttactaatacaaagaactttgtaagtccgttttcatataatgttccattctaaagctcaaaatgcatttttcgcgtgaaactaccttctggaccactggaaactgctttatcagattaacccctctaccggcagcttcattttttaccgcaaaataaatattcaaatcgttataatttttttgtttttcaatatatttgtaccattttttcacaagtggtcaaaaaacttttctactttaagaatctctgtcgatattgagcattgctcacctggttccgaagaaattccaaaattccttgggggaccgacgcgtattcataatcccccgttaatttctcaggatacataattttaatcgtattcggatattcactctatgctgtgggagtatgctgtgaaaaaatgaagcaattttgtgcagctgtttttgaataatgaacatttagatttctggtaccacactggccagatcttatttttttttcaaaaacttcaaaaaacatcatattgtgattttcagatatctccaagaattcttaattgatttgtatgattttttcagagcagatccttattacctgacattttatagcccacattttatttttttgataaaatgaccgaaaacaaaatggtcgccaaagacattttctatggagaattttgggcccctaaaggaacatcggattatcttcaaaaccagatcaccaatgatcaatacagtatttgatttacgttgaacagttgcactggtttcgtgttctgtaactcgatacctccctaactcgatggttcctttaatatcgagttagggagaattgactgtactaatcatatgagcgaatacatttttttcacggaaatggcctattctcaacataggctctagttggtttttattctagtgcttgaaaggattaattcaatgttgccaaatatgatttgaatttcatatgatttgtcaagaataagctccacatggacttttgcgtagggttataaactttcatgttttataaaaaaaaaagcacggacatcgccttcagccatttagctgcacggactgtaacttaacactagacaacggacaagcatgctccagtggcacagccgagaaacatttctgacgaaaagttttaatggctgaagcggaaatcgaacccagatctcatgacacgatgcacttaaatgcctgacgacactaaacacacagccgttttgaaacatgtcgtttagaactatgtcaacagatttaccaataccatacaaatttactagtattaaataaatatacacgtaaaaaggataattttaaaaaggaaattgcattaagtttgattcattttcacgttttttagaattccccgggaaatggcaattttatttcccgtttcccaagaagtaaagtcacgtaccaaattaaaacagcgatcgaagaaaagttgaacttaacacaaaagtagtgatttaccatttcggtcgagaactttgaaaagacaaaataattttcaaatgctgtttgaaacttactcatggactgtgttgatttattttagcgcgctactctaggacgtaattttcttctatcgaaatcgtttaccggatgtaactgcttcgctcatgtatcttcaagcgatgattcgtagaacgtcattccactactggtgctcttacttcctggtacagccaaaatcaagtcgatagttatgtaattatcctattaagaagcgtcacatcctgaacttttttttccacttgcatcgtgttgagtatccatctttccagatcttctcttttggaagcgaagatcaaataggttttatttcttcctgttacctcccacaaagaaattaaagttaagaaattctattcacataaactgagtaaagtcacattttaaccaatccgaacaattttctaggagatgcatttgtctataatctcaaatatattcgaaatgtttctaaggaaataaaccaatgaatcaaaattgaaatatataaacgcacgtgctccaactatttggctatctatggcgtcaaaagaaaattcaagccaaatatagcatgcactttgcagagaaaacatgacgcgctgacagcttgatatatcaaaaatccacagcctagcgcagatgcaaaacgttgtaacaagcgtgcacttctgccaagactgtggtgaagatagaagcgccatcaacaacatcgattacgaccacgcgggaacactctttccggcatccatattttggctaccaatatggactcgtgcatcagtgctaactgtgttgttgatgcatttcttttcgcgcccggctctaagtattcccggcccatcgcgatcagagcaaagttatgaacatggctcaaatcgtggaatgctgagctgtgttgtcgtctgatcccaatgtgaacgctggctgagggggaaatggctgcgaacgaagaaaaacatacaaaaataaaacggaaatcctttcgaaacccctcccgtacagtcgggaagagtaggcacagacaaacaaatgttaaactgacgaaatttccatctaccacttcatcgatcatttcaaattcgtttcgcattgtttttattgatgacgtttcacactaccgtcaggtcttgatataagaaacagtatttcgtgcaacatcctcaccagatgatgatggtgcgaaatggacgaaggatttcaaagaaaatttgttctaagtgttacgtccgtttgtccgttgagtaagtacagctacgccgtagtacggatgaagtagtttcccatgcctatcgtcgtcgatcgcgcgtccgtcagcgcctgcttcgtcatcagggaatggcgatgtcgtcactattgttatgagactgactgcctgagtcgtcgtcattcagagaaaaaaacagcttggtttgcggtacagatgtaatctaattattttaatccggttgctttccatgtcaacgatgcaaaataagaccccaaacggaaccacacgtccacactgcaatggaagtcttttcaaagaaggtggcattgatgatgaatggaataaaagggcgcattgcggaagtaactcatcttcaaactgtaatatggaaaggctcttgcggatgttctcgggttagagttatcgtggaatggttgctttaacgtacacggagacggaattcaactcaattttgggttgtttcaacgcaattccgtaattgagcccaataactcaattttggctaaatttccaaggtccccactaggtagtttgactttaattccattagaaaaatatactcaattttgggttgatttaacgcaaaattgagttttttcgagccgaacataagaaaagttgcatttacccaaatttggcttattgggccaaagtacccccattgggtagatgcagttctctctatttttgacaacattcgtgtgggagaaagagaaaaccgagagattttgggttgaaactataatcgatatacttaattttgggtaaagtaaactcaaaaattaggtaaaaatatttctccgtgtatgtatagccataaacaaccacgctttatacaggtcggactcgattatccggagtatcgatttttttttattccggataatcgaatcctccggataatcgaatcactaagaaaaaaattggaatcttcgataaaagaacttaaatattatgtttttttttgttgtttcatttatatgatgcagtggtgtagctagaaattatttctaggaacagtaagggtctttacaagaaaacaaattttttgaccagcatacacaaaaaaacactttttcaaaccccccttttcttaaatacgttcaaaactgcaaaaccattcatattgtatattgcaataccaaattatctcagatttatgcataaaaattgaaaaacaagaatatcaaaaaccaaattccggataatcgagtctaaaattccggataatcgaatcccggataatcgagtgtccggataatcgagtccgacctgtattatcatttcaaacttcctatgttccatatttcacaaccagaggcgcacttatcgttttcctttatgtttgacgttccgtaccacaggatgttagtgccaaagacaaaataagttctcaaaaacttattcaaatagtctcaagtcagaaaagtgaacaaacttactttatcgatcctacgtgtttcacagacaaaattccacacgttccgctcttacccaactagatttttcacttttataacgtttaattccggtattacaaaacggcgtaagtaagaatttcaacttttgcaacccaaccgctactttcaccgctccgttgtatgatgagaaaagtgacttaaacacgaatcaaaacaaaacactacttgagccgaaagaaacggcatatcattttgttataattgtttttgtgggaaataatactaactacctagtttttgaacgcgagctgattgtatgcaaagcgatgtgcacgtcgaaaaaatgttaaaaaggtgattgatattaaaacggtttcagaagacaggttttgattattcttaatcaattttctcaaaacttacacacttaaattattttacggattcctgtaaaattctcaacagctgaacagttcggtgaaataaattaacggagtacggtaaatttttacagtatcccgttaaaaatcaccggaatccgtaaaatttcgacggaattacggtgttttatttcaccgaactgttcagctgttgagattacggtgaaattcaccgtaagagcttagtgtgtacgtcgatttgaaaaagtaatcgagagttgtttatgcagctgcacaaagttttatgccgcttgaggtaaagatcagcatctccaataggcctattcacataatgtctcaaatcagctgatcgggaagcactttgacagttcttctatgaaaatgacaggctcgtgttagcaccggacctccaccgatgtaaacaaatgcatagacggatctgtcacatgaaaaggcctatgctgtgaaaagtgtactgcgatctgtcaaacttgggtagctagtatagtaccatagtagtactatgagtggaacctatggtcttatccacgggtgtactaaactgactcggtcgaagaactttgacactagagcgggtccagatcacgtggagatcatacggaagcgtgccccgctcaagtgtcacaattctcagatcgagtgaatttagtacaccgatggattagaccagtgtttcccaaagtgggcaaattcgccccccggggggcgattttcagatccaggggggcgaaaatttgtaaagttgaatttggggggcggaagtgctagaaagggggcgaaagtgggaacagttgaaaaataaaaataattacaaagtttgtaagagacactcatattttaattaaaacatatacatctgagaaagacgttcttcgacacctaactatttaatctgttctttacctctaaacgcgctcatttttaagttatgatagacaaatttgacgattgtcattaagatctgaatggtttttgccaaaaataatattgaatgcattttaaaagcaaaaaatatgtgagaacttttggctatgttcgaaatttatttccaagtccaaagtaaaatttggtgactttttgttaggggatctttagaataaggccattttagtttcgattatttctcatgcatttggtagactactcatattttgttatcacgcattttagccagtatttatagtacaaatcattttataaataaatgtatgtgactttggtggacaaatatcaggttccaatgatataatcactgattgccatatacgtaaattaccctactcagaaataggcctgagcaacataaaattacatggagcaaagactaaaaacaaaatctaaattgaacgttatatttcaatgaatgaagagttgaaaaaagtctgggttcacccatttttttatactttatatatagattgagctatatccagatcaaccgaaaatgtattacccaaaatttcataaatttttttctacaaattaaggtacattaaaaaaaaagaagacaaaaaagcagaatgtgagccgaaacttttccgacgatcgcacatatgccaggatgatagatttattgatacaaaagtatttgatgcatatgatagatattgcatgccttttttatggatatacaagtggaagacaccctttttgggatatttttattgaaacattattttcgattaattttcggtatactatatgatgagatattgatcaatacttcaacgtaagtttaacgcttaatacaattattcaaatttaggggggcgacgtattaggggggcgattccagaaaatattggtctcaagggggcgaaagtcaaaaaagtttgggaaacactggattagaccattctgaacctgactattatatttttatttcgtctttggtatagcagtgtgaattataacagacaacaattattggcaaaggcaaaatacaagcgtccatgttccttgcatgacctaactttatggcatataagacaataaaccaaaatctataatgctgagaaaagtgtagtgcgatatttagatagtcatatgtgtactccaaatacgtcaaatgaaagcctgaaatccatattatgaatgaaaaatatcaaaactaaacagaaactttcgttttcgtaatgaaaatcgctttagtcaatataggtcaccagaaccactttcggctacattttcaacttttgttcctaaatgcctttcatttcgattttcatgagagtggccaaatgaggaacaccgtgatcctataaggtgtataaaagctacaagtttagaaaaatgaaccctacctatgaatttttgaatgtttttggacaaacgtagctctgtcacatgaatatagtttgcaaaacacggaataaatcacagtgattttcgtttaaaacagcgtataacccatgatatctgactggcgttatagccaaaaccgatacctttaccctactataagtgatacctattctgaaccaaactactataattagcaatgatttaacattgattatcattatcatagttagattacacaaatacattgtatgctacaaaattatcaatgcttcttctgtttttcgaaaaccatgattgttcgacggaaaaatattctattgagatagagactatacagatttttatcattggtttgttttctgtacctactgtactcatatgacacattccactattctctttcacttcccgccaaagcaacaacagagttcaatgagaatacacgacttaaatagcccggaatttgtatcattcattgtgcagtttcacgagctcgagttgaatgcttgaaaagaaaggaaaagcactattagaccggcgaccgagcggcgatgtctgatagctaatccaacaacaacgggggaaattacactcagatacagttaatgccaactatgatcatgggcgttttggatgtccatttccggtacgtgcatctccggaatgacccgcttgggtcgaactccggatcatttttacaatgcgggttgaagctgttcaagaaccgtcatcatccggccacgtgcttcgcttacattaatttcgcgcggcatccgggaaaatgctattttcaaataaataacggaaaacccacattacaaggtcgccggttcctgtgctcagctcgccgcacggtagatttatttgctgccagggcgcgcagtgtttctcggactcggcgctcgcgcaaaaagtagatcactccgtttgcagcgtcggaagttgagccacagcaagcaactagcgccaagccgaacaggtagcatgtgggcatcccgcatggtaacgaatcatcagtaccgtggagcggagtgaaattggactttacagtcaactttccataactcgacattgaatggaccgaccagtaaaataggtatcgagttacagaacacaaaatcagttcaactacggttcaaaggaccatcgaagtacatagtaatgaaatagtagtttacgcaacagaatgatgatttttacagctcgagtcttactttttttcaacgaggtttgccgagttggctaattacgacgagtgctgtaaaaatcaagatctgcaacgagttgcgaacaacatttttgcagtttcgtcaaagactaataactaattactgaggcatccgatttgaaaactgtcttcagcaaagttgtagctgaaaaatgtatctaacagtatcagctttaaccctcaggagcacatgggcacatattatgacggattgagtgagatgcttgtttttcccatagtaatgcccatataaactttgaagagcttgtgcagtctcatatttcatacatgtgggcttcgtagccgtgcggttagtgtcaccaaggcatttagccgcatcgtgctaaggagtgtgggttcgattcccgcctcaggccgtaaaacttttcgacaggaatgttttccgactgtgccactgggcgttgcatgctagtccgttgtctagtgtggtgcttccttcaaagggcaaatagcccactgggagcatttaacgtgtagtgtctttaaaagttcttaaagaaatcatttgaaggatatctgtaagaattccaatagcaatagctcaaataagctcaaattttgggaggacactcagaattggatctaaaatcggaaaagcggtgtggagcaaaaacgattttttgaactaccctactatctatatctataaaaataagaacggagtggtgtttgtatgtcacgaaatggcatacgaatgggtcaacggatttgaatgattctttctccgttttattcatcaagggttctgaccagtcttctaagatcatctttttactctgagatttaaacaagcatgtcttgaacttatcccaatttgcaggatcgtttagaatcctaatttatttcgatcctagtgagcgggatttgatctgggattgaatcccaggatcctcatgaatgaattgtcattctctttcagcaaacggtggtgtataaaagttagatgatttgatgtatttttttgtcattttatatttttaatgaagaaaaatattctcctaggtactccctctccccagcaaatctagcttgtttcggataggaatagataatctgtgattatttctcctggcaaaagaccaatgttgaagaagatcaaaaaaatacaaactttttcaaacgtatcaaaagtgtgtgtgctgtcaaaagtattcctcacttctgttcggttattatcaaggttaacttgatttattttaataatacttagggtagatgtaccaatagtggaggtactaagcactattgaacttcatttaaccgcctaaattcaagaagcgcaattaatgtacatgttaatgttgcaacgggaagtaacgaccattgacataatgagaaaaaatatttcatcgcaataatccacggcatgtcagtgaaaaataatatctccactattggtacacttttcctttagttgtggtatattttaaatttgtgttcctgtagtagcggtatctgtggttttcctatgggatcctccactataggaacactttaccgcaactattggtacaagcaaaaacagtttaagcaattttagtggtatttcatcagttttaaagcaatttgaacgctcttttcatctattccgtgtatcaacaagccaatacgtcgattggcagtgtcagttctgtggctaatgtaataaaatcagtgaaaacggcactaccgcaactataggaacaccctcaactaagagaacacttaccctatcaatcaaggatcgaatcctaggacacagacaaacagacgtcacactctcatcgctgtccatcgaccaactttttaacgctcaattcaaatattgggtaggtggtcaatcgactacccgcagcgctcgcgtcgtttttgttcgtgtttgacgtttacacactaccgccacctgttggtccatcggccaactacagtgtttttagcattgggcgtacaagttttcgcgactatgattttgatcgcgatttgttctaagtgttatgtctgtttctctgtgcctaggatttaatcctctcatacaagacgcatgattcaatgcatgcatggattggaatataatgagcgcacgcaatcgatctcaatatgtgggttttgaatctcagcagttcttggagtaagattttttgaagactggttctgacgtgttagtgtgtataaaaatccgaggagaatcaccgggaaaatcggaagaacgtgcaagtgcagtcatgcagtgcaagtcattttttatgggacatagcgttcttcaacagcctacttgatggcaaggcgaagttttccgggacgactagtctatctatctatataaataaaaatggagtgatgtttgtatgtcacgaaatgccttgagaacggaccaacggattgacgtgagttttccactgttacactagacaagggatgcgacgtgttcgtgcgagcaaaacgtttgggaaagtctccggaattattgggaaaacgggagaagcctaatgttccattttgtatgtgggattacatgacgtttcacaacagcctagtttgccgggaccactagtatatatatatatacataaaaatggaatggtgtttgtatgtcacgaaattatttgagaacggttcaaagaatttggacaattcattcactgttacattcgcccaggcttccaacgtattcgtgcgtagaaaatgtttagataactcttcgaaaagtcgtataaacgacaaaaaaaataaaagtgtcattatgtacagagttgcttaatatcaatcatatcagctgatggctgatggtctaaaactatcaatatcacttgcaagctatcaatatcactttgatttgacaaccaacagcagtgatgcgacatcgcactctagatcaaaatcactgcagaatgagtgatcacgtggtcattatccatgctattaatgtttttcagtgaccaacacatagtttcaatctatctgcaacactgtcgaaaatatcgtactgataaattgccattttatctgcttaatttaaagctaaacttaacccatcagtgatatccatagtctatcgccatcaatgcactggtgatggagtagacagcatgatgttgatgtgatatggaatgatccgatttgtatcgcagtcggcctgtacaaatcagcaaattttaagcattgatagtgacatcgagtaactctgattatgtatgggagattgcatgtcatttttcaacatcctacttgatcgcaagacgaagtttgccggtaccactatagttgagttttatgtgcactaacagaatattaaaccgtataggccatgtgaaagcaaaaatactaaaatcctcagcgttaagcgaatactcaacgggttcaaataatttttaacattatactcgtcttactgctgaaactggccagaggaagtcgagattataccttttccggtgggtcactgggcaggttgcaataacaactattttaatttgcatgataattaagatctgatattcagcattataaataaagagtattggaccgtttataatataccggatgtggtcactcgcgctttatgtcctgaagaaccggtcatatatttgctggatactaaaccgtttcaatgtcgaaaagttcaaattatcacgtatggcgcaatagggaacagctatggccataactggtacacttaccctatgctatgttcaaaataacaccaagagataaccagttacactgttgacttgtaagccttcactctattgagttcgatgatgttctgtaataaacttaaatcgctaagcacaagccattgtgatcgtttgtgattttccaagaaacttagcgaacctttgtagatttttacaaacctttttgaacccatgcagacctataccaacccgtagtagaccattgagtactttcacggatcttacccttgtcaaaataagatgaatgtgtaaataaaatcttggaatttagtaaggaaattgtagtggaaatcaattttcaaggaacagaagttagcaaataccactattactagaacatgttccaatagtggcggaattgtaaggacttaatccttaggacttatccttagtgcacttcataaaaatagtaggcgttttatataaagtgggcggatttagattaatttcttaggtgtaagaattttgatcccacacggtatgaacggttaatacaagagctatttttaaactgaaaatcccttacaaactcaaccatctttcatttccgatcgtttctcccgtgtagcgcaagtcaaaaattggtccaatttaataaccatttattatttctttctccaacttccagattccggccaaacagcagaaacccgcaatgcaagtagaaagtgcagcaaagtggcgcgtaccgccgttggatctatccgcggtcagtgtgctctccaacgaaagcgatcggcggtggagcaataatcacggccttcatcatgcgtccggccaagcaccgctacctccgccaccgaagaagatccaatatggtcccgatggtttgccaattgatccccgggattggacacgtgccaatgtgtggacctggctcataaatttggcccagtctgaagggttggacataagccctgagctggcgcaaaagtttcccatgaatggaaaagccctttgcctcatgagcttggatatgtacctcagtagagttccggtgggaggaaaaatgctctaccgggatttccgggtgcggcttgctcgagccatgagcttgtaaatgcctcaactatggccaactaatggcaataataaagatgtccaaatctcctcagtaacgttattagtatttagaaataagagtgttaaatccaagagtttcgacaatgcattatatacatatatctctagactagtggttaccaatctagctgacttccaaagttccacactatgctgcgaaaagcatcagaaagtttatgaaatctcaaatatatagcaaaactacgatttagcccaaatacataaaaccaatatacttaaatatacactataagtaaaagcatcgatttgaatgatgctaagtatttctttactatcctgtcgtatatcttttgaaggtacattttcgtgggaatttgtttgtgtatatataattgttagaaataagtaatctagtcaataaatcattttcaaaataaaagcctgaattctacatgttgaaagaaactatctttttgctattttttcgtaccaagtttaaacaggacaagatgataagatgaaagagttattgcagagtttattgaggtgattatagaacgaaactacacctcaaattttcaagagcacaagacttgagaatcaagcagcgctccgcgttgaaaatttatcccattggtcaacaccagcaagcaagcaatttgattgattttcatcgcgaactgttgtcagattctccagtcttgtgcgcttgaaaattcaaagttaggctttgttttataatcaccttaaatgttttttctcttgcagccccttaagaaaacaaaaatctgcaatgcaagaattcattcaggcatatattcaagaatcgctcaaaaaatccatcaagtataactctatacgttccccagggattgaaccagattttttaaaagatacctgcaagaattcatccgggggttcctttaagaatctctccagtaattccgccaagagttttacagggttttcttttatgatatctcaagggatttctcccataataacttgaatttcttccagaaatccatatgaaatactc

SEQ ID NO: 106 - DNA, 12346 bp, Aedes aegypti
ccctacccagtttatccaaatttgcccacggaattgcgtcaaaagaagtctaagttgggttgatttgtggctccgtgaatatattgtattttaatcgattaattattgcggcgctcatattaaatccacatccagcggcggcggtaacgcgcagaagatatgcgcgcaattcaaacgcaacgtcaaaattcaagtaggcttggattttttcgtgcttcaaggacataaatgtttcaaatttgctaaatctgaaacatttattgattttcattatcactgcgacggtatatcgacattttcagataaccgcattacgtggatttatcttgcagagcacaataaataaactgttgcattcctatccggatcatttttttttttcaacgtttacccctcgtcgaaaatgatgatctgtcatcatgatcatcattaaaaaatcaacacgcatcttttccatcttgtttacgtccgccaccgcagagcgagcgagcagagtccccaaaatcgcaattcaagctgtacaaaaaactttccagcgtcttcaagcatctctcgtccaggcttctcccgtctgcccgtggactgttgtacaacatcacaatgtccgccgaaaatacgctgccggatttgcttggcggaggagcgcaaggagcgaagccagataacaaacccctggtcgacggagaagaagctggcggtagtgtgacgagtaacagtgtcccaaaggcatcacctttggagcttgatacagcaggttccggcagggaaagcaacaacagctcacaggtgcagcaagctccggatttctcccagtttgacgacagcgaagatgaagagcattaccacagtgggggcttccactcggataacatcagcatcgaacggataagacagtatctctcggacaagctgggattctacactaccgattccaactacgacgacaaggatggagttccgagaaagagggtgctggaaacggtcgatattgatggggttttaaaacactggaagaatgggggcttcaagaaaatcgtcactatggttggagccggaatttcaacatgtaagtacctacttcatgatagcaagtaaaagtgaacttaacactttctttcctaccattggtgatccaccgattttcgacgaacgctagctaaaccgaattggtacgattagctcaataatggttggaataaatttatgcgctcattggtctcatcaaacaccgtaataagtgaccaaagggtcttttattgaactattgaaaaacaataaaaaaaaaatagtgattttaaattcagcttatttgcaacaacttttgctcaagcactttagttttggaatgtccccctttttcaaaaccagtaatgcaaaatgtacttaaatatcctaacggtacgtctacccatgagtgcatacagcatatacagggccatagcgtaggttccaggcgcccttgacaagccacttttttgcgcccctgaggcaaaaccttgctgaggtttattgttgaatttctgtgaatttttcatcgaaatcttcttgaaagattatcatgagaaactttaaaatgatcaacattatttttacggaataattaagaatcgtggaagtagccaggatttccatcagaggaggagggtaagcgaccacaaatgctcattcacgaatttcacgcagggaacgttaaactatggagggcatcaacccttacatcaacatcaactcctttttcttttacagtaagtaagcaaagtctaatcctaaacgcactttgtttcaatttgttggatgagtaacaagtccatataacgccttggaaaattcccgattgggtttagtctaaagctcgtatgaactgcgaatgcagatgggtggcaagtcaaaatgcgtgaatttacacagcgtcgacgacatggtgatctagcaaatgtgcgctgttgaggtttttttttctatatattctactagcgttttctcacaatcttatttctttagcaaatacaccaacagttctatcggtgattccataatacggaatttctccagggattgtaccaggaattactacaaggaatcaatcaggaatttcatcaggaattccatcaggagtactgttaaagtttcaatcatgagttccacgaaggattacatcaagagttccatcagggtttctctagggattccattgaatttttcctctatggattctatcggaagtttctctaggatttcatcagatgttcttctagggattccatcaggagctccttcagcgattccacctggaacccctcttctaaggattgcattaggagttcctccaatgattccatcaggagtttctattgggattctatcaggattatctttagggcttccatcagagttcttctgaagattccatcaagagttccttctgagatttcacctggaattcctaaagagattctttcagatattcctctagagattatttcaagagttcctcgaggaatttcatcaggatttcttttagggatatcataaggagttcccctaagaattctatcaggagttccatcaggaatcttagcaaggattattccagagattttatcagaagttcctataggaattccaccaatagttcttctagggaattcatcgcgatttcctccaatgatttcatcaggagttccttcaagaatatcttaaggatttcctccaagcattccatcaggaactgctctaggaattccaacacgctctacggaattcatctgaagttcctccaagttccttcagagattatatcaggagttcctccagagattatatcaggagttcctccaaagctctaaggattctatcaggagttctattaggaatttttctaggatttcatcaggaattcctatagcaatttcatcagaaactcttctagggaatttatattcatcaaatgtttccatcaggagttcctatatggattctatcaagagtacttttaggacttccatcagagttcttctggggatttcatgaatgaccttcatatatttcacctgagattcttccaaagattcctccagagaatatatcaggagttcctctagaaatttcatcagggtttcttctagggatatcataaggtgttactctttggattgtattaggagttctatcaggaatctcatcaggaattcatccagggatttcagcagcagctcctatagggattcgatcaggagtttttctagagattccatcagaagtttcttcagagatgccacctgaaattcttctagagattatagcaggatttcgtcaaggaaatgtatcatgatttcttttagaaattgcatgaggagttccagggattccatcaaaaattcctttaggaatctcatcagtaatttctgcagaaatttcaacaggagttcctttagagattcttttagaagttcctccagaaattacatcaccaattcttctagggtttacatcaggagttattctggggattacatcaggagttccttaagggagtttatcagcagttcgttcagaaattccaacagggttttttttcagaagtttcgcttaagatcctagtgagttccttcggagattgcacctggaatttatctagagattatatcagggattcctcaaggaaatccatcaggatttcttcttgggatttttttaaaaagatttgccaggcatattatcaggaatccttttaggtatttcattaggagttcctataaggatcccgccattattttcttcagagattccattaggggttattccaggcattacatcaggagttcttctatggattccattaaaagtctttcaagggattttatcaggagttcctccaatgatttcatcaggagttcctttaaccctttctctcccacagctttgttcgacaatttagctatcaaaatggcgtttctaaaaaatgtgcttgaacaaaagttgttccaaataagctatattattcaaaaccacaataaaaaatttgattgtttttcaatagtttgacccttaggtcacttatttcgatgtttgataagacaaatgagcgtataaatttatttaaattattattgagctactcgtaccaattcagtttagcccgcgttcgttgaaaatcgggggatcgcccctgtgctaccatgggaaagagagggttaagaatatcaaaagtttctgtaagaattccttctgatattttacctgtaattcctactcgaattctatcaagagtttctcaagggattcttccagggattacttcagaggttcttccaaggattccatcagaagtttctctagggattccttttgaaataattataagatttcattataaaatcctcatgggactccatcatgaacactggagttccatcagaagttttggcagggattctatcaaaaattcttctaaaagttccttcagaaatcctctaggggttttctgggttttatcaggctatttactacggattcctcccgaaatttattaagggaaattctaccagaatttctttccaggggtttttctagggattcctgtaggaattcttcaaaagggtactcctggaattaatcaagggatgcctctcgaaattctttaaggaattaatatctccaagggttatcagaaatttctcgtaaggatttgattagcggaattactaaagagattccttcaggaatttctcaaggagtttctcgcggaattcttccagtatttttaccaaatatttcttataaggatttcacaagtaatgtgagtgactctatgacgagttcctcctgcgattaaataaaggaattccgttaggggggattccaactaaaaatccccctaaaaatcctgtagggattccaactaaaaatcctccagggattcctctaaggattttaccagaggttccttcatggattgcatctggaattcacccagataatacagtcgaagctccttataacgacaacttttataacgacaaaagctctctatagcgacatttttcggtcccatgaaaaacatttcgatgttataactattctctataacgacttttctctattgcgacggtcctttgcgatgtcgttataacgcgcttcgactgtactccatgatttccaacacacatcataggacacattcataggaattccattagaaattctttcagaaactccaccaatatttttccagtgagttacaaagaattcaaaaaatcatctagagattcttctaaaacagtctggaaaaatcctccgagggttccgccaagatgatctcaaagtatcccataatgcagaggattaaacaaagcatttctctgaatgtcttcaggttgaatcagaatcaggaaggatttttttgaaaatttctggtaaaaatcatgaatccaaaatcccaggtcgaatgcctcgtagggtttcttcagggatacaaggaagaatctttgaagaaacactggaagaatttaaaaaataattttttgaagaatcctctgagaataggcttggggaacctctcaaaaaattgcaaacggaatctctaaaggaattcctgggtgaattccgcgtagaattttttttttaattcttttgcagtaattcttgtggaatccctgaaagtctcctggtgaaatccccagaggaagtccttgaagaatccttagagaaatacagagtagaatcactgtaagagttcctagagtaaatctgaacaggtatttctgtaggaattattgaaggaatttctagctaaaatcgtgtaggactaccggaagcaatccttgcaagaatggttggatcaatcgatgaaggagtttctggcggtattcgcagggaaatcactagaagatttttgatgggagcaattcctggtggaatttttgatggaattcctgttctcaggagagattcattgaaaaatccctttaagaatttttagaggaattcctggtggaatcgcaagaaaagaatccttattaaatctgtttagaaattcttgaagttacgctgcagggattcccccaaataaacctttggatgattttttggtggaatacttgaagaaagcattataatacccttggaagttttgtgatatgattcctgaataatgcatgatggaatcctgggaactaacttctagaagaattcctgaaggaatctttaaagaaattgttatagcaatctctagagtaattcttggaagcagccttgtagtaagctctggaaaattactgcagaaatcacttgaggtattttttggattgatctttgaccgagataagccagcctcgggctgcgaatctcgttaataaagataataataataataaactgatctttgaaggaatcagtggaggaaatcctgaataattaatagtggaaccattgaagtaatctctggaagaatgccaccggcgaaatttctgattgaaactgcgcataaatttctagggggattattggtaaaattgctggtagaatcccagaaaaatatctggtggaattcttagtataacccatagattcctatgaaagcttcaaagtagaataactagaggaaaccactaaagattctggctagaatcttagaagaaattagcatagccatttccatatcgatgactgttcagatataaaaccttcagaatttgagttttgtcgtaattcttcgtgcgaattctaagtggaattcctcatcaaggtttggagagatgcatcctcagcaaacgaacgccattcgggattcctggaaaataatgtttccaacgctatcttccaatcgaaagtaccacaccgtataattcctccataactttttcacagttgtattgaggcatgtctgatggaagatcgtgaatccgagcagtgatcgaagcattatctagataaaccggtattttgaggcttcttccctggtgaactatgaacatgatttaaattattacctttctgatacagtttagctaattcgacactatttagttcaattaaaatacagttccgtattgtatgaaactgtattgaagcgacgtccttcagtacaagtttaatagtctcgcataaaattttctcgatgttggcaacctccggccgcactgggagaacgctaaggtctacgacgagaataattctgcgagcgttcgccattatagaaagtcctttgacatcgcgggaataaaaatcgcacacgtccgtagtctactaatggtgactgtcaactgcgttataaaaatagtcgaatccaatagtttaaaaaacgtattttaaagcaaaagttttcgaaccattggtatacattttcaaaactatcgtggatcacctgacaaggcttcgcagagcactctgctgcaccgctgctttatggtgtaaagattattcttgaagttcgaaagagatttagcaaggatttgtcccggagttatccaaagagtgctaaatgaaaactttaacggagagcaagaacttatagtacctacactttcttaatgcgttttggtatacttttttagatttttcagtttcagttcctccaaagatttatattgttatattgtttttgagaaattttgggaagattcttttggtgttcttatataaaattctataggattaggtatattgctgagattcctttcaaaattcttctcgaattcaaagataaaacctcggatattttacacacatttcgttaatttttcttttcaattttccatatgagcatatgacaatgagttttaattttatatcgatatgttttagctgccggaataccagattttcgatcgccagacaccggattgtataataatctgttgaaatacaaccttccgtatccacaagcaatcttcgagctggaatatttctatcaaaaccccaaaccattcttccagctagctaaggaactttatccgggtacttttaaaccaactccttcgcactattttgttaaactgctggagcagaaaggattgctcattcgacattatacgcaaaatattgataccttggagcgcatagctgaaatcaacgaagagaagatcgtggaagctcacggaaccttcttcaccaatcattgtttgcagtgccgagctgcttattccgtggactttgtcaaaggttggtaatcgctcgattttctttgatcgatttctcatgactagcttttcatttcgctacagagaaaatttttgccgacgagataccgacctgtgcatgcggtggtgtcatcaagccggacatagttttctttggagaaggtctgccggaacggttccacgttctgccgcacaaggatttcgcagagtgtgacctgttgattatcatgggaacctcgctgactgtgcagccgtttgcgtctctggtggaatacgtgaacgacgattgcgtacggcttctgataaaccgtgacaaggtcggtggcggaggattcggattcctgcgttcgatgatgttcggcgagggactgtgtttcgatctgcccggaaataggcgggatgttgcctggactggggactgcgacgatggatgtttcttccttgccgacaagctaggaatgggggtaagtgtcgtagatgggagtagtcaactgtattattaacccaagaacctgcacttgtaaagtaataaacttcaattcaagtgaggaaaaaaaatgtaattagtatttttaaattagttgaatttaggtagctgattattaactccgttaagatgaacatacatcgaagcaaaacctcatattttcaagagtacaaatctagagaaccagatagcagtttggaatgaatacttaatcgattggtcaccaccagcgtgtgacgaccaatcgattaagttttaagctcaaatcgctgtctggttttctagatttgtgctcttgaaaatttgaagtattgcttcgatgcatcttcagcttaagagaatcaaggtttcgtttcatatctagaagaggactgttgcgttttatacactttaggacataacggttccctatttggccatacgtgataatttgattctcttcaattttttaatcattctttgtgtttaagtagtttgatatgaaacatatccgaccagctttcgtcacctactgagtactggtttcaatggatttgttgtagagttagtcgagctcgtacaaggtcctaagcacccggtgttcgaaactccaaaagcttgcaggtcctcctcgtgcatagtccacgtttcttgccagtagaggactaccggccttgtaagcgtttttaacatggtacatttggtgcgaaagtgaaccttttttgagtgcagcttctcgtggagctcataactagcacgacttcccaagatgatgcgcctccgtaattcaaagccaacgttgttatcaaccatcagctaggatccaaggtagactaactcattgatctcctcgaaggagaaagctgttcttgttcatgactttccatagcttcatgcggtcgacactattggaagcggatttgaaatacagccggcttgataacttccacgaatttcgtttacgatgaatgacagacgtcggagaatgatctaggataacattttgtaggccgcattcaatatggtaaccgctcaaaagttctcacgttaaacttgtccacattacccctttattagtattctgtttcccagattgtacctatcagccgatgcagacaaatggtcagcctctccggacccatcatcacgagtttaactctgatttcgtccatactagcagttttttatccttgaacttgaacatccttaacctctcttaaactaggggctggttggttgccatcgttcgcaatactgacattgacatttcgtccgttgccttaaccctcattgctcgttttctcagtaccattcaggtgttcatcgaagtgttgcgtccacctttcgaacatcgtacgttcgtctgtcaagatgctccactgcttatccctgcacatctcggctttcacgaagctaaaagtgtgcacccacaggcactcttcctgctgaatttaatatacctagctatatattgattgaacagataaataatgttagtttttattccaggatgaattgcgagaaatgatcaaaagagaacacgctaaactggatgcggcgcagcacaagcatttcccggttgcagaaccaaacccaaccgaaacggcatctgctacagcatcgcaaaaccacgacagtgatgatgtcatgatacacgatgtccaacatgccgtcgacgaaccggctacgaacatcgctccggttccggatttagttccggtggatatcaaccatcatggcgagatgaaggatcttggcgaggggaaatcgacaacggtggcggatggaaccaagaacgattgaacgggtacaaattgtaaagagtacgctacttgcaaaagtggcgaataacattgtgaataaataggaaacaaagtacatattaaacttgcaatcaaactccaacaaatcaaccgacgcaaacaaatagttgtagtaaagcaaactttgcaagaaattaattgtatagaaatggaacccaaattttataaactagcttaaagagcttttattagagttgaccaacagattccctaataatatattgagtttcaccattcaaggatgtttcggatcaaaccaaacatgttctaatagttcgaagttcactttcacgaggttacgtttaatagtaagatacaagcattagcttgacacaactagaggatatttaagttcaatgcaaaaaaaaaaacagtttcaaaattaacgccgacgagattaaataaattattatcccgaagctagcctgcgtattgtcactcacctttcctttcgaaattccctcaatagcttctgccgaaaagtgtataaaactttgcacttctgccacacgctggatgtacacacttgtcgtccttcgtaatcttggccggctgttcgaacggaatacacaacgtcttggctcccatagccggtgcaccgggttcggcttccgcatcgtcacgggcgctttcggccttgattttgtcttcgcacggcgattcaccgcagaacggagccatgatgatattcttggtatccaggaactggataaactcgtcccacttcttggtgaccttcagatgatcgtgaagatctttgtcggccttcttaaacatgttttcgtgaatagtttccatcagggctggaatatccttcgctgcttgttctctcttgaccgttatcttttcgccggtgtcgcgacgaacggcaacaaactgcttattcttcaaatccttgaagcccagctcaatgcggattgggactcccttcaactcccagtggttgtacttccatccaggtgaatagttatcccggtaatctccttcgcaacgaactccagctttcaccaattcggcttcgagctccttgcagctttcgtagagagatttcctttcgtcatcggtggtgttggcagtgattccacagggtacaatgatagcctggatgcaggcaacacgtggcggcaaaacaagtccttgattatcggcatgtaccatgatcatgacaccgatagtacgcgtcgtgatgccccacgagttctgatagacgtactccttttccttcgtttccggatgctcaaacacgatgtcgaacatcttggagaagttttgacccaagaagtggctggtggcaccctgaatcgctcggcctgacgcggaaatgaacgcttccaccgtggtcgtgtagtcaccgccggcgaatttctccttctcggttttgcgtcccttcacgaccggaatggcgagcaggtcggtgtagaccttggcgtagagatctgcaaatgaattcaagatgtaaaattcagtttggtattcgcatgaaaattccaaaaagcttgattctgtctagtttgagtattggctacagttctagcttagattaatctttgatattgaaagacatcaatgatcaaaatttgctgatacgtgcaaaatggtacagcccaagtgagcctacttcccgaagtgaaatttctatccaagtaatctcgagtgcctagtttttgctactttcagcaaacacagagaagataacgattgagtattcataaattaagaactttagagattttatccctagaaaagaaaccaaaccggaatcaggaattacttctaagaaattctttaacgattcctcgtgacatttctctaagcatttttttttccttatccccgggatttcatcatttgcttaagttttttcatgtatcagacgaacgaagatttcgctaggaattcatccagtgattcttccacgg

SEQ ID NO: 107 - DNA, 2900 bp, Aedes aegypti
tatacttacctatatcattaccgatgacagtttctaccacaactgttatcgcacctcttgctgctaactgtcacttatgtctaaccaggcggcagggctcccagaacaacgacggttgaatcttacattggacagaatttgaacttcactgaaattttacaattctcattccttaaacataaacagatctcaagcaacttaaagcacaaacagatctttgttcaaaagtttgaaaataattttcagactcaattagatggtcaccctacactggctgcttggcggttttgtactttcaccgtcgtcgtccgttggtggagcctgcaagtgatgcttgtaacagcgtcgtcgtcctgctgggctgctgggataagtggaaatggcaacaagacaagtgccactgacggattctgcaaactttactggtcagtcagtggaattatcccataccgccggcaccggcggtggggccatgacacggctgccaggacggagacaattcaagagttttatttgccacaacgaatgagcccaaggtactcgaccatgtggtgttacgcggtgatgtgtaagtgtttttccagctagaaaatggtcaggatggctggagtggtgcaggagatggaagagttggtagagccagtcttgatacaaaccatattgataaaaaaatattgtaacattcattaaatgtaaaacgatttaaactttatttgaaagttagttcaatcaataattcattgatttgatccactacatacaacatacgtcctaaatggatttttggtgactgttatgtatccaagactgttatgtatccaaatttattaatagattcaaattctttgtctttcaattgcagtgccaacgaaaatgcatcctggaaagtatatctccatccaccggcgattcactgcaccgtctaacgctggttctgctgcagatgatccgcaacgagtccctcgtcacggcagatgtcgcctgggtaaatgcagccgacagccgctccagtgccaatcattcccaccaacaacagcagcaacagcaatgtctggtcacgtgggaagtctccggtgggggactgatgggcaacctgctgactgaatcttccaccgtgcagctatcgctttggccagaaaccaactatcgggtgcaggtcacctgtcggagcaaggtaagaccacttcttcgagaatgaaattagttttatcgtcttttttgatgctatcgtcgcactaaggggaatttggtgaaactagctggccataacttattttcttgagtttatttaaattttgaaatagtaataggcatatgacacatatacagttgggcaaatttcaaagcgatgatcctggaccggtgggattcgaacccacgaccctcagcttagtcttgctgaataactgcgcgtttaccgctactgctatttgggccatacatcaagaatgcaaaaatggtctcaaaatacttttggtcagctagattgcccagataccccttagtgacgtcggctgggttgccaagcacgaccgcactattttagaaagaaagagagagaggagcgagagcgaagctcgtcttaattatggtaattttattgcatctatacaaaatgcggtccttcctgctggtttcgcacttcacaaattccgacgacaaaacaagtctttaagtttttattgcgccatcacggctgggtcttgatttatgctatcggagaactgaggatttaattaccgactcataattataccggccgctcttgaaatagccacaattttggcaaattaacgttttattgttttcttctattatttatatttcagcacactaacaccatgatccgttcggcaccgatagtgttgaatacgtccactgccacctccgtcggtcaaggtcagtcgaagaatccagttgccgatgaaagcgaagcacaaatcggccttgaagaattagttcctgcctccaacccgaagacatccaatggccaaaacgatattattgtaacgtgccgcaacgatagctcagatcatcccaatggcctgcgagaagttctactactaggggtgtacgtcaccctgctggtgttcctgatgatactgctgacgttgattagctttatccagccgaagccaaaaccagtgtcgttggataaggaggtttcctcaccgtcttcggcgtcgtcgacgtcgtcggacacgtgctcgatagcgtccgataagcaagtgctcgttgcgaatgatgtgatggctgcggaaatggcttcggtagcaggaacggaaattttgcacgtttaagggtcatttgactgtacttggggagggacttttagattaaggagtgctcaaagtcaataggggttaaattagcttttataatgatatttgcgaagaataattagtaatgagtaatgtaaggaaacgcttttggtattcagaccatggaactacagaaatagaatgacagttacaagcaagatggacacgaaatcagttctcacattatgttcttcaattgccataaatgaaaacatagatcaaaagattggtaaacaatgcgacacttaaaaattatattttctgttacagaaccggtggatctgaaacaggatctgctggtggctggttttcttcttcatgcctcggttctggttagacaaatcagaatgaccacggttgggaacaacttcgagtaaactgggacctgcttcgacgtcccggttgggactctacagatgttcactgccacttggtgttgctgcggtagaccttggtggtaaagcatgtcacattttcggaaatcacgaggagttgcgccttgagtaaattgtgagcagctgcttcgagtcgtcgtcattcttccacgtgcagatatgcttcactcaggtcgatgacgtt

SEQ ID NO: 108 - DNA, 8235 bp, Aedes aegypti
ttgttatcagacgggagattttgaatggaaatacggcgcaaggccgactacgatcgaactggggagggtaattaaatcaaatctcacaatttgcgaagttatcaatcgagtagtccaaattaaatgttatgaatgaaattctgagttgcttggattaacgatcgtttactgctttgtctatttccagtgcggagtcggctgtagattgtgggagctagcgctggaatcttcatgtcagaatgtttgcgtaagtagttcaacaccttccaaagaatggttccctagcatcaacgacccttccatcttcctcagaacaaaaccgatcaggagctgttcgagccgaaggagctgtactgcgtcatgggatgtaacgatgcgctgcagcggtacttcaagtggctcaaggcggagattggctcgccaccggcaccggcgctggtggccgacagcttgaccgctacctcgctgtctctggagtggaagatccctgatcggctggtgcagctttcacgacacaaggatcacgctcctcggagctacctggtgcagtggcggtacgaagaagtcgccggcgactggaagttctgccggaatcagagtatgggcgataactcgactatccgagttgacaacctgcagccgtacaccaagtatcgggtaggatctctcataactcttgacacgtatcgagtctctaacgcacagtattctcctcttttcagttccgggtagcgttgatcttgtcgccgaaccgcgacgacgccctcatctcggagcagagcgtcatcatcctgacgctttcgcagggtgtgccaatgtcggagccgaaaattgtacgagccgttgcggtagatcattcacgaatatccatctcatgggaacccggaccgttcccgaacggtcccatcctttcatacgtgctccagattacagatctcgattccgaagactacagtgccctcaaggttctaacaactccccgttctctgctgtgtttgatctttctcctttacgctttttgcactgcttccttgcagcagcacctgaactgcttctctccgttgccgagtctcactaacagcacccgctcatgcatgccctcgcatttcgctatcactataacaaaactaacccaaattcaccggtaatccacgcccgttctaatctcgccttcgctcatcccccacaggacatccccgagtccaactcgtctcgctactacatctacgagaagctcaagccggagcgcaactactccgtatccgtatccatgcgcaaccccgaaggcgaaggacctcgttcaacgaccttcgtcaaaaccctacctcaacctccggaccaggaggaagccatcaaccccaccctgatactgtgcgctgaccgctcggtcctcctgcaaagctccaacatgttcaccgaccggccctcctacttctaccgcagcaaggtgcacgccattcgaggcactgccatccacattcgccgtaaccttatcttcatctccgacgatgccggctacatctacaaaacacccctgcaagcagccgaacgcaatcgaaccgccattctcgttcccgaggcgggtcacaacttccgccccacgcttctctccattgattggctgaacgatcacctctacatcctcggctacgtcaaagccaccgacctatggcagatctcccgctgcgatctgaacggcgatcgtatgaccgtcgcctacgccggacttcaaagcgaaccagcccacttcgaggtagaccccttcaatggctatctcttctgggtgatcagcagtttcggcaaagatgccgggctcttccgactggacctcggtgacatctccaacggcgtcaagcacgagatcagtccccatcgacttaacaacctctacaacctcggtgccttcacgatcaaccacgccaatttccgagtcctcgtttccgatcaaacaaacaatacagtcctatcaatctcgctagatggctccatcaccgaggacatccgaaagaacacggagcaagcccgcttccgaaaggtcaaatcgatcgtcctcgtcaacggtctattctactggaccaacggcaaagacgtcttcgtcgaagaccaccacaaaacgtacgaccgctactaccacaacacgatctcgatcgaaaccaacatcacctacctcagcatctacgtgaatctctcatccgcccaacccgtcccgacgcccgtcaaccccccaagaaacgtccaagcgctcctcaccaacagcaagatcaaaatcttctggaacgttccgcatctgctgggcatcaagggcaagggcgcgtggcaagagtggcgttacgtgctggaggtgaacgacggcaagaagatacggaacatcaacgggacgacgtttacctcagaagatctggcgctggtcagcccggggcaggagtatctgatcaaggcggcggcctatacggatgccggtcaggggccgtggagttccgagtttcgggtgcggacattgaaggacacacacgatcgacatctggtgtggtccagcagcgaggggattctgcgcagtgacgtgataggtgatagcgttgagactttaatcagccgaacggagttggaagatggggaagttacggatatcggttggttcgagaacattttgtacgtggtcagcagctcgacgttgatgttttacaatcagagcgagagtggggtgacgaaactgcgggagatggagtcggtggagtgtgtggctgtggattggatcggaaggcggttgtattattacaacccgtcgcagcagatgatcatgcggagtagtctacatggggagcaacccgaattgattcataacgttaacaacgtgcggtcgatcaagttcgatgcgctgagaggcttcatttaccacttcacggcttacgtcgtggaagcattccggttgaatggcaaggacagacacagctactacatggagaacaaccgattcgctgggaaagaggtgatcgggatgaccctggacatggacagcaagaaactctactggattgtccgggctatgaacaacctggaagtgttcagcgcaaacatggccggaacgggttcgccgaaggcgatttccaccatagccgtcctatccgatcaacactccgtaggtcctctgacgcactttagcgatcgccttctctggctacaaaaagacgagatcgttgtgggcgatctccaagcggagaacctcgcacatatcaagaaccagaagctcaacggcactcgagccttcgcgatcatcgatccggctcatcacgtctacccggaggacaaccggaaagtcaacgttctgcccatgcaagttaacgacagctccatccgcatccatggcacctggaagaagttccagatcgtgtgggatcccgtcacgaacgtggactacggcaaagtattctacaagctttcaatcaaagttgccggtagacccgaagagatccttgagttgtccaagcccattcaccctttcgtagtctccggaccgaatcacatcacccctcacacggagatcaacgtaacgatcagcgccttcacgtactggcggtcctcgccgtcctcctccgcccggctgttcagtccctccggtaaaccttctcaaccaacgcgaccccgagtctacgtaaggcacttcatcgaccccattatggacactcacaacatcgaagcgatcttccgctggtccccgccagaaactcccaatggacccattatcgcctataaggtccactgctggtatgaagaggacggcatttccaatcacgtcctccagggcgagcgcatcaacgggacggagagaatcgttcgaaacctgctgcacaacgttacctacttcttccgggtgcaagctgctacgactgcccgggacagcgaaatgactccgattcgctcggtggacactgccgaagatcacccgatcccgcaggcgatgatcgggacccgggatcacatcatccaggtggacttcgatacgaagaattggacctacatggtgggaacgtcgactccggtgaaattcttggctcgtttggccagggaacggaagctgttctgggtggatgagaacaacgaactcttccagtacgacgggttgacgaagttgaaactgtactcgatcagtgggactgttacagccttgacggtggactggatccaacggatactgtattggtctcagagggagttgattggcagtgcgatcttcgcgttcgatttgagccgcttcgaacacgaaggagtacatctgcagaagatcgagcacagagaaggctacatcagtaatctggtggtgtctcccttcgatcgaaagctgttttgggtggagaaggttccagaggacgtgatctttgtgcacagcttcagcgagaacaggacaagggagttcttcgacgacagcttcgaggaatgtcccaacaggacggcgggtattacggttcatccgatgctcacgctgcagacatcggtcagcgaagaagccaagctgttttggggtgagactggtttgaggtacattggattgaacaacaagacttgcgtgaacttcgggttggagtactatccgaatatgacgagcatcgcgaaggatagtgatcacttctattggctggatggaaatgatacgatcgtacgaatggatgaaactggagatcaagcaacgatcgcgatcccttatgcgaagacactgttgcctctgcagcttcagtatttcccggagcggagatgcttgattccgctgcaaaaggatcaggattatcgagcgaatcttctgcagcgtacggagaactctttgactttgcttctgccaaaagcggaagtttacccgaactgttccactcagcccagcggaatccgatacatgatcttctacgaggaactgaacgaagcgaatctgaacggaacgatcgattgcagtcccagaagttgtctgcaggttagttcgtacgatcgcagtaagaccatcgagggtttgaaacccttcaccaagtacaaattccaagtaatgctgatcaactactaccaggagcactaccgagaggtggccgagctggatagtccccgaatggggtcgatcgctgtgttcagtacggccgcgggtgctccgtccaaaccggagcatatttacgcggaggccatcagcccaactgaagcggttgtgcagtggaccctgtcggcggtgaagaacagcgatcgcgtctggtacgagatccactggcagacggagaacatccacgacggggtgaagaacaagcagcagcaggtgatcggaggtaagtttgtgggacttcagcaaagatcgaacgcagagtagaatctcattttgattgcagactacgacgaactgctgggaaatgtgtcgatcaacctcaaccgactccaaccgaatcatgcctacaccatctgggttcaagcgtactcgaccgaaacgatgttcaccgtgagcgatcagacgaagatcgttaccttcccggagccggacgatattcacttggtgtacaactcctccacggagctcagcattagctgggttccgcaccagcatatttctcggtaagttcaggttcacgatcccttcactagtcacgtaacttattgatcttcccgcaggtacaagatccagtattcggcggtcggcagcaagtcctgggtgacgatcttcgaaacgggggtcaacgaaaccactccggagaacgacgagttcaaggtgaccggacttcaaccgaagacgcagtatcgcttcattgtgctgctgttctacccgaaccgcaaggaaccctacgtgtggcctccggatgcgcggttcgtctacgaaaccgatgccgatcacccaagcgctccgggtcgtccgatcgtgacacaactccgacaggacgtctacaaagtatcctgggaacctgcgaaggacaacggagctgttattctggaatacgctctggaagcattggtgcgactacctcgcagtacgaatagagttgaacgaagcgttgaacagctcgacggagatagctccgaggacatgaacaacacgattccgacgcgcatggacgtcatgacaaccgatagccaggagtacatgacttttgatgaacgctgggacttggtctacaacggaaccgacgtctactggataattcctgagaaattgaccttccacaagaataagttccgagtccgtgcaagaaactcttgcggttggggcccattcagcggtgagagcgatcccatcagcgaaccgctgctctccagtcaaaccggcagctacctgatgatcgtgggggtcatcatctccgcgatcgtgatcgttttcttcgtgctgatcttcgtctgtggtgagtattgctgcggcatctttgcgcatctccatcgttcgttccatcccggaatcatgccatcgttcgccatcactcatgcttcatgtgtgttatttccattgtgtttctcctttgcagcgtgccgtcgggccgagcttaaaaagaaaattctaatcgatgcaaccactactcgcattccagatgtggagctggcgaaccttcgcgagctgccacgccgcggcaatttcattcacagcaacaacatcctgtacagctcgagcccgctgacggactcggagattgccctgctgccgcagatccgccgggaacaggtgagttatggtaaggtcgatggaatgttagtgtttcaatgtcgtgtctcgttgtagatctcgatgaccagttcgccgttcctgggtagtggtgcgttcggcgaagtctacgaaggaatcgtcaagggagtcggaggcgaagcggagactcgagtagctatcaaggtaagtccacttccatctagctgccaagtttgagttaaccttaaccctgttttgcagactcttcggaagggagcaaccgagcaggagaaggccgaattcctacaggaagctcacctgatgagcaacttcaagcacaagcacattctgaagctgatcggagtgtgtctggatctggattcgctgtacatcgtcatggaactgatgcagggaggtgacctgttgagttacctgcgctcgaaccgaccaacgccgggcaacccgtcaatgcttacactcctggatctgatctcgatgtgcgttgatgtggccaccggctgtcgctacctcgaagagatgcacttcgttcatcgggatctggcttgccgtaattgcttggtatcgtcgatggatccgagggagcgtgtggtcaagattggagacttcggcttagcgcgggacatctacaagaacgactactatcgaaaggaaggtgaaggactcctgcctgtcaggtggatgtctccggagagcttggtcgacggagtattcacctcgcagtcggacatttgggcatttggtgtgcttctctgggagatcatgacccttgggcagcagccctaccccgcgaggaacaacgtcgaagtgctgcactacgtacgggatggtggtcgactcacgcgaccacaggactgcccagaagagctgtaggttttgatcttctctactgcttcgcacaaattcttaatgcattcacggttccttacaggtatcaactgatgctcaagtgctggagctattcgccggaggatcggccaaccttccgctacatactggaagagctgaaaaaacacaaggcgggaaccagtgagtccatcaaaatcacttcccagttcccttgcaaggttcagaatggtacgtcctttacgatccgcacttctcgattatccactaactttcatccacgctcatcacgctgaacgcatcacactaatccggcgattcactttgctctctctctatctctcgttacgcattctaggtgcggtgtttaaccgatcctatctgctttccgacatcaatcacaacccgttcatggcaggtacatattgtcaagatccatttcataaactctcaatgatcgaacagtcgttcgccttcaactaactgtatccttccactttgtcactcagatataaaattcgtcgggaacagcggaagtggtggcggcttcatcataactccgccgacttcgtcgagcggaggaagcggagcaaccgtgatgaccacgacgatccccaagtacctggagctggtctacgacgacagtcacagtcagaacagcaagtgttccaccggagaggacgtcccgctaaccgtcggactacctcctgcctcatcccagcagaaccaggtcatgcccaccg

SEQ ID NO: 109 - DNA, 10831 bp, Aedes aegypti
tatccatcgcatgttgtacgatacattcgtgtttctccgtatgcgtccatatggacacataatttacctataggtaattgaatcaggaatatattgttcaagcacttaacatgtagttcaattaccattagttataaagtggggtatttttcgtggttttctactggcaaatgatcagccgtaattgacactaactgttcaagtttaacatatttgagataactactgttcttatgtttcttcatttatcatccacaattctttaaaatttaactgaaactgaaagggttatattgttttatcgatcaaacaaaggactatgcagaactggctccagtgaaattatgttatcattttaacatatactttggggtattttttgtcagaaacatgttttaattcaaagtaaaaaataaagccaaaaaagatttaaagtttctgatatatgaagtaatttaaactattttttgttgaattgttggttttatctcctgcaatctggcagccttgtaaaaaaattaacgtcgcttttatgctataaattcatgcatcgaatcatcatcgattagtgtccacggaacgaaagacggcacatccaacatggcgggtaagtgattcacatcgcgtacgacaagctgccgtgcaaatccaccgaaatcccgtaattccgtcgctaatccgttccttttcgcccgcagaactgttcgccaagtacacctgcacgaactgccaagaagacattccgggaatccgggtccactgcgtcgtttgcaccgatttcgagctgtgtctggcggtaagtagggcgtcaaagattcccgatttttgtgcttcggaaaaaaatggctgacctgcttctgggctggggctagcttgattttgtgttcatcgtcatcggtcactttctagaagaagcgcatcgttaaaacgatgatgatgacgtcgattatttgaatgaacctatgtgggcggggcgaggtgtgcgtaaattgaatgacaacaaatcgtaatcagctgtgatttgattgatgagatttagagcgattgtaaaccagctcaattaaaattctagaccatcatgtgaaatagtcggaagaaacgaattgtaaacaaatctgtttttgcttttctctgaaaatgctatgaaatattttagttttttgttcaaagtgctcttttgaaattttgatctcaatatttcataggtttttactgccgtgaatcgcaagtcagtcccatctgtaaaaagtaggcattgagaaaatgggctgtgaagtttccaaactcgttttccatacgaatattcaaaaaaatccagattattggaacatgttccaattttaatgaaactttcataacttgcgttttactacgatatttttccgagaaaaatataaagatgatcgaaacacggttcatttttgtgttactcggtgcggaaatctgtagtgggactgacatgcgattactttttattatgggacaatttgacttgctgttttttccgaacaaataatataatctcataagtgcagctgaaagagcattggaagatatgttgaaaactgagctcaactcaattttgacgaaaatgcagatgggactgacttgcgattcatggcagtttatatgaaaaaagaaatatctttaaaaaaaaatcctggagtaattcctcaagatattctttgagacatttctgattgaaaactgaaagaaatctttaacgacaattctgtaggaatatctgaagaatatattggttgatcttttgaaaataaaacgatggtagaagcaatggataaatttggaatcacggacttaggaatttctagaacaaaatctaggaatttctaatccttagaagattttctgagatatctcaaacgaaagtctataaaaatcgttaaattaagtcctgaagaaatctttgtagtgatatctgaaggatacttcgtaaaaatacctgaataaactcctggagaaagtaatgatatagtacatatagaaatacgtacatagcagtaatacttaagcaattctcgctgaaaccaggccaccatcggcacacgtcgttagtattcaaattttatatcactgatcgctagcaaatgctaaaactaaagggtggtcgtttcgtttttctctaattaaaggatccctcaaacagaaatgtgcgaagaagccttttttataaatattaggtatttcttcacgtgatatactttacatttcccttggaacacattgcaagcttaatggcttcgtttagtcctttggcatttcattgaaactaattccttcattgcagtgcttcgcagctggcgcagaaattggacagcatcgaaatgaccactcgtaccaattcatggactcgggcatactgtccatctatcgcggcaagggaggatggtctgctagggaagagttgcatctgttggatgccatcgagcagtacggattcggcaactgggaggacatcagcaagcacatagaaacccgcaccccggaggaagccaaggatgagtacgtgtcgaaattccttaacggaaccgttggacgtcacacttggtctacggccatcgatcaacgccctcagttgacagatcacacatcggacgatacgggacctctggggcagctgctcgttcaaaaactcccgccaatggattgcagccacgaagaggcagttgcccttggctatatgccaaaccgggacgatttcgagcgtgaatacgaccccacggctgagcagttggtgtctacactgtccctatctcctgacgatgaagatgtcgacatgctactcaaactggcccaggttgacatctacacgagaagactgcgcgagcgcgcccggcggaaacgggtcgtccgggactaccaactgatagccaatttcttccggggcaatgccaagcgggcccatatgagccgtgatcagcgcgagttccgcgaaaggctgcgcaccttttcgcagttctacacgtcgaaggaattcgagcacctgatcggctcgttggttcgggaacggtcgctgcgcatccgattgtccgagttgaatcgataccgctggaacggacttcaacggatggacgagtgcgtccactttgagcagcatgccgcggccgcccagcaccgcaatacgggtccctacgggcacggccgaacggtgagtaggattgatttttcgtttcttgccatgggcagatttaatctcggagagttgtttactgataggctgtattgtaaatttaattctggatttcggtagttttaatactgggatcgttgggattagaaaataagcattttaaatgtttaagcatttaagtgtgtgttctacagttgagagatcgcttcttctcggaatcaatgatcataatgattgcttgcaaaaacgtaattcttcttgttgcgactgtaacttacctacattcaattttttgcatgggattcccagagctatcgtcgcttcgatgtttgcgccattttcatagaggtttcttaaggaattcattcatagtttcttccagaaattgctttgaaatttttccagggattccaggaattgtccaataaattgaactccgtcagaaatttacaaagagttctccagcattttattgaaaaagtactgatgcagttcttccaaacatttatcgagtaaagtctccatgtattcttcaaaagctcatatgaggtttcatgccaacacataatacacagcaatttccagtaataccatttctacacacatttctccatggatttcgtccaacgtttttcaaggaatgctttaggaaaaccttgcagaaaattattcaggaattcgattggttatgttgcttttaattatcttggcgatttatctagagaatccatcaagattctatgatttctttcggaggtcatcgcaggaacctcgaaggatttttttttgaaatatttgtcaattttttttttcttgaattcagagatgacgtcaccatgttcaaattcgaagaacaacaaagtgtagaccgtggaggaacagctgatcaaaattcatagaggaaaaaggggtccattaaaacatgggagagatataaattctaggagaccgtggggtgaattagtgtgccgccagtttttcgttgtttttcaatagctagaggcttcaaaacatatgagttcctttggagagttggtccagtaaattaaaagaaagcttatgagcaaagaatttttttcacggaaatggtctacacggagaaccgaaacaactcaaaattaagtatttttaacccatcttgacagctaagtggaacgagtcaaaattgagttctttgcaaagtattaaattttgaatcattccacaaaaactccattttgagtaaaatctaactattttgagataactgaattttagatgaaaattactcaaaaactagtctttttcaagggcaatatttttctcaaatgaatgtacagtgctgttctgaataatagcagcgcatgtcgattttcatacaaaatgctcaactttgacatgctgcagttttgttcactttcaagcaatcgagctgaaattttctccacagaactacaaatataatcaattttgtaactacaaaatttcagttttttctgagtccctgccgaaaagtgagacactaggaaatttttttcgaaaaaatagcagtttttcattttaaagtttttcttttacaaatattttgaacattttcggtttaggtgtaggtttgataagtaggaggagattgttccaatggtaagtgacatacaatttaaaactataatgtcaagccgaaattcaaattttcaaaactgctattttttcgaacaatttcacctagtatctcactttccggcaggggcttagaaaattttgaaattttgtgtttacaaaattgggcatatttgtagttctgtggagaaaatttcaactcgattgcttgaaagggaacaaaactacagcatgtcaaagttgagcattttgtatgaaaatcgacatgcgctgctattattcagaacagcactgtattcattgatatacagagacgatatgggaatgaaaatatgaattattttattcgttatcatacattacaatgtaattataaattaataatcgtagcaccatccagtttcaatgggaaatgtccgcggtattgaacgctggggttgactcgttagttcttttctatcgatgccatcgaatgccggtcttttctatttgggcgagggaactgatgagcgtctgcataattatcattagaacatgaaatcttacctgtatttgccactgtaattcagcatcatcctattccggttaatcaaaaatcttcggggaatccggaatggacttcaacgatccacggctgttgaacagttttgcaccagcaacgcaattcatcaccctataaaactcaatactgtgaacagaagcattgtaaaaaatagtggaattataataataatcacatcataattaagaaacttaccaaagatcgcagagcactcagcttaaccaaacttgaatatgatggcgtgggtattttcatccaaaaatgaagtactgtcacaacacttcgttttgggtaatttctaagttagagatctaatccaaaccaatttccaaaacaaacatcagaataactcaaaagaaattagttttgtaagtactcatagaatacgtcaatattacctaacaatgagaatgagattgtacctaatcaaagagtgttgggaaagtacttaattttaggtacttttaaactggattttgagttgtttcggttctccttgtattataatcagattagttggttttgccgattttgttgagctgttatttgcagaagttgatgccaggtattaagaagaacgactcccgaaaagttgtggggaatgatgaagcaaggcagtcgtttgaaatggcaccgaattggtttatcattatgatcgcctggagaatttctggactacgctaaagacgaaaaaagccgtacggattttgcaaattaattaagggacactttcagcaggcttaagtcgattgatccagcacatcatgctaaattatcggtatttgtgaacagtttacgaaatgcagccacgtgtttcaggatcaggattaacgcagtcaaaacgtcgctcgtccaactgtatgaaggaccattctagtgtaattgatggggactatgtgtcgcattctgtcaacactgtgtgctcacgcataaataccaccttgaaaagtatgaataaacacgagttactccgtttattttatcccggaaaatacgtctatcggttcccacagaataaaaatcattcctcggacaaagttttggatgtaaattgggtaaatttctgatatcatcaacctaatttcagcagaaagtacagaaaaacttacagttgttatgcattttgtagaaatttctcgaagaattcttagagaaattcaataaaatagtgccaatatttctggtaacggggaaaataataaaaaaaaatacatagaaatacctaaaaaattcaagcgtccagaaatttctccaaagatacataaggtagcacaacgggtaagcccataagaattttctcagatattactttgagattgcctcccggaatttcttcaataatttctgaaaaattccctggagaaattgctgatggcattactggaagaatttatattaaggcttcttcgtgaagaatcttcgaagggttccatggagtacttcattgttgaaatcttaggaggattggagaaattcaataaattcctgtagctaaattggattttttttcaaagggagatctcgggaacactttctgaagatttccttaagtaaatttctgattcagtttagttccgactaatatggtggacagaggcgtcgcgtccacatgtgcaacatgtgcactgcacaggtggcaaatcgttcatcataacaacctacaatttctactattattgaagtacgattctttaattctttcaataaaatttagcctatttcaattatctttatcattgatcatcgcaattttcacctttcaaaatatttgttgttatatttttgctattcaaattaaatgcaaaagctgtttggtgcggcgcgaggtctgtgccctaattttccctacgcgctcagtgccatgcatgctacgcaacactttgttccacgctacacgttgctgctgtgacgatgaaacccagcgtgtgcactctcatcgggagacgcgttgcctttcgtcgtacacacaattctgtatatgtggtagaatgttttttgcactacaaatgccagtgtgtaagtagccaaagcgtccactctggccggtgcacagtcttgccacatcaatctgtgcgagcgtgcggtggggagacaagagacaaatcaatccacgagagagatccattttgcttgctctcttttttccttcacgctttcaacatcaccacgcttgtggtgtggagtactggcgtgattttttagacggctgacggtaagaagtttctgtaagtttgagacccagggcccgcgcgtttttttggtacaatactggttaagaacctcgcttccagcatacagtattagcgcggtggtacttgtgatggtcaatcagaagacaatcagaaaatgaattcaaaagcggtcgtgccctccttaccgtcatcgtcagtataacgcttgtggtgtggtttaaaggcgagcaattttcttgatgcgtgcaccaagtacacgaagcgaacgatcttgtattaattctatgtaaaaatatgtgggttatgatcacaaactctatattgcaacattagttagaatccagtgctttataaaccgaaattgatgacccgcataatttgaattattgtcatatgcaattttacaatttccccatagcgatgactaatcgttaaaattgaaaaagtgaaaaaataaaactaaacaacccgattagcatctgctatcatgaatgtatttaatcaactgaaagactaaaaaaataatgacatatataaaatgacactaatgttgtttccgtttttaggaactgggtcgattattaacacataaataaaccaacgtcaagcaaattgtagttcggtcgaacttgaatcgggttggggttgaaactgtggttcagaacaggttgcgccagttccaacctaggttcaaaaacgaattcgacttaaattagaagtgcacaggttgataattaggccacgcaacgcctctgatggtggaggaattcctgcaagaatcatcggatgaatttctagaggaaatctttgaggacttcctatagaatcctttgaaaattttctttgtttatcaaaggtatcctgaaccaaaatcttgaaagaattggaatccagaagaaattaaataatacctgaaggaaatcttgtgcaacataattaacaaatggcgccattaataaccaatgaaattcctgagaagttcattaaatgttgacaacacccactttcctggtcaaaatgtgaaaaggcaaaacatgttcgatcgctgtgtagagtttattcattgactgttaattttgttaccttgtcaattgtacgaaacccttaccaactctccgagattaacgcccatttctcaattatacatgagagctattagatcttccagtattgaacgagaacgctaatgattttctatgtttcttttctacattctaccttcgaaaccgaacaaccgaacaatttgccccctccttccctgttcggacccgtctctaatcctactcgttttcgtgtacccgcgccgcgctgatggaacaatacgaactgataatagcttacatgtataattggccccaacggtcaaacgatctccggctgtataagacaaattttgacaggacaaccgaagcaaaggcggctcatgcgagacaagcaagggatcctcggcgttgtccagctcccagataaaaagaaggtactacttcaatcttccttattccagttctagttcccctagctaaacatttcttccccaaaagcagcgaaaacgacgcccgaagcttaagttccatcggccaaaagctcacgcaccacaccgacgaccgggtcttctccgacggctcattcagcagcagaaacttctcggatagctcacggggaacggatccatcgaggcaccactcgcatcaggatccggccgcgcagcaacagcccggcgtacagctactcacgtcaaacgagctacaactgtgcaactccctcaacctgccggtcacccggtaccttagtctcaaaacggtactgcttggccggccggcgttggatcacggaatcagctccgtggccgagagcatggttaaaaagtatctcatcaagtcgggttggctgcaaacgagtcctcagaactgaggacccccactcttccgagtaatgctaggcttaggaaacaaattattggcgttgatctcacatctctgaaagcgaacattggtgaggctggctccgcgccggccgattggtcatactcatgcacgatagatggcacacatatttccaatatgtatttaacatatgatggttactgacgaaaaacaagaaaatccgtacggtagtagatagcttgatactgcctgctctaacgtaatattcaaattcaactagagatcaaatcatacttgttataggaaccctaattgtagacactatcttatcaattcacagtttcgccacttgtaatgagtgtacctactgtcgttttctccgacacaagtcgtagattctcctatgcaagtgggtgtgcttgattgtgacaaagtttaaagttagtctgtaaatagttcaataaattattgtcaataaattttattcacttacaaatcaaggttgcttttagttttccaatcacaattccgttttacatagtcatttatcccacaatgcgactaattttgtatcaaagaataataaaacaggcattgtcgtaatcattaagacatccaacataataccaaggcaggggaatgtttttcaacttgatgaagattattctactcgtcctacccgaggtctcagtggctcagcttgatgtacagtaaaccggccagtatcagcgcttccatcacgatgatcaatatcaagaccactttgttgtagaaaacattcctgtgcatggcccgtaggatggcactggatttggacagaccatcgttggcgttctccaagcgccgttgactgcgcagcaacgactccctttggacttccagctctgacatcacctgtaagtgcgaaattcaaaatgcgcataattcaatcaggcaattaaaggtacggatatccggggcaaaataagcaccctttgtttgttacgttcttatcaaatatttcaataaattatttaggattctgattaataataaattgatatggcggccaagagtttcaattctcgcataatttatcttctcgccctaatatcaattcaaagacaaaagtcagcaatcgagagatcttttaatttaattcaaaaaaggtaaaacggtaggccaaccctttatggctttttcggcaaggttatttggtttcagaaatcattcaaatttgcagaccatgcacccagggcgtcaaacttttgcaacattttattattaacttttattactgactgcacgtctgttttagagtctggttgaaaactagtgttctttttttaataagcttatataaatttcagtaaatatgtattgaatttaatttcctttctatctttgtatacctacgatttgagttgtatgtcatttcatctgattaggttagaaccgcaaaatctac

SEQ ID NO: 110 - DNA, 11735 bp, Aedes aegypti
acaccgacacgttaatgcttccagtggacgatttgtccttcgaaggcagcaccacactggacaatagactagcatgcaacgtccgaacacgactgatcattcctttttgcatcgctctccgcctcaagggcaagcgacacaattgatggaccaaatactacttgctattcttcggcgatattttatttcttccgttctgataactagagcctctttcttgtcattccgcttaactgtcttcgatttcgggttttccttggacgctaagttgtacccatggttgttgtggaatcgtttcggataatcccgaggcactttcttctaagtctacttggtctgagaagtgggattgaccactcgaggatcttggctcgtacccgcttccgcactctggaggatcgccgcgtaggtcgcgcccaaccgattcaaactgcaatttttgccaaaatgttgaatatgttaacaatatgtattaatccaaataacatgcccagtaatgtttgttttaaataatttatcggaatacaaaacttataatgtgattattattatttttcaggtattacataagaatccatataacgattattcgaagcaactatgtccgtcctactcctgctatgtttgcttcatgtcgtttacctgtcaacagtaacgataagtgtatccgccgaaggatcaatagcaactataacagcatcttcgttaataccatcacataatgtggttgcacaattcacgttggataacaactcatactttactcatttaacatacgacaaacataggaatctcttatatgccggagcaactaatagaatctatcaattagacgcaaatctcaaacagctcaatgaagctattacgggtcccaaactggactcgccacagtgtcatgcgggaggatgttctcctgacgaggaaactttcgagacgaataatcacaacaaaatattgatttacaacagtggaggcgatactctaatcgcctgtggaagtatacaccagggagcatgtgaaatctactatctaagcggtagatttccagattcctcgaaatatatggaagttgctctagctgcaaatgacgagacatcttccacatatgcattcatcggtccgagcaagtaccagtcgtggaagaaagaagatatactctacgtgggcaccacgttcacgaacgttggtgattataggcatgacgttcctgccatatcatccagaaaattagacgatttaaactatgcggaattctcgatacaacaatcgaacattaacattgatgtgaaatatcgtgaccattttctggtaaactatgtgtacggcttcaacagctctgagtatgcttactttgcggtggtacaaaagaaatcacatctggcggacgaagctggattcgttacccgactgacacgaatctgcgtaaatgatcccaactacgacagctatacagaggtatgtgcaagaattattgatttagattctaaagctcaaataattttcattgaaaatttttctaggtaaccatcacatgtttagtcgacggagaagattacaacattctgcgcgatgcgaaaataattcaagcgggaataaagctaagtcaagatttgggaatcaaaaaggacgattacgttctaattgccgtgttctcgccatcgaaagagataaccaacgagccgcagaacaattccgctatgtgtgtttacagtttgacagagattgaagaagtgttcaacgagaacattcactgtaagacaagtattatttcatctggggagtaactattacactttattacttttttcagcttgtttcaatggtagtatcaaagacagaaacttaggatacatctctggaacgataaacgatggcaagtgccctgtggtgggatccatcggcaacattttcagtttttgtcacgttgggctaaaaatcagcggcgtgactccaattctcgccagagctctcttcaactttccgaacgaatcggtaacctccgtcacaactactaataccggacctcatacgcttgcgttcttgggcacttccgagggatggataaaaaaggtaagtgtaatcatgttgaagtgatgagtcagggctgttacaaatgatggttttttgagattcgcgcatatgattttgttcaatgttttgaatgacaagcaatgcttcgaataagaagtgctcgaacaaaagttgttagctttcacttgaacttatcgaaatagtgaaaaatgtttttggttgtaatcaatagtgatttgattgtttaccaatagtattgaaccaacaagtagactatttgagtactctaggcatcatttgagtacttaacatcatttcaataacttgtttacagtgatcagtgggtatatttcactaaatatgcgtattagcgtttcaaactcatgtgtaaacctttgatgtcattcagaacatgacgacagataagagattctagagattttacaacccttattgcataataaagcgaaagattgttagcctgtcaactattactccctaccgacccctgtcgttatacggctgaaaagccgatcgataattgagtaggcgaagaagcaaatcgaaaatacacccagcagagaagactctgtgatctggtagaacccacacgtagttacgtaaagttaaattctacaaaccccaagcgaaacataaaaacaatgctccttaaccatgcaataaagtaactttgattttttttatagttttatgagtcaatatagagtaatggaacatcgactcaggtttaatcgtatttgcaaaatgaaaacaccaagtactgttattgatctgcaataagaattgttcattaattacgtcacgcttatacagagaggctatactcctcgattgagcgatgaacaatacattaaccctctaatacccaaccccgcctttggacggggtacaccttggaattttgtgtattttttcgtagctcggaaatcaaaatgattttatttttgccttaaaccttgactcagagaaaagttttttaagacttttgatttttttttttgtatttttgaaaattgtttgaaaaattgtattcgtatataacctggggttcatttaacgtttaatataaaaaatcgtatctcttatatttttctactatcaacctaccacagaagaagagcttggtggtatttaaataattcaaaacctgtttttccgttaattacacaaacaataaaaaataaaatcctgaaaataattaaaaatttaatatttttaaaagtaccgtaaaaacttgaaattttattattgccaaagatcagtaactagaagaggcttcaagaaaaaatgaaaaaagatagtgatgttcagaaatacaaattttaaaaaccaaaattcataaatttgcgaataaaaataaatcattgcccaaaacatgttgagaacgatttaagataactaaaaatgatatttagatcgaaaataaaaatttgggtaaggtaccgcggggcaagtgggtaaatggggtaagtgaaaataatttgtatatcttactgaatatgtgaattaacgttttaaactcatgcgtaaaactttgaggccattaagaacattacgataggtaagagatttctgagattgtttaaccattattgcaaaatagaacgaaagattgttaaccaatcaattactactccgtaacaagttggcggcgtgcaatcttattttaatattttcagcggaaaaaaaattgcggtaaataattttctgtaccacttctaagttgtcccttctgacagttttaaactacaatataaaaagttttagaattaattcaacatagaccaaaaaataactaaattgaaacaccgtcaattttctgctcacgtggggcaagtgaaaagtttctcattagagattgaatttgtgttttctctttaggtagctataagtatacaaggttcgcaattatcatagaacaacagaacgtgctgataattcaagaaacactatacatactcaaagcgttaaaagctattattatggttaactcattgaacttctctaaaaaaggttgcaaacattacgatattaatatgtctacttcggacagccgattaaaaggaagacgttgattgaaaagttcaatataagagaacgcatggaaatctcgtggaatgtttatataaagctagatcaaaacataaaaaaatgagatataggcgtatccacgtaaaaaaagtttgtaaatactttattgaaggattccgtttcatttcttccgaagagttatccgacgtcttacccgatttttttaacaaataacgagcggtgtaaactctacagagcagtaatgcaattgctgtcccatgatgttagaactaacattggaaatgttgcagttataatgttggcgaatcatttcaacaaacataaacagaagaaaattcaagtaacaacaatacaattttctttgtttacatgttacttatgttgttgttcattgggacgccttaacaaatgttaaaggtaatataaatcgtgttagtttttggatttattgttcaaaacgataaacttttcacttaccccacttgtgaagcaagtgaaaagtaaggagacgtttttcaaaaactttttctgtacttttttcttcaattttacataaaaataaatttcagcatactgcttatatttggtgggagccaagctaaaaaatatacacaacctcattttttttaattcaaagtctctaggatttgaagaatcccaactatgcgaaatccattacccacttgccccacggtaccttattagagagttaagaatacgaaaaatacgtacaaataagggagagggatagagagcgcagagttaggaacattaatgcgcagaataaggagcactgctaaaatgagtgcgcagagttaggaacacggatacccttgagaagatttaaaaatttgcaattaaaatcattacttccctggccacgatcacagggtttgacggtgccaaagtagaaggtgcaccataataatacccgtctatgaaacatatcaccttcccaatattttggcacacctccaacggttcatgatttatcgtgaaacggctgcattcaggcgggggatctgttaatatgtttcggcatattatcaggtcctcttcgaacggagggaccgccagggctcattagttacttataaaccagtgctgggtgttgatgtttcagttcgtttacatgagctgtagcatcctttgtactaatcagcaatggtggttaagtttcgaactgtgcgttacactcgtcgttattaaatttagtgattgtgaaggtgctaatagtgaaatttgaaaattaaggtggaagtgattctgatagttttgttaaaaatataataataatgatgtgaactctactaatttaataatggccataatacattgtgcaatcatttctctgaatataaacttaattgcctagttcttcaaacgtgcatgataaaagtgataataataacagcgagtgcagaaaaatggatcgaagtgattttttttaatgtaactttcttgatcatagtgctaaatcgtagtttgaatagtaatgactctacagcaacaaaaataatgatacatttgaattgaatatcttttaattacttactaatggtaacagatttatatgaaaatggtgtgatgtgaaaagtgatataatagaaagtatatctgaagtgtattacgaaagttgatgagtgataatcggtgatatacgtgatagtgtcgaaaataaaagtgacgatagtgagtgatgaaatgaaatggggaatgaggaccttttaataaaactatttcgttcttcactttaaccactctaatagcatttcaggccttatcatagtttgatagtagtctgaactactagactgcaaaactacggcaagggctgattgctgctagcgtacacagtgaccatttgagcaacatagcttaggaacgtctgtgtgatgaacgcaatagaggcttaaaagcaaatgctgggaaggagcttagggcagataaagagtgccagtactacccctaacgctaccgacaaaaaaaaaaaaaaaaaaaaaaatcattacttagtgaagcttttatattttttacttatacataagatcaataagtatttgctcccaaaatttcagagcattgtgtttagttttcaattaattacagctgtttgaaatttgaaaagccttaagtgcgcagagtacgaaaaaatgaaaattttaccatagttacagttgatgctgttaaacataccagtgttccaaataccatgcatccgaccccgactgccgacattttgaaacatctctcaattgaacgaacgaagcgcatcaaaaataaattttttgtatcaaacaacgtattgagatttgcatgattgattcgggaaatgaaatgtatgtatttcgcttcgccattttggaattataactgaaacacggtatttggaacacataaacaaccgtgccctaataccgtgtgttggcaccaggcgattacattctaacattgtttttgtttatttgtctgtgcaactttagtttgtcatgacttactaaatactccttaatgtgctaacatttgtgacaatcatttagaaaaataaataatataatatgctagaaatccacaaaatttttaaatacaccataataggcaacacacggaattagagaaggtcacggtacctatacttggagttacattgtgacaatagaaacaatgacagggttggctaatttcaattcagagtggattgagaatcttggaacgatagattctacgattcatcgaattcgatgacaatttcaaatgtcacttccccgaatgccattatttcgaacgatcactaccctaaataacgaatagtcactacccgaatggccatcattccgaaaggccactttcccgagtggtcattacccgaacacccgaatttatttgagaaaatagaccttctattttaaaatcgttttaaccttccagtcgtcgcgtggttgaccacagtcagaaccaccacgctgctgttgtgatcgaaaagcgaggtttttttcaccagtgttgtacaaaatacaacagcgcgacgactgaagtgataataaaaaacgtataatttgacgcggattctgcacatgttgacttgactttctgcgttttttttttgtttgtattgaccttactgtaacagtcctgaacaagaaacaagattattgaacagcacatcaaaccataattttctttgcagatattaatgtcaggaccgtctgctggagaatacgaacgcattgaggtggacagtggttataaaatacttccggatacaatgctttcaccgaaaaatgaatacatgtatattttgtctgaaaaaagagtaagtgttattacaatctatatgaaatgataagtttttttatgttcatctcatatcgtttcctaggttatcaaaatgaaagtcgaacattgtagtacattcaccaactgttcgagttgtttagaatctagggatccgttctgcggttggtgttctcttgaaaagcgttgtacagtccggaacacttgccaaaaagataccagcactgcaagatggttatcgattagcaccggacagcagtgtatcgattttgagatggtatcccctgataaaattcccatcaatcagatggcaacggtgcatcttattattcgaacacttcctgaattgccacataatgccaaatacaaatgtgtttttggtaattcaaccccaatcgatgctaatgtgacaaatgaagggctagtgtgtagaactcctccgatagataaacgtccccaactggctgctaatacggaccatatcctagttccactaagcgttcgaagttctgagacaaataaggattttgtatcgcgcaactttgccttttacgactgctctcgtcacgataactgtagaaaatgtctccgcagccagtggggttgcaactggtgcatttacgataacaagtgcgtgtataatacttcaacttgtcgcaattctggtaacatcgttaccaacgaaaacacgtgtccacacttcaagaaacgatccgagcccattctactgcccaacaaagttcccaaggaaataaaattggaaatcgagaatctgcccaggccacaaagtgcccatactggtttcctgtgcactgtcaatatcgaaggagctcacatggttttaccagcacgcgtggaatcaaataaatatgttgtttgtgaaaaaacaccggtaagtattcgaaatatagcatactgttacggacaatacaataagaccacttcggcataaaaagttaaactctttgatgtttttgggtttctttcttataactagcagatttttgtttcatttattttatattatttttatctacctatagattttcacacccaatttaaacttaacatgatcaaacaagccaaacagtagagatgtagcgaatacccggccggtcgaatatatttttattttgccgaatatttggtttgccgaatagataaatgcgttatttggccgaataagccgaatagttaccaaatattaccaagataaactaaactgtaataaaaaacacacgtgaagaaaatttttaaaagatgatccaacgaattttcttttttatggataaggtatccatcggtagcaatggtctgttctaacaaaacaatttgttcaacattgtaaggctatttgtattcaatcacactcctgtcaaaagggccaaaaacgaatggcggacccgtaagcagagacacttacgcggaacccgcaagggaaaatgaatctcctttcagaagtaagttcacacaaacattcgtacaatcaagcccttgcttcccagaaagacccaatagatgggaagaagagcccgcccttttttctacgaaatgttagcgatggaaagttgacagtttcactctttctatccatctcgcttcaaaagggtgcccctatggtaccacccagacccaacccaaaaatgcatataatattagaaatataatcaaatacaatgcatcatgtaaagacctcactttttttctttttgtgtaaaattttgaagctggtcgttaaaacgatgttgtcatcgttaattgtgaatcaattaatggtcgcagtggttcaaattccaacaagaaaaaactgtgaatctaagaacaagaaatattgcaacacacaaccaccacgaaaaatccagttactcatctccaacacgcctcgacaaaaacgcacaccacgtcgaaaaacggttgcatcacacccgtcttacgaagaccagatacccatccttctccccacctcacattcaacaattgttccctgattttcgattcatccaccaccaacactagaatcacaagtaaaccggcaccaccacatctatccaatcaacaaacagcgggccattcttcacatttttttctgtcttcgttctcaattagttttacatgcctaggtcaagattctcattacgttctcaagcctcaagtatactccttgcactacggccaaaactacaatcactctattcacagtctggcggatagaactatcggagccaatcgcatcggagctaaagagtgcttgaatcggcgaggaatcaataaaaaataagaagtaattcgcattacaggctcaattaccaacactttattggtattaaaacaaagcggagttcaaaaatattcggcgaagtttgatattgatgaaagttattggttgatctggaaaaatattattttgtcattgttcaaacaagaaaatcacttaaaggcctcagttaccagcgatttcagtaagattatcacggtgccagttcttgggatgtagccaaaactcgtactactatcctgttataaaatttaaaaaaatcagagagttaaacttattgtttggtcttattgtttagcccggtacttaaaagcaataattaatactgtaacatttcctttattcattttcagtattcttatgaagccaacacaaatgagtacgaagccaaggttgatgtaaactggaaccggaaccattacatagacacagtgtcaattattctttacaagtgtgatattctagggtctcacagagagcacgccgactgcagtttgtgcgtgacacgagacaagaaatatcaatgtacttggtgcaacaatcagtgtgtgtataacgaaacgtgtgcattcgatacacatttgaacgaatgtcccaagccaagaatcgatctcatcaaaccccttagtgggcccatagagggtggaacgttactcaccatagagggaagcaatttgggcattcgcgaagaggacgtgagaggtaaaattagaatcggcaatgtgccatgtgagctggtaaactatgaaatatccgtcaaaatagagtgccgcactggaccggttccggaagaaatgacggcatctattaaagttggcaatgaagcaggttacaccgaatcaagtgtgcagttccagtataaaaatgtacaattgacagggttgcaccctacgatgggaccacagagtggcggtacaaaagtttccattatcggaaagtttttgaatattggttccaaaattatggcatatttagatgactatccttgccttatcaatatcactcaagcttcgtccggtcgactaacatgcattacgtcagccgcccgctccccggagcatatacgaatcttaacattgttaatagatggagcaaaccgcacgttgaagtgcattgacgacaaccagcacaatagcctaaatcgaaacaattatcattatcacagtcattatgaaacatgtagtgtgtacaattataccgtcgacccgaaaataatgcaaattaaaccgcttaagagtttcatgagtgggggaagaatgatgacggtacacggcaccaatttagactccatacagaaacctgagatagaagtatactatgaggatgaacgaattaacaaatcgatttgcacagttctaaaccccaatcaaatggaatgtccatcgccatccgtcaaccttaaatttctctcattcctcaagcacttggagcagatgacaggaaacctgcatgcaggaaataatcaaagccgcataaaaaatcgcagaagtttaataactacagaatcttcagcttttatatcaactgcagaatcattgattagtgataactcagcgttaactgtgtccctgttctcaccaacccagtttcttccatcagaagaactgcaaacaaccgcttccttacttgaaactacaatgaacagactaagttcaccaatagcgctcaaaatgagcgaaagccagatagcattccaaataagttttgtaatggataacgtcctctccgttaaggatctcaacaaacatttccaaaatctgcgctccaccatcatttacgtagaagatcccatctattttccatttccgagtttcaaaaaactatacaaaggcgacactcttgtcatcgaaggtgaaaacttgaacattgccagtgacgagtcggacgtaaacgttacaatcggaacaatgcagtgcaacgttacgagtttggctcttacccaactggtatgtacgccaccgtcgcagcaaccgcttccaacagatgaaaacggcacggaacaaactgtccaggatttgccactagtcgtggtacgcgtcggtcaaaatcttcgctttcaaat

SEQ ID NO: 111 - DNA, 14560 bp, Aedes aegypti
  misc_feature (8822)..(10927): n is a, c, g, or t
ctagaaatcccgaaaaacgatggaattcatttttggatcttccccaagtatgaaactagtaaaaatcgaatgggtttgaaataggaataatcaatatggtactgaatcttcaaccgaaaatttccaatatttagctattatatagtgttcacataatcgctaaattttgttcaagagttatgcaaaccaattcaaaaatcaataaaattagcaaattataaaagggcctaactgaaaccatgttcaatcaaagggcctaactgaaagggcctaactggtttgaagattcataatagggcctatctgccgatgatgtttgaattcaacaattttgacgagttgttgtgttatttgagactagaaacataatgggtcacgcaacagactttaatgggtgtcgaacacaggtatgaaactagtaaaaatgcgaatgggtttaaaataggaattataaatatggtacggaatcttcaattgagaatttctcaatgtttacgttttgcagataggcccttttcaaatgttacgctagaattcttttttttttctgacgtcaacatttttttttgctgatagcgaagaaaattcgcttttcgaaaaatgaattcgtttttacggggatcaactaactatgtgtggtgtacgactagtgttctgggaaaaggagccactggagctgtgtttcagggagtcaacaagcataacggtgagccagtggccgtaaagacgttcaaccagctgagccatatgaggcctccggatgtccaaatgcgagaatttgaggtgctccgcaaggtcaaacatgataacattgttaagttgttggatatcgaagacgatcaggagggccgtgggaaggtcattgtcatggaactgtgcaccggaggaagcttgttcaacattctggatgatccggaaaacacgtacggtcttcctcagagggaattccttttggtactggaacatctctcggcgggaatgaaacatttgagggataacaacctcgttcaccgggatctgaagccaggaaatatcatgaagtatatctccgaagatggcaaaactatctacaaactgaccgattttggagcggcacgtgaactggaggaaaatcagcagtttgtatcgttgtatggaacggaggaatatctgcacccggacatgtacgaacgtgcggtccttcggaaatccatcaatcgtagcttcaccgcaaacgttgacttatggtctattggagttacactgtaccatgtggccacggggaaccttcccttccgtccctttggagggcgcaagaacaaagaaaccatgcaccacattacaaccaaaaaagcaccgggcgtcatttccggcacgcaaaccagcgaaaacggcccaatcgaatggtctcggcatttgccaccgcattgccagttgaaagcgggcctaaaattcctcgtgacacccctgctggccgggctgctcgaggaaagccagaagcgcatgtggtccttcgatcggttcttctacgaggtgcagcacatcctgaacaagaaagtgctgcacattttctacaccaaccaggccacctccatcgaagtgtacatggaccccgaggagagcttcttcaacctgaaggaacacgtcatggtgcagaccaaggtgccacacgtcgcgcagctgctgctgctggattcggaacggtttgagcagaaggtcggcgtcaacagtagcggtatgtatacctcgttgaaaaacattatgcggaataccgtgcaagcaccatatagacggcgccaaattctaaacggtttgttccatattccaaaactagtacatagcaggtttcttttcagggacttggtctctatttcaattcaaatattttatttttttttctgaatggtttctagagtccctattttaaccaaaatagtctctaaggtcgctttttcggaggtaccagtggaatctttagagactataacgcgacaatttaacgggttcttcaacaattccttatcagattcctttgagaaaaacttcagaaaatctgctagtgatttctttagggggtgttgaaaattagtcaaaaaatgctacgtcatttattgacgctgccttagggatttcttctgacatacttttagggctggttcatatatttcataacgctcaaattggtaattttggacacccacccacgccctcatgacgctttttgtattgatactctacaatttttgtatgatccgtaacaacgttaggacacccacccaccccttaaagcgttatgaaatttgtgaatgggcccttaggaactcctccagaacctccactagtgattctctctattctctaaggaattattctagcactgttactagagatgctttgtgaaattgccttagaatttgcttcatgaaatccaggagcactcttaacgcttctaccttcagtaatagggtgtctactacctgaaaaacctggaattatcaggaaattttattcaacctggaaaaaaactggaattgtcagggaatttcggacgtaatcagggaaattattttgaatcagttatacaaggtagaatatgttctttttgtggtagaaaatgttttaaatcataaaaattttcggctgcgccgctgttaagaagcgagtagaaatgttcagtccttaaattgtttaacgatttttatttatccatcataaaacatgttcagataattgcatccttatcttaattcattaactaactctaatcctaacttaaaattagaaagttggtaaagacaagtacagttcccatttacagttgggcgtcgttcatgaccatatgaaacttggttgaaaaccttctaaatttgtttacaaaaatgtttttcgactgttccataagttctggaagaaatttcaaggaatgattcaggtattttagtgattctttctggaatacctttatgaacttctcaagggatgctacctgtaattttgcagggaatactcaaattaattctctcacaaattttgtcaaaaacgtcgtagagtactgcaactcaccgatttttccagttattactttattccatagttacgatcacgccaatttttttttttttttttttttttcatttttcatatgtattctccagaatttcatcaaaatatcattgctgtggttcaaacatttgtctaataatttttcaaataacatttccaaactccatgaattcttcaaaactaaattcaaggttccacgtcaattattatactacagtcattcttacaggtatttttctaattattcataaataaatgtctcgaagaagtctctccaaatttcttgaatcagtcttgtaggacattacacagagattcgatgtttttttcagttatattagcattttatcaaaaaaatcctaagtagaatttcatcaagaatacagtagttttttcagagatcatcgtaagaattcatcgaggcatacttagaactcacacaaaaaaattctttcgaaattccacgcgggttttactcaaaatttcctcaaaaaatctgatcaaatccttgacatttcccttgagaaaattctggaaatgaatgactaggaaatttgtttgagatttctttgagaaatgaaaaaaaaaataacatgaattcctgaatgaattttgaattttggagatgctctcaacgggaatgctggagaaagtcctaggaaaattaatggaaaaaataatggatatacttcttgagaatatgagacttcctttgaaaatttcttcaacggtatttgtagggatttctgatggaatctcgaagtagtttctatggttatcgccagaaaaactccagattaagttcttggaggtaaactaaattcttggaagaatttcgtagatacttcttgaaaaatcacaaaacaaactcctgcagagatcgttggactaagatgtggaagaaatccacattaaaactagcagtaatgcttgtcataatgtcatgttttcaaaaataaatttgtagtcataaaaaatgaaatattcgccaatgattcatgtattttggaaaattcctacaaccaggaattgtttttattttaagcgaagtatgcacttcaacagaaaagtaatcgcctatctcgatgcgtgggaaatttcttgcaagaaatgctcaagaaaagcatttttctttgatcgcagtacgcagttgaaaagaaatgtcaattcaaatggagctcactgtaggaaatttcttgaccatttcttgggcagaaatttttacttttcttgagcggaacagtatacttagctttaccctggaaaaacctggacatctcagggaatttcatttctgtaaatggagtttttgaagaaattttattacggatttttatgccaatgtttgggagctgatccttaactttccttccgagaggactgtattactgtaaacatatattttgggtccgatcgggtaaaattgaatttcggctccgtctgagctttggggcgacgtaattcacaatgatgatacagtcgagtctccacaactcgatattctataactcgatatactctataattcaatggatttttctgtcccttcaaatttccatacatcgtgctctccataagtcgatatttctataactcgatatctccactagtcgatgtcacgtgagtggtatatttctctccataactcgatatatattttagagtcattcttatttgagaaaacttagtctaattcatgtttcgaggtgaatgaatacttgcaagttgtaatgaaagtttaaaaatatgaaaataatgttagtaaaaataaggcgatttttcgaccatttcgaaaaaaagtcttcgaaataatagtttgcaaaatactataaacaaaataatacacgctatgtctgaaccaaatgattataaaaatcgaatgtacatcgggttttttttctcgttggagttcagtatttgggctatattttcataatcggatggttttaaaatattccatcggagaaatttttattttttccactttttaactattttccatactaaaacttatgaaaactacgtttttcgacgcgttcaaaatcttccgattattaaaatatagaccaaatactgatctctggcaagaaaaaaattcgatgtacattcgatttttataatcgtctggttcagacataccgtgtaatattgctttcttacagaagtgatcagatatgtattggaaatacagaaatttgttccttcgattttgtgattttttgtgtcagtatattctataactcgataattctataagtcgatggtcccttgaatatcgagttatcgagagtcgactgtagttgggtgacgaactaattcgttcaaagatcggttatgttacaccggggggttcttcaaagggatttccgatcgttgtgatactcgaacagttccatttatccttctaagggacgattcaaatatgacgtccatcgtttttcgggatttctagaacccccctcccccctctgtcacgcttttaccaatcccttttacacgtactgtcacactttcgtagatcccccctcccccaaacgatggacgtcatttttgaatgacctctaagtatttttataagaattctgaccagaaggaaacatattaatactctttttttattgtttctgttcgggatgaatcattgcgaccagttttctttgatcttttctcgacaaacatttcaaaagggcacatcgacattggtaaacattggctttgcaagacgctgttgagcccaattcaacttaatcacgctcaccaacaccactatcaggtagagctaacaccaatctttctgatagtggtgttagtttgcgtgggcgagctaagaagggctcaacagcaacgtttctaaaaaaagccccccccccccctcttgggcccttttcaaatgtttgtccagttttgtggtatacccgtatcctttgtttagtgcatgccgttctactccattacttttgagaaataatgaagtagtcgtttttatacaaatatcattctctaccattttgcatagagcctctttagaaaaagataccgctatttatactgcccataaatgcataccagtcacactagcaaaacaacgcaccagagaaaaaatgcgatacaagtcgtgaacacttgtatgctgtatttaccccaattaagttgaaaaagcgatgttttcgtacccaaatttgcactaaaatggtgcaatgaactattcattacagtattacatacatttgtttataaattttctcgaataatttgttaatattcgggaaaacgcacgcgtgactgatatgcgtttatttgctcttgaatatacgagaataaacgcataacagtatcagtgcttactatgatgcatcggtctccacatgtgaattattgttgttttgacagtttaatgtccgcattcaaagtcgtggaaatgtttgcttttgattatttgaaaagttatggtacttctgatagttccgaggacgacccgttggacagtgacgcgggctctgaagacaacttcgctggcttcgacaataaggacggctgtgacggcaatgctggtagcgacggcagctttcagtttccaccgaagacgaaccctgagcattgggtaagctatttgaaatcgttggagaacactgaatatgcgacggggactgatgaaatggaatcagacgaaaaaaaacggaaaacagcttgtcaccattaaactctcaaaagcgcacccctcattcaggttctgccactaagctgcttgaatgatactgattttgaccatgcatctgtcgtatcaaattattacttctacctataagctaggtatgctgtttcgctcaagaaaagtaaaaatttctgcccaagaaatggtcaagaaatttcctacagtgagctccatttgaattgacatttcttttcaactgcgtactgcgatcaaaggaaaatgcgtttcttgagcatttcttgcaagaaatttcccacgcatcgggataggcgattacttttctgttgaagtgcatgcttcgctataaggttcaaagtcgctttttgtaactgtgaacaggtttcatcccattagacatttagattaattgaaacaagaagcttattttagatggaagaaggtttgctactccactgattcgaaatcgtttagatatcgaaagataatcactaaactgatgcagattttgaagtttctgctcccctatacttaaacgatgtcaattatgatgaaaatcattctcccaaaatttgaagtgatttggaagaaatttgtttgtgcacacgccatttgaaggaaaaggaaaaccttttgtattcagtcctctaactgctcgtaataataatctttggaaaagtgaacatactcttctcatgtgaatttttcccagctacaactttgccgtaaggttaatttgttataattgatgacaaagtctaaatcatgctgagatgatcattcaattactttcatagcaacacagcttttttgatgtagaacatagtagcctggactactttgatctattcttcccgcaaggagcaccactgttgcctgccgaacagttggtgaagcatgctacatgcaaaccaactttattattctgaataacaatttatcctgacgtccaatcgaaatgtggtcttcggcaaagttgtagctaaaaggatttcacatgagtagagtttgttcacttttccataaaatattatgacgacgagatagcgggctgaacacaaaaggctggcgtttcccatagtaatctcatatggtcgccgttaagtcagaggggaccaagtacaaaacatgagaaaattggattattctctcattagatgcaaaattactttacctccgttacactttgatcagatttgaagaatgctgtaaactgcgagagatatgtaataaatttactttggatgatcaataaaaatcgataaaagtgtgcagtcagaatggaccaagtgcttagtaccataacagtgaaaatgatcagcgcgcttaggaatgcgaggaaatgaaagacatttcaggagattagtcagatttttcgacatcgaatcattcttctacttatccatcaagagaaatttataaatattacatgattcgatgcatttgattttgattttgaccatttaccatattcggatgggtggtcaggaattgcaacaaattctgtgcagacagagcggaccaagtgttgaaaagcaataaaatgattgattactgcattttttgagtcaatttcagagtccgatataagtttacggtagttctatagtgtatgtatggcatgtcctacgatccgcttattggaccagcatattttggtcggtactcaagattttcacttggtccactctgactgaacgcatatttgaatatttctggtcttcaacgccctgaccctgcgaaaccttaattttcaatgctatcgtaataccactgattttggtatttatttaagaatttatgatactggtgtcgaagggtcttgataatctgtttatattagatatatgcacccaatttggccatgcaagcattaaatgattgttatttttcaagaaattgttcagtcagagtgaaccagctcactggacggtggtttttggttcagtcagagtggaccaagtacacatagtccatcaaaaaatcgttctattagaggtttggattatgatttttcatgattatcacttcacattatattgtttgaaagtaacataaagacgtgtaaaaatattgaaccgaaatttaaacgagtcaaaaaatacagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccacccaaacggagaatccggtgatgttgttcaacatagagaacaacaacgtgacgctgcccggggagctggaattgcccaagtttccctcgttcccgagtggtgtatccgtggagaacgatgccagtttggcccaaggttgcctgcagcgttgggcacgagtgcaaacggcgggtggagaacttctccatgctggacacgctgatgaacaaagcggtggaacaatttgctgggctgctcaagaatcagctggccaaattgtgcgagtaaggaatttcgttgaaggatacctgggccattattttgaaatgtttcaattttcttttacaggcgcgtcaaacaccaggaagatatcggtagctcaactagggagatttccgatttggttcaaatcgctgttatgaatgtaagttttacttcagatattattaacatcatcgcataaaaagattaggtaatcatttgatgttcgataactgtttatcttatctatcgtgtaatgttattctggtgagcgaaaaacacccacccacgcggaatattttttatattgtgaacgctcccttagtggaggcagtgcgtttgacttgtttcgcacttatttatgactatgatatatttttctatcatgttcgatgctagaatgataaaggcaatataattaatgttggggtagggtggtgcaagatgagtatcataagcataaaccaattgttgccgaatgtgaactttattctttatttcaaatgatacggtacaaatctatatatcatgtttcccatcatataaaatttcattgaataaacgactaaataagaaagacgattttcacttggcttgaatacgctgcggggcttgaatacgcttgcaaatgccaccgccgttccctctcgcaacaaaacgaagaatatggattcatcgatcgtaaatcgccctgctgctgtttcgtcgttgaaatgtctacctgaaacccaactgggcacaagagctgcagaccatctgagcagtacaattgtggaacagaagtctacaaacgaacgttttcggctttttgtatctagagtcaaaaactgtgtgaatgaacgagaaatttttaaattggcctccaatgctttaggcaccgatgatatagttgttaagaagttagtttcagcatggaagaactcaatttcaatgccttttatatctttcaaaatcgggatcgacattcgtcgtaaacgaatcgcacttcttccaaacacttgggcttgcgaaccactgtaatgaagagatgtatatgttgtttaaacaagcgcaatgtgtttcactaccaatttgttatttcgtatttatctaatattgttatcatgagtctgcgatagtcgttctttatctaactgtattgccgttgcttgtttgtcatattagttttaatgttattatagttatagttcaattagaccccatgatgtccgttgaattcaaaataaataaatgaataactgtggagatgcagaggtatactcggtctctagtaacaacctgggggatgcgaacagaaaatcaacaagcagccaggctgctgtcaaactaaaattttcataaaaatgatcagagtacgcctagaaatgtacggtcgtgatttcgacaccctaaaaattgttgtataatgtatgtaacacaaataccgccaactgttaaaaaaattgtgttcgatccaaattatgaataagtcttgagcaactgctcaaaatatgtttctaaccaacatacggccaggaactttctgattaagtacattcattgggtttatttcctgcattgaactgatggaactctgtgtgaagtattttaagtgtgcattttgaatgtgggttcctacgagacaaacaaacacacaacggttagcactcgtggaaaagattgttttcagtttgaactatcataatcttcgagtccgcaccccctaggtaacaacggttgtcttaactaacattccttcctttccccgatgaccgtaaggacgtggccggcgccattattaacttttaaatcttgagctctccatttgtgcacattgagaatggtaagctaatcacaagccccattcattaaatttctgtgcaacttcgattgttctggccattcacgtagtagcaactacgaattgtaggtcatctatgctcatgctcatgcccattactaaaaaaataattttgcatatacttatttgcagcacagacacagtgtgtgcttacagttttcttaccaaatagtttatcaccctcattcttgtttacggcggatccaactttcgatcggatcctattcgtttgaatccatggcccacttgattttgctggcggaagcgggaatgcaaaatggttttcgatcgaaagagcattcgaacgtaaacaagaatagggaactttacagagccaatattaattttctataattcatagaacaattatcgcaaactgtcgcattatcgaacgtttattaattcaagcttacactcaattgcagaacgagtcgtaccaggacaaagcgtcgactatccataccgagatgaactccctgaaagcagcattccaactggtttcggacccggtgcagcaactccacaatcgtttcgtcatggaggaatccctgagccgagagtggattactgcctaccgcgaacttcgtagtcctaacaaaaaccgagtcaatgaaaaagccaaatatctggtagaccggctacgtgactcttggcagcacctgctacgcgatcgtgccacgcgatccctaacccacaacgatgaacagttccatgctctcgaaaaaattaaaatcaccgaaacaggaaaacgagtcaaaacgctgctgaatgacgacgtgcgaccggctgtggaacaggaggcagaaagtttggcagactggtacaaaaaagcgcaaaccatcttcctgcagacgaagttcctgttcaaggatgtgggttcccacgaagacaccctgtacgacatccgggttcgtttggtccagatcaaagaggacttgaaagaagacatcaaaaacgatggtgaggtgtccaagattgctaatgagacaacggtcaacgagcagaacatcgaaagcatgaagagagccaaagagatgcagtgttacctaagggtgagatgtcttaatatacactcctgtgcaatagtttgggatcaccgccaaaataacatgccaaagtttttcgtccatatctctgtgattacacgtctgatagaaactctctatggctcattcgtaggaggattaattgatcttacttcgtgggtattttgatcgaaacatttttcgaattttatttatttaatttttatttacagttcacgctatgtctgaacaagacgttttttctcgttggagttcagtatttgggctatatttttatgatcggatggttttaaaatattccatcggtgaaatatttattttttccactttttagctattttccatattgaaactcatgaaaaccacgtttttcgacgcatttcaacccgtaaaaaatgtatagaaaaaatttcaccaatagaatattttaaaaccttccgattttgaaaatatagaccaaatactgatctctggcaagaaaaaatccgatgtacattcggtttt

SEQ ID NO: 112 - DNA, 20673 bp, Aedes aegypti
aaatttcataacgccgaaaatggtcattttcgatacccacccaccccctcgtaacgcattttgtatgaatgtttttcgaattttgtatgagctgtaacaacactaggacacccacccaccccctacagcgttatgaaatttgcgaataggccttttcatgtgacaggtccgtctatgcatttgtttacatcggtggaggaccggtgctaacacgggcctgtcattttcatagaagaactgtcaaagagcttccggatcagctgatttgaaacgtcatgtgaaaaggcttatgggcccttataatggaccgatgcacgagttcactattttgacgttatagcggtgccgaattcactggtttccatggtcacataaataacacggcaccgctaaaacgtcaagtaatgaacccgtgcataggtccatactgaacgcgagactcttgtttctccgtgcaccccagggatgccacgtaaatttttccaaaaccattaagattttgaaaatttgacaggagagccttacaaattatttacaaaaccttacaaattcattacaaattttatctggatcttccagatttttgtaaagcgaggcctcaaaaatctggaatattccagacaaatctgtaaggttggcaacgctggtgtttccattaatcagccgcccgaagcatggacacaaaccttcgaaacgtcatcctttcatcgattgtcgacgaataacatctgtcacctgctggcgctgatcgaaaagctgctgttttgctcgacgaagtgacgcatccgtgcaagatttagtgaaaaaggaaaccaaaagtttttcgtctggaaacaaactgcgaaattcttgtgaaaagtggttgttccgtcacggttccgagcagactgcacttggtaaaataattattgttctttgaccgaaggtgagtactgttgagcattaatcgtgcgattcgaaggcgataataattattctgtgaaatgacactttgtttatgattgaatttcgctaatcagatttcgcttctcccccgaacagaaagtccttgaacagcagttcctcgtttggtttttgttgatcccataggacagaagaagaaacgcacatcaggatgagtttcttcgggaagctattttccggaaagaaaggcgaaccggcgccaacgccaagtgaggccatccagaagctgagggacatcgagaatatgctgaccaaaaagcaggaattcctggaaaaaaagatcgaagttgaattggacactgcgcgaaagaacggaaccaaaaacaagagaggtgagtgatggggaaagttttttttacaggggggttgagtagcaaaagttcgcacttttgtttattaatgaactgattgtgcaaaatcagcgtctaggatggatgactcatgccaatgcttaaagattagggaccttagagagataacgtaaacactttttagcagtgcattgctctttatgtcagccaatttttcaatatagttagctgacgaagtctatgtttagttaataatttcgacaataaactacatattcatttaatgcagattcaccatttatttttgaataataccaccttgcattcaagaattttgagacacaaatttaagattatgcatgtttctgaaacgtgatgaatttttgcaagctatgttagcgatgcatatttttctgaaccaattagtcgatattcaaacaggtcaaattagatgattttgagccttgtaaccactagtattagaaacgcttggcagattttatcccacaatttttactcagttttaccgcagcgattcctcctaagattgctttagggattattccagcaattctttgagatttctcttcattcacattattccaagaatatctgaaaagctcaaaggaacgcttggacaaatcttctttcttcacagattggttcaagctttcttccaatacagttatacagaaatttgagaaattaaattgacgcttatattaagctgttcggtaatccaatccgcatggttattacatttattcactcattacgcgtggtaaagatggacaaattatggccgagccgagcacgtggattttttttcacaatttcacccataatttgtccatttttaccacgcgtaatgagttaatttatttgagaaattgttgaaaaataaattgtgggatattttattacaaaaatctcaaagcgtaataaaactagtgtaagtttccaattcactattcatcaataaggatttctaggaaaactcatgggtgttattcggccgaattgtaaggtttttttttgtccggatattaagtcattattgggcccaatatttgtttggccgaataattatgtttcaattatttagtattcggccgataattcggtacatctctacatgcaactcttcgagatttctgactattttcgatatactcccgaattaaaattgtttatgtttaaaaatccgaaaatcgtgcaaaactatgtgatcttggctcaaccagacattacaccaaagcaagtttatgcttaaaacaatctatttaaaatgaatttttcaaaattttattcaaattttatattaaaaactgtaaaattaaaaaatgctatttttttttgcataaagtcatataagtcacttttgccgctacgaataacaagggacatatttgcaaataacgtcttacatccttatgagcaataaaagtacagattgtagggtttttctttaaaaattatgaaattggcgcatgggacagttttgcgattatacgtatatcatatggtcggtgttcagacagcccggaccaaatgatgttttgactttctaaagatacgttaagaacttcatcagttctgattttttcgctgaaattttgatatcaaataaataggtttcattatcacagaaaataatacaaacattttggcattttgaatgcttgaggtatgtattcctgaaacctttgaaaaacacttggtccggtctgtctgaacaccgaccatatgtcaattatgcaaattgtagctcttttgaccagaaacaactttctcttccataccaaggtgcacgcaaatggtggcctttccatgtatattttcaaaacaaacaaacaaaatatataacattagtgttaagcatatttttatgtaaacacatggaaaatttgatagattgacgagtattggaaatcaaaatcaactgttcaatagtacatataaaaagaaaatattacaatttaatgaaaggcaacggaatttctatgttttttattggatttatcgcatatttttgttctgcatcggtatggtttatgtttgcaagggatgacggtgttgccaggtgattggtgacagatttttctagcattgttatatgcttgttttcggaagttctgtttgatctttcgaccttgacacttgcttttgccggggcgagcgacgagggcaggatcaaacatgtcgcgcgtcggtctcgtaagtgaaaaagtggcgtgatcgatgagttcagttgaagaaagtaaaaaagtgccgcgatcggttagttctgtttgatctttcgaccttgacacttgcttttgccggggcgagcgacgagggcaggatcaaacatgtcgcgcgttggtctagtaagtgaaaaagtggcgtgatcggtgagttcggttggagtaactgaaaaagtgccgcgatcggttagttctgtttgatccttcgaccttgacgcttgctcctgggcagtgcgtcaagaaagcccgaacagtttttttttattctttttgggtcgcgcgcttattttttttttcctgagtgcttttttatagccgagcaaacgagtgaagccgaaagtggattgtggctgctcagtcaaggataacggatcaattggtgagctcgtttcatgctactatttctaatctataaaatatgtatgactgcacattcaatcgttacaatggtgggatgtaaatatgatttttcaacaaactatggatggttcgtcactgtgagtgtcgacacaaactctgattcatgatttatttatgtttaacattttttttcagaacacctcttatatacctttatttttgtaattaaaaaaactttgaatggttcgacactacaagtgtagacttgcgaaaggttcactttattcaacaaactttggatggttcgccactgtaagtgtcggcataagaataagagtgttctatgatgtcccaaccaatcgagttttttgtttcttttcaaatgagtaaaatataataacacatgctttcgtcctgacagctgtaggaatgttacatttaggtatttgttcaacaaactttgaatggttcgtcacctcaagtgtcggcataattttcctctacatagaaattgttcatatcaaatgaaaatattatatttacgtataagcatgtatatatctcacaaatcattgtttattatggtctaatcgcttatcaaagtgaatcctatgacccaacgatcctccccattaacaaacatccctcccagtaacctttgtggagatgcagaggcaaacacggtctccaaaaagcaaaggttacacactaacattccttcccccaatcccacctgactgcaaggacgtggccggcgccgttattgaccctgtataaacagaggcactgaattatgcacactgaagaagattatggccaatcccagccgaacttctagttgattctttgtgcattttcactgacttcggtcaatcacggaatagcaaccattgatatgtgtagtcagtctaagctaagctaagctaagcataccaaggtgcacgcaaatggcttgatcttccaatttttatttatgtcccgcatctccataaattcaacgccctgtgggccgtttaatgactaatgttcgtgacaatattgtacaatataatttacgttcaccgctgttttctaaattgaactcatataattgtaaacatatgaactgcaaaaaaaaaacaagttattcaaaatatgtctggttggttaatgttacaatactaaattgctacaaagttgaatagatacattcccatataagtaaacacaaataatccataaaacttttgaatccctggatgattaattcagtccggataatcgagactcaggttaatcaaacacttgcataatcgagtccgacgtgtataacaaattttgtatttgcattgtacagtactgacccgattttgtcagcctctttctgcggggaactttttgttctaatagtttcgtaatcgatttttcatcaactcatgtcaaagtacacacttaaattattttacggattcctgtaaaatttcaacaactgaacagttcggtaaaataaattaacggagtacggtaaatttttacagtattcggtaaaaaatcaccggaatccgttaaattacgacgaagttacggtgttttatttcaccgaactgttcagctgttgagattacggtgaaattcaccgtaagagcttagtgtgtatgcacatgtcaaatatgcacaacataaggcagaaagaattatgataacttgtttacgttttaaatgggagtagaagaacggttttaaagaggggctgacaaaatctggtcctctagtgcttgaattgtttgcatttgtagaaaatggaaatttctctgaaatcagaccaaagatttctaatttttaaaatcctcgagacattacgacaaataattaaaaaattatttcaggtatttggccaaagattcagatattactctcctcaggttattaaaaattgatagatttctttagtttagagatttgcaacccgaggctagctgatctttttcaagagtttgtctaattattatttctcataggaacccgtcgagaatttttctaaggaatcgataaaagaattttgttttgcatatctcaagaatacaacctgtttttgacaaatataaccacagaaataaactcagatatcaccaggaatttctttttatatgctttcacatatttttcaagaaagacctaaatagtccgggattctatctatctaggacatcctcgaagacagtttctccaaagatgcctccagggatttcctaaaaattctccttcggaatttcattaagacattgactaggaatctctctaaggatatctccaagaattactcagggatttctttatgaattcccacagtaattctttaagatttctcaaataactctattatggtttaaccaagtatttttttaggaatttttacatagaaatgtcaatgaatcttgaaaaaaaaattatgaaaagtcaaaggaagttttagaagagtaagttaaattgtaagggtgattgaaaaaaataatcaaaattctggctaatatcctgcagcattttctgaaaaacatcggactgaatcccttgaaaaatgtgtaggattttttttggaaaagtgtggcaaaaactgcaattgtaattctttgattgtattctgtaaaaattcttagaaaatcagtcctctgatcgccattagacggggtacactttggaatttttcgtaactcggaaatcaaagcgattgtttatgtctttttgatttatttttgtatttttgaaaattgtttgaaaaattatatttttatataatctacaaatgcatggggttcatttaaggtgtaatataaaaaatcgtaacttttatatttttttacgatcaacctgtcacagaagaagagcttggtggtattaaaataatttcaaattttttgtttttccgttatttacacgaaaaataaaaaataaacagaacaacattaaaaattaaatattttcgaaagcaccgtaaaaatatttttttattattgctaaaaatcagtaactagaagaggcttcaagaaaaaatgaaaaaagataggaatgttcaaaaataaaatttataaaaatcaaaaaccaaaatccatagatttgcgaataacaataaatcattgcccaaaacgtgtttagaacgattttacgtaactgaaaattatatttagatcggaaataaaaatttgggtattagaggattaaggaactcaatgatgaatcacagggtcgaattcgacgaattctttgaagttaccgtgaatgaaataaatgaaattcttgtcgggtttcttgaaaaaaaaaaaaaaatccctgaacagttgtttttttttcaaaaactgcaaagcttcgcagtaagaatcattggaagatctcctagagtaacaactggaaaattcggatgatagattagtggtaaaaaatctggaggaagtcctaagatagtgtttgtaaaaaaatcaaggtaatccctgagcaaattactggagatagtaacgttgaagtgctcgaaaatttcctggagcgaattctggactcctgaaagcattccagatgaaatctctggagaaatcactaggataatacctgaagcttttcctcgagaaatctgagatggaatttttgaagaattagttgaaaagcctcgtggctttcactggagccagcattattttcagggtgtccatccatccgggaaatccgggaaaaacccgggaattacaaataaccgggaaaaatacgggaaatacccgggaattggaagaatacacctggaaatcatatatttcaaacattagaatactgggttgctcccatttcaagcactataagtttttcaggaggtgcacaactttttgtcaactcgtacttcgcatcatgactatcttttggtgagttgttatagagatacccaactaacattcactcatttaacaaacaccattaggctgatacaaatattaattttcttttatgtcaccccccccttcaaaaattcaaaaattttgaaggggagaaaaaaaagattcatcattttttttgacatcagttaggtttttttaatttttagagtaaaaaccaggtaaaataatgatccagatgacgattgaaaaaagttttacaacaatcgttaaaaataaatattcgaacaaaaaactttttttcatttttattttttttgttccttatttatttttatccccccccctcgtaccttccaagtgatctcggacataaaagaaaattaatatttgtatcagccttatggcagttttattcagcatcatgtttaataaccttttaataattttcatggccaacctttgttcaagcgttgttcacacaaatttggagaaactttaaagcatgtcgttgaattccaactttatttctcagcttttgaaacgttttacaagcatttggttcagcttttatatgactggtccaaaaataattaaaaacaaataaaaaaacaaaaaatatttttcttggcgcttcaaatgtagtgtacacaattatcatgatataacaaccatatttaaaaatcgcctggatactggattcgaactcgagaccttccaatcgtcagtggtatgccttgccatctgcgccatcctagaactgaagaacaaaacgtccagtgcaaaatataaacctctcatagctgaatattgatcatgtttgagcttctattcgacatcgtctaatcaacacatggtacgctaatcaacaactgaacaagcgtattattcagctgctgtttagtgctgatccaagctgagttcagtcggctatttttagcgcacagtgagaaaattaatgtcaatgatggtcaaaaataatgtttatttacacaaagtgaaatcagtctgaaatgattaaggtgaatatgcatcgaagccaaacctcaaattttcaagagcacaaatctagagaaccaggcagcgcagcggttcgagctgaaaacctaatcgattggtcacacactggtggtgaccaatcgattaagttttcagtttgaacggatgtttagttctctagatttgtgttcttgaaaatttaaggtttggtttcgatgcatcttcaccttaatctaatttcattataagttttagtttgttcaaaacttcaatttgaatgattcattaacttaaattgacatttatttattttataaattatatttgtattaattaattatattattcatttgtatttttcataaacctattatgcattaaaaaaatagtcctctgtatgaatatatttaaatcatttgaagtgttctgaggactatgcgtctaatagaaaaatgttcgaatatcttgacgcgtgggatttttttcagtaatggccaagtaaatcatttttttagatctcactattcagttgtgaagaaatgtcatttcaaatgtaactcgctatagaaatttatgtaatcaattctgtcaaaaaaaattccacttttcttgtacggaacaacatctcgagcaggctaaaaaagcttagcaatagcaaattataatatggatcgctaaaagtgatattaactggatagatataatatataaaagatctggaaatgatatctaaaattaactacgtacaaaaacaacaaacaaaattttgatgttgccttcagatcttttatgtcaatcaagtcaatatcacgctttgtttgtcagtacttcgctactactagggatacttagctcaaatgtttgtttttgtgttccaaaataatcctacatttctggaggttgaccatgtttatattcagtttttaaaaaagttttgagaaagcataagttataagcttcgaaatgcattcggaactcaacacgaatttcggatattttgtccattttatgaaatttagctatagtgtgatcgcttttacaaggcttatttattgctgaacaatgtgtttgttaatcgtcattttggcctctattggatcaactgttcttattatatactgaagctgaataaggattttataagatgcttattcagctcttattcgtacttttgttaaacatgtgcaagtagctgaagtgcgacgcaagtaaaacgttagttagtcttctgaatatccttttatacatatacatttgtttagtggaatattggctgtttaattggaggaaacatgtcttgttcagctcattagtaaaacaatattgactagtcgaatgagaatctttggaaacgtttaataagtggcgattcaacttttgttcattctaatgcataacgttgaacattgacctcagtttgtgttaaaaaagcaccttttcagctcgttatagagcaaaatttttattcagctgccattaccattattgaacaataattaaacatgcatgcttgtttgtggctttgaattgttagttgggtagtcaacgataaagatccttgaaaagctcctataaggggatataaagattcctggcaaggttcttggtaatatgcttgttagatttccatttagattcaggacaaacttttaatgtgatttttgctagaatcctcacgggaatcgtgcaaataactgaccaatttcttgtaagttctttttggcactgataagattatgactagattgatactaatgagattttaagatcattctagaatatatttatgtatcagccataaaattcttagtacatgtttaaaggttggcaaaaagctgagtcaaaaaatatatggaaaatttcttgagagatttacaaaagcagacggattacttaagaattccgttcgcggattactgaggttattgataacaccgattcttggtgaagtttttttttggaatagtttgactagttattgatttataacgaagcctaataagtgcttccaaggagattttgtatggatttctgtatttttctgtttacgatttgtttttgtagttagacacttgagaccaaaggtagtataagataaaggaataaaaggtcgatgttatcgaatgttgattgataggtcgtcgttaatgtaggagaattttgaactgtgatgtcattttattaattatgtttagtttgattaatttaatgatcattgtcattatggaaatttaaacttatcttatatgtcaaatgcctacaaacaaattaaaaaaatatatctatgaaaagttgaacctattatgtcgtactactgctctaggtctgaaggaagtcaagtgcctttactatcatatacgtcccaaaaatgaaacacacactcttgcgttctgttagttatatgacagttactaatgagtagtttcaaaataacgattttgcagcatagctgagcctttcggatcgtaagaattatgtatataaataatttgtttcaaaatttgttcgcgtggtcttccagtacccttattaggtaagaatcagtcattatcatacatactgaatgctcgccatgaccctttgtgtctaacatttgtatatgtatggacttagggtatgtgactttcctaataggtagttctttcactcattttttttttttttttttttttttttttttttttaaatttctttattagtatcattccaaacattacattcattatttcttatatctaggtgttctgtgttattagacaacactatcatcctaatttggtaaaacaaatctaagattttattaacattttgttaacaacatattacatttcatttgccgtagcagttcagattttttacaggtgagttgatttcacctgcttataagagaaaaaaaaagtttttaatatacttaacctaacttaacctaaacatataacgcattaatcgtggcaatagaagattgtaacgatttttgcctgaaattattgattattttatttcacatttgttccaatgtttcaacattggatatcctatgtaactcattggtacaataccagggaggaagcctcagaatcattttcaaaattttattttgaattctctgcagagctttcttcctggtattacaacagctagtccatattggtacagcatacaacatggctggcctgaaaatttgtttgaatatcaaaagcttgttcttaagacaaagttttgattttctattaataaggggatagagacattttacatatttattacatttggcttgaatgccctcaatgtgatttttgaaagttaaattcgtatctagcatgagtcctagatacttaacttcatctgaccaatttattggaacccctctcatcgtgacaacatgtctacttgaaggtttcaaataaagagcttttggtttatgtgggaatattattagttgagttttggaagcattaggagaaatcttccatttttgcaagtatgaagaaaaaatatccaaacttttttgcaatcgactacagatgacacgcaggcttcgtcctttggcggagaggcctgtgtcatccgcaaacaaagatttttgacatccctgaggtaactcaggtaagtcagatatgaaaatattgtataatattggtcccaaaatgctgccttggggaacaccagctcttacaggaagtctttcagatcgggagttctgataattaacctgaagtgtacgatttgacagataactttgaattattctaacaatgtatgttggaaaattaaagttttttaattttacaatcaaaccttcatgccaaacactgtcgaatgctttttctatgtctagaagagcaagaccagtagaatagccttcagatttgttggaacgaatcaaatttgttacacgtaaaagttgatgagtggtcgaatgtccatggcggaatccgaactgttcattggcaaaaattgaattttcgttgatgtgggccatcattctgttcaaaataaccttttcaaaaagtttactgatggaggaaagcaaactgattggacgataactagaagcttcagcaagatttttgtctggttttaaaattgggacaaccttagcatttttccatttgtcaggaaaatatgctaattgaaaacatttgttaaatatatcaactaaaaatgataagctactttctggaagtttcttgatgaggatgtagaaaattccatcatcgccaggagctttcatatttttgaattttttaataatagttctcacttcttccaaatcagtctcccaggcattttcgaaaacgttctcttgattgagaatattttcgaactcctgagtaacttcattttcaattggactagtaagtcctaaattaaaattgtgcgcactttcaaactgcatagcaagtttttgagctttttcgcaattagttagtaataatttgttttcctctttcaatgccggtataggcttctgaggttttttcaagattttagataatttccaaaagggcttagagccggggtccaattgagaaattttattttcaaaatttttgtttcttaaatctgcaaaacgtttcttgatttctttctgcaaatcctgccatataatttgcatagcaggatcacgagtgcgttgaaattgccttctcctcacgtttttaagacggatcaagagtttaagatcatcgtctataatcacggattcaaattttacttcacattttggaattgcaatgttcctggcttcaacaatggaatttgttaaagtttcaagagcattgtcaatatcaattttagtttctaaagaaatgttaacatcaagattagagtcaacatacgtttcatatatattccagtcggctcgtaaataattgaaagtggagctgataggattgagaatcgcttcatgcgatatttgaaatgtaacagggacatgatcagaatcaaaatcagcatgagtaactaattggctacaaagatgactagagtcggttaagaccaagtcaatcgtagatggatttctagaagaggaaaaacatgtagggctgtcagggtattgaattgagaaatatcctgaagagcactcatcaaataaaattctgccgttggaattactttgagaattattccatgaccgatgtttggcattaaagtcaccaatgacaaaaaattttgacttattgcgagtcaattttcgcaagtcagtttgaagccaattaacttgctgtccagagcattgaaaaggcaaataggcagctatgaaagtatatttaccaaactgtgtttcaacagaaacacctaaagtttcaaaaactttagtttcaaatgacgaaaacagttgatgttttatacgcctatgaatgatgattgcaactcccccacatgccccatcaagtcgatcattacgataaacaaaaaagttaggatcttttttaagtttggatccaggttttaaataagtttcggtaataactgctatatgcacgttattagctgtaagaaaattaaacagctcgtcctctttaccattcagagaacgagcattccaatttaaaatatttaaattattatttggatccattagaaaaacgtaatccaataacaatttgatttgtaaattttacacctacttggactgcttcagtcatagtggtggctttgaacattgcatcaatcattagattcaattgttcagttagaaaattaaaatcagaggcagacatatcatctgatgatttcccattggaattttcggtagacgaagaagcggggtaggagttacctgtggcggtagggttttttccatttgatttgaaacaagtagaatgggtactcatggaacgaacaggggaagagttcaaattacctgctacgatatcggcaaaggatttaccgtgggtagatacattcgaaattgaaagattcgaacggctacccgacggattaaaatttgtttgtgaatgagcatgattatgatcttcctggtgggtatgattcctaatcaagcgatcgttaactgaaaaatgagcattgttcgatactctactaggcaaattccggaaacgaccgttatcgtaacggatattatccttcatctgcttggcacgagcctcaacgactcttttgcgtgacatgcattcccaaaagttagctttgtgagggcccttgcaattggcgcattggaactttctggtatcttctttcacaggacagtcgtccttagcgtgagaagaacctccgcaaatcatgcatttagcatccatgcgacaattttttgtaccatgaccccacttttggcaccgacggcactgagtggggttctggtaatttcctccaggtttctggaaatgttcccacgtcacacggacatcgaacataagtttagctttttctaaagctttaatattatttagttcttttttgttaaagtgaactaaataatattcttgagaaagccctttccgaacaatgccagattgggttctctttttcattacttggactggggaaaatccaagtaaatcatttattccatttttgatctcttcaggtgacttatagtcacttgagagacctttcaagacaactttgaacaaacgttcagttttgtcgtcataagtaaaaaatttgtgcttcttctcttcaagatatctgagaagaagttcgcgatctttaagagtttccggcaaaacgcgacagtctcctttctttgcgatttggaaggaaaccttgattcccctaatggagttcaagatctcctgcctaaatcccccaaattcggaacaactgaccacgataggcggcactctttgcttcctcacttgaatcaaagagcctgggctagaggctgcttcgatttggtgttcggaaaatttgtctagagcatcgaactgattgctcatttcaatacaattattcatttcacccttggaagaaacttcgcattccggggaagcgtcctttcttccattcttgccacgtgtagtgacagttttaaaacccacttttttggaaggaagtagtgaattcagagattcacccttccttttgttagttgttgataccatgtttagttaataaacgagaaagacgtgaccttcgagaggttttttccctagacggtgtccaagaaggattaccaccgttagctttcgccaacgggtccaacgaaaaatcgaaggcacgggtccaaacaaggatcgtaaagggatcaatagtagaaaaaatagtactgaaaagtactgtttaagtagcactgaaaagtaccgtttttaattttagcactgaaaagtactgtttgtgtagcactgaaaagtactgttttattgctttaggtagtttttaagaaaacttccaagagcagagagaattcgtgtacgcacagcacgaaggtacgatgcgcactctctttcactcattgattatcttcaaaacttggtcaagtatagctggaaaatataattccacgcccagggaaattttactaaaaaattatacataaataatttagatcaagggcttacactttgaccatttagtatgaaataaaacaaaaaaacaaacaaagatatcaaggtgcaggatcttttaggcatccgttttttaatcttttgggcatccgggaaaaatccgggaatcgaaaaactgattttgaatggacaccctgaattttgcaccagagttcactgcaagcaagatatatgggaaaaagagacgatagagaccattttgatttaaaaataaagacttttcataccggaaaagatcctcactagatagctcaaagtgcgttttgagagtgacgagaaaaacctttgtcctttgttccatgaattacggcatcaaaaaatttccctgattgttatcgaaatttcctgaaaattctaggtttttccaggtagtagacaccctgttcgtaaatttctggatgaatggaacatcattgagattcttgaagatttattaggaagggtatttattaagcgggcaaggagatagacaagttacttaatagttctgtaaaggtaaacagtgtatttcggttttctaataagttttttaatcgaatctataacagatccttcgattatttttcttgacattcgtatcaaattcccagcaatcataaaaagccgaactaaaatatattttggaaaatttcttcggagatctaaaagattttctaaagaaattcttgtctatctatggcaaaatttgtatggatttcagcagatttgttacgagttattccagtcgttcgcttggaattacttgcgggatccttaacgagttcatgccgaaattattaatcgatgaatgaatggcgaggtcctttaggtattatttgacagatttttgtcgacatttgtccattttgctacttgtatatgataatagatcacagttttgcaacaaaaaaaaataccaattgactataatatttaatcacttagaagttttcttaaattcgtgtaagggtgtgaagcgattccattcttttggtgggtagtgtacacactatgatatatatgccgaatctcggctaattttaatcgtatttttttacagccgagtagtcggcaattaaatttcatgagatgagatttcggaaaataaaagccgagtatcagttagtcgtaattcgctgctaatcaatctggcaaattgaaagctgaatctaggttaaaaatgaaaaaaaaaatgaggtttgcacagctgagcacgtgaacgaaaacttaaatgtatagatataaatggtggtgtatagtttcttcatgtgaattttcagatataccaaccacctggtccaattttaaattcttatccaaatggcagaagatttaacaaaactctaatttataaggactcaacgaatgatatgagagattgggttttcaaagtttttagttatttgaattgccctaatgcacacattggaagcaatatgcttgagttcggaatacagtaatgacccgattttgtcagcccccgattttaacatcctttcttgcccgattttgtcagccttaaatttataattgttttaatcactatatttgttttaatactggcaattttgtgtgcacaaatttaattatgaccatggccacatgaaattttaaatttttaataattatcgaagaaactgatcaatgttaccttttgttacggtacatatactattaacaaaatcataaaactaagtccttaagttaaagtaaaacttgaaatccgtcgaaatttccctattttagctctttcccgattttgtcaaccctaaatgcagcatggggctgacaaaatcgggacattactgtacagtgaaaaaatgcattttgaacagaaaactacttttgaacatttaataaaatttatttataaaattattattcgtttccttttcagctgcacttcaggcactcaaacgaaagaagcgatatgagaaacaactgactcagatcgatggcactttgtccacgattgaaatgcaacgggaagccttggagaatgccaatacaaacacagccgtgctgaccacaatgaagaaggcatcagatgccctgaaggcggcccacaaagatatgtacgactggatcgcctatcactatttgctttcaaggttttctaactgaccttttctatatttcctacaggaatatcgacgatgtccacgagatgatggacgacatcgccgaacagaacgatattgccaacgaaatctccaacgccgtctcgtcggcggttggcttcggccaggacatcgacgacgacgagctggagaaggagctcgaagagctggaacaggaagagctggacaaggaactgctcggtgtgcagccggagacggatcaactgccggaggtgccagcaaccgatctgcctgccaaggcgaaagagaagaaaaagggtaagttattacaatgggactttacaaagtgggaaatgatcattgcttccaaaaacatcttgtgaaaaaatgtgtatttttcgcgattgattttagagaattggttgttcaacgataactgcactctttattttatttctcgacaaattttatataaacaggcttatctccaagtagtaaacgaacttacattatcgattatggattctaaaatcattaaaacagcaaggtcaacaaaaacacaaaatataaagaattctcgaaaatcgcgataatgaacttaggcttattgcgccttctctaaagaatcactaaaaaatttcattatttcacaggatgttattttgggactatatttcactttattaatttagaatatgaaagatttttggaaatattcccaccctagtaaaatttacttattactaactaatctttcctctctgtttcagctgttgcggaggatgatgatgatccggatatgaaggaactgatgtcgtgggctaactaaggtggtgaatagaacgagaaacggatcagttcgataggtgtccgtcgtatctcccccttgatacctagcgtttccttagacaagacattatccacatgcatatatctattaaaagctaagacataggtactgacaggctaggcttctatccaatgcacttaatatatgtcaacaaagggtaacccaaaaccagccgtacctacccgttgcactgcggaaaacgaacagataagattcaaattgagattgaagacttcgggaggcgatttgtctgtgtaaattttatgtataatttttccgttggtttattttcttacaatcattaaaaaaacgtttaaaattaatttatcagtgccgtaaaagattggattagtttcattcgcctcggcgagcattgtttgtgtgtcggttgtagaagtttgcccaaaaacatgtaattagttcgatcctttcagtgcagttgtgatatatgcagtactacagttgagctgttgcagagggatacccaatagtcacttacgaaaggatgtttgaagctttgagttccagaacgataatatttgacccattgtggagagtttggaaatatattttctcacgctaagttacactaatataggttcattgaaaagttgttttttgcttgaagatggcatagactgtgaagagaaagccaatcaaatactgccacgcacgagtatccttaccaaccttatgggagcatcatgcacattaatatagagcacatttcattcagcactggactatcgcagtagttgatgtgagtgcggaaacgcgaataaaactgtcttaaaagcactggttttacgtaaaccaaagaataagtgctcataagacatcagaaccagatttgaggcaatcgcgtattcgtccatccgcacttcaaaacaaaatggtatatcttaagctttgattacacagtgcgtgcaatgcacgaacatttgtgcaagttgcacgaatgtttgcgcgaactgtgtaatatgtgcacgaactactagcgaacattttgtaggaatatattcgtgtattcaaacatgttggttcgtcgaacttgcgttgtatagaaacggtagaaaattgtgtagtaggaaaggaaatcaaaatattcattcgtcctggtcagattgagaatgaaaacattggtgttggtagaaaatttccccaaggctcttccagatatttgtccaggattttttggaagattcctccatggattttactacaaaattattctagatagtctctacagtgatccatacaacaattttgacagagtttccatcacgaagaagttttgatcacaaccagatttttaaggaccggatcagacagggctccaggagcaccttcagcagatcctccagaaattctgcctggagttcctccagggatacttccagggttttctccaaggaatattccagggattcctcaagaaaaatctctacagtgattcctctagaaaattcgcaacgagttcctcaagagtagtaacatgaat

SEQ ID NO: 113 - DNA, 18311 bp, Aedes aegypti
aaacagtgcatagatatatcaaagccatatgatcagatgaaagttttggcttagaggattcgattataaaataacacagaaacattggagatttatggtcacttacagaagcttggaaaaattgctaaccgacagcacaccagagtacttcaaaacaactaactattataaaagtcaaacgaattaactgaaaggcgtcaaatttattgagttagatccaagccagacggtgggtagaacaacgatactcacgatctctacagttacgccagtattgaaaaatgcttgatggtccgaattagaacaaggtccgaattggaccaggttcccctatgttattagctgttaaaaaataaaacagctcatcctctttaccattcgaagaaagtgcattctaatttaaaatattcatgaatttatttggatcgattagagaaatcggtaatccaatgacaattttgtttgtaaatttcacaccaacttggcttggttcaaccatagtgacggctttgcacattacatcaagcatgtaaaattagccttattggtgcggtgcaatatgcccttctgcttagatgaggtttgcctcatagggtgcgtttttttttctcaaaaaaggagttcattctgctccacataaaaaacactattctggaaaaattagtacctactgaaaatctaattttccatgaatttactacaattaggataaaaactcgccaaaaactatgtatggtggatacaaatcactttaactcgtgcattgaaatcaattcatatacatatgttattcaaccgtcattttggcacctctcccttgactggtgcatttcaccccaggtccccctaggcaatagcgtgccaccctccggcccagcatggtggttttctttcggagagcagcgtgctctcgctcggagaaaatttgttcgcacaggaaaaaaaatcaatatcattccagacgtagtggcgttgggaacaaagttgctacgcaaatggagtgatatcgaaatatttttcaaacttctgagttgtattccggtcggttgcttcaatattccggttgaaacaatagattgcgcaaatccggatttgtgataatagacttcatttggattacttgtgatattggtatagtgtcgtgcaaaacttgtttaggtactcaacgtcggtctatgtagtactcgggatttttttcacagttgtttcaagtacttcatagttagcccacgtttaaattttgatatcacgccaatgtacaacgataaaaaaatgtttggctgcggtcgatatagtacgggaacccatccaaaattgtttcaattcgaggaatgaaaattttcatgaagctggttgtgatgaaagaaaaaaactatggtcgtctactcattggattttttatgttgagtatctttacaatcagaattagtgcaaaaaagatgaaaagagaaagtaatcgctaaattagagaaactattacttttttgttttgaacttataaaactctgctaaaatcaggttcaactgtttgacatagattttttcgtttgttcctgtgctatgccctcagtacattatgtaggcatcgacattccagttgaatgctgtatagcaagtgtcgtacacaaaatatacgcaatgatgggatacatttgaggcgtacgtgtttatcggtgtttcgttcgtacccataaattaccattatgcggtattttctaattcgcacattcgcaatatatactataactcattgttaaattgtacaaatctgttgtatgtgtgaaccctacatgttgctaactattgatattacgctgaaaacgcccactaaattgaaagtgtgtgtcgggtagaggtagtttttcgaatatcctgtacaggggcaaacgacgaagaccaagtggcaaatgagcatgattgattttgtgtcgtgtgcttttagtgctactggaaataaaaaggaaaactccgaagaataagtgataggtgtgatagaaaattgatacttaaaataggaatagaacgtggacaatggaaaatcaaagtttgatcgatgttggcatttaatcgcgtaaaaaagtgcaccctcaaacaataaaccagaacagtgaaaaatatctacaggaaccaacgtaaaccgaaaaaaacaatcatcatgagatgcacaggttgtattattgtactggttggcttgcttagctggacttatgttgaaggtaagcattttgaaaatcattctcgtagaaaaataaagtttacctttagtttcagttttgggattccgtataagttttacacttattgttctctggttagaaaaatattttttagccatttgccttgcagttctgacagtttacttcactttattaggggtagaccccccagtacaggacacctgagacgataactacataattccaaaattattggttctatgctatcttcatttatgaaaaatgtcataatttttgtatcgtaaaaaaatcaatttggaaatatacatacatacatacatacatacgaatttaactttgcattttggtgatgtatgattattgcgcagatgccttgctacaatagatggtggaaccaaatcatcaatcatcatcataaacaactgcggaattacgttgaaacaactcaaaattgagttgaatcgcgtctccatgcattctttgcagaaatcacaaaaatatggatgcacgtgataaatttaatggtgcaaatgaagcattttcgaacaacattgttttatgtaacgaaggaaatcagcctacatttacaacaaaaaatagacaagaagtgttggacataactatgccattgaactagatttctacaaatataaaaaaaaaactggcgtgtttcagatgatgaaacattatatgaccacaacaaacacataatgtttgagtactgggccagtggaaaaatcaaagtcacatacagaaatcctaggaatactaactgggacagatatgaatcgctgttaaaattaaacaacaatatcttaacatattgaatgacaatattgaaatatcaacacactagacaactaaacaaaatttcagaaaataagtataactggaaaaaaatattcgggcatatgatactagttgtccaatggataaatctttagaaaacttaaggaaaaaatctcggcagattttcaactgcacaaaagtttctgggcaatgggatcaatacaaaaagacttttacaacttacaacaaagaaagaagaaaatggtagaaaaacctggaggttccactatgaaaacatataaaaaattccagatatagcaaagttacagaaggttatttttaaagaccattcaaatggtctgggtaatgtagttttactgttgatacaaaaaaaaaacacttgaaataaagatgaaaactgtttttccaggatcaagtttagtattaagcctagcatcgctcaagaaaaagaagaagaaggtaaagtagagtaaactgtaggccaaaaaagactacaggcaaaaacatagatttaccggataccgtaatccggggtaacattgatcatttttctggatatttcataataactgtattggaaaatgtatatgttgtaggttttatatttttaaaacaagtgctggcacccattgttcgtgtctataaactgtatattgttttctgggagtttgaagcatgtttaaaaaaaatgttttaagtgattttcttattcagctactatggggttacattgatccatgaaaacaacgatcggtattattgaaaatatcattgcttactaaaatcatgttctctgaagctgaatataaaggccaaactcttacaagtcatttacttttaataatttcaaaatgataattatcttgaattgtggaatactcctaaagataggtaatctactaaggaaattctgcattctttattgtaatttgtgaactttgcttaactgagcatatttacgaatgtttcctcaacggaatcgttttcatcgatgttatttttagtattaactgcatttcttttgctcatatcgtttttagaactcatgtgagatatgattctttgatcgtttcacccataatcatgaaaatcattgttaccaaaagttgaaaaatttatgcatgaacacaacttaattttcgaaaaaaaatgtttattagctcatgaatagaagtaagagaataatcattcacgcattgaaaatatttcatcgatatatgttgatccgaactttttgcgaggaggctcattgcgatcaatgttaccccggaatatccaagtttagaaacaacctctattccggttgagtcgtaaggccaaacagaaaaggaagcatatgagaagatttaaattcaattctgtgcgaaaaacatgttattcaagctgtcacatgacaactgcacaggaggtcccaaacgtgaccatttgtagccctatcggaacctgtcaccgaacgtccgaaaatgatcagaacccctttattattcacttctgggtagaaaatgtacgaactgtatcagtgcatgatattttgaaaatatccattaaggcttccacccgagaccgataaacggtgaccatgccctgagcgaccaaaatagtctccaaactgaaacaggtgatacattctgtacaagtatatcaatgttacattgattttttaaagttctcaacaaggtttcttgcatttcccccatcattttcattataaaatactctaggtaccccaacacatttggacctaagaacctatcaccgaatttgaaattttcagtgcataaatcaaaaatataacttttttttttcctgaaaatatcatcaaaatcgatcgaacgattgcgaagttacagagttttgaaactctgatgtactttaatgttaagaagagcttacgaaaggatgaccgttgtaaacgaagccttagaaagaatctttttatcaaaactcaaaagtaatcattggaaaaaacaaacatcagaactaattttaggaacagtttctaaataaattcccgaataattactaatggaagcgctggagaaattgaaataatttttgttaaaaatataaaaacaaaaaaggaaaggaatagccacactaggatcaaatctaggtcaacctctgggataatagtggcgtgaaactttggataaaatcatgattttattacatgacacgattgagcctctttttgccacaaccttagcaaattttcccgctcaaataacgactacatcatatttaaggtgaagattaatcgaaaccaaacttaaaattttcaagagcacgaatctgaagaaccggacgcccatttgagctgaaaacttaatcgattggtcaccaccagcttaagcggattttcggttctccagatccgtgctcttgaaaatttgaggtttggcttcgattcatcttcaccttaaacttaaattagaaaaatgggtcgaaatttaaaccttgaatatttttaccatgtattacatcactccataggcgtattgtatcttgtatcgatcacgagcgaacgactggggcaattacaagaactttcatgccgggttatattgaggcagaggcgtgaaaattgggtaggacaggtaggacccttcaagtatttcatgatattgactcattttacaacaggatatgtttatgcgaacaaaattggaatgtatgttctagaaatcatcaaaataattgtgagaaatgtttattggcttaccgtgcacccccactaatttgaacgctacgcacatcgtgattcatttttaatttgaagttctggttatcctatgaacaacataaaatcgtacttatgattacctcgttgactgttctgattcgtttcacaacgttccttttcactccactttgttccaagacctgaaggactttgaaccacttttaatttgaacgatgtgcaaattagcggactacaaattaataagggtacagattgaatgcggtcaaaccaacaggggtaccactcttcgtacaacgtttttgtggtaaaaatatctttcttcttcttttctggcgttacgtccccactgggacagagcctgcttctcagcttagtgttcttatgagcacttccacagttattaactgagagcttactatgccaatgaccatttttgcatgcgtatatcgtgtggcaggtacgaagatactctatgccctgggaagtcgagaaaatttccaacccgaaaagatcctctaccggtgggattcgaacccacgaccctcagcttggtcttgctgaatagctgcgcgtttaccgctacggctatttgggctccctaggttccctggtaaaaatatacaaccctgaaattttaaagttaatgtgatgttccttacattttcgggtagtttcatccgacgtttttaaagagattggctttgatattttgcaagtttctctgactttgctttattgtaaaaatacagtctattagttgtggacctgggatcgaacccctcttgaaattgttacttatttcaaaggatttctttagtgcttgttcttggagtaactccaaatgactatttctaaagcttgtcttgatttctagatcatttatcagtcactttttatacgttacaaaattgatgtaaacattgatgttcgtgaaatatctgaggagtcgtccttaaaccacgtgggaatcatttattgccctgaccaaagaccacagtccatacaaattttaaaattgttatatagacaaaatggaatcccgacaaaatgaccacgtggttaatggaaagcctctgaggttttcttaactaaggaagatttttttgaacaaatttctgtaatgtaatttcatagatgttcatacgagaacatcagaaaaatgtttactaaaatttcttgaaaaaaatatttaaatacatcacacagcgtaacaaaaatggcattttcgtgtgcctcaaggatcaaattatgtgtctctggtagatttggggttgctgaatctgatgcagttctccgaaatattccagcacgtcacaatttttagctgcaggtcgtcaaagttgtatgaaataataatttcattgaagtttacataaaattcaaggtatgatgtatcaaacttttttgagatctaatccaccaagcatgcaaaatgaactttaactgtcatttcagatataatttggttgaaattgcacgattaaattgagattaaattgatggcaaataaagcaaataaattaccatacaagctggtaaacttggctacaagttggctaaaatagacaaattttgtattttcgtcagccaatatctcaaaaactagacgtgctataatattttttaaaacgggaatggattcagcaacccttagcggtattttggtgcttgagacaaaaacgtattccgctgtggatgaactacagaagcaaaaccatatcaaaatgccctaaagaagtactccataggttctatggagcacttaattgatgttttccttgaccactttttaaataactccgaaccaaacctttgccaaattccaagagcaatctctgttcagcttttaaagtaagtcttgtacgggtatcgaaattaaaaaaatgagttgattttcccctaatataggaacaatttcataattcgtaaaagccaggcttgctgccaaattccaagagcaatctctgttcagcttttaaagtaagtcttgtacgggtatcgaaattaaaaaatgaggggcccaaatgtaaagagatgcaagtgacattggttttgacgtatacatactgaaaaatcccgctgctttcaagcactctaaaagcattttcagttgattttcccctaatataggaacaatttcataattcgtaaaagccaggcttgttttttgtttggctcccgtaaaaatggtacagaacataaaattgctaaaaacttcaaagctagctttctcaacagtaggtttttttgtcattgaaaccccttttttgtgatcacctcaaatgttatttgttttagtttcaaaacatttcaataaggtccaatattttgaacctgtattgcaattgtttagcctatccactgctgtgaacgcgatcgcgtcactgcattgagaaatttgtttcacctacaatttcatagagatcttgtacatgaatgaccactggattcaaatacaattgcaagaactatgattcttatatttatgggactatattgaaaagtagatattataccccggaaaatattttagaatggtcaaccggcggtcaggaagtcaaaagagcaaggtaataatcaatttgctaatgcaatttgatgaaacttgataaccttaaaatttaaaaccaatacataccaatatttgatatatttgacatattcccggaaacctgaatttcacgagaaccataattattcaaccggcacagttcgataagagcggtaaagcccaatactctatgattaaagcgctacatagctggatactaaagggtctataagtgttccgtttgagacctatcgaaaccgatatctgaacatctctaaacagttttaccgaaaaaaaactataaaatctaccattaaagctcaaaattctttactattgcggaaaccataagagtggtttacattagtaaacttcctttagtcatagagtattgggctttcaaaccatgtaaggtcaaccttaaaatatgtaatcatctagacagatcttacagtattatatatgaattttcaaacaggaacaccgttaaaggtacgaacatgtcttcaatacgggacaacgtctacaaccaacactaacaatcagcagaatccagataattcagatgattatgacagctatgacgatcccgcagattccacagatgatggacttgtcgacaaaaataccgtatgtatcatgattatgctaatcatgtcatatattgttaatatatattatcaaatatttcttcaattctagtctactgtggtatcgtgttcacgttatgcaaccttttgctacgccttatggacaatagacgcagtgaagaacacaaccaaggttgtcgttcaaggtatgtgtttgaataagctcaagaatgttcacttgatcaatgcatttcacttttctgcgcacattcaggctgctgggaagtctcggacaaaaaggaaacgtgcatcaacaatgagtgcatcagttacaaggaaaccaaaagcggccactttttctgctgctgttcaggagacaattgcaacgggaacttcagctatgctacgaaccctatgctgaccgatagcgccaatttggcaacagatggcgattacacaccgtttgcaccgtacacttcaatctggagttcgccaacggtttacatatgctttgccatggttgggatcattttgatgttgatcattggctttctgacgtgtcggactacgacaaaggctgtttcggaacttgcgccgttggctccatccggaccgggctacagctccaatttgtacaatgtggataatttgaagcttgtgtctatgattggacagggaaagtaagtttacaaattttcattctaatgagatggtagaagcataattcactttggtcccttttcagatatggaactgtatggaaaggtatcgtaaatgagcagcacgtagcagtgaagatctttactgctcagcaaaggcagtacttcctaaatgaaaaggatatctacagcatacctttgatggaatcaccagccttgttaagctattttggtaagtgcaccatatttttttttatttaaaagctaggttacatgaaacgtttttggttgtatgcaccattttttgccacgttctcgaaaaactcttctattttaaaaatctgtgtcgattgtaatcaattgtgtcaattgaattccgaaaatattccgatattctgtgagttacataatttaaggtgaaagtgaatagaagccaaactttaaattctcaagagcacaaatctggagaactaaacagcgatttgagctggaaacttacagtcagtgacaaaagttagtaaccaaatgctgtttttccatacaaaatacccaaatttggggacctgtatctcagcttctggtagcccgaatttgctgaaatttggatgacgaactacaaatcacctgaagttttgagcatacacactaaatttcagtcattttccgaggagtttcagagggttgattaaagagaaaagcaagtaaccgagagatttttcaatttaattaaaaaaacgataagttttgtttggttagcctctgcagcaaagttgttcactttcggaagttacacaaacttgcaaaccaaccacttacagctcaccgttttttaattaaatcgaaaaatctctcgaatacttacttttctctttgaccaaccctctgatactcctcggataatgactacaatttagttaactcagtatacacttcaagttatttgtagttcgtcatccaaatttcaaccaattcaacctaccagaagctgagatacagatccccaaactttggcattttgtatggaaacagcatttggttactaacttttgtcaccgactgtaatggattggtcacacgctggccataaatcggtcaccgatcaagttttcagtttctctacatttgaacttttggaaatttgaggttagcttcgatgcaaattctccttaacggtcttttaacaacgaatccttcataaacttcttcattgattttttttctggaaggttcaaaggaatatacaaagtattcctcaaagaattcacccaatgaatcctccaagaattccttaactttcaagcattttcttcaaattattatttatccgaaataactctggattatttcaaggattgccttgttaactttaggaatcaaaataagactattagtattacttcaaacaatataaatcttctgatattaaaaccctttcctacggcatatctcaggataaatgcatcctatattatttccaaacgttggtgcatggacttaagaggatttcctacttgggttccttcagtatgaacatcagtaattactgtttcaccactagatactgctcccagatcatttaaattccttcaaatttaaagaattatctcagagatagctcgataaacctttcctaataccaactgctccagaattccttgcactaatttctgaagtaacattttatggaatccgagaagaaattttgcaaggaattcccttttctggatcctaggaccccttagatatataacatgaactcttaaggcaattgctagattgtattcctacgtcaaatattgcaaaactagtggtattaatcatatataggaaataaagacaaaatagccttcaaattactgaaatatgtctcacaaattactggatcgtagtcaaggaataagtattgaaaactaaaaacaaaataaattttcaaaatatctcttcttgaggtatctataatttttaggagagattcttgaaaaaccctcaacgattgaagttgaaaatactctggaaaaaatactcctacaggaattgctatacgaatgctaagatctaatgctttgagtgattactggaagaattcgaaaaggtacaacttgaaaaatattcaagagacaatcctttagaattttatgtcaatttgctgaaaagaatacctgaaaaaaaattcatgaataaaagtctgaaataatgccataaatccttccatgaatcctttatccttataaaaaatatattttaggaatccttgtaaaaatgttaagtaaaattgataagaaaactccagagcctaaataagtagaatttgaaaaaaaaaatcattggagattcttcggaatcatttgggaacatttttgtgagccacaaattccacctcaaaaaaaattttgagggagctttctggaaataaatcgttagaagcatttttggaggaattcatggagtagagcaaaaaagaatcccacgagaaattgaactaaaccaaagaattacttaatacattaatgaatgtttgccctttacttcatgtataaaccagatttgcttgtatgtctgaaacatagtttcttgggaacttgtaatcagaagacacagtgtgtttgtttgagaaattgagacatgaatttgcgaaaagatacgcgttctagtgagactcgaactcacgactccgtgtacgctagaccggcgctttaaccaactaagctacagaacaccttatgattctgcggaatagaaagccaaactgaatccgagtactaactataaacacatctcttctcgcaaatccatgtctctttcggacttagatgcctaacccccaacacgctcacgtttgtatctcccaatcgcaagtgagagcgaattgtttatggatactgagttcttacgctctacagccagtgttgatagactcacactcaaatctcaatcaatacgctctcccgtgagagcaaactcattatagatctgctttgcaaatctcacgcttgagattttgatgcaaaatcaactcaatcaactcaaaccgtaaaaaatgattcagtcgcaaaacccggcaaaaactcgtgaaacccgaatgttgttgtttccgttagaaaggattaacacaattttaccagactaacaagaaattaatgccgtgtgtgagtaaactgtggaaatacgagacaatgagttaaaaaggtgagccaactcatccatgattttttgactgctgagttgcatgattgacatctcacgcatgaaaaatgtcaagcgtgagttgtgggaaattgagtttttcacaacactgtctacagccgcatacctataagccgaatacttgccggcacgaaattcagctctacgaccaactgcgccaggaggacgcaactcgggatacattaaggggacacgatccgtcattgatttcggaattttcaaaagcagtttttcgatcaaaatcacgaaaatttacaggaaaatgtgttcactgtattctattctccaaccgaaacacagtgaacacattttcatggaacaatttttatttttgaacagaaaaactgcttttgaagtttcgatgatgacgatgattgcgatgacggagcgttgatcgttaatgaatgttaatgttaaagcgccggtctagcgtacacggagtcgtgagttcgagtctcactataacgcgtattttttcgcaaattcatggctcaaatcgtcaaacaaacacactgtgtcttctgattacaagttcccaaaaaactaattactcaattcgtctttgtaaaaatatgtttttttttctactaattttttggatactttctataaattaaaattaacctttacagtactgggtgccgacatcgaagtttctgtaacttcgtaatcgtttgatcgattttgataaaattatcagagaatatcataaatgaatcatatttttgattcatgcatcaaaaatttcaatttggttatggttttagatttaggtccaaatttgttggggtacctagggtgatcggcacccagtactgtaaaggttaaaacaaatttcggttataaatactagacaagttcaggagtaaatttctgaaaaacttttccaaagaatatgtaaaaacagccattacggtaattataaatgaacacttgaaggaatctttattgcatacattatttgataaattcgtgcacacacaatttgataaattcataaagtaattttctcgtttttttattattttggctagcaaattcattcatgaaattgaagatattttttgtgcggttaacaaataaattccgtgtgatatttttgggaaaaaaattataacttcatttcattcttggagaattcatttcttgcagaacctttatgcagttctcgagaaaatataaatattaacagccatagtgatgtcagaaacataaattatcaatgctgaaacaagtattgacggattccatgtcaaatcggtcagtcacagaactcgaccatcttcgatttggattaaattttgcacatgtttttggtatggtagaataagtgtttgccatggaaaaattgatcattttgacccaagtgtaacttttgaaaatggcctataaatttttgcatgcaacttatttgaaaaattctaactccgaaactgttgattttagagaaaaatgttctatgaagaagttgtagtgaatcgtttggactataagaaaaaaatatacactgaaaaaatattttatttattttcatagaaaaatcaaaaaataaaacttgaattttaaattatacaaaaaccccattttcaatattttttaaattttcaccatagaatcttgatagtaaaaaaatgtttgggacaaagtttcatgatggagaaatttttaataaaaaagtttttctaagaacaacttttggtcaattttcaaaattttgatattttgtcaaaataaatacgttttgatgatacagtaagcatcttgagttcttgactgaccgatttgacatggaatccgtctattgtaacattcttagctattatttggaggttgatacaagttatctgacaaaatgaaattttggatgcccttttatggagaaaactgatacttctcgttatatgtcttcatgctgtaggatagagaatcaataaaagttacttcaagaacaaaaaatttttttttttaatttggcggagttattagcaggatcaatgaagagaaatcgctcaaatcttttacgccatcatgcaggaacattgttgatctgagatttttcaaccgagaaatagagccgctatagggcttttccgagactagtattttattcgtaatcattgaaaataaaagaagttgtccaacaattgtcctgtaggttgtaaaaattggctaaatacggcgtgaactaaacgattgttgaagcttcggatgttacattattaactgttaagaacctcgatatatcttactagtatttttgacaaatatctcgtcagcctgctgcatgtttatcagtaaaagtgagaaaattatgttttcttgaaactctcaataaacctcgataagaaagtcacaacttagaataatggaattgttaatacaacctactgctccgctgtttgcaggttgcagtaaggaaagccattttttattgctgtgttgggggtaggggtggcacgattatgtccacgcggttcggaaaatatgaaatggtgcaaaactaaatagtaattacaatattaataattttttggcctaacaaaatgagtttgagcaaagttaatgcaatatttttccaattcaacaggttgtgacgagcgtagaacaatggacgaccggattgaatacctgttggtgctgtcattggcccccttgggatgtttgcaagactggttaaccgataataggatgccttttggagtattttgtcgaatggggaagtcggtcgctaacggacttgcacatctacacactgaaattcgcaaaggagatataatcaaaccatgtgtatgtcaccgtgatctcaactccaggaacatattagtgaaggctgatttgtcatgctgcatctgcgatttgggttttgctctgaagacctttggacctcgttatgaatgtcgcggagagattgctcttgctgaaacaaaaagtatcaacgaagttggtacattacggtacatggcaccagaagtgctagaaggcgcggtcaatctgagagattgtgagtctgctctgaagcaaatagatgtctattcactgggattagtgttatgggaattggcaacgagatgtgaagatttttactcagatgaaactgctgttccagaatataaagctccttatgaagaggagatcggtacgaatcctagcttcgaacaaatgcaggttctggtgtccagaaataagaccagaccaagattcccgataaactatgagaaaagcgttgccgctaaagtaataaaagacacttgcgaagactgctgggatcatgatgcggaagctcgtctaactgcactatgtgttcaggaacgaattcaggaaatcaccacaatgaatccaaaagctcagctgcacaaagggcaaactcctccacttagcacaaacaacttgatcatcacaacaccttccgcacacagtaagatcagcccaacagcagtatcttttatgactcctcctaatcaacaaatcattccacacacaaaccattatagtgataccagtaacggtttaacaaattaccctaaaacaatgaatgcatccgtggatgctcggcaaaaaattataacaaatggcctacaaagactcagcatcaacggtgcctacataccagatgttgaagataaattcaaatctctgaccaatgatcatccaccggacgtaacgttcagcaatcctcgtggcctaccgaaactagacaacagcgaaactcaacgcaaaatacgaggtttgaacagcgtgaaagctatgcttcaaaaaacatttcacaaaccccagtccatggcgcagcaagactgcgacgataaatcaaatctagtcattaactccctcacctatgcagtaaacgtaaaaaatttcccatccgaactagtcaatacaaactcaaaaagtcaccatattgatatgataaactcagcagataatgatattgaaaagcgtattatcgaacgccctaccaatcttgatctttcctctggtagcggtcgttatgagcataaccttatacgttccgctaacgagagcttcaaatccaagaactttgctgatgacttcacaagccagtcgttcacaatgatccaatcgaactctcccaaccccaaactgcgcattgtggtctccaagtcggcaaatgcagtgaagaatctcaattccagcagaaccagcttgagtgatcgcggtccagatgatagtaagttcatgaaacgtcagcgatcattggaagtatttcacgaagtttttggaccgaaaggcagcatcgaaagattgcgcaatccgagtcaaagggtgaaaactccaggagatgttcccccatcggtaaggaaagttcgagcatccaaaacgctctcactgtatgacgatcgcatgatggacacaagtaaactagccaactccgtatagcacgaggaggtgcttctgcttgaactgtgaaaatggtgggcagtgaggacttaaaatcgcctggaaaaatataggggcaaataacgtaaacaggagaatctcacatgagtcgatagtgaataaacattatgtagattttgtttgtcttttatattccttgaaaactttgaacaaaataaattctaagagttataaacacgatatttgtgtggctagtcattaggttcggagttattccacttaggaagtaaaatacaaaatctcaaccttcgtcacgtagagaaaagacaagatctctgagttgagcatggtaatgttgtagaatgaagaaaaggtgtatgcaattttacccaatggaaaagacttactcgtagacaagaattaggatatcttgataaaaacgcactatactctgacagtgagaacgtattgaacgataattattactcgaagaaaataaaacactgaagtattacacagaaaagggctaagatgtttctacaattgagaaaattcctgaacaaatctgtatcgcacccaatcagccttttttttcctcttttttaaatttgtcgaaacttgagtaaacatgtgtttttagcctaaacttaagcgtttggcactaaaattgggacagagctttatgaccctattggtctgaaattacttggtagttttaagaattatttcccgtgtagagtaccgtgatgaatcaatacccggacgctgaagacgacacatatgttcaaactcttatttaattatgttttattggtatattcttaaaattttgttgcccaacacatttttacaaatcagattttcataaaagtgatgaaatatccagtattagtcataatttttaaaagaaaagtaataaaatgttggtgcttaccttgtctttaaatccggacaccggatgcaaaagatgtttttaaatccggacatctgtgttaaaacatgatatatttgaatatcgcttgaaaaaatcatgtcaagcttaaatcaatatcactctttaaccaaatcgatgtatgtattacccttacagtgtttcatatcatagcatttaagtaataataatgttttggttacttgaaccggaacccgtgcagttcttactggagtacatgcagcttgagtgtcaattgcaaaagatatacaagatctatcttgtattatatcgtattctgataatgc

SEQ ID NO: 114 - DNA, 11233 bp, Aedes aegypti
cactcacaatcacccagtttgggttgtttttcttcgagcatcgcacatcaagtccatgatgatgaacttggtggttaaaatttaaaagacagacgggtctaaaattcagtcagtttgctgacgctgtaggaaagagtattgatttttcattaccaatgttcaaatcattgaaacattatagaatttgagcaaaattgtagctgtatacagtcaaattcggtcttaaggtattttacaaaaataactatgccgatgtgagccaacctgccgtcagtcaccgaagcaagagagtaaaaccaaaagagccctcccgaacgctcccagaacaacccaagtgggtgtgaacgctctcgtttcggtctgttggctggctggcggtgacgggcactcactcactcactcgctcgctcactcgccgtcgtcattccgctgtgttgttttgcgttggaaaccagctgaatcgataatccaaacaaaagtgcgagtctagtcataaggatgtgctgttttccgtgaaaatcgtcgaaaagtcgggaaaatttccatccgaaccagtgtttccggtgcaaagtggtgccaatccggccagattgaggaacgatgaatcgcagcgccaagttgaagagcgtcgcggtaagttgattttcgggcagccttgagactccacaaagtctatgggcaggcaaacatcgcttatatcgtctatgagtctatggtgaaaaaatgagagaagcagatattttcacagagatgacgagcacgcagaagatgataatagtattagataaatattagcgagccgatacgacaaacagaaattgcacaacttcttttttttttcgggggctacgtgcatcatcatcatgagtgattacatcgatggtttgctcactttgcgcatccgagaggtgtagaaacggggacccaatcgactggaacgtgtggtgcaccatatacaatatacctacatccaaatgcaatgaaaagctggaaaatgaaagtgaatcgtttacagcaggtgcctattaacctgcgcgatggctatcgaagaggatgtcattatcaattttcgaggctaattgtaggggaatgtagagcatgacaaatcgtagggaacattagtgtcaacttggtatagacttcaaaccaaaggcgataaatgttgttaggaaccaggcgaccaaagcaataaaccgcaaacgatgtgctaacccaagcctcccctacttgataggggaaaaactcgtcttcaacgcttttctcctttttataatcagatgacttcatgccgcgattttcttttcgcatttcctgcttcatatacatcgcacagtggcgcttggccggataaaatctcaaaaactaacagttatcgtaaaaataaagtacccacttgctaataaattctcatagtgagtcactaaaacttggtccctaagaagtcactatgtgtaacataaaatcactttttaattgtcactaaatcactgttttcgtgatctgatgataaagaaattaaaggctgggtcaactttgacgtgatttcttaatctaattgtgaagaaaaatagggattcaggtaaatatttcgagaaatttcaaaatgtgattgtttttctgaagactattctgacaaaactttggaaacgtctttgggctaaagtttctggttaagatatttgaataaattttgacaaaaaaccaggaccaatatttgatagatctaatgaatggattgctagtatcttcaactataggaggaattttaaaactcttctgaaagaacctcaaggtaaacatgttaggaataacaaccaaagaaattcaaagtgttaatcagcgagtcatccagtaaatccaaaattacgaatcattttgaaaatttcactagaaattattactattgctacatttttttagctaatctcaatcctgttttcttattagtttgatctactactgctagtagtagaaaaacacgtttctaaaatgaaagcttgaacaaacattgttgaccaatgattgtcaatcaatagtggaaactccccaacctcagaccatgaatttcagatgcaatagaatcgcataaaaaatgatagaatgaccaattccaatcagccaaaagactttcgcctttttaacggttttcgcttgggatccaaaactataatgtattctacgtgctgtatataaaaaaaatacgaaacaataaattttgtgtaatttaaggtcaatgcccggtaatttaagcgtccgggcgattggaaacaagatgatataccgtattaagcatcttctgaaatatatcaacgttcaaccactgaaaatttttcttctaaatatttcacaaatttggccaaaaatgattcaagtaccttcaatgaattttggccagtaaactcttcattagcattagcattagcattaagcaattcgcacaaattcgtaggtggtaccgtcctaaaccgttgtatgagcatgagggttgcctccttcccgtccgttaccaaagtcaaagatttgggactaacccttaactcttagacaagattgacgcatcctccaacagttgagagctcttgcgaatgctgaggaatgggaaggaatgattaattgaacacctacttaagaaagatgcagacaattctacgacctctcataggtgttacgggatattttggaatgttaatgggatgggaaaagccataggatacgtttggcagacgttctagcacctatgaataatattttggcattgtttcatattggaacaaactcaccggattctgcatttgcaatctctctgtaattcgacgttcaatcgaccgtccaaataaaatttctacactcagggtggtgtaaacctgtgtaaacgatcctgatggcttcggtcaccatagcaaaacacgcatgcttgggcttccgaattgcactccgcaatttgacatacaatcacttaagaacaaaataaaacattcgcgacaaaaaaatgctgccgtagggtgccggtgccattagtggactacctaagctgtaaaaaatcataacaaaataacgaaaagccttaacagagatcttctggcgtcaacagatagatttcaacctctgctatatggaaaaaatataaagagtgataaaaacaattttttaacataaaatcgcttgagccactattggtacacgtgttccagtagttgcgctagtgctccagtagtagacgttcgggaatgatacaacgaattttaaacaaaataataaatttttacataggtttaacatttttccctcgtaacagcaattaatatctttcaaatgaagcataaagatcatctctggggcttttcttcatttttatacatccatttttaaaactacttccatccgttgatccactactggaacacgacggcaactactggtgcaagggagcaaattttttgcataaacttaattatttatatgactttttgataaaataaaaagctgaaattaggcaaatcgactaaactagagacgatctatccaccaaaaatagcacatgtcgtttttattgaaaaatgttaattttattccatagtccaatctacagttacattacaaccattggtaccggcaccctagttacttttgaactcaagtttggccagtaaactcttcatgcacatgaattattataaaaaattctatcacgagtctttttttcctgagtatcataaattttataagcttaagatttgatatagtagtatagcgtactagataagtaaaagatgaggagtaaaaactccaatgcgtcattgtgactcactaccgccgtaccttatgttttatcgtatttgcggctaatcaaacgagtggaagttttagcaaccatcgaaaattcaggcattgcatatacttttgcaattggattagggtcgatgtaccaatatccccatagctataaacaaatatttgtataaaatctaaaaataaagccgaataattttgtatttattttatcttgtgcctatagtagcaccttttccaatttctgctcctgtcgtgtcgaatccgattggtacatgaagggagcacagcgagcgaggtgacttgatcaggtacaaaaagatctggagagcgtgggccaaaatcgaagttggagggatacaaccatagaccgagtaaattggcgtaacatcgttaacgaggttttatcaaactaattgatgtaacaccaagtaaataaataataataagttgtgctacacaaagcagaccaaaggccacaaaaagactgttgtgcttagcgaagtaattggagaaggatccaactctgttcgaggcgttcgacaaaaagcttcatgaatatgaagaaaaaggctacgctaggaaaatgcaaccgtcaaagatcgacgacagtcatccccgttcatggtatcttccaacattttccgtcaggaacccaaagaagccaaacaagctgcgcatagtgtgggacgctgccgcaaaggtcaatggagtttcggacttagcagtgatagatgtcgctggttcaaccatgagtactgtgtactgtgggggattgttgcacccctggtcacaacgaaccgactccaactattcccagtgtagtaaccgatctgtcaaaaccttattaccaatgacactcacactatgctatcaaaatgtattacactttcgtctcacttcgacgtatacttttttattacctgtcagaaatcattagttggcaagattataagattataagaggatgagatttgtttcttatgttaaaattaaatcaatccatgattgtgaactcatttatttttctcggtagctttaacaaatcatttaactgaattcgaacgttcgatcatttcctaagctaaagtatatgaagtacggacaggtaaattgtaatatgcttatgctaacacttcagtcgtcgcgctgttgtatttgtacaacagtggtgaaaaaacctcgcttatcgtacacagcatcagcgagagagttctgacgactgaagggctaatatcgtgaacctaatgatagcctatacaattacagcattcacgtgcgaaatcaataatatgaaaataattattatatactctagagacacaaaacgtaagtaaactaaacaaagaatttaagataactattctgacgctaatgttgaactaaaatcatctactaggaaattttaacctaccctgtacacaaaagttgctaaggtccaataaaggttataaatacggaaaagtctctatagagttactcattgcaatcgtaacaggaacaataggtttactataggtgcaagggagcttaaattttaagcaaaactatttacaatcatcagctagcaagttaacttagtaaacgttgaacaattgtaacgcaaccgacttgagcccaatattaagactggcccaattcagtacgggccaaaacaaagttgtagaataccacggttccatgagctggcgcatttgaattgaattgaagagaggattaattcatcccacgacattgatcgactatttctagacgaaaaaaaaaagatttttatataaagtgcttgaacaaacattgttgtaaatcagctttttttcaaaatcattaaaaataattgattgttttttcaatagtatatagattgttggctcttcgattgatctgataagtatgggatcatattctagtaagtattgcatagtatccatctggttcggattgtttcaagtttgtcgataatccatggagctctggagctaccattggaattgtatcgattgcaatcaattgagcggctcaatttgagccaagaaaaactacttgatgccattaagcttcattggcaaatttagtcctaaaaatgtgtttaaatcttcctttataattctggtaagtttttaaatctctgcctgactaatttgacaaacgattcagcgatcaattatcattttcaatcaatttgggacatttgaggttttgtccgaccattgcatggaggcgcgccactgtacatctatctctctgtgctttacattaaatcattttttttttcttttccaaacaggccgctaaaaacgagtgcgtacaggtggtggtacgctgtcggccgctcaacaacaaggaacaggcgggcaacttccagcgggtggtcgatgtctttccgagccggggcgttatcgagatactgaactgcaatgaaacgtcgcgggaaaataagaagatgttcacctacgatgcggtgtacgactgggggtaagattttatcactccttaattttatcatgcttcattataccacgcacgatttcaacacggttctctttgagattatatcacaccacggtaaatgtatgggtttcataaattttacatttaataattattctaaaacaaccaatatttttcctcttatctgttttttatttaattcattcattttcttctttattgtgcttattctacgaggcgtgtaaggcgagacgagttgagtgaggtgacaattgtagactcgctcccatttgatttacattatatgcctcacgtcacccaagattaaaacgactcgtattgactcacacgccgagcagaataagcacatatataagacagaacttaataacaattgcgtagcaagaaaaaaaattcactacacaattttgggcagtgatgtaggtactcaggaagtccatttcaaaatcattcaattgaatattattgcacgtccttggataaattttctaaggaatgattagatacatttttggaaacatcaccggagttccaaaatgaggagtagggaaatttattgttattattcaatatgttcctaaagttatccttgtcctcgaataaacaatttgatactatgaaagaaatgcttggataatatcaatttttggtaataagggtatgtggaataaatattgcaacatattttttatttatttccttaaatttgagaaaaattgctgtgtgaacgatctattgcaagggaccgtcgtaatagggaaaagtcgttataaataacggttatgacattaacatatttttcaagggaccaaaaaatgtcgctatagagagcttttgtcgctataaaagttgtcgttataacgagtttccactgtatatagattactcaaaagagagctccagattttttcagtgatttttcaagagattccctcagaaaatcatcatcgttttctccaacaattatcccagagatagtttagaaattcttcgagagatgcctaaaaggattcttttccatttgtgttacaaggaaatccttcagcagtccaacgttaatacctcttgtcatttgaagagggattgctccgaaaataaatccaggggtacatggatttcctctacagatccttccgatgaagccttccttagccgagtggttagagtccacggctacaaagcaaagctatgctgaaggtgtctgggttcgaatcccggtcggtccacgatcttttcgtaatggaaatttccttgacttccctgggcatagagtatcatcgtacctgccacacgatatacgaatgcgaaaatggcaactttggcaaagaaagctctcagttaataactgtggaagtgctcataagaacactatgctgaaaagcaggctctgtcccagtcaggacgtaaatgccaagaagaaagaacaacttcgtacatagtatcctcaagttccatcagcaggctattcaaaagatatttcaagttatttctcaagtaaactttccatggactctttgaatggttaatgtaggatttccccaaggtaatggaacagcaagtatttttataatactttcgattattccaaagaattcgcacaaactttccaaggattcttccaacatatccggcaggatggtatgtagggtttcgtttgaattttttccaataataatttgtttagagaatccgtcaagaactctctcatggcttcgaaatttattcagagattcttgcaggagtttataatatgtttctcaagcatgtgaatcaaagaacattttaaaatggctttcaggaatatctctagaggaattcctgaacaggtttgaacgaaaatctcgagagaattcctctgaaaacccggaatagagtcattgggtgaattccttaagacatcttcggagcaatcgctgaagcaaactttgcaaacagtcaggcattgagcttgccatgctgcgtgggatcaatacttatcttagtttcgcattttataatcaatatacacataattctcctctcattccaggtccacccagcaacaggtgtatgatgaggttgttcgtccgctggtctactcggtgctggaaggattcaatgggtgcgtctttgcctatggccagaccggcaccggtaaaacacacactatggagggcatcaagagtgatcccgaacaacgaggtatcatcccacgtgcgttcgagcaaatctgggcccacatcaaccgttcgcagaacatgaactttttagtggccgtttcctatctcgaaatctacatggaagagttgcgagatttgctgaagcccaattcgaccacgcctttggaactacgggaacgcgatgggggtatcgtggttccgaatctacactcagtgctctgcaagagcgtagaggacatgatccatgttatgtacatgggaaacaaaaatcgcacggtaggattcacaaacatgaacgagcacagttccagatcgcatgcaattttcctgatcaaaatcgaaatgtgcgaagtaggttcaactctagtcaaggtgggaaagttgaacctgatcgatttggctggtagcgagcgtcaatcgaagactggagccacggcagagagattgaaagaggctagtaagataaatcgggctctgtcgtcgctgggaaatgtgatctccgctttggcggaaaagtcacctcacattccgtatcgtgattctaagttgactcgtctattgcaagactccttgggtggcaattccaaaactatcatgatagcaaatattggcccttcagaatttaactataatgaaactttgaccacacttagatatgcaaatcgggccaagactattgagaacaagccgattatgaacgaggatccacaggatacaaaattgcgcgagtatcaggaggaaattgcccgtttacggcagcttataactgaacgtcaaacccgagagaaatccgttccaaaggttaggaaggtgaaacaaaagactattaagcgagatgaaagtttggaagagtcggatgagaagtctgattccgaagcagaagaggaggaggacgagaaggagaatgagcaggacttcagtgaactggacgccaaagcgcaggaagctttgttgaaggaacgagagttgactgcttccctagcaggaaaattgcaggagctagagaatcagttggtgaagggtggtaagaatattttggatacttataccgaacgtcagattgaactggagaaaaaaatggctgaaattgccgagcgtaagaagcgggagattgagatgcaacagcagctggaactgcatgaggaatctactatggaaattcgagagaccttcacttctctgcaacaggaggtagagctgaaaacacgcaagttgaagaaatgctacacaaagtgtatggccttgaagcaggaattgcaggacactagggacgagcacaaccgagatcgacgcgagctagaaatgactcaaaatgaactgattaaggagctgaagcgtttgctgttgataattgacaattttgtcccggcagaggtcaagtcgcgattgtatacacaggccaagtatgatgacgaagcagaggaatggtatctcaatagcaatatgatcttgagtaaccaccaaatggtgccacgaccggtggccgacgtgaacaggaggcgaccgatgtccgagtatgctttgcatatgattaaatccaatgcatcggatgctgtgcgttataaggtgagctataattgattcattttataacactcgttttgaaataggggagagttcagttcctataggacagcctatatgtccggacattagaaacaaatattctaataagccggacatcaaaattaaattatactattggattctgatacagtatcgctatcgtatacattttgcctaacgaattatctcttttcttgtagggcgagaacattttgaactacgaattggacatgccccttcgtacaacctacgagtactccaatccgaaggtttcggcgtccctgcaggcggtcctggctgaagccatgcaaaccgaggacgacattgatattaccgaccagtccaactatgctagcatgatgaaacaacgactggataggatcacccgtcgtaacgttggagctgaaggatcttccggaagtggcagcagcgcaggcactaccacgtccaacggtattcctcccagcagtagtagcagtagtggtggtgcagtaggaatcggtgccagccgtgcccgatcgtcaatttacaaccgcggaatgtcggcagcgcccacgtttggagcgcattccgggtcgacaacggcgaaaaaagcaccgccggccagtgcagctacctttccgaaggcgcgtggtttaataccgaagtagatccagcgccaaggtgaaactgaagtactcatttgatatttctacccccttctagttatcctcctctcttaatcatcataatcctcagcacagcacacacacaacaagcatatgctcatcgataattaatttaaaaagtgttgaatgttaggttcgattagttttcggttgcatttttcggcagaattacgagatttgattttccgggcttgaatgtaggaaaagtttcacacgcgtgcgcttaacaaaattggcttgataggcaacaacactcacggagaagatattggttagacgaacggtaacggtgtgtggattggacacagcaaatattgacgagttatcgaggtaatgtaaagacgaatggtacggttgactacggtaggatgaacaaaagataaaatatcgttaggcttagtaggaaaagtgctgtaggcacacggtgtctgtctatatcgttttcacggtttttcggttctagttgtcgatagatttcaactatctctcgtaatgtaaatagggtgtattttttcggttgttacatttttttatattttttttttttttttttagttttagctaacgagtctgtttacgttg

SEQ ID NO: 115 - DNA, 69926 bp, Aedes aegypti
  misc_feature (34731)..(35289): n is a, c, g, or t
  misc_feature (49869)..(49968): n is a, c, g, or t
  misc_feature (53246)..(55085): n is a, c, g, or t
caagaacaattaagtcgactggctgtgtccgacttttttttctcggggtttcctcccattttgggcgtcgttacatgaccatcattaccctcacggggtcgtcgatacatatcccgaccagtggattacagaagaactgtaatttgaggtttggcttcgatgcacctttaccttaagtttttaattaatgcaattgtaatacagccttcgttattataactgattttttaataattctcaaagtgcttttaacagaaatgaaacaaaattttaataaatgtaacaaactttgatataatgatttgtgacacaactttgttgtaatccactggtcgggtatttccaccccaatcttgcatcagagtgccagaagagttcaaattgtgttagttatattttgcaccatctacagtgaaggaaacctagatttgggtgaaacctgaaggaatccgtgagtgaattctcgacactgtgagaagttgatagtgaaatttaggaaattcggaacaaaacgtgacgacagaacaaaacgtggccacagcggggttccacgcggccaaaaggggggacggtggtacgaccatcagcaggagcagcaccatgaaggaacaagcctcgacagaggtggataaggccagtaaggccaaccgcccgagccagctgctgaccaacgacgagaacgagcagcttttcgatctgctgggaaaacggtgtcaggtgagtaaatgatcgttggagaaaaaaatgcattggttttatggtttctcttgatgtgcgaagtgagcgagttatgatcattgattgacggtggaattctggaacagtgtgtgtatgtgaagtggttgcaataatatgatacatatgatacataattccatgccgaagggattgctgcggaatgactcacacctgattgataacgatggcggaaggtactgagacattattattttcttatcgtattcatatacttgagcactcctcgagctcttaatactctgtcttttctattagagccctcaacttgagatgcccttcaataaacatactcttcttcaaaccataacgaatgccctaaatttaatgtttgtagcaaaacaaaggtaattgcagtttttttgtcacttctgattgaaatttccatacaaagtcttaagtaactctttgatattgattgataaggttttgtccgtgaacccccgtttcaatcgggtgtatcttatcggtttccaagataagagtcgagctgtaaataggtgcatttctcgcataacttacgatctcgtcctaaaagccattagtaaccgtgtgtgtagctcctgtagcaaatgaatgggtaaagaaaaaactatcactactattagatagagaaggatcttctcttgattgtagtatggttaaataacgtgtaaatccattcgttgatcagtaacaacaagctacaaacttggttactaattactttaagggccagatcagaaattaaataccgtaaagtgccgtaattcagcgcagttaacgaataaaacatttcaaatgcttaattaaaaattagtattgcatcaacaaaaaagctttatgggtggatcgctagcaaatctgttttagattatggcaaaaatataaactagagtgtattcacacgttacaattgcgatttttttgaaatagttcactcgttgaaattgcttaattccgcgcatttttttacacgcttttccatattccgcgcagaagaatgcctaattccgcgcacttgcaaaacaatcaaattaacattaattttgtttaaggcagcatccattcattacgtaacgctgaaattgaacattttcaacccccataacactttttgtatgaaaaaaaagtaaagttttgtatgagccgtaacgtagacttttttatatttttttgactatcacatgaaataaggataaacatttgttgtagtcttttcctgagacgagactcacgaagatggtcttctttttctgtcattgctgagtttttttcttcttaatcctctgtgtttttatcaatcatgcgcaaaccctcacatgaacatcccagcaaatatgcaattgcgattgcattacaccgaaacataaaaagcctttgaagtgaaattttatgccagaaaaacttgcagacatttgaaataactatagtcttgtgtttagatttatcagcagctttggaaaaactgctccgaacactgaggtttttataacagtttattttgaatacaatacttttcaatttttcagcacttggacgtttcgcgactgcggagacgttgatattttttttccttttccttgtcagctttggggttgcatgttattccagaagaaatttcaaaaaaatatgcagtttggcgaaaccgccccgactacctctacacacttaaattgttttaccgtaatcctgaatttcaccgtaatctcaacagctgatcagttaggtaaaataaaacaccgtaattccgtcgaaattcaacggattgcggtgaaattttaccgaaaactgtaaaaattaaccgtactccgttaatttatttcaccgaaattttcagctgttgagattacgttgaatttcacggattcctgtaaaataatttaagtctgtatatttgtattctgcactgttcatacaataacaaatgtttatggaccttggttttggacaaacttttcctcccaccatgaatgaccacatggtttctgaacggccgctagtttccctgtaagtgagctttcccgatattccggttgtttgcgaaacgtatttatgcatgaaaatacttcctcagataaatattcagctgtgaagaccaatatagcatgttttacttgtttgttgttctgtaaatagcagtgcgcggaattagggacttatgaaaaatgacgtgccctaatgccgcgcaatattttttgggattaatctcaataattatgctaatatttgataagatttcaaagaagcatcattaaacacatctgtagcaagtagtttcatagaatattgcataaataataaaacattttcaatatagaaatcacgtttgtttgtgtcctacagtcttagcacggacgctaaggaaattgaaaaaatggcgtctactcagacgggcctccactgattattttttacgccgcgaaaaactgctctatttgcttttatttgtgattcaaacttattctaaatcaaagtagcatcaaatggcgttaaaagttgctgcagtattgatgtgtatttccatatgtaaataattttgtatgaaatgcgcggaattaggcaatgcgctgaattagggcactttacggtaagatttgtttagcaaaatacgcctgctttcctgttcgtttctctaaaaatatcattgagctcatcagtcgtacaaaacatcatgtcccaaagaatattttaaaatgtcaggtcggattcctggagaattcctcataatcttctggttcctccatttggttcctgtttggccatcttttttaggcatgaggtctttaaagttcctatttttaagaaactcagtggctactattgtaaaaagttttgaagatgttttgaagagataagcacgatatcaacctgaagatctgtcctgactcctgacaaatggaaaaatatcaaggttgtaccaattttgaaactgggcaaaaatcctggagaagctcctagccatcgccatcgatctatcaaagttcatagcatttggtagaacccgaggacaaaatcagagggggttgtgtacaagacacgaccgcatgacgttaactacgccaagtgattttttgcatttgaattttagtcgattttcatagttgcagccttcctttagttcaaactctaacctaatatcgtgacggtcccaagatttttaattgacacccagtatattgccgtaagacgtagttaacgtcaaaagaagaatgcgcgaagaagcagaaattggtctgcttttatagtgcactagccaacccaaatgaatcgtggaaggcaatatgaacgagtttggttgcgtaagaaagaggtcgacattttcccaattttcgacagtctatcgtcaaaaatcaaaagttttctccatttgagtaaaatgttgtataaatttccgaccgattagtgggaaaatattgaaaatctaccgataaatggctgagttattagtatttaaaatcttacataatttcgtgacggtcgcaacattttaggttttaaattgacacccagtatattgccgtaagacgttaactacgtcgaaaaaaaaaacgtttccctacgctgccattcatctatcattatagcaaagcctatccttacgcctgatacataggcagtctgctaaccaaacagcaagcctctctgccttaacaattaccgcccctctacacccttcgcgcatgaactggcgtagacgcagtggtatatacggtctactgtgggagccagttcaatgcatcatcacttcctcccccttcccctcattggtcttcatactgacgtggcaggcgccattgttgcctaaacatagaagatcaccagcacttatacactgagggtgtctgttaatcccaagcagtcatctggttgatttcttgtgtaagcgcagctgatctttcgatactggagtagcaaccacgggcggcgaatcaagttcaagctctgattgaaatttccgtacaaagtcggaagcaagaatttgaaacggattgataagattttgtccgtaaattcccgtttcaatcgtgtgtatcttatcggtttcgaagataagactcgagctgtaaataggtgcatttgttttgcacaagacgctgtgcatacaaggtgcttccctctttgtttctctataaaaagaaagtctaagcttatgtctctgttttatgaaattgttccatagtttcgccaaaagtaccagagatttttccaggaatgctttcagctaactcttcggggtcccttcagaaattcttttaaaaagcaattcttctagaaattcgttcgatttctcaagagatgcttagatgaattccttcagaatttgctcaatgaaattcttcagcaaactaaaacttgcgtcatttacaagagttactccaaaccctcttcccacgtttctttcctttttccataattttaaagatttcttcaaatgttacttaggaacttatctaaatactcttacagaagttgagtagtgtgtggtcttgtttctgttgcatgcttttttgggacgaacgacggaatcaagatcaatagtgtccggtgagttatgcgagtgcgaaaagttattcgtgttcaatctagaatggattaccaaatggtgagctcgtttgggtttattcacaaatttcataacgccaaaaatcaccatttttgacagccacccaccccttcgtaacgctttttgtatgaatatcctaatatttttgtacgagctgtaacatttcttgaacaccctaccaccccctttagcgttatgaaatttgtgaattatccctttcatgcttgtgatgatgcttatgatttacagatgcaacattgcgtttatgtaatttttgaacaaactatggatagtttgttactacaagtattggcttgaatcctcattcctgttttatatagttttaatatacacgtaattaataaaaacaacctttaattacttcaacattatgagtgccgacgtactttttttaatcttctaccaatatcttttcacatcgatataacaattcaaagctaatttgaagggagagcaatattttcccccttatccatggatcgcatcaccgaccaaaagtttcctccctcaataataagcacgcttcccgtggtgattgtggagatgcagaggtattctcgatcaacattacattacacactaatattccctcccttccaaactaaaagactaaaagaccttgaccggcgccgttattgatcaacaatatgggaactaataaaagtgcactttgagagtaagcggaaagtcccagtcccattcattgggatctaagtgcagttcttaccagttccgaccagtcacggagtagcaaccacggtcagtctatgctatgctttgctatctgatattcatacagaaattcttcctggaaagaccataatattgtaggttttttatttcgagaaaacctacaaaaatttatcgagaacttccaatacttcttccagccatttattccacgaaatttattgggaacttattcataaattccattctgggattactcctgtagtctcttccaaagatttctcaatcaaaatttcagaatttgtcaatagtttacactaaagaaagctcggcaacctgcagcacctctatgtgaaatcttgacataaaagatcttaaataagcgctctactgttccaatctcattaaaaaagtttttcagggagtttcaatgaagaatagaatattttctagagtttcattttgtatttttttcaaaaatgaaatttatttacagaatctttaaatagtctagttactccagaaatacttatattagctctctgctgcaggtgttcatatgatgtttagcaaaaagttgctctacgttttcagccattttggctcgcgaagcacttttttaaattaaatcgttgcacggagcacctgttcttcatctccgtttgaaatccgattttttacacgctaaaatcgacccagtaatttctactaaaattatgaagagagatttacaatcagtgacaaaagttagtaacctaatgctgtttttttcatacaagatgctcaaatttggggttctgtatctcagcttctggtaggccgaattgactaaaatttgaaagacgcactcaaataacctggaatattattaaatccttacaatgtagtctttttccaatgagtttcagagagttgttcaaagacaaagtaagtaatcgagttttttttttatttaactcacaaacgatattttgtgggtcactggcgtgttctgtaaacttgcataacttttttaagtgaatgactttgccgagcaaaccaatagctcactactaacagttttttgaatataaataaaatcgctcgattacttattttgtcttcgaacaaccctatgaaacttattgaaaaatgactgcattataattatttcactacagacaaaactatgtgtagttcacaggctttttgactaaatcatttttgacgacttaagtgtgattgggtgattttgcacgaaaaagtcaagcatgagattttcgaagcaaatatcttatgagtttgctctcgccggagagctgattgatggagatatgaatgttagtctgtcaacactggttcactggtaaactaacatgacggccaaacaattgaactgaaaatctaaaatagtacattaaagtgatatgtttgttgcataaattcatccatactattttagccgtatggttataacacaatattctataaacaatccgaagcattactattatcaaatttgaaaagtattttcattttttgaataccatatcaatatgtttgcaaacggggaccctgttcaaaattaagtaaataagtgaaattatatagcaatattaaaatgaaaggctgtttctgtatccactttacactaaagtatgaagaataaatcgttgttttatagattcctatgatgtttaagaggattttttgaataatagctaaactcaaatattcgcatattataagctttgagcattgaagttgtgccttccttagcctagtgataatgtccgcggctacaacccaaagccatgctgaagatgtctgggttcgattcccattcgatccagaagcttttcgtaatggaaagctatcagtttacaactattgaagtgctcttagaacactaagctgagaaataggctctctcccattaaggacgtaatgcaaaacaaagaaaaacaaatattgcaaaacaaaagtgcttgaaaaaattcctgaatgaattattttattaatgtcttactattgaaaaacaaaactccaagggaaaccagtaaataaaattattgaaaatgtaaatacattcgaagcgcgttataacgacatcgcaagggaccgtcgcaatagagaaaagtcgctatagggaatagttatgacatcgaaatgtttttcatgggaccgaaaaatgtccctttaataacgagcttcgactgtaaatcattgaaaatgttgaaggaaaccttaaggaagtcggtggtcttaaggagtacttattttccgtacactagttcagtacatgaagaaattcgatataaaattcctggggaaaatctggagacggttttaaagcaattcctggcgtaacctctggaataattcctagagatattcttgaacaaattacagactgaattcttgaaacactgctgaataaaacaacttgagaaattcattgaggacttcctggaaatatgtctggaaggatttctttgaggaattcctgaaataatcccttcattgtttctaaaggttttcgtagaggaatttcttttaaaattgctgaaaaagtgcgaaatttctaggaaacaaagacacactgttttttttttattttgaagaataccggaacgaaaatcttttgaaaatcccttaaaaaccatattagaatcaatgcattaatttctaaacgattctttggagcattttctacttcaacttttttaaaggtattctgagcaaaaatcttgaaaggctggccatagaaatctcttaaagaatcataagactaattcctgaaaaaaaaatcgtagttatacctgaagcaaacttcaggcaaatgggtactaattcttttttcatgaatgtgatctttaaagtttcgtcttgagcaggcattgtagaattcgttctcaattgatttcgaagcacgaacattacaagggtagaaaaacatcacatctgtctgtatcggtccatgatcgacaatgtttcgcgagttgtaacaagcttgataaatagcagcaacgaaggcgagctccaaagcgagaacaatgataaaacccatttttctcgcttatttatcattgggattaggtgttttactttactggcatgataaacagtaaccgaacatcctattgcaatagtgcccccaggattttatcatgcactgttatttccccgatatattcagaactgtagcagtagacgataatcagactctctcagaattcaacccatggtattaagtaaaacatcaatctgaagatcaaaattaaactgatttatcatttatattacagcttagccggtcatgatcaaattcaacctaaataagaaaggttacagataatcattttccattcaacaaagccatagcctgccaaaggttttgcttaagttgctttaaattcttaaattgtaaaacatcacatctcaattaactagctcatttatccattttgcacattccgataaaaacgggaagttaactcgcaagtccatacgggggcccagctttcaggaagcaccaaattgcaagaaagcaagaaagttgctctgcttagcaaaaaccatacattcctaatcaatgctgcttggtgtggctagttatttcactgcacataagagaggcgcgtgtgcactgtgtctgtctattcatccgcaagggaagatgacttggctgccattcatctaaattgctgcgtttccacaatcgcaccgtcgtgtgtttagcctctatacccagaaagagcaccccggaccaaagccggagcaacgaaaggggtactagcttggggcatggacattagggtgtcccagtaaaaagtaataattatcatggtgctcattctagaatgaaagatatgcttattagtagtattttttgtagaacaaatcaattttgaaaaaaaaagttcagaggttccaccatatcgatttatgaaaaatggtagttttttttaaggaaaattgtgtaagagcaggtgatctagcgatactggagtagcaatcacgggcgaccaatcaagctcaagctgagatttcaagtgggttttagaaagttcatttgttctacaaaaatgctacatcaagcatatcttgcattgtaggattgatcaacattacttttcgaacgttgattattgtatgggacaccctaacggacacgcacttgcttcgtttgcctcaaagtaaacaagtttttccgttgaaaattaattcaatcgttcctgggcaataatggcgaatgcatcaattcctagacaggttttctcgaataggttttctgtgtaggtaatcactttcggtttcgttcgctctctcgctcttcttttccgacacattgacttctgtctatcctctagtctactccttaaggtttttggcagcactaatgggcatttctgttgcgaatcgggagacgatgatgtgaagtgcgtgcgatagttgcgtattttacaattcgttccgttcaatgaaattttttgcatcaccgataacaatatgagccgtttgggacggtaacgttcaacgatgtgggagagcattgatctttgaatggcagttcagtttggtggttcaaattgtagttttttgttatatttagtgcttagaaagtagcaaatacataatatcacttgaaatcacgtatctaggaaaaaaggcttgataaaattttaaataaaaaaaacactcatgtatgatagttttctgaaaggattctaggcaactaatttggaatcaccataaaaaatccataaaaaaatcaggtattctacaaagtattactagaaaaatatcagtttatttcccggagtcaatcctatgaaaaatccctgaggagaccgtagaagaatccctaaagaaataattctagatggagcaacttcatgagtagtttctacatattctaaagaagttcgtggagctagttttaggaaaattcaatgtttggaaaaaaatggtattttgttctgcaacatcctaaagtactgtttgaatgttgagcccctatgcttagtgacagtgaagttttgagagatccttatgagaatttccatgattattactcctttttaatttatggaagggattaatagagtatgtttaagaaaaaaaaaactactaattgaactttaacacatcacttttgcaaaagaaaaaaaaatactaaaaatcacaagtaaggcgagcaaataccttttaactgtaatacatatgcgtcttatcgtgacagatatgcctgcgacttacagacttcttcagtgtcgagtgctaaaatgattattaacttagagtcagttgaccaattgtttatcgtagaacaagggcaaagatactctagcttagacttactacacatatcaatggttgctattccgtgactgcagaaaagtgctggccgaagtcagtgaaaatgcacaaagaatcaactagaagttcgactggaatttgccataatcttcttcagtgcctttatttatacagggtcaactatggctctcccagagtcatccaggccccctccagaattttgaatgataataaatgaaaaacaaaacaaaacaatatagtacatgaatctaacgtgaagaaaaatcttctgaaaaagtttacctgactctttttttgacaaaaaaaaaacttcaatagttaccttcttttattttatataaattttatatactaaattcagtctgtacgatatttccaagacggtgtaagtaaataaataaataacaatagtggaaaaaccttgcttgtcgtacacagcatcagcgtggtggttctaacttcggtgaatcgcgcctcaaccgtccgactgtcgctcgatatatgtgctacaagtgcaatttttcgacacgtccgctgcaaaaagtccgtggtaaaaaaaaactaaaatatccttgaaattcggttcccaaaattcgtattttcttgataatgtaaacaataatgttttaaatgttgtggcttagagcaacatattcactgcattacgatttctcatgtttttgggagatgccttgcacgagatgttggttatgatatccaaattcatcaaataatccatacatcaactaatgtgagtttaatgcccgtcagaattatttgaaaaaaaaggcaaaatcactcgaacattttttttttgtgaaaaaaagcgcaaaacctattcatattctctaaaacgtcataacaaatattttatgaactaaaggctcactcagattgaatcataacagagctagatttttgatcttccgaaacgttaaatcagaaaaaagggaaataagaatctctcttgataggtggttcaagtttcaatcatgaaaaaaaacaaggaaattaaagcatataaaaatcaaacaagctatggtatctcaaataacttcaaatagttttcccaaaattttcatcaaattcattcacaaaggttcatcaaaagtcctgcagaaatatttcttaaacagaaatttcgtcagaaattcttctatggttttttttttgcagattctgattcaaaacaattatctacgaaaagtgtttttgaaacgtttcttcccttcagaggaaattacttggaatatcccagaaatactttagtttccaaaattagcatagcattaaaaaatatttattctaaaatagttttgtcaatcaatggaagaatccatcctaaccttgtgcaaatccaggacagagttcacttacgtatagctccttatttctgaaagtccataaggcatttctcaacaaattttaagagtaatacaaatatttcctccaagatttcaatttagtaaaatctaacattgcgacttttatcataagacatttgtttcgcttcaaacttatacaatcctaatcaacaatagtccctcccaaaaagattaattggaaatagtttctacatcaatgtttcgccaaatttcggagctcatgaaaaacattttcttcgatgttagatacaaataccttcgacaaaaattccgtccacattaacgcacattgtccattataagagaagaagaaaaacgaataagatctttttttagttaatcctacaaaaaacactttagcttttatatgtggtatatcatttggaattttgtcaaaaagtttcagaaactatacggtgaattctatttttttctaacagaaatccagtatattttccgaattcaattcaagctgaaattatctctataagttcttcctatttttttgtatgttgctttatgaatctgaaatatatttgatatggatattgagtgattctgggaataacttgttatggaatccataaaaaaaactattgaggttttgctggagtagtttctgaaccctaaatgaagaataaatagatttctagatgcttttttattaaaaaaaaaatcccggtattaaccttttagtaaaaatatgaagtgatttctagtaattgtaaggatatctgattaaattactaaagatttgtttatggatgtacattttttttattttcctatgtaggcatttttgagcaaatttccaaatcataatttcgagagagtttcgatggaatgcggggagtaacatagaaatgattttgaagagaaattcaaagaaacacttagagatttttttgaaaagataaaaccaaaaaggcagataaatttgcggagaccttctctgagacatctctaagaacattttgccaattgaatcctcttaatttgcttatgcatgtcttgtagaatattaagaagaaatcttagagtaacatctggaagaataattaaaggttttccaggaagtcctggataatttttgttgcgaaattttcaagttatccttgaagaaactttgagaggttttctgaaggatttttcgaatgaatatgaagaaacttaaggaaaagctcaaatacaaagttggaaaaactgttaaactttgaacaatttgtgtaaagaatccatgtttggtaatcttgaagtattttggtaagactcttagaatttcttgtaccatttcttggagaactcctcattaattccagagaactcatagctgggatttttaattaataagtacgtagaagaacttcccttgagattcttcgagcatttcgataaagcgtctccgagaaagcctactgaaacttctggtaaaatctgctgaataataactatttatcatgggaatgattgtccgtgagcatactaggagaaactccgtgaaaattggtaaaggagctcttggagaaagcactgaaaaattacggaaataattcataaagacaccgcatgaaaattctcagaggaatcctttaaaagcacatgtttgaatacctgaaaaattcgtagaagaatctcgagggatattcttcatgagcgatttggaatatttctttactaaacaaaaaaatggatatttccgtattgaaaattgaaattcacaaacatcactaatgtgcggtgacatgaggcaatataacaaacaaataaaaccaatacaaatttatgcaaactacgaaatttgtgaaaatcgtgattattgcgcctgacattacttctgtaaaacaagattataatagaccccccccccttggccccctccagaaaaaatcctagctacgccaatgttactgagagggatgtttttaatgggaaatatcgttagcacataggatttactttgataagcgattagacaatgataaacaattatttgtgagatataaacatgcttacagatataatattttcaatcaatatgaaaaatttccaagtagaagaaaataatgtcgacatagtaacgaaccattcaaaatttgttgaacaaatacctaaacgcgacattcctaccgttgtcaagacgaaagcatgtattatattgtactcttctccttcttcttcttggcattaacgtcctcactgggacagagcctgcttttctgcttaatgttcttatgagcacttccacagttattaactgagagctttctttgtcaaagttgccatttttgcattcgtatatcgtgtggcaggtacgattatactctatgcccaggaaagtcaaggaaatttccattacgaaaagatcctggaccgaccgggaatcgaacccagacacgttcagcatagctttgctttgtagccgcggactctaaccactcggctaaggaaggcacaatatggggcctcattggaaacataaaaaagaactcgattggctagaccattgcagaacactcttatgctgtcacatacaattacgaaacattcaagtttgtttaataaagtgaaccttttgcaagtttacacttatagtgtcgaaccattcaaagtttgtttttttttcaattacataaaacaaaagttaaagaagagaagtgttttaaaataaatatgtttagcttaattaattcatgaataagagtttatgccgacacccacagtgacgaaccattcataatttgttgaaaaatcatatttacttactgttgtaactataaaatatgtatgtttaacagatttgtaaaaaaaagcatgaaacgagctcaccaactgatccttcatccttgactgagcaaccacaatcaacttgcaccttcacttaacgcatacaaactccataggacacgtgcaaagatgctctataccagaaagtcgagaaatgttttgaccaaaacaaaaattctcgaccggaacataatttgaaccggccaccctcaacatggtcttgttgaatagctacacatatacacagctatgacgagggtccccaaatccatcatattttttgacatttcaagtcttcattcatatatcatatatcatatatcaaggtccatccgcagaccgctaggcctgaattacgcatcattgaccaatgaatgctgtttggtgttgttggtgccagattgccatgtcatcaacctgacaattcacattaccctaccagcgcatcattgcattcatcagcaatcgattactttttcacactggttcgtgcacaaaccgtaaaccgaaaagcccatctctctctcttgcaatccaaaacgtggcacgctgtgtaatcaattttgatatactgtatcatcaagtacccaaattggcttcatctccaccaattgtgtgcacaggctcaacaacaatctcatgacgagcatcatcatgtttggacgagaaaaaaagaggggcaaacacgttgtcgtcttgtgttgtacctctttgaatgtagatcaaccgaccgaggccgcgagaaattcagtcagaaataacttctcatttttgcataataaataggtggcagcgcgcggcgaggttccattgtttgttcggccgaccgcactatgggtcagcaatcaaaattcttggaaaaaaatcaactttgaataataaaattttttgtatacatgaaaaagtcgtgtttgaagtgattgagatctgttttgaattggaaacaatttttgggattgcgaattttaggaacatcttatttctgctcagtttatgaacggcccttacttactaaataagttgctttatccgtttgtctgctatttttttcgaccccaaacttttacaaaagtgttttgttcatatatctgtcattatacgtccaatttaaactctatatggctcattcgaaaggtaatgagttaatcttacttcgtgagtactttgcccaaatatttttacatcattttcacttgaagtaagttgttaattaaaaaataaataaataacaatcagaaaatatgacttttgtcgtgaaatttctatttctggcccacagtgcgaccgatccgtaacgagtaagcccggcctggccaagatgacgatgatgcgaaaattgagaggaaaaattatgacttcttatcacaccacaggtgcttcccaccttccacctgtcctgctgcgccaccatcaatccgtggcgcttcatttggaatccgtcgacttgtgtgtctcgacgttgagcttaaaagcgcggaaaagtgctttcctctgttggatttgctacagtcagtcggttcagtataaaggccaacataggtctacttccatctcagttaagtatacgaaacgaagcatcatgggggaggttgattgctctggcggccatttgtaagaggtactttcctttttgaatgaagaaaattgaatccgaacgaattaagcaatgattcattatttagcagtaattcgttcggcaacgcatcagaaattgatcattagctttttgatcaccaacggtttaacaaccattacacacatgcttgagtagttcaaaaatagattggtcaataatattggagcatttaacaaatttgatgggatggtttatggtttagagtacaagttataacatcaagctcagtagactctgaggtgtcctctaatcttcagtttcagtataaagaacatctactttcctctttcttgaacagtagacaaattcaacctctgaatagggcaacaaagtcacttaacggtttgaaccattgtcgcttgaaaaaaaatgagatttttgtcggactcaattagaggtaagagttccaattttctttttttcaagaaatttatttatgataagcgattcgacattttgtaccttctttttgtaattttagaccttttgtcctttcggatttttgtcctttgacctttggtcatagatttacacaacattaatcttcaaaaatatctaaaaaaaatccagaagctcttgtaaagattcccttataaaatactccagcaaagaattccacatctttatgatcttttccagaaatcattatactgtttagtaagaatactgtcaaagagttttttaagaatcacttcaacagattgttcaggaatatttccagaaatcattcgtttagctttcctacgattaatttcatttaaattattcagtaaacatctaaacagaaaaaaaactgaatcaacaatttcatcccacaaagtccgtccacctagatcgcagcgctccatgccttcttgtaccaaccggtccgaagcgaacaacatctttgcaggggtgctgcctggcattcgtgaaacatgccctgcccatcgtattctcctaggtttcgcaccttcttaatactggattcgccgaaaaattcggtgaaatcatggttcatccttcgccttaatacatctcgagaacggatagatcaaattcttcttcttagcattacgtcctcactgggacagagcctgcttctccgcttagtgttttattagcactttcacagttattaactgagagtttcctttgccaatgttgccattttcgctttcgtatatcgtgtgacaggtacgaagatactctatgcccagagaagtcaaggaaatttcctttacgaaaatatcctggctttgttttgtggtcgcggactctaaccactcggctaaggaaggcccctattgaactattcatgtattccaatcaaggctcgccaacacttccagtcagttagagctgatgtcatgaatcatgactcatgatgctcaccgtatccccattctaacaagccttgccgcaaacacaaagattgaaattggcgtttataacgaacgcgtttttcatggaaaataatgaaattgattgattctggaattcctctggaagctccttaggtcacagatatctgtgcctaggtattaaattatcataggagcttctttggtagtttagctagtagttactctaggagttcccttaagaagtttctccggaaattccttcagaagcacctggagacgtttctctgaacttagcactaggagttcatccggaagttcctctagaagtttttccgtaagttgctttagaatttctttcggaaactcatctaaagttcccttagaagctcatctggaaacttctttagaacttattctaggagttttttcctaagtttctataggattttttttccggagaaaggagtttcgccggtgtaagagttcctccggaaattcctgtagaagttcatccgggagttcttgtagcagttccttcgaaaattcctgtagaagttcctccgaaagtttcattaggagttcctccagaagttattgcggaaattcctctggacgttcatgcagaaattcctccaaaaatttcttcaggagtttctctagaagctcctcaacaatttcttgtagaggttcttccgaaatttcctcggatttctccggatgtttcaccaatagtttctccggaagtttctcaaggtggtcttccgaagtcccctaggttttaatctagagagtattcctgaaagtcgctgtaaatttcatcccgaaacttcctccggaatttcccgaaaattcctctaggtgttcttcctacaagtcttctagaagatcttgcgaaagtttctcaagaatttctcctggaagttcctctcaaagttcctctaggtttttctgataagctcctatggaatttctttcgtaagattctctaaaactttttatagaaattctattggaagttactctaggagcttttccggaagtttttcttaaagttctttcggaagttcttctaaaaatttttcctgaagtttgtcttggtttttctgaaagttccgctaggagttcctcaggaagttcctgtaagagttccttcggaagctcttgtaggagttccactggaagttcccgtagcagtttgttcggactttctagtaaaagttcttccggaagtttctctaggagtccctttggatgttcctgagacagtttacaagaaaaatcttctaggaatttctcaagaagctccccctgaactttttctagaagttcttccgaaagttcttaggattttcctgaaagtttaactctaggaaacctttgggatgttttttaaggaataccacagacaaacagacgtcacactctcatcattgtccatcgaccacctttttaacggtcgattcaaaaatatggtagatgggcaatccgccacccgcagcgctcgcatcatttttgttcgcgtttgacgtttacacactaccgccatctgttgtcccgtcggccaaacacactaattttagcattgggcgtacatgtccgcgtgactatgattttgatcgagatttgttctatgtgtttcgtctgtttgtctgtgggaataccttcagaagcttttgtagaagttattttgaaaattcttctgattcctggaagaactccagaagtttctcaaggatttctcctggaagttcctctcaaagctcatctaggaattcctccggaagctcctctaggagttcttcctgaagtttccctaggagttcctgtagaagttccttcggaaatttctataattccatggtttctatggaagttctactaagaatacctccaggagttcttgttgaaattccttcagaaaatcctctgatttctgcaatgaattactccggaagttacccaggagtttcttcgaaagtttgccaaggagttcctccggaagtttcctccccagaggatacactgcatctttcgccaagagttcctcaaggaagctccgttaggagttcctccagaagttcccttaaaagttcattccggaagttctgctaggagttcctgcagaaatttctccagttctgaacttccactggaagttactccataagttcccctaaatgttcctctaagagttcttccgcaaatttcctaatgggggagtaccttcggaagttctgcaaggaatttctctggaagttctgtaaggagtttctccagaaattccgctactagttcttccagaatttctcctaaacattcttccagaagttccgctaggagttacaccggaagttccaaaactatgtaggagttcctccagaagttccactaaaaattcttatggtaggtcctgtaggagttcctccggatatttttcctagaattccttcggaagcttctctaggattttcttcgagagttcaacgagcagaacttcctacggaaggatttctctatgatttcttgtggatgctcctctaggaatatgtttggaaattcctttagaaattcctctggaaattcttcctggaatttcgtcctggaatttctctagaaattcttccggatgttcctttaaaaattgcttccattttttccggggatttctgcaggatttgcattagtttttttttttgagttcatacaagaacatcgttgttataacgttataatctgggaaccttccttagccgagtggttagagtccgcggctaccaatcaaagccttactgaaggtgtctgggttcgattcccgatggatcaaggattttttcgtaaaggaaatttccttgatttccctgggcatagagtatcatcgtacctgccacacgatatacgaatgcgaaaatgccaacattggcaaagagagctctcagttaataactgtgaaagtgctcataagaacactaagctgagaagcaggctctgtccccagtgaggaagttgatgacaacaaaaagaagaacgttataatctaatattttgtaatttttagttttgaatcggttcatccggagattacttcggatttttttacataatttcttcctcgcttctcaaaattctcaaaataatttgtaagggaattctgtaacgaatttacagggaaatatctggaggaattctctaagaaatttattcgaaaatttcatgacgacttcctggtgattcttttaggaatcttgaaaaaaattctcaaggatgccccttatctattcctacaaaaaacctccagtattcctggattaatttttgaaaaaaaatcttggctagcttttagtgtaattattttagaagaattcccaaaaaaatatgagatttttgatgttatgccctgaaatgctataaaatgattcactaaggaaatcctgaaagaattaccaaaggaatttctggaggaattctcagaataaaatcgtggaaaattgctgtaggaactttttaaacaattcctggagaaattctccgaatgaatgaaatgaatgaaattacgactcatgccaaaccccttgtatcatggtgttttcgacacctgtcacctgaaggaatatggaatgcaaggcgggttcaattctctagctacagagtacagcgcacacatcttgatgcaatgcagcccatttctccatttttccatttctgttaattgcaaaaagttcatcaaacgtcatttgactcgtaaacatcgccttctttagcgtctacattagccagagagtccgctttctcattgcccggaatggagcaatgagaagggcccaagccagggtgatagtgtataagcgatttgacgaagcactcaattattggcaaatttttacatgtgttttcgaacattctagtgggatttccatgatttgttttgaaatagttttcaatattggacagacaaaaaataacttaatagatataaatttaaatctgaatcacgtgatattttcgtaccagaatttttaaggagttgcgatcacttttcaaacaagtttcagtgatattgtagcaaaaagcaagctcgaaacaccttcgaactgaatccttgtaagtttctggactaaacataaggcaaaagagaatctaaatctagaaggattctgagtgaggtacggttaattagtttgcttagcgaaaacttaagacttcagaattgattctgggcaaaatcattgcaggaattgagaaaagattttgagaagagaaactatccaaattattggaagattctgaataaatcatgagctgataatataatatacagtgttttgacaggacttcgactgaaatactgtcaaagtttgtaatcgtaaataatgtaaaaaactttgtaagaataataacaaattaattagtgaattagtctatatcttgactagaattatgtgtggatcctgttaagatctcgattcgaatcttcttagtccatggagaaagcttaccagtgtatggaagttaatatttaatttccatataacaatgaatagcattttcttaaattaattaactcattacgcgtggtaaagatggacaaattataggtgaaattatgaaaaaatccacgtgcttggctgggatttgaacccaggactcttgtatgctggacgagcgctttaccaactaagctaccgagccacttggtgacccaataactgagttgattacaagtttagaattcaaatccctactacagaccacgcggacccctttcttaacccatatccatccatctcatgttaaatacacacgcgagaagagcgagtgtgatttatttagtgttgaaactgtttgcctatcgttaatagctcatgatatttgaaaactttatttaattaattcatgagaacaaaccaatatcacattttgccataatagctcattttactattcgtatgatatgcattaaagattcaaaaaacaaaagttttttagcaggaaagcaaaaagtttatttttcattcatgctaaatttatatattgaagtcaacgaactaaaattaccattactttgatcaactcgtgaatagcttatttagttattattttgttataaatatctaaataataacatattttgttattacgggtgcctatatttttgctattattttcttattacaatggcaaaatatgatattatttagtttttatgccatacaaacttagttattatttttgttattttatctcttatttccgacaaacaaagaacaaattttgctatttaaatattctattttaatggtaaattttgttattattttgcaattctcctctaaccgagaatgcagttgtttgtggaatgtggaagagtaaagatgtgggaaggctatcaacgtgtcgttctcactcaagtgacgacatgactactacagagaggcagtaacactctaataaaaattgacgcttatattgagctgttcggtaatccaatccggatttttcataatttcacctatgatttgtccatctttaccacgcgtaatgagttaataatttaataaccatgcggattggattaccgaacagctcaatataagcgtcaatttagcattttcttgttaatatgtcaattacaaatttcattatttttggttatctctacaatccgggacgttttccaggactcttttgtcctttcgaccttttgtcatagattcgtaatgtatacacgttcaagaaagaattccggaaaacgtgaactgtcaaaaatacaccgtgaactaccgtcgcgttatcatgaacattctccaggcaacacattcatctaaatatgatctagttcacggtgtatttttgcttgttcccgtaatcatgacagctgttcacggttttttttcatgtatctgcacagtaaaaaaaactgttatatcacgtcattttagctgctcattagtcccgtcgcaaatgtgatgtacaattacaccatataaacgtataaaaccagtcagctattgctgaaaaatgaaatctagcaatcgatagaaccggtttgacaatgtgacaaaaatatgtaaaagtctaaccgggatttgcaccctgaagagctgcggcgtaattctttatacatagccaaaaattacgtcggccgttatcaattgtatttttgctgtgggctatttcagaaatatatacaaaacatagcttttgaagcatgaaggaggtgctacgataaatgttatacaaatcgaaatcatcagtttttggcccatcagtgaagaactgtcaatccttactcacatgccagaatttacgtgcaaaaagggaaatgggctatgaggctttgatcagcgaaaactagcaatttatccagtattgcagtgaatgatgctgatacaaaccgatgccaaacaattatttcccaagacggtttcgcattgttctatacgattttgataaatcttgatcgtttattggaaaggatgcaatgaaattattacttaccgttgcctaaattcgtcgtatcccttttttatttctgtcgcaatcagttttgattcgtctcacaactaacgactcactttgatacagtgagtggtcaaaatacgacacttcaacgttataataaaaggttttacaagaaaatctagaaccacggggatctccctccattccttcagcatgatgaaaaatatggatttattataaattcattggcgccatcaaaatacagcccaaacatatcagcacaatttctttcgactaaacaatcgagacaactgctcacggtgcagctcaaacaacacaatcaaaggaatcattttctacgccgaatattgcgcacacattgatgcatacatgttcttttttctcagtccgacatattgaaaactttgtttacgttcccaattatttgcggtcgttgagggaattgaaatttcaagaagtatagaagttttccagcgtgttaaatccttcagtgaagatgtacgaaggttttccttagtgtaaataaatgttcggtgaagtaagtcacacagaggagcgggaagaaataatcagctaatcagatttcgctcggtacgtcttcgtccatgcgatttctgtgcaaagtggatgaatgaaatgaagttattgattgaaatacagcagtattattgcattctggtgtggacgaatcataacagtttcacaaaattacacttggaaaataaatctacaatttgcatatccgccgtagcggaacattttgagtttgatacgacgaataatagcgcttgcgacgaagtatatcgaaatccttcgttgtagtttaaatggcagcatcctagttacttgaagttttattggatagtgagccttcgtgaaatttgtgtcttcaaagtagatgtgatagttgtcagataatgacacatgccaatcaacaactcgtgactgattatattcgagcaaacacatatacacgctatgtctaaaccagcagattatgcaaatcgaatgtacctcggatttttcccgctagatatcagtatttggtctataatttcataatcggagggttacaaaatattctatcgcaaaaaatttttcccatacattttgtatgggctgaaaggtgtaggaaatgtgatttttatttattttcatagtctgtttatggaaaacagctaaaaagtggaaaaaatcaaaatttcaccgatagactattttaaaaccctttgattatgaaactataacccaatttctgaactctagcggaaaaaaatccgaggtacattcgatttggataatctgctggtttagacatagcgtgcatgttctcttgcagataccatgaagattgtgcgattacctgaattgagtatacataatcctaaatatgttaaatctacaatgatagatgatcaaaacctatgctgtcgacacacttacatgtgtactgcatgaaatcaaaagcgtagtctttgcttactctactctaagccgctctaatggtgagcccacactaatcacatcaggaaattatccgactagcctaatccactgaccaaaagccttccattccaagcaggaagtccaactttttgacactaggctctcgagctccacacacaaaaccgcattcaatccagtctgtacaacattttccttcggtcggaaaagaagttgaataatataatttatggtatccaatgtgcacatacatatgtatattggaaacctggtagacctatgtctcgattgcccgtagactgcagaagacatgccatgcagaaatatggtcatcaggccagatgccgagtgcatgccgtggagatcgaagctctcgattacattgaaccaaacaactggttcggtggctttcctgggcgaaagtaaaaggctatagctacctacccacctaaaagaaaatcaggaaatgtcagcctcaatatgggcacgtttttcccgtgaaatgggttgcagacccttcggctggagggctccaaattccaccaccagcactgttgaaacgggaattatcgaaaacgttgaaccccgatgcagatgacagtttccaatcgcgagacctacatatcgcacgccaatggaacaaaccacaatgcagtgattatctgtgcgatatagatttaatttttattaatacacaaaattaaaagcatgattgttaagagcgtataattgttctcttgggaaccagtcaagctcgcgaatcggagggcttttttctctgttcacatggcatatcgtctcgaggaggaaacaaacggtattcctcttttttttctgtgggtaattttaattctcttcccactgactgactggagtgtgacgacgactcgctggccgtatggatagcagatcatttcacggaattagcgagcaaaccggcgaacgacagataccaaaacataaacggcgataatacgtttttgtttctactgactggttggttgtttgtgcatttttttttaattagagcattttagcacacgtttcacatgagctggtctgtttgtctaccgggagtggcggatgtttagattcaaatagctttgctattgggaggaatgtctagatttgtgtaacttccctgacgaaggaggaagttaccgcagctaaaccgcgatttatacgcaatcaatctctttctgccaatcgttttttttttcttgaatattggagattccggaaaagaacatcgtcagaggaagtatcgattgcaacacaaacaccccgaatccggcagcatttgttcagcccatcctgctgactaagctttgcattttctggtccaaatcggatttgaagcgaacattatctctggcagattttgatccgatgtttttttttttgggagctaggtcaaatatatcatcagaaaaaaataaaattagggcaagattttagctctcagagaacaaaaatcaaagggtcctgagaacaccctcttaatatatataaactattgtttcaaacaaacgcgtcgaagccctcgacaaataaaacggagaaataatcattcccatccgttgtctagttttcaaagacgggcttggtagtctaattgctaccgcttctgcttcattagcagaaggtcatgggttcaatctttgacccgtcccttttcttgtgtctactttttttttgaggatttgaaccactgcgaccattacgtgacctactttgtacttgtatcaatcacttacttcaatttcttcgttcatagcaatcgctagatccagaaacggataagaaatcttttccgtacgcttccattcttctatcattatagcacgccttaccttacgcctgatacataggcagtctactaaccaaggcaagcctctctgtcataaaattgtcttacactcaacccatacactgccgcatgaacttgcatagatgcggtcggactttacggtctacagtggaccagttatgaatgcaacatcaattcctcccctttcccctcattggttttcaatctgacatgagggatgcgattgttgcctaaaaatacaagaacagttttctctcaatgtattttaagattaaaagtccttgtaatttcataaaacttatttgacatcattttaaacaaatcaaaagttttcaagatagtttttttttcttaatataaaatcattctatttgatttgcccttcccatagcataccgcttctggttgtgactttgggtttaagggtgagaattagtcgaagtgtacagctgaaaaatttcttcataatgtagcattttaagttgaaaaacaaatctaaaataaattgaattctaaggctgctgtcataatacataagtttgatttatttttacaatagtcttctaagtatagtaaggtaccgtggggtaagtggatacagaaaaatcaatagtctacttcattgatatgtacagtttacgtgaaaaatgtaattcaaacttttttctgtggataacaagtaagggactaatatacttcaaatcgtcatttatttagatttttctcatttttatgtattgagtatagaggacttgaaaatttgtgccaaatgatccacttgccccaccatggtggggtaagtggatcaccaataaaaaaaatcttttctcaaaacatatatggtgttattatgtatattaagactgatactgctctcgttcttgttattagtgctagttatgttatgttttgatacttttaaaattaaaaggtgtctttattttataaaaatattgttaaaaatatgtatacattagttcacactaattcgaaccattaaaaacattgtagctgaaataatttggagaaaattcttcaatatagtcacataagttatactggagtattgtaggattattcccaacgatgttttcgaaaaaacactcgtagttttaaaatatcagttacatttatttttgtttaacaaactgaaattttcttattctatttatgagtgtatttgtatcatcaatctaaaacaatttatatgttcaaacaaggtacgataatatgttttctataggaaaatttgtatattttgctcttttgcaactcagctttaataaaccacgaaaagttttgtttgaattttgcaatatttattcttttttattttttatatcagaaagattgaaataaattttaggtggattaattcaaattttctatagccaattagacaaatttaagcttgttttaattatgaatcgtggtttacggccaaccagccgagtggaagtttaacaactaccgaaaagctaaacattacatataatttgcaattggattagatggacaaattgatgtgaagatttgcgaaaaagttacacgtcttctcagtgagaatcgaactcacgactccccgatctctagttggggcgcgttaaccactacgccatgagaggactcatgaacgcagaagttaacctgaattcgatttcagctcaataatcacgtggtcctctttcgcaaagtgcacctctttcgaaagaattagatgcccatccaaacacaacgctttctatatatatccaatgcctagcccgagagcgcattgttttttaggtataggaatagcacactacactagccagcaactgcgctggctgaggtttctattgtgtgggcttccaatgggtcgcgacgttctcaaacgaccggttacggaacatgagtccgttgctcgataaatacttgttttaattatgaatcgtggtttacggccaaccagccgagtggaagtttaacaactaccgaaaagctaaacattacatataatttgcaattggattagatggacaaattgatgtgaagatttgcgaaaaagttacacgtcttctcagtgagaatcgaactcacgactccccgatctctagttggggcgcgttaaccactacgccatgagaggactcatgaacgcagaagttaacctgaattcgatttcagctcaataatcacgtggtcctctttcgcaaagtgcacctctttcggaagaattagatgcccatccaaacacaacgctttctatatatatccaatgcctagcccgagagcgcattgttttttaggtatatgaatagcacactacactagccagcaactgcgctggctgaggtttctattgtgtgggcttccaatgggtcgcgacgttctcaaacgaccggttacggaacatgagtccgttgctcgataaatacttgttttaattaagaatcgtggtttacggccaaccagccgagtggaagtttaacaactaccgaaaagctaaacattacatataatttgcaattggattagatggacaaattgatgtgaagatttgcgaaaaagttacacgtcttctcagtgagaatcgaactcacgactccccgatctctagttggggcgcgttaaccactacgccatgagaggactcatgaacgcagaagttaacctgaattcgatttcagctcaataatcacgtggtcctctttcgcaaagtgcacctctttcggaagaattagatgcccatccaaacacaacgctttctatatatatccaatgcctagcccgagagcgcattgttttttagatataggaatagcacactacactagccagcaactgcgctggctgaggtttctattgtgtgggcttccaatgggtcgcgacgttctcaaacgaccggttacggaacatgagtccgttgctcgataaatacttgttttaattaagaatcgtggtttacggccaaccagccgagtggaagtttaacaactaccgaaaagctaaacattacatataatttgcaattggattagatggacaaattgatgtgaagatttgcgaaaaagttacacgtcttctcagtgagaatcgaactcacgactccccgatctctagttggggcgcgttaaccactacgccatgagaggactcatgaacgcagaagttaacctgaattcgatttcagctcaataatcacgtggtcctctttcgcaaagtgcacctctttcggaagaattagatgcccatccaaacacaacgctttctatatatatcccatgcctagcccgagagctggctgttttttaggtataggaatagcacactacactaaccagcaactgcgctggctgaggtttctattgtgagggcgtcgaatggggagggacgtccactgattacgaaagaggtgcactttgcgaaagaggaccacgtgattattgagctgaaatcgaattcaggttaacttctgcgttcatgagtcctctcatggcgtagtggttaacgcgccccaactagagatcggggagtcgtgagttcgattctcactgagaagacgtgtaactttttcgcaaatcttcacatcaatttgtccatctaatccaattgcaaattatatgtaatgtttaacttttcggtagttgttaaatttaagctagttatgaggaaaagtaaaaacaaaacaacatttgaaagtattcaaacttatttaaattatcgtaagcagtctgccaataaatgataataacacaaaggcatcgcatcattttattttgacatgcaatcacgcgtccgattccttgtgatatttctacaataacaccacatatcgatcaattttctcaatactgtcgtacattagtttgtaatgtatctattataatcataatccatccaattattcacaaaaatagctatgaaaggaaaaaagaacggctgtgagcagactctgctcatccagcaatcacgctctttttacatttgttttgttctggttctccgatgcaagaatctgtgaccaaatcggtcgctgttggttcgtgagcgtgtgagcgtggatcctgcttaatattggttcattttgcgtaaacggcatgattctttccaccactgaaggtcgctaaagcctcgtttctgacatctctttagaattgtcttctgatttccagctatttacaatatgatatggatacgatctgacgtttggccttttcggtcgacgccgatgaaggtatcctctagatatccttcagaaatttcttccgcatttactataacaagaatttctccatagatttttccaggaaatcttccaaaaaatatctttaaaggatttacaatccactaaaagcacttagcttagttattttgtttcaaactccctgttgttgtcatttttgattattctcagcctcttataaatatttgttttcttaatttagtgttgcctgtggctgagaattgagtgtccattaccagggggctcatcatgagcttttcatgacgatggaggagagcggagggtcactcaaaaaaaaaaaaaaaagttttcggctaaacattctttaaagaattccgtcaaatttgtttcgttgaatttcactacgcatgcgtccaagacattctccggagatttcttcagtaatttctctgtgagttcttccaagtattgttactatgattcctttacggattccctagaagtttccttcagactttgttcaaaatttcccaaagatttccaaaaggtgtttcctctaaaaattccacgaatatctcgagaaactgtctcccgaagaaattgttttcctagatatctcctttatgtttctttagagataaccccagtgatttcttcattaatggcttcacagatcattctaaaaatgtttcccacttcaggatttcccggtatttttgttttcgaagtttcagcagaaatttttaattgattttctttcagcgatctctccagaaaaaaatcagtaattacttcaggatttttttaaggtttttcaacttcaacgattctttgaaaaagctgcaagagtccaaccatttatcgaaaatcattccaaaaactcctataggtttctctagggattcatccagaaaacattcggaggatgccttcgaggattcatcctggaattcagtgactctgtcaggagttttgcaggggattttctctagggtttcgtacagatactacttgaatattccatcaagaaattcatgtggaatccttgattttttttttcagaaaattctcagattcttcatggatttctatagtggttttttaccttacgccggcgattcaatcaggaatccttccatgttatttctcgtggtatactttgaagaattttactgtaaatccattcaggtactcctccttgtttccaggattcctgcatcaattttgttccaaaatgcattagaaaaacatcacccgtggaatcgcgtagttaattgtagttaatgcaccctctaatcctgaattattccacaataattattttcaagatacctgaaaactttttctggatatttctctaaaattttctacaaatattctttcaatgattgctccaaacaatataataagaaatatataataagatttctatagtggttttttaccttacgccggcgattcaatcaggaatccttccatgttatttctcgtggtatactttgaagaattttactgtaaatccattcaggtactcctccttgtttccaggattcctgcatcaattttgttccaaaatgcattagaaaaacatcacccgtggaatcgcgtagttaattgtagttaatgcaccctctaatcctgaattattccacaataattattttcaagatacctgaaaactttttctggatatttctctaaaattttctacaaatattctttcaatgattgctccaaacaatataataagaaattccagacggaaaccctaacagaatttcaaggattttctctagtaatttctcaagattattttccgtggagatttcaaagcatttctctaagaaatacttcaggaatactttttgtggttgcttgaacgctatgaacataccttacatgaggcggaatctcaggatagatttttgtaattctggtattcctgaagctgtaagaagcctctgtaagcacacaatataaacaacaacaaaataggatcatatcaatcattcaatcacttaattatataaatctttaaagaaggcgaaatatacaccgacacgtcggaaagttgaagcggtcgttttagctacttaaagactggtagagccgataaaaccagaaagaataattcatcacagtcgatcactataattaagtgattgatgattgatatggattcagtccatatgcatttacaaatttcttctatattcatgctagattttttccagctattctaaaaatataatatcatcatataatcttagcatctgcactgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagccgtctttgagtaatgagcatttatgttactgtaccacgctggtcaaatcaagatcttgaaaacttcagaaaacatcatatcgtaatttctagatatctctaagaatacttaatcaatttgtatgttattttttagagtagctccttatttacctggcattgtatagcacacatattattttttcgataagttgacgtcaaacaaaatggccgccttagacattttatttggaaaatgtcggtcccacaaggaacatcgatatttttaaagatattcatctttaaaaccagatcaccaatcatcaatatcgattcctaaactagatgagttttttgagaacttgagaaaaaatggtgcaaaaatatcaagaaacaaaaaagttatcgcgatttgatattttttgcggtaaaaaataaagctgccggtttcctctttctacgtaaaaattaatctttgtttgaccatagctccatgaatacttaactgattccaaatcattttaaatcctacaagcaaatttagtagtttttaaactgttcatacaacatatttgatataaaaaatagtttctatatataatatttatatctaaaaactacatataaaggtctagttaccatcaagaacatatatttttgtcatttaagtaaatattagctgttgtattctagtggaacaataagaaaaaaaatctttttgttcccgctattgcggtaaagggtgcttataccctacctagtgccccaaaaaaaccttttagtggaagttcttacttctacaaaatagaaataaacgaaaccagcattacattgtaaacctggtgttgtgcttacagtcgttgaaggagggagaaatgttagttaaacgcctacttaagaagatacaagagaccaaaactgtattcatagatgtcacctgttaaggagattgtgtttgtagggtagggtgtatatagggatcagctcattattggtaaaaaaagtaataatttgtataacaattgatttttattacatctgcccactactgaaaaaagaatttgttataaatactgtagaaataaagcactacaatagcgatgctcgtctcttccagatcaaacaacacaacagaaaaatagcttgcccaaataaagacgcgtaacacgattcatcctgtttcttctgcccattcttgcactactattcctgcttttcctcaaaatctctataaaatccatcagattcctgaaggaatactcccatattttccttccgaggatttctcctggttcttcaaaaacttttttgaaaaatcccatgaattattgaagaaattttcctagaagtatttgcattatttccccaaaaatcactctgaaaactcttgcaataatttctcaaatcggttctgccgaaaatcctccagagcatacttcgggatttctacaaggaatatttccagtgttccttcgggatattgtttagaatatttttgattctcttattaatatattcgaatcctctgagcagaatctcaatagagaaacttaaaagtagaaggagtaccgtgtaccttttaattccctcctaaatgcttatctttgacagacacgcgtatttcgactaccactttccagtcttcttcagtgtcagttactcgtatccaatactatccaacactgtttttgatttccttctatgaaaactcctaagattattttttttctcttaaggtttttcgaaacattcttccagctttattataagcaaacatcctagaactcctgtagatattttatgaaaagttctggaaggtactcttagaacaggaatgggtttataaattttcaatgttcaagaagttttaaatgattcaattgaaattccagaaaaaatccttaagcaatcaaggttcgcaagaattcgtggaagaagttttcctggagtctccagagagagcataatcctggtgtaaattctagactcctacgtgagtcctccactgaatgtacagaagttactcctacagtgttaggaatgttgaagtaaacttctgtgatttccccggagattcttatcgaatactttcagcttcaggccttctccagagatccgtccagaaatgcctctaaaaattcttccaaaagttctctctggaacaaaacaaacagtgtcaggttaccatttttcaaatgtcaaaccgaagaaacagcaaaacaaatttaaagcaattggaatttatacatattttcgaagtgtattacaaatgttttgaaaatgggtatttcactatatttttaggctattcactgcctataaaagcacaactgttccatagtataaacattatcataagcattgatgagcgtacaatttgtagttgctactccgtgattgaccggaataatcaaaattgtacaggtaaccaacagcttgggagcagcataccatcttcaatgtacaatgttcaacggaaggaatgttagtatgacgttcgagatcacgagatcacctttgcatctccatgtttttcacaggaaggagttttttttagtgggagggtttaaagtcacatgctcaggattcacgttggtaagtgatgcgatttatgtagcctcgatttaagaagttaactatcagtgcgtcgacatttttaattgtaatggttatttttagtaaccgtgactaataaataaataatatttatctattttttaccaggaataagggcttatgccgacacttatagtgacgaaccattcatagcatgttaaacgattaaaaatgcaacatcgccacaatacaaatttgggttataacaagcataaaacgagctcaccagttggtaatcaattttcggctgaagtcactacgacgacacagaaaaatagcacgaacccgcttgctttggtttcaccaacagcattgccgacaaaaaaatccaatacggcgacgcaaaaaaacacgaaccggctagcttgaatttcattaaaagcacttcttctggttcatggtgtccaacaagggacttctcagtgttctttctacatttttttttaatatttttttcatgagttccttccataagagaaagatttcaagaaatcttgaagtttttaaaatgaagaaattccgcaaatatcattgaacaatgtctagtcgaaaatatatctggagttttttgttgctgcgtcaagcgttggagattttctgaatggagtcactggaatttgctggaaaaatccatgatgtgaacaaaatgcaatttctgtaagaagtcgtggatgatactttgtagagaatcctgttgtagatcttaggtaaatccagggttgggaaaaaatctgaaattcactctacagtagtcaaacaaagccaatcacagtcagcgaagccagtgaaactcacgcccatcgctgctgtaggcaaaaagtcttgaaaattacaaaacacccgttgctaagggcaacccaaaattactgtagaaaaatgttctatttcccgctgcatttcccgcatttagatccttcaatgacactactgatttagagaaaatcatgtacccaatggaccgatgcacgagttcactaatttgacgtttgagcggtgccgaattcattcgttgccatggtcacgtaaataacacggcaccgcccaaacgtcaaatagtgaactcgtgcattggttcatacaggctacttgatgagattcacgattttaaactactgtagggagagagccacgtgatttttgcgaaattcaagtctactactattaccattcccagcactggataaatcccttaagtcctacacgaatcgttcactgattattcaagaaatccttccacagttcttccatagattcctcaggaaatttctccacgaatacatttaggggctcttacagaaatccctccagcaaatccagcaataccagatgatgatttctcataatttgctgaaagaaatttattcaggagtttctctaggaaatcccttagcagtaaaacgctgcacactaaaaaaaaactaatattacatatgaagtaaatttcacgaaaagaaaaatacttgatgtaaaatatgtaatcacgtaaatttgatggtatgtatttgaatttaaaaatacgtcattcttgcaaaatcacgttcaatgtgactgaaatttgatgtgatccaaagaatattcagtttaatgtgacggaacattacatcattgtaaattgtaattccatacttttggtgggtagtgtacgacgtaaatttcaattgattcattcagcaatttgtagatatacacgtctacagtctacaaatgatctctagaggccaatatattcgcctgagataaacataggaatggacgttcgatgaaatataacaaatacgtcatgtgtcaacacattgcacatttccaacacacaacatctactgtgtgcttttgtgagcctatgcacctacatatattgcgaactgcactcaattaacacacattgctcagctaatgctcttgtacgtaggcaaacgaaagaagcaaaaaaaaagtgtgaaaaactgcaccgccgaaaacaacaacagcaactcatctgtgaaagaggtgagaatgcacatgataataaatgcatcggagaaaaataccgatgatagaccgaaaacaaaagatcgtcgcccattatatattcaagcgcccggcactggtacatgcatatatagatgcataaccaatcagaaggaaaaaaatgcgaacgatgagcaaaccaatgagagctaaacgcattttgcataatcgatctatcaaacactttgtgaaatccagattttgtgtgatcatcgccattaataaaatctgataatatattttgtacagataaaagccgaccgataattatagctaataggaaacggttcgatgaagtcgacgtgactggcaaaatttcttggcaaatacttattcacaaccaaatgaccgaccgggaattgaacccagacaccttcagtgcaaactctaactactcgattaaggaaggcccaacattgatcagatatttcatttgaaaatcaaatgatgcaagttatatatattgcattttgctttctgaatgttttaaacatgtttaaaaaaatgtttgagggatttttatttcacttatgatgtaaacattatgagtgagcggactatcttcatatttccacaagttcaaatctaattcatgttgattaccttcagcagtccaattactgagaccaagtcacttgatttttacacctatctatgaattattcacgaacagtttgcagtgcaaaatgaaatacatatatttcagtgcaaaagaaaaaaaaacaaaccacaaaacaagcgcccgaaaaagtgcaacgaattacattatcttttatcacaccgctctcaattaagctgacttcgtgacatcatccgcaccgcaccgaccgagccaaaaagcaatggccggtgcgggtgtttccatttgaccgcaatttggcaggcactcggtactcgtcatcatccgagtgatgaacaataatgcataaccaacgaagaaataaaaaccatcacgcacggggggatttgatacctatatctcttacttcctcacgtcctccagcagtgtgctccagtttcactttcatctcggtccaaattgtactgaataggagaatgtggggcaagatggtcaccataagctgaagtttatgctgatcctactattttcaagtatgtagtatgtccaatagggtgccaatggaatgtatgggaaaaattttgtcatcgaatttcaaaaaatggtagtgctcaaaagttttgtctcctcgaaaaaagtccccatgcaaaatttgagctcaattggacttcattaagtggacccccaaagcggtcaaagtttggattttttgacccatgaaaaatctccaaaggggggggggggtacatgaaattttctgaaatcgaaattttttttttgatgccagatgtcttagaaatgcatgaaacgtcgagatctggtgttatttggaaaatttttttttttttgaaaaatcgaccttttgggacttagtaaatttttgagttgggggagtgaattgaatttgaaatgaacgatttgaattcaattgctgagaaattcaaggcaatagtattgaaacatatcctatatcattgttggccattgaaagcatattatatgtgatatttcattagggtggttcatttactttccattagggtggtcctttttgttaaaaaataaaaaaaaattaaaaatagaattttaattgaatattgaagacaatagtattggaacatctctcacattatcgtaagccattttctacatttaatatgtggtattttattagggtggttcacttatgttccattagggtgggcctttctttcgaaaaataataatttgaatgggatattaaaaacattagtattttattacctctttcatcatcgtaggccatttccttcattaggttcgtgatatttcattggaaaggctcacttatattccattacggtggtcctttaaaaaaattgagaatttgaatggaataataaaaacaagagtaattaaacatctcctatgtcatcgtaggccacagttaacatataataagtgatatttcattggggctattgttctcagttttgcataagggtgatcacttaatttgtaaattaaaaaaaaattctcaacagatctaacaaatcaactttgtttgtatagttttgaatcatgattcttcattggcatgcaactcttcgttaagatattttcattaaggttttcttttgaatagttaaaataaaacgttcaaataacaataatcagtgaattcagtgaagcacaactctaactgccataatcaaaatacagataaaaaagaatgaaatattttttgacgtattcaaatttatgacatgatgggcgacgatgaagggcaacaaaagtgtttagtttatattttcaaaagagattctcagccttgggctgcttcattcccgaaacaaaagtacgttgccttctgcttgctatagtacacgcgattcggttgtgacaacgtaggcaattccagttttaacaatcagttctcgtttattcttcaaagatttaacaaagttccttatagaaatttcgtcggaatttcatatgatttttttcgttggagtttccaatggaattttctttggagtttcctttgaaattttaatcggaatttccttcgaaattccttttaaaaatttttattggacttttctacgaaatttcctttgaaattttctacggaattttcatcaaaattggaaatttatcctgaatttgcttcggaatatcctgtggaattttcttcggtatctttagaagtgcccttttgaattttctgtggtatttccttcgaaatttcctatgaagtgtccttcggaatttcattctgaacttttcattggaattttcttcgaaatttacttcggagtttctttttgagtttccttcgaaatttgcttaggaattctctttggagtttccttccgaatttgttctagagtgtgtttcggagtttcctgtgtaattatctttggagcttccttcataattttattctaaatattatttggaatttctttcgaagcattggaatttactttggaatttccttcgaaattttccttggagctttcttcggaatttcatttgggatttcttttggacctttgaaatttagtgcagaatattcttagaaatttcctttacaattttctctggaatttctacagagttttcttgagaatttccttacaaatttgctttggatattccatagaaaattccatagaaattttctacgcaatttccttttttcattgcaatttgcttcggaattcgatttagaattttctttggaatttccttagaaattcccttttgaatatgttttatcacaatagtcctaacaaatggacgcagtgatctcacacccgacagaagaatgttttggatatttttcagaattgtcgtcggaatgtcctttggaatgtgcttcagaatttctttaagaattttattcagttttttttttaatttttttttcggggtttcccttatattttgaaagtttccatcgaagtttcctttggaatttcttttggagctgcgattttttaccttcgaaattaccttagaaattcctttcttgaatttcattcggaatttgctttgaattttttatggaatttcccatggagtttttggaatttcctttggaattttccacggaattttcttcggaatttcctttggatttttttcggaatttcctttggaatattctacgcaattttcgccagaatttcctctgaaatttgcttcggaaattccgttggatttttttttagtttccttcggaattaactttggaatttccgtcgaaatttcattaggagtatcctttaaaattctttgcagttttctttgaggctacttatcaattttcttcagaatttcctttggaattcctttattacttccttaaaaattctctttgaaatttctttcggaatttcgtttgatgtttacttccaaatttgttatggagtttcctcggaatttcctatggagatttcggaattttatttagaagttttgattggatttttttatggaattttcctttggactgttttacgtaattttcatcagaatttccgttgaattttctcggaatttactttgcaatttccttcgaaatgttttttcggaattttcttaggagtatccattaaaattccttagtattcttcggaacttcatatctcatttacttcagaatttcctttggaatttcttcatgaatttctttcagtaagttgcttcaggaagttattttggatttctttgaaattactttcggaatttccttcttcagttcttcaaaacaaatttcggcttttcctttagaatttctttcggaatttcttctggaattgccttcggaatttcctttggaattcgcttcggaagttcctttgaaattttttatggaatttcctttgcaatttctttaagagctggcttcggaatttcctgcgcaattttcgtccgagttttcttcggaatttgcttcggaacatccttcaaaaatccatacggatttatttttatggaatttctttttgaatttgctttggaatttctttcgggatttgctttggaatttcgtttggaatttcttttggagctaccttcgggatttgatttggaattttctacgttattttcgtcgaaatttactttgcaatttgcttcggaatttcttctggagtttccttcggaattccttttggaacttcatgttaaatttcattcggaatttcatttggaatttcttttgaagctttgaaatcatttcggaattctcttcggaagtacctctattttcgtttcctctggaatttcattcggtatttccttcggaattttctttggaatttccttcggaattttctttggaatttccttcggaattttctctggaatttccttcggaatttcctctggaatttcattcggaattttctctggaatttgtttcgggattttctctggaatttccttccgaattttctctggaatttccttcagaattttctctagaatttccttcggaattacccttggaatttccttcgaaatttcctctagaatttcctgcgaaatttcctctggaatttcctgataaatttcgtctggaatttccttcggaatttgttctggaatttctttcggaatttccactggaatttccttcagaatttccactggaatttccttcgtaattttctctggaatttccgttggaatttcctttggagtttccttcggtatttccttcagaattttctctggaatttccgtcggaatttgcaaaactaaattggaaaggtcactgaggctcaatgcttgatctctgagatgattgcatctgaaatcacgaagtagcaagcggattttgtatgagacgaggcatccgaactgattcagcttagtgaagtgttgcattccgaatgaaaatctcgcaaaacttttcaaaaggacctttctaacaatgagaggctttctagaaaactcttttgttgttagctaagttacctttacatttttcgtcgaacattatgcaaatattatgtagtagtccataccataatctttcggtctgtagatattagggtggaaatttttacaatgacaccctaattaaggaaagtggacgagactttttcgagaaatcttggtttcaaactgtacgaaaaatgatgcaccctaatgaaatatgttaacagtgtcctacgatgatgtcgcatgaattcaaaggaatttaaagcctctctaaacaaaaatgaagacaatggcctacgattataagagaggtgttaaaatactaaaaggatcaaattcaaaatttcttgatttttttttaattttcggcaaacaccgatggaaaataagtgagccaccctaataaaatatcacgaatctaatgaaggaaatgccctacgatgatgaaggaggtgataaaatactattgtttttaatatcccattcaaattatgatttttcgacagaaaggcccaccctaatggaaaataagtgaaccaccctaataatcgcagcgtgcgctacgatgaatctgcacagaatgtatgagtctgctccactgggctcggtcctaagccaatcgcttccagtcgccctgaacgttaagccacgttaagtgcccttaagtcctcatcaactgtaaagagccatcgtgtgcgatgtcggctgcctcgtccaggttctctgttgaatattatctttgcttgaatgtagtttccccgaatgtcatttccccaaacgccagttctccgaatgacccgttttcccgaaaagtgatgcagttcaaaaaaatgccaaagatgacgaggtcggtgaaactcgaaagaatcgccaattcaacaaagaagggtgcatatctgagtgttcgggtaactggcgttcggggaaacgacattcggggaactgacattcgggataaagtagcacaattacataaaaaatctaataagattttatttttaagtaggccttccttagccgagtggttagagtccacggctacaaagcaaacccatgctgaagttgtctgggttcgattcccggtcgatccaggatctttttgtaatggaaatttccttgacttccctgggcatagagtataatcgtacctgccaaacgatgttcgaatgcgaaatggcaactttgtcaaagaaagctcctgattaatagctgtggaagtgctcatgagaacactaagctgggaagcaggctctgtcccagtgaggacgttcattccaagaagaaaaagaagaagttataaattttcaaattatgataactttccaatttgatccactagcacatgtgcgaattttcattcgcattgaaaatagtcaattcaaaaatgccaaaaggtatataaaccttttgatcatgaaattgtaaaaaatattttttgcgtctaaaaacaacaaatagccataaccgtttcaaatctcaatgtctaaaatgtttggagtgaaagtctcttacttgaacagcatttaaactacaaggacatttataacattagttgagctaaaagtctcaaaaaaaaggctcacattaatttgcatcacaaacggtcattggtacaccgcgatattttttaaagaaaaatgcatgtttcatgttaacaaagtaacaactagtatttcaaaagattattgtgtgcctctaagatttttttttcaaaatattgttctttctaccttatttatcgttcctcatactaaaaatatcattctgacggaaatttatggctaaaactgaggtttcccagcttgcaccccgtactcccctacacacagccaccgttcgctcaccgatcgtccagtagtaacataacggctttgctggcgatcgatcgctggtgcatcatcatcaccattttttgtaattggtttcttccttttgtttctcttttttttgtcatagacccaatgcaccgccgtggttcagctttacatgacgcaatcgcccgcacatgcttcctggatgaagaaatggaccggggcgttgtgcttcatcaaggacaacatccggaagtcgtacttttttcgcctatactgccttaaagccaaccgaatggtttgggaacaggagatctacaacggaatagaggtcaccaagcccaggccgtttctgatggtgttcgaaggccaggtaaggcccaaaattgatttgaagaccaatttaatgaatttgacttatctttcttcttcatactacgacaggaaggaatcgtggcgtttaactttgccacggatgacgaggcgactgcattcatgaacacgaccatctcaacgatatccaacagaaaccggcgaagagatggtaagtttcttttgtgattgtccttccgtttcgctgtgggcaagggacttcctcactccagcctcctacaagacaattgacatcaatccacagcatgaaacgtacctaatgttcaccacgagcattgacattggacgctatgtataggtatgccaaaatatcagcataatcttacatatctaattgcaaatcagagagtcgaagggccctaatttcatccgggaattacaaattaccgaaaaaaaaaaaacttatgaatttaaagaaagcaccaggaaaatatgtttttcaaacataagaatactagttggttcaaatttcaagggctacgcgagaaactaaaaaaaaaatcgggaggtgtaccactgcttgacacttcacatcatgactaactcatggtaaattggtagaaagacagtaggggcacagataacagatgtttatgtccgattttgaaactgtgtaagacaattgataatctttttaaacggcaacacaagtagcaacatcatggtggcgcttttatcgctaagttcctatggcaatgtcagtggtgaatatgaaacatttcaagatacttatattcaccactaattgccgcaatacgttgtgtggcggcgctagtgttttcaacgtattttggttcgaatatttacacaaattttcagatgatttttgttctagcataaacatctgttatctgtggtaggggtattcacttaaagctgcgtaacgtgtgattttgcgtaattgtagcgatgaaatatttcgaatgaaataattctcttctgactcagtgcgatgtcaaaagagtgatcaataatctagttacccgctaggacaggacgtgacagctcaactaagactgcccagttgtttttcggccgatatccttgacgatacaaaagccagtgctaccagtattcattttaagcaaatcttgtgaacaaattcaaatatcaatgcccataatttggttgtttcttgcacgcttcattcatatagtgcaatagaggatgctttatttaaaaaaaatcaagtttatattagaaaccggcaatacttgtagagaaaattgacacaatttccattatattgctctcaattaagtatatttgattgattttagtattgtaggagcacatgcggaaaagttaacatggaatataaatggattcgaaacaaatagacttcatgaaaaattttcaatctttttatgaaactttaatttatgatctagcaacacggccgggctagcaacaaagtgccctgttgaaatccaactcaacgatgtgaaagtaggcctttgccaaaacgaccaatcagaagtggtcttttttgacaggcaattggtttcatttttgtactgtgacctgtcacgtcttgtcttaggttacccgcagcaaacttatgtcatttcaacgattgttgttgtttgaacttgaaaaatggaatggaatacaggggataggcaaaatgattgagataggcaaaattttgcccaaattcaaatgcttataactttatgaaaaatggatgaaattggatgcatctggaagcagtcaacggcaaatttggtcaagttttaggaactttctgggccatgcatatttgccactggacaccggagatgttccggattttctgaggtcatgtccaaatgtcattttttctgtcgcttgtatttttgtgcggtgtaaagttagatagatgtttgcaattttcctagaaactagaactaataggaagttgaatgccactggacgcattaagattggttggaaatcttcagaaatataaccatttccgtaaaactggttccggaaagcatggtcagtcatgtttgtatttcaaatcatgtaaatattatccggagctatatccaagcggacagcaaccttaaaaatgatgtttcctgcagcgtattcagaaccattagatgcacagaccactctatagaaggttccagatacccccggggaagtggtcaattacgaacatatccggaaccatatcaatatgggcattaaacttcatgattttcaaaggttatgctttccgaagctttccagcatcacccggctgccatgaccactttatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagatttttgaagatgatgctaatagaagtatttaacagcgcaacttatttatacgaccactgtatagtaggttccatggaccctgggggataaggtcatgtttcgaattggccacatctctaggagcccctggaatctactatagagtggttattacatcatgtgattctgaaaatgatcgccattttccaagtcccatggatcttactgtttatggtagaatgtgattctaaacagatgaacggacatgttccgaatcggccacattccccggggcacctggaacctactataaagtggtcatggcagccggtgatgctggaaatgcttcggaaagcataacctttaaaaatcatgaagtttgatgcccatattgatatggttccggatatgttcctaattgaccacttcccccaaggtacttggaaccttctatagtgtagtctgtgcatctaatggttctgaatatgctgcaggaatcatcatttttaaggttagtgtccgcttggatatagctccgtataatattaacatgattggaaatacaaacatgactgaccatgctttcaagaaccagttttacggaaatggtcatatttctgaagatttccaaccaatcttaatgcgtccattgcattcaacttcctattagttctagtttctaggaaaattgcaaacatctatcgaactttacatcgcacaaaaatagaagcgacagaaaaaatgacatttggacatgacctcagaaaatccggaacatctccggtgtccagtggccaatatgcatggccaaggaagttcctaaaactggaccaaattttccgtcgactgcttccagatgcatccaatttcatccatttttcataaagttataagcatttgaatttgggcaaaattttgcctatctcaatcattttgcctatcccctgtaaatgtaaaaacggaaggattttgttgctttttgcagatttgactgctgttttaaataataattactgaaaatcatgaatgtgatagttgcatttaagagatgaaaaagtgtcgttaagttgtaaaattgtgttgcacagcattaaagtgattgaatggaaagacctacaaagaccctcctaattattgacaagatttagtttccatgactgttcttcgggcatttcagacctcttaagactgcctatcaaacaaaatttctactcgtgaatcttatctcaagatttgctgaccggaaaggagggggaaatttttgtttgttattctcatcataacaacggaacaaggataaacaacgccttcctagattgaaaaactgacgaatgtcaacaatttgaaatgtttccttcacagtttacgcgatttcgtgaaagatttgagttaatcagtttaccacgatatacgcggggatttacgccgttaagtgaatacccctagtatttttgttcaaaatgttgtcaaaaatctttgatttcctggattttaggtagattttctatcaattcttaccgatttcttgtgaaatgtattgcagattactagcggctacatattgaacaaattcaaagaagatcttatagaacatcatattgacatactgacacatatattgagctgttcggtaatccaatccgcatattttcaatttaattaagtcattacgcgtggtaaagatggataaatcatgaaaaaaatctacgttaatgagtgaaattataataaaaaaaatttgctcaggtgggattcgaacccacgactttcgtatgttagacgaatgctctaccaactaagctaccgataaacttggtgacccaataaaagtttcgaattcaatacacgtattcattagggcgattcaaattttaaaaatgtttgaaaatccaatcttccatatgctctttaccatcttaccataaaaatagtgttttatgaaattttcagctgtctagatggtgatttaaaggtggcccaaagacaatgtaggattatatggaaatttctatggagaaatcttgagaaatgttctaaacacgcaagtactgtaatgtaagtagaaacttatcatcccgtaatgaaaactcattcttcaagccttcttcaaggacgttgctgaagaaacaaatcccttttgagctcattttgttttggatttttgtacatgtatagccctgcaatagcccatattaaactaaataatagcaaacaaactcatgaatatctcttctgcattccgtcgggtttaatttctctcttcagcaaatttctttattatggtttgaagaataagttttcactatgggattataagtttgtacttacattcaagtactagcgagtttgcaacatatctgaaaatttctccatagtaatttccatgtaatcctacattgtctttgggccaccttttatcaccacctagaaagctgaaaatttcacagaatattatttttatagtaagaatggtagggaacatatggtagattggagtctcaaatatttttaaattttgaatcgctctaatatcaattgatctcatgtatacaaacgcgcgcagagccagtgcgatttattatggtgaaacatctcggaatccaaagatggccgacttgtgcccctattcacgttttcaaaggcactaaactggagaaacagttggcaaacgtttctgattttcttattttaagcttcctgcttgttagatggttatattcttcccgagatcagtgccttagaagttttagtgcaatctcaaaagtttggttccaaactgtttcaccttaagtgctgaaactgatagtcaacaactgtattgtaaaattgtatagataagggaaagctatcaacgtgtcgatcgcattcaagtgacagggtgtctactacctggaaaaaacgggaaaacctggaattatcagggaattttattcaaactggaaaaaaactggaattctcagggaatttcgatcacgatcagggaaattattttgaggcagagattcatgatgttcatgacaaaggatttttgggtcataacccagagctaccattatttgccagaaaactctattcattcgaaaaaaaaaatctatatgagctgttttgatcctgagtgaggatcctttcgagtatgaaattgtatcagcttaccaacacatcaagcgtgtgctagaataagggcgtaaggcgcatgttcgatttctcttcatcgatcctctcttctgtgaataaaagtgacaagacgcgggtttgttagcattttttacttcagaccactggcagcgatgcaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncactacagcatattttttatgaattcctccgattgtaggaacaactattccaacacaattttttaggaatttcgtcctgtttttccaggggttctgcgagatattttttttctttttttctcaattatcttagcaataatcttggaaaacttctaagagattcttcaagagtgagtgtttctgaaaatcaagggtgacctaagaaattacataagtaactgtaacagaagtaagcctaaaacttgctttagcaatacatcacgaatttttctcagtaatttctcagctctctggaaaatttcattaaaatttccttagacgaaaacatttcttagaattaatggaggaatttcttaagaaatcatagaagcaatctctggagtgattcctgaaggtgtgacaaaattgtagtcaagatcataaaaaaaaatccttggtgacatctggacaagtctctggttgaatattacaacatattttaaacgggagtcttggaggatgttctagaaaaactgagtggagaatcatcagattaaatcctagaggactaagggcattttcgaaaaatatctgaaataatatatgaaggaatttttaatagaagccctgaggttatttttgtgatattttttggagaaaatcctggttttatttcgaaatatccaaaacaaaatttttggaggaattcaggaaaattcttggagagtgaaaatctcaataaagatatcagtctatgtctctcataatgtcttcgtaatacatcaatggaagtttgccttttactgacatataccagatttgttgaaatgtcgtcataatgtaacgaaaaaataaaaaaaaagttttaaaattattctcagacaaatgtctgtccgatcaaactatttcatacaggttcctgtaaggtttcgttttttgattactgttttgtctcttttcggtcttttttagttactttttagtctctttctttctggagagaggtttcttaatttcctatttccaagaaactcagtcaccaccaggcctgcttcatgcacaatttttaaatttattgaaaaatatttggtttgagaaaaaaaaaacgtttttagaaaagtaatgtggaatttaaacaagttcaaatttaaaatttcgtaacaatcatgattaatttaagtttttcaaatgaaatgcaaaagttcatcatttatttaaattgccacagttaaatgttacgtggtcgaacttgattacccaggggcttgataatccgtgttgctattatccaaaaaaatggactcgggatccagcagttttatggattatttgtattactttagatgggtatatatctacttaaatatgtagcagataatcactaacaattgattcaattttattaagatattttaaagaatttgttttttttttgcaggtcagtactgtatgattacttgctaataaatcggttaccttagtatttattgccacaaatacaaataaagttttacttttgcgcccatcaagctgtcttagttatttaaacgaccaacctcgaatggtaaataatatgtactaaaaatattttcaagaagaagcatactgatgtacttgaaagttccattcagttcacagagctcttataaacaaaacaaaatacaatacatttgaataaaacttaagttttggtattgttagcatcttcatattgtgatattggatattggaatggcttcagcatgctttgaataatgtttagaagtgtataaatagatattaaatggaaaacacttcaaaatttgtcattagtttgttttaaacatataatattagagtatttcttgaacctggatttttttgcaaaacctggaaaaacctggaaatatcagggaatttcatttcgataaacgagtagacactctgagtgacgacatggatacggtagtttagttggtaaagcactcatctagcgtactagagtcgtgggttcgaatcccacctgagtatatgtttttatcataatttcacccattatttatccatctttaccacgctactaataagatgctagaaacttttctagaaaggttatttagggatttctggcgaggttttgatgagataatagatttcgatatagatacacggcaaattttccatgagatctttgcaagacgggaatcaaaacgatagttgacctgtttcttgaaaattatttgaaagatcattggaaaggcaattgaaggattgctaattaaggtttttagtggatttcttggaagatctactgaaatcctggacagattaatatgggattccgtttacgggtttgtggagttactgattggtgtttggattactaatttgaatagcccttggtctatgacaaatttctaatgagacccctgacgagattttgtgtagaatcctgtagatttacagtgaattctttcaaccattcccaacataaattcatggattcatgggaagacctctgatgaatatacatataatcagcgaggtcttttgggtattattaggcagatttttgttgtgttcttgacgagattattggctaaatctttgatgaattgcttggaagatctttatttttttttttgaattcatcaataaaatgatcttggggagatataatttttgttaaaaagatctttcccaagatccaacatgagcttgtctaatcaagaatttctctaggaactagcaattccgaaagcatttttaggagaaataggttgaatggttgttgaactttactggttttgtggaaatataatcagagcagaaacttgttcatataaatgcaaaatttttttgaacttcttatgaattgtggatggacgtttagttcatccacgtccaaatcatgggcaaccggaaattgtaaaacatgattttgaatggacactcttaaagacttggtcactatttcaatgcaagtatccaaaaagttatttccagcaattctcccagaaattcgtcccaaacgcaaagtaacattttggtcggttttaagttatcattttgtattaaattcggaacacgtctaatatcccgaacactagacttttaattgcgattttttatgacaactatttaaattactttacagaatcatcaattcttctatgattcaagtcctcacatttaaagattgtgaaaatatcaaatcttacattgaaatcacactgttcggaatacgagtcatgttccaaatttgggacataacggtaagaattaagagaattggctgtttttggcttccatacaattcgtatggaatgaacttcaatggatgattttgatttgattttgaagcacgatcaaagcaagcgaagcaacacatcccatctgtagcggtccatgatcggcaatgttgtaacatgctcgatgaataagagtagcgaacgacagaagcaaagagagagcgatgatagagtatattttctcgcttgtttaccattggggataggtgttttatttcactggcacgataaacaacccccgaacattcgatagcaatagccagagttgggaaaagttctgaaattcacactacagtaggcaagcgtaacaagtcacagtcaacgaagccaatgaaactcacgcctatcgctgctgtaggaaagattccttggaaatagcaaaacactcgttgctaagcgcaacccaaaactactgtagaaaaagttctatttcccgcatttgcagccttcaatgacactacgggcccattcacaaatttcataacgctggagggggtgggtgggtgtcctaacgatgttacggtccatactaaaactgaatgatattcatacaaaaagcgttacaagggggtgggtgggggtcaaaaatggccaatttcagcgttatgaaataaatgaatgagccctactgatttagaaaattcatgtacctaacataggctacttgatgaaattcacgattttaaactactgtagtgagagagccacgtgattttcgcgaaattcaagcctactactactaccattcccagccctggcaatagcacatacaagctttgatggtaaatccaccaaaatggctttggtgagtgattttgacggatagcgccgacaatttttgtcgcataggattcatcgaatgtagcgtggttgttgcaccatggtcagattcatttcccgagcgcgtgcacggaaagaaataacagttgtgatttaaaaaaaacagtagcggaaaatcaactgatgatcattgtcgttctactattatcaaacgttttaataaaaataaaatgcttttagaagtgcgcagcaatggtaaatcggtctgatgtattctgcgcagttcatatgtattttccacacgttctcctataattgtttttaatccacttcgataccgtcaatccgcccccaaactggatggcgtacactcagcttaaggtgaaacagtttggaatcaacttctaagattgcactcaaacttcaaaggcacaaaactcgcgtataaagcttccaacaacagtgcactttttattttggctttgtgcactagcagaaagcttaaaataagaagatcagaaacatttgcttactatttctccagttttgtgcctttgaaaacgtgagtaggagtataagtcggccattgtgccggccatctttgaactccgagatgtttcaccttaacgcaatttataattaagtattgagttgtatatattagtatatattagttgtggtgctagaggacatcttgaaaatccaatgagattctttcagaaacccttctgaaattattatgtgtagttatttctttgatcgctctgatttttccaataacctccttgggacttcctattggactatcccagaaacccatcttgggttattttggaaatcctttcaggattctgctgtaaaattctggaattctgccgaaaatgatttaatgattgctttccagtgtaatggaatctattttaaaaatctgggttcggggattcccacaaaatttctcgggattccttctggaaatccaatcgaaattattatttaaattctgatattttcctcataatccttcagtatttcttccgtgaaactctttgaaagttcttcaaaaatccatttgagattctttctgaaaaatgtcttagattatacctattattctggaatactctcggaaagacgcctgagactataattaaaaaaatatattatttcacttcactttcttccgtgcaaattcttgggattctttcggaaattcctctggaattctttaatcccaatggaattctcccagaaatccctgtggaatacttccgaaaatcctgctaagaagcttcaagatgacgggtattttttaaaatctttatttatggaaatcatccgaaaattcctctgtaattgtttggaaatcctccttatattcatacagatttattgctattgattttattgtttctgcctgagataattttgtatattcaaaatttttccaaaaattccttcgtgattctttagattttttttttctaagattttttgagaaaaaaaactgtgattcttctggaaattcataaggaagtgtttttgatttttttcgtgatttatcagtgattttccttggaaattttcttaaatccttggcagaattttctgaaaatccctcttgagttcaaatggaaatcctccaagaaaactaccggacaaccactgggactttaaaaaaatacctatgagattctttgattactgatttctttttctgagcatcttttgaaagtgacttttaaatggttctggaaattccatttgaaattattccgtaaatctttctggagctcttctggacatcgtaattattctggaaaatattcatgaaatcgtctggatgtctgtgacatttctttgaatcttcagggattcttgcgaaataacttctgggattcttttggatatcactgtaaaaaacattcaaaatccattcgaaattctcctgagattctttcagaaatttacgagaatccttaaaataatttctttagaaatctccctgataatattttagtgatttctctatggtccttctgtaaatcgacctgggattcttccggaaatcctcctttaattccaaagcaatttccagaagaattttcagaaggatatttttaagaatcctgtatatttttccctaagaatctcaatgtaattaaacaaaataccagaacaatttacggttgaaccccacaaaaacttccggtggaattcttgaatacttatcattcaagcagaattccagtcgtatttccggatgaatttcggcaggttttacggaagaatcccagcagaaattcttgaaaaattccagtaaaatttctggaagaatctttgaaaaatgttttgaagtcctccagcaggataacagaaagaaatctgggggtattttagaagaatttccgaaaaaatcctggagagatagtcgaaagaataacagttttcttgaaaaattcaggatactcccagattctagaggtaattcgggaagaatttctgcaagaatccttgacagaaggatttgaaggatcctcagaaagattttcgaaagaatcccagaaggcttcccgaaagaatgctagaaagatatctggaagatttcctacaggatttttggaagagtcccagacaaatttcaagaatatggacgtaaaaatctcagtggcctttctagaataatttcagaaagattgtcggaagcatcctcgaaagtattctaaagggattccgaaagcatctcaggtgatttccggaagaatgccagaggaatcataataatcccagaagtatttccggaaaaaggccagagttattttcggaggaattctcgaagaatttgtagtagagtcgtagtacattttttggcaaaatcctctaaaaatatccagaagaattgcatcaggatttttgttagaatcttccattgaatttccgaaagaatcttcgagaatttcgattcgaatttgatttccaggatttcaaaagtaattcttaaggagataaacgcaaactcacttacagatttatgcaaatattccaataagatgtccagaagaatcacaaaggatatccgaaagaatctcagatatagtaccggaatgctaacgattttttttagatgagtccaaaagcgatatctggaagtattctgtgatttccagaagagcttagagaaaaatcagaaataatctcaagatttccagaacaatcccagagaggttttgaaggattcataagtggtttaaggaagaatcccaggagggaaattccaaagaattctggagtaatttctggaccaatgtcttttttatatgctgtatcaatatttacaagtaattataataaataagtatttatggaacagtaaaaattttatttgaccgttgaattgaacgacaattttaattagaatgtgcatccaccatatcatccctctcagaagtattgtgattctcaatatttttttgcggtgattcagaattgtaatcacatactagtttaattgtatgtggtgtcattcaatatttaaaataagattcgttaagccgaacatgttgctccttcgacatgaaccaacgagcattgcttgaaataatgagattttttcgattactttgattactgatttctttttctgagaatctactaaaagctactttcaaatggttccgaaaattccgtttgaaattattccgtgaatctttctgcagttcatctggacatcggaattattttggaaaatattcatgaaatcttctggatgtctgtgaatttcctttaaatctttcagggattctggcgcaataacttctgggattcttttgaatatcactgttatttggatttaaaattcacatgggattatttcagatattaacgaaaatccttcatacagaagtgatgcttctgtaaatcgccttggaactcttctggaaatccttctataatcccaaagcaattctcagaaaatttttcagaatgatatttttaagaatctcaatggaatttctgaaaaataccaaaacgatttacggttgaatctcacgaaaacttctggtagaattcttgaatgatatctggaagaatgacagtcgtatttttggatgaatcttagcaggttttacagcacaatcccagcaaaatttaatgaaaaaattagaatagaaagatatccgaaaaaaatctccaacaggatttttggaagagtcccagaagtatttcaaagatattggcgtaaaaatctcagtggaatttcttgaagaatttcagaaagatttccgaaagcatctcaggtcatttccggaagaataccagaggcattctcataagaatgccagaagtatttccgaaaaaaagtttagagttattttcggaggaattcgtgaataatttctagtagagtcgtacattttttgataaaatcctctttaaatatccaaatgaattgcatcaggatttttggtaaaatcttccatagtatttcgaaaacaattttcaagaatttcaaagaatttaatttcctggatttcaaaagtaaggagatacacgcaaaatcacatacagcgttctgcaaaaaaatccaaaaagatgtccagaagaatcgcaatgggatatccgaaagaatctcagaagtaataccggaatggtaacgttttttttttttttgatgaatcccaaagcgatatctggaagaaaatacagaaataagattttcagaacaatcccagagaggatttgaaggattcatgagtaatttaaggaagaatcccgggagacgctcccaaagaattctacagtaatttctggaacatttttttttcatatgatttatatataaaaatactttgattcaaatatatttcttgtgtagcattaattttcactgcagacacagctcgtaacatcaataataaatttaatttataaatcttttaacataatgatccttccacaagaaccaacaacgagcattgcttatattaagacattttatcgtaatgcacaaccagcctaaacgttcttccccttttgtttatgtactaattataatttcaaattattttaattaaattagttgtaatgtctactattgtacacgtttcaaaaataagtggagctgcttttaaaacaaactttaacatcgatcaaccaaaccatagaatatccaatagcggaaaaataatattaatatccgatcattgcaaatcgagccgaactggcactctttccgtgcgcacgcgctttctgcagagctgtcaaacagagctgtctggttgttgcagatgaacacttatcgtgtagcgcgacatcatcattgacactaagtttgcaactcaccagacaaacgataggtgtaattaacaactgccctacagtcatctctcccttactcgatattcaaggtaccatcgagctagggaggtatcgagttatagaacacaaaagcagtgcaactgcgttccaagggatcatcgagttagccatgaaaaccaaccttcactatggttctctaactctatatcgagatacggaacatcgagtaagggagagttaactgtacaaacagacgtaacacttataacaaatagcgatcaaaatcatagtcacaaggacatgtacgcccaatgctaaaatcgatgtgtttgcccgatggaccaacagatggcggtagtgtatcaatttcatacgcgaacaaaacgatacgagcgctgtgggtggtggattgaccacctaccatttatttgaatcggccgttacggccggtgacgatagcgtgacgtctgtttgtctgtggcaatagtggccccaagatttggagtttgtttacaggggttttatcatgcactgttattttcattaggtattcgcgattctacatcattacattgatctatgaaactatacaaaaaatcgaaattattttattgtatggttagggagcattcaaaaattacgttcatcattctggggaagagaagtctacgaaaatgtgacaattcttgcattaggtactgtaaaaagcgcaacaggcgattgaggggatggagtgtacaaatcccgttgaacgttaataactgtggaagtgctcataagaaaactaagctgtggagcaggctctgtcccagtggggatgtaatggcaagaaaacgaaaaaaagtgtagaaatcccaaaaaaaatgatggacgtcatttttcaatcttcccttactatgatggtcacctcaaacaatttttcaaagcctattctatacctcgatggcgtcgataattcccctaaatatcgacttattgagggttgaatgtatgatgaaaataacgttcgataactgctgcgcatagtgaggaacatagttgaaaaatggttctttactattagaagaataagaatgtgtagataaaataagttgcattttaccagttatgaaactagtgcctacgtactaacaatctgaaatatattcttctaacggataatcaatttggacattttttaatatttctacaccgattttatttttgactaaagcaataaacgtaaatttgtcaagaaaattcttcgcgtactttttattactattgtactgcccataactacatatttgtcgcattcgacatttttgacaattccgagttaatcccggggagagtcatcaaatggcaaatactttcgatcaacttactgaaatctgtgagattgttctagaaaatccgaaaaaaaataccaagttgttttgtcacattggcaattgtaaccgcataacaatcacattgagattatacacgagcctcatagagcagtagcaacgaaatttctatcagaattattttctgactattaacccaatatgcgatatgagtaatacaaaatttcagcctcaaataagcacttttgaattcttagtatttttttaatattagtatcctcccaaactgcagtgaaatgcaaacttggtatccctttactcaatgcctacttttgtcgaatattacacataaggtaccccggggcaagtgagaatccggggtaagtggggcgtttcgtcatagctcaactagaaaaagtttttaatgggggtattcttctagaaagttgaagatacaatgacaaggaatgtatttagtactaaacatattgttatttttattaccatgtgttcatgtaacagttgtcagttcagcgccattttcaacttgcatgacaaattgtgacacgtttcacgtcttgcattgactcgcaaaaaataaatgtgttttaaatcgaatttccatcagtaagctataatgtttagtattattacaagctgctaacgataaaccagtattttgttttcatttcatatgaaattttcgatggtctatcttaccccaaaatatatttgtacctggggtaagtggggacctatcaaaacaaaaaccagaatcaaaacttttcgtacacgtttcatacattttgctagagagtagcactaaaacattcaaacaaatgatgtttatcaaaaaagatcaacctcatattacgtaattgcataagagggagaagaaaagtgttattattctttattatttaattatttttttatttttgaaatagactttaaaattgaacaaacacacagctgaaatttgaaatgcatcatgagaacgattacttttctatgttatttgaactttattttttatttctaccaaattaagtagtgatggaaaacaattccatcccataaggtggttttctgccatgcatataaataataaaaaaacatgtttataatttcgtcaattattgattgtttatgtgcaacattttatttaacaacttataagtgatacattttgaacatgttgaattcctctttacgcttttattgaggaaattttcagttaatattaaatgtgaggtgacaaactattaaataaaaagtttcttcctataacgtaacgtattttatggttgattctttatgtacatcaaatatgtacttaaaattaaaaatctatgacttatcaatcctattattgtaatggttgacttactgatgtggattgacgcatgaaactggatgtgtcccacttaccccgcttagcgaggtaactgcgtccattggctcattctaaaacattcttccaaggttttcacaatttcgaaattattcgattagtttcatgcacataccagcaaatatgttgccaaaacgtgattgtgttgttggatttgaaaaatattgacatttgaaaattttattgaacaatttgtttgaactatcgtttttttcgttcccacttgcccgcggtaccttatgcagttatgggcagtgtagcaatatatgaaaaataagttttttaccaaattttgatggattttggtgaaagtgcacagaattaggggcggtcacggtaattgcacgcctactcaaacactcagatttgattttaacctttcggtcgtggcgcgaatttttgtaacgcgagtagtcgcgcgttgtactttgtacaacacccttggttttgcgaatatcccaggagtctgactacttagaaagatgacgtcttcggcaaaattgttcagtagctcaactgcccataactgcaaaacagtcacattcgacatttttgacaaaatggagttaacaccatgtagagtcatcaaatgacaaatactttcgatcaacttactgaaatctgtgagattgttctagaaaatttgaaaaaaataccaagttgttttgtcacattggcaattgtaaccgcataacagtcacattgagattatacatgagcctcatgatgcagtagcaacgaaatttccatcagaatttttttctggctattcatccaatatgcgatatgagatgtacaaaatttcagcctcaaataagcacttttaaattcctagtgattttttgaaattttggtttccccccatactgcaataaaatgaaaacttgttatccattttactcaatgcctacttttgtcgaatgttacaaatatgcagttatgggcagtcaagggctataactattatagccaagaaattcgggattttgtcactaggcggcgctagtgagcataaaatttttttttcgcagatctcaggatcctgaccacttagaaagatggcgtcttcggcaaagttgttcggtaactcatggactatcattgtttgagctagttgattcaaaatttcgatcgtagtggtattctagatcgctttaagttatttgaaaaaaatatattattttttgaagtgcagattttttaaatgcacgttgaatggttgcttgacggtgaacatctatacaactttacacctcgcaaagaaacaagcgatagaaaaacgtgattgagatatgacctcggaaaatccggaacaactccagaaactagacaaaattcgctcctggatgaatctaatttcatgcatttttcgaaaagttattagcaatttcctgatttattttgcctatcccttgtatgctgcgtctgataaaaagatcacttgttatcaaaagttctatacagagtgatgtagattctatcatcatattcgttatgaatgattataattatatggtttggtagacatttacctcacctcacatagtcaagacatgttaatcatgtgttaatcctcatcttccctacttccagaacgcctcaaacggaacagcacccgcaaagatccacctccagcgcggccaccgccggtgtctaaccaaaaagaggacaacaccgtcacactacgccacaagccaacgtgtaagtaatcaacaacttcaattcaaacttaacttaaatcaacataacccaaacaaacaccaattttctccatgatcgcatgctactccacgcagtttccgcaccgacgattcccaacaccgccgtgcagccccaggcgtatcagcagcagcagcagtcccaccaccatcaccgttcggcggccaaaaacaagggtaagccccgcctacgcaaggaggacattggcatgccgtcgaacttcaagcacgtaacgcacgtcggctggagtccgaccagtggtttcgatcttagcggcgaggaggaaacactgaaaccgttcctcgagaaggcgggcgtgcgggaccagcatgtgagtatagcatccatatagtttttagttacatcgaagcgatcctccaccaacgcacagtgggagatttcgtcgttttagcgcgtaagtgttatggtgtctgctgctagaacgcttttcgtcaaacgctagttagaatgctaaaattgtcaatggtactcacgtcgaccttgcgaatatacgggattgtattagggtgcagagctacttgggcacttccatgattcactttggcatgggcggtttatctcgaccgaatcgtctgaaaatttgcaataagaaacacttcaatgtaacgtatattgtggccaaatatgggctcagtatctttcaaaaaaccccactgccgaagtgaatcaaaagtgccaagaataggatccggctccctatatggttagtcttttttctgacgactgtgatcgactttacaaaaaaacttttttttaaataaaaacattgctatacatgatctaaatttttcaaaatccatttaaaaatttttggttgtatttgtttatagtaatttgattgtttatcaatagttttactattgaaactattagtagattctcggaataatcttatgagtatgggatcacaactgcttcgtagtattcatctgattcggtttgtctcaagttcgtctaaaatcaatggagctctggagctatcacgggaaaa

SEQ ID NO: 116 - DNA, 32369 bp, Aedes aegypti
catacgaatttcttatggaataaagacataagaagtatctaatgagactcataagaaaaacttgtgaacttccatcgatcattgcgttcataatataaatgggtataatatcgtaagatactcttatgaaggatcatagatatcaattatggaattcttttcgaccattatgtatttagagtattgctctttgaatttaggaaaataaagttattcataagatctctaatgataacgacaagaatttcttgtgaatatcggaagttttgtatttcataagactcttatcccaacaaacattttagtggaattatagttgaacaaactactgttaagcatattccagctgaataagctgttattcaactactaatgtttcttgggtatgagagagagagaaaaccagtcaagaaatcaattcacaagcgttctcttatgaaatttgtacgccatctggctcagtgtacggtaaaatggtccacagcctcaaaaagtcgaaatttttatagcacgtgtgttttggcgccatctgtcgcagtttttccatctacgggtacgccctttttcaaactcgattccctgtcagaactcaccgctgccagcggtcggtgagcgtcatgtcaaattttccaatttttgagcgggttttatttttcgatcgtcttgcaaaaacgaagctgcgcatagtttgtgggaatcgagaatctgttttgttgtgacctcgcagtggctaaatgcagaaaatatcgtttgatttcgatgattcagtgcctgattgtggttttcttgtgagataattagtggggaaaataggagactatcatttttctacgctcaggaatttgctgatcagttgcatcgaaaagaaagaaagaaaaccgcgctcaccctcttccgcctcgccgcctacttggtcaacaaaccataatcgggtgtaaattagtaacagaagaagaagcgccgaccgccatcaagctggaagcaaaagatcaaaaacccggcagcggttccgttgcgagtggagcgggaaactgtcctactgctgctggtggaggtgggaccaattccaagaaccggaagatggtttcgaagaagagggagaaagacgcggaagtgaccaagcagccgaaaatggactcgatgcagacggaccatgagctttttatgcaagcctttgagagtgagtgtgtttcttccgattgtttttgtgttggtcttttctccgttttgtttcgtatggcgttcagggggccgatatgatggccatattttgttgcctcttatcgaacgtacgcagcgcacaccaatactattacgctataagcaatgccgctggtgtgaatgtgggaaaatgaacctaggcacacaaaatctacgcatattgttcgttattatttccatagcgtagctcgcggtttaaaataaaagtaagtttcatatatattatcataaaaaccacaatgaagtgttgtttccttctttcggtgtcgattctcataatcagaagaacaattatcacgatgataacatttcgcatcacaagtttccaaccaatatcgatgcgcgggatagatggctaaatgccattgcgaacgtggattaaaccactgataagtaaaccgaagactttcaatgcacattctcacataccagctttgcgcagtttttgtcttgtttggcgcattttgtaccattttcactcatacgaaaggtaaacattcaacaaatacatgagtgtgcgtgaaaatttcaactggagtataaatttatgctcccgataagaaggcacaacgagacctgtcaaataccatagtgaaaaactatgatgccatccctctgggaagggcggttgtgggtggtgtaccactcagctatgatagggccttaaatcagtaatagagtaccccaaagaaaaaaaaaatcagtaatagtggtttaattaactattggctttgatttaacccctttaattcccattttcttacattgttttgatgggaatcagggctgggagagaatcgctttttagtgacttcgtcgctttttttaagtcagttactatataaagttcctctcttaaggtgaagatgcatcgaagccaaaccacaaatctggagaactaaacagtagttcaagctaaagacttgatcgattggtcactaccagcgtgtaaccaatcgataaggttttcagttccaaccgctgtctggttcactggatttgtgctcttgaaattgtttcaccttaactctcaaaagcccgagacgagacttgtgtgcttcaaatggctcattctcagaaactaaccaaccgaattacaaactttttgaagttacttcaaaggaaatagtgctgcaaaaagatggtatgcccggaattcttccttgaccctccccctttttctgggggcgtatgcatgtgtgagataaggcataatttcaactaaccttgattatatgaacatgacttagcgttagcgtagttacggtatacttcgtagattggatactagcaatattaatgtttgttcttttgataatctcatctagaatgccttcaggaacagtgaataagccttgatccaatcttaaataagaataacaaaatcatgaatattgctattcccggtcacgcccatctttaccgtaacttgggattggggaaggaaatgttaatgtagcacttacttaacaagaggcctcatactcagcggcaccctcataagtgctacggagttgggggctgggagggatattactgcccatattcgcataacagtcccatgtcgacctccgaccgatttgcgttttttgcataaatcaactcaacatcgtcagatgctcgataaaaactgctaaaaaagtagtctttgttcctaacttgtataaaacagggtgtctactaccttgaaaaacctggaaaacctggaattatcagggaatttaattaaacctggaaaaaacctggaattctcagggaatttcactaacaatcagggaaatttctttgtggcagtaattcatggtagaatgtgtacatgacaaaagactttcacgtagaaactccccaaaaaaattcggctgcgccgctaccaaaaccctcctttaggtgttcagtgaatcttatcgacttcccaaaacatgattgtctctatttttgatgaaaggtttctgaagtttgttttttatcaaaatggtctctaaagtcacttttttccatatcttgcttgcaatgaattctgatgctaaatgatgtaggcataagaaaaaccttcggtgactgttacgagacttttcaactaattctttaaaattgtaatctcagatttctcgaggaaaaccttcaggaatcctagttatttctctggagatttcctctgggatacttccagggattcctatcaggaattcttctagagattcttctgccaattctcttagatattctcccagagattttttaaagaagatcttgagtaatttatccagaatttgctccaggaaacactatatgaggactttctatagatatttttccattaattcttcaaccgaattttctagttgttactctaggagatcttctaataatgtttactatattttttccaagaaaaaccgcaaaggtcaattccacagtttttgaaagaaattgttcagaggtttcccctcaaactcgaccctgtgtttcatcatagaattcttctagacttctccagaatttcattgaatgattacaactgcagccgagtctagtacacgacactaaagatggcctttcagttgaggtcgaaatacgcgtatttgtcaaaggatacaaactctagtggaattaaatggtatagtactaaattcggtttttcattcacttacaactgcagttcttcaaaacatttctcataaaatcccatggaacttacaaaagtgataaaagtttaagtttccatactaatcaacactgtagcattttaccagaaaattatacacatattttttgctttttttttcaattatcccaacaatttaacaagaaaatcttctaaaaaaaatttcaagggtctatgagttaaccgggtgacttaaaaacttacacaagtttcatcagagtttgctttaaaatttgctttagaaatacctcacgaattgaacatttttttcaaatttctgaaaaattgcattcacattttcaggcagaaaagcctaaaaaaatcctggaagtgtacttggacaaatctttaaagacttccttgagaaatctttaaaggattactgtaggaattcctaatgaaatcagagtaattcccggagtcatccttagaagttgaaatcttaaagacattatgaaggacaatttttaagaaatccctagatgcatctttggagaatcttctggttgaatttttgaagaagctttaaacggaagtcttagaggatgtattaggaaaatcgatgaaagaatcactggataaaatcttggaggacttaggtctttcttggaaaacatccgaaagaatcagtaaagacattgctgacgatctctgcgttaatttctgtggttataaatggcaaaaacaaggtcgagtttttgagatatctaaaacaaaactcttttacgaattccttagaaaaattctcgaagggattccatgggaaataattactacatgaactcctggagacatttaagatgtgagctagtctagtggtgcaaatttcacaaataaagaaatctatccatctatcctagcctgagtaaatcttcggagtaacatctggatctttgggcaaatacttgaattaatgtctgatgaaattccttcatttgtaagtattgtttatttcgcccatttatctgtcttaagtatccaaactgcccatggataccttttgagatttttttcactgagcgtgggccaaaaatgaatagtgcattatcaaggctggtagcgagtcactttttagtgacttagactttttttaagctagtcactttaaagtctcttttttgaagccatttcaactaaggtcacttttttagtcaaaaagtcacttttctcaactattttgagctaaattttcgagagaaaattacgaatcggctttctttctatttaggctaagttttaatttaacttcctgtcagttcaaaactttagttcatggttttcttgtgaaaaaagtttatttttcatagaattcgacgtaatttataagagtatctaagttatcattagtatggtgtaagttcattgttgtaaaattaaaggttgaaatgttaagtattctttttgaaaatctctgaaaaattcttgtggtgtattattagatatttgtcttctattatcgaacactacgctttaaaatatgcatccaaattattctctttgtctttgaaattcgtcttttttaaccaaaccatattatcttttttaaattttacaaaatctattatataggtatttaacactaaaacacaaaacaaagaataattatttaatgttctatttgggattagaaacttatccatacttcttaggatagtctttatttacaaaccaaacctttaaaaatggccggatagaccttcggtagagtataagcatttttcttcctctgtttttcttatgcatgtatttaagcatctttcaggaaagtatattatcaattctttctaggaataaattttgaaagaacctctttcgaagctgtttgagaatggattaatacataatacaaaaatgcttctgagaatttatcgttttcattgaatcgcatcgcaatcgaaatcatgcatgttttcttcaaagaaatgtcggatcttcttcttggtacttttgattcacttcggcgggaggtttttagaaagccacgcagtttatgtttgacaataatatgcgcggtattaaagtatttttaattatatagtttatgagaattcgatcaactataactaccaataccaagtgaatcatgaacgtgtcttagtaattttgattaaaatatcagaagctttgtgctaataactttttcaaaagcgcagggtgtctactacctggaaaaacctggaaaacctggaattatcagggaatttttttcaacctggaaaaaacctggaattctcagggaattttgactacactcagggaaaattttttgaagcagttttacatggtagaatatggtaaaatttgtcgtttttgtgacacaaaatcgttgcaatcaaattcaaaaccaaaaaattttcggctgcgccgctattagcacgctaattgacgtttagtccttttaaaaatttgtatttatccagcatagagcatgtttagacaaggaagcagtacttaagattgccatgttggtaaaatcaagtacagttccagttgggtgtcgtttaaaagtatatgaaacatagttcaaacattcaaatgttttgcctactataccataataataaactttgtacaaagagaacaaaaatacaagaactctattaagtaatttaattaattaaatcatctgcttgctgtgaatcctggtgcaaaagtctagacttaaaataaaccttcagagactattacgaggttataccacgagctcttaataaataatatttttctcagatcctgaggaatgccttagcaattatagtagattctacagtgatttcttttggaatatttccaggaatgttaccagcgagttttcaatggatgcttcgaagaacttcctcagaatttggcccagaaaatcgtagagcactctaatgcttccacaatggtttatttcagagttaaaaagcctgcagtaattttcacagaggttaccctgaaatgaaaatcctagcgattatcccaggatttcctctagatgttttttcaatgattctttccaccattttcagttgttacttctagaagatttaccacagattctaccgaagttcttccacaaaggtttttccaagaaatcccacaataattcctacgccgttttttcatttattgtaggcattttcattaggattcttttttaaaattcttccacgattactctcaggagttgttccagaattcttccaggcattgttcgatgaaatctattataaaattttccaagagatcttcgataaatttgatctgggattcctcattaagttgcttccggaatttcttacggcattttcccagcatttcatcagaatattattgttgcggttcaaatttctttaaaaaaaaatcaaataaaatttccaaatcttcatgtattcttcaaaactttaatcaagattccgcatcagttattacacttatcaaaccgattattcataaataggttatttcaggatttttttccgaattctttgatgaaagaatttttatttttcaaaatttcttctgaaattgtaataagcggtcctcgtagaaattcatcaaggcatactcttaactcacacaagctccatctgaggttactctaggattttctttcgatatttttaataattgtctccaaaacaatcaggaaaatttacttgtcatttctctaggggcatacctgtatgaatgacttgaaaaattctttcaagggttcctttagtaattcttcaaaaaaaaaaaaaaatgtaggagatccggaagtgtgcctaacgggaatgttggaggaaatcttaaggaaacgaatggaaaatctttttgaaaagaagaaaaatgtctggaacattccttgcagggattcttgatggaatctccgaagtaatttctgtgaaaaattccagtttgaattcaaggtattcaaaacgaattttattatttatattattattatttattaatgacattttaccaaacatatggcattcgtgtcagacaaaaaacgaattttaggaaggattacttagttcgtgaaaaatctcaaaacaaactcctaaagagaactttggaataatttgtgaatgaaatctacagtaaaacgagcattatcacttgtaatgtcacgaaaaaaaaatagaaataaataatcttacaaaaatgtctgttcaacttaggaatcgaactctgtcgtcttgtaaggtttctttttgagaatactctagatacgtcgctgatgttcaaaaacgtgaattccattttaaggaaaaggctgttttttccttacgatcgaatagactgttttttatatctgactcccagatcatttttttatctgcactttcagatcatttgataatcattcttgtttttcgtggaagttgaataaaaattgggtcctaaaatgtttaataaattctcgttgttattcaataatacgaaagagcatgttcttgcaactactttagcaagttttcccgttcaaataacggctatatcattttttaacttcaattttaaaaatggttccaaatatcaaccttgacacttgtgatcttgtttgacattcactttttcgacaaaaatgctacagggcatatagttttaacactggggttgttcctatctgacatttcggaagggacacggaaaacaaaatatacccaaaattcgagtttaaaccaaggggtgtgacaaaatctcaaaaatcataaaaaaaatgttttttgtacttaaaccaatgaaaatcatttaaaaattgagtaaacatgtgtttctgccctaaacttaagcgttttgtaataaaattgagacagggctttaggaccctattataagtattttgatttgtttttccttttgttttcacgtttatggctggtacgctgatcataagtactgtgcaaaaggatagtacaagaaacgttcaaggaatgattccgctaccgaaattacttgagttgtaccctgctgagaagtagagcagatttcataacgtcaataacgcctgccgtacaaataaaatggagttgtgacttttccgtacgaaaaaatgtgccgctcaattattccgcaagtaaaagtgacactttgctcacactggatcagctgtcaaaattactttagtaaaaaagataaatttaacttgagcgatttacgtttcaggtgcataccacgcattaaatcaaaacagaaagtgtttttcagggaaaaatgctttgaaatttatagttagatatttagtttttcaaagatgcctttgaaaattaatttttagtcatataatatttacttttcgtcaatcatttatgtatttcggagcatctcttaaacctgaaattgttttttaaaccctgggaaaacctggaaatatcagggaatttcatttttgtaaatgagtagacaccctgttatacctaggcgatctcgaacgatctggctgcaccattcccaaactttttttgaggctgggaaatcttttagcctatgcttattgctatcacggtgaccacatcttttacaaatatcatcgctacgaatgccgtaggcgcacaatttactgttgtttggtattaagtcatttacaaaacaaaaaaacttttgcacgatcctgggtagagatgaaattgtagttaaagtttttccaaactggccaatcaacgtctaccaaattctcaattctaggcgtacaattaattctatccaccaaacaagcatacaaaactttagtgcttggtagatcaaacctcgtttttagttcatttgcttcttctaaccaaaccctagcatttttcgtgagcctctggggcatcgaaaaatttaaaaggtaagattcttcatgattgtcgcctgcattatcaagattatttaatatgtttctaataaaaagtgctttaatttttgattctgggtccactaactgcagcccacctttttcatattctaaatataattgatttctttctacctcaaaaatatgcccggaccataaaaactttccacaagctgatttcaattgagctaaatgtcgatttaaaggaggaaaaacttgagcaacataccaaactttcgacaaaataaaagtattcactacccaacaccttttgtataaattcaggtttcttactgagtgcctttgcaatgtcagctttatattattaatcacggtatcataattatttacaattgttttataccagcttctatggaaatttattccaagaattttaagtgcatcaacttctttaaccaattgaggtcaaaatcgagcctgattaaatctcataaaggctgatttggaaaaaaatattttaatcctagcatattttgagaaattttcaaatattaaaaccaaatcaaaattattatcatttctcacaacaatgttgaagtcatcagcatacactatcactttaataaatttatcataaatccagaatcctgtcaaatttgcggataactgtcgaataagaggttctacgtacaacacaaacaaaatcatactaagaggacatccttgtcgcacagaagtacttatttttatttcatctgtcaaaaatccacaacagtgttcatgtgggcgccattgcctagtccgtctgagtattggtcctggtagaggggaaacttggcaaaagccagaccgagggttcagccttgacaagttaagctgtcaggcagctcccactgaataccatacaaaaaaaaaaataacagtctcgttacgatttttgtgcatttttaggcaaattttcaacttgaattcaaaagaaatttataaggtttgttcatgtactcaacaaacagtgatatgtagaaatataacacattctaggccaaatagatattcaaaatggagcaaaattgtttccacatttcaatcgtctttttctcagtttgtcatgggactgttgtgcaaagaggggcagataaggtcatcaggaatcgcctgaaaagctagcgatagacagacccagataagttgttgtttaattattttaatttaatctcttgaatgccggcaatcaaaagaggtaaaatgtttgatttacagtataaataatgttgtttcgcgtcaaaatagtcgattacgcgttcaacggtaataacgacccgctttttacctagtaaaaagcagaatagatccctccagggtcatctaaacaaaaaaaaaggttttgatgatttacatggaactgttatttacatgaaatacgaccgaccaaatagcactcacaataggccaggggaagtggttaacccagagtgaatttatgtcagagaaaaagtagattttgtatgaaaattgacaggataatgaatgacaaaaggggacggacctggtgtagtggttagaacacacgccgaggacctgggatcgaatcccatccccgagatagtcacttaacaaaaaaaaaatcagtgacgacttccttcggaagggaagtgaagccgttggtcccgatatgaactagcccagggctaaaaatctcgttaataaagatagaaaaaaaatgaatgacaagttcatccacttctcctggcctatgcatagccaactcctcgataagcgaccggttgaaacgggtaaattgccgcacttaaaataagcgagaaaaaaaatacacccgagtccatgtcgcactccgaatcgcgaaaatttgatcacgaaaccgttacgtctaaaacaaattcgggtattatgtttaaaaggaacggactcaccaaatacttgcagcctccggaaaaacgttgcttaatcccccgccgcggcgctggtcaacgtccaccactcttgatccaagttgtaacgtaattttccactggttcagaaactaaatgcactcgattattttcaacgtgaaactgaacaacacataaaacgcgaaagagcaacaatttcatgccgaaagatttccagtttttttttcactgtcacagagtacaattcgaaaaatttaaaacgattgcggccaatttgcgattgcatcagccgaattgatatgatgcacctaaccttgattatatgaacatgactacactaaaagatcatagttttcctgagggaaattattctgagttagtaatgctttatttatttttttttttcaaaatagacatatcttggccgtccagaaattctggaagtcctggaaactttgcaagtgatgaacgattctcctgcatctctacaagcctgctatgtgatacatatgttttatttgattttctggctgatcttaaattggtcaaacatatttccagattgattctaaccgtctagagggctcacaattggttctggataccaagaaatccctggtagagggaaaaatcgataatcgatttaatcgattacatttctgaggaaccacatctattactaatactactgatatttgaccatgcaacggaactcttgtcccatccttgtttcactttcagtttaatcccagaaaaatactagaaaaaaggggttttgtactagcagcaaaaccgaataaatctagaaaatttgtttagtaatcagaattcaagtgaatccttgatttaccagtacttaacagttcttgttgagctaatactcatgattgttattctggcttcaagcgtagtctcgggactgatcaactccgaatttttaaccatctgccaggtaaaacagattcgggcgatttcttttggggcgctatggcgcttttgatcttagccattaccactctgtagacgtcaccacacagactcgagttggcactcaggcagaaactatcaaagcatgcccgtttccgattcttgaattcctttttcaaaactaactttgcctctctaaaagctgcgctgcgttcttctctttgtacttctgtgcgtgcgcgttgcaatcttcgtctagcccgaaggcagattgctcgaagatttgcagttgattcgcaccatcagtacaccggtggcctgtcctctctgataggtgcttttcttggcacacgcacgtaatatcacagcaactagctcttcaccgtttagatccagagtgttcccttcgcgcatcaggacttcagtgaatacttcgccgtcgaagcgcgctgttttccaacatcgggcttgggtcgagttacatcgcactgccctccgcccgcctgatattataccacagagaaacagacgtaacacttagaacaaatcgcgatcaaaatcatagtcgcgaaaacatgtatgcccaatgctaaaaacactgtagttggccgatggaccaacaggtggcggtaatgtgtaaacgtcaaacacgaacaaaaacgacgcaagcgctgcggatggtcgattgaccacctacaagatattcgaatcgatcgttaaaaagttggtcgatgaacagcgatgagagtgtgacgtctgtttgtctgtgattatactatagcgaaccgatttatgatcgctatgagtataaccatcatcaacacgacagctcatggtacctaaaaggataggactacaaaacgtcacgtcgataatcgattctgcaccatttctgcggaatgtactcactgtacccacatttgccagctctacatttaatggtcagggattcaaacaacagtgggcctttttggttggtgcagcggctatcccactccactgcctttacattaacgtttaaggatccgtcatcgtcccctggccaagaacacagggtttgacggtgccaaagtagaaaatgcaccataataatacccgtctgtgaaacatatcaccttcccaatgctttggcacacctctaacggtccatgatttatcatgaaacatctctattcaagctgtttgtatgcttcggcatattatcaggtccttttcgaacggagggaccgccagggctcagtagttacttataaaccagtactggttgttgatggttcatttcgtatacacgagctgtacaatcctttgtactaatcagtggtggttaggtttcaaagccaacgtgtgttcaatcgttttataatgcaacataagaatgtgtgtttggtgaaactctgcgttacactcgtcgtatgaaattagtgattgtgagggtgctaataatgatgtttgaaaaaagtatggtgatgaaaatatgaaaatagcattggaagtgattgtgatagttttgttaaatatacaaataataaatatatgaaccctactagtttaataatggacataatacattttgcaatcatttctccgaagataaacactattgcctagctcttcacacatgctatgcatgataaaagtgcttacaatgacagcgagtgcagaagaaactgatcgattttttactgtaactttcttgatcatagtgctaaatcgtagtttgaatagtaatgactcatagcaacaaaaataatgaaaaatttaaattgatttttttaattacttagtaatgataatagatggtaactggtaataacaataaatttatataaaaatggtataatgtaattttgatgaaaatttgtagctgtgatagtgaaaagtgaaataaagaaaagtatgtacactaatctgaagtgttttacgaaagttgatgagtgataatcggtggtataagtgatagtgtcgaaagtgagtgataacatgaaatgaggaatgaggaccttttaataaaactatttcgttcttcactttaaccactctagtagtatttcaggccttatcatagtttgatagtagtctactgaactactagactgcaaaaatacggtaagcgctgcacactcaatctgttcggtaaaaataactgggttttggaactaccgaaaaagtcagtaaaataaaaaaaaatatcaaaaatcgaaaaacagagattttttcctgaaattttgcagagagctttctttttatatcatatattgataaaaaataaaacatggtgaaatttgtttttcaattaagcgtggcgacagttttcattttactgactttttcggtagttccaaaacccagtaaaattttaccgaccccagtaatttaatctaagtgtgtgattgcttctagggtacacagtgaccattgcttaggaacatctgtgtgttgaacgtaatagaggcttataaaagcaaatgctgggaagaagcttagggcagaataaaagtgccagtactagggcaaacactcccttagtggaggtagctccaatagtggaggtagtgtgttttagcatgtttcgtactaataaatgattatgtgatatttttctatgatgcacgatgcgaaaatgctacaagtaattgaataatattcatgaattctaaccgtaaaactatttaaaacaatagggtcctaaagccctgtcccttaagtttatgccaaaaacacatgtttattcaattttctaatgttttccgttggtttaagcccaatttttttttttttagattttgtcacatcctttgacttaaactcaaattttgggtgtattttgttttccgtgtcccttacgaaatgtcagataggaacaaccccagtggtcgaactaaaacccctgtggtgtttttgtcgactaagcgaacgtcaaatatgatcaaaagtgtcaaggttcatttatggaccaaatttttaaattaaagtttaaacatgatatagcgactaccgaaaagctaaacattacatataatttgcaattgaattagatggacaaattgatgtgaatatttgcgaaaaagttacacgtcttctcagtgagaatcgaactcacgacttcccgatctctagttggggcgcgttaccattacgccatgagaggactcatgaacgcagaagttaacctgaattcgatttcagctcaataatcacgtggtcctttttcgcaaagtgcacctctttcggaagaactagatgcccatccaaacacaacgctttctatatatatccaatgcctagcccgagagcgcattgttttttaggtttaagaatagcacactacactagccagcaactgcgctggctgaggtatctattgtgtgggcttccaatgggtcgcgtcgttctcaaacgaccggttacggaacatgagtccgttgctcgataaatacttgtttttaattatgaatcgtggtttacggccgagtggaagctggctagtgtagtgtgctattcttatacctaaaaaataatgcgctctcgggctaggcattggatatacagtcagtgacataagttagtaaccaaatgctgtttttccatacaaaatgcccaagtttggggtgctgtatctcagcttctggtagtccaatttggctgaaatttggatgacgaactacaaataacttgaaattttgccagcaggggaattattacattgctgtcattttccatagagtttcagagggttgtccaaagacaaaagtaagtaaccgagagactttttaatttaattggaaaacggtaagtcgtggaatgttggtgtgttctgcaaatttgtgtgacttctgaaattgaacaactttgtgaaacataccaacatcccacaacttaccgttttagaattaaattaaaaaggctttcggttacttacttttgtctttgaacaaccctctgaaactctatataaaatgacagcaatgtaataattcccttacaggcaaaatttcaagttatttgtagttcgtcatccaaatttcagccaattcggactacctgaagctgagatacagcaccccaaacttgggcattttatatggaaaaacagcatttggttactaacttatgtcactgactgtatatacaaagcgttgtgtttgaaagggcatctaattcttccgaaagaggtgcactttgcgaaaaaagaccacgtgattattgagctgaaatcgaattcaggttaacttctgcgttcatgagtcctctcatggcgtagtggtaacgcgccccaactagagattggggagtcgtgagttcgattctcactgagaagacgtgtaactttttcgcaaatcttcccatcaatttgtccatctaatccaattgcaaattatatgtaatgtttagcttttcggtagttgttaaacttccacgagtcataattaaaaaaaagtatgatatagcgattatttgagcgggaaaaattgctaaagtagttacagtaacatgctttttcgtgttattaaataaaaacaagattgcattaaaaatgttaggacccaattattttgcttaatttgtttgctcctttgcacctatagtggtgcatcagtacccatagtggagggtcccataagaaatcaatggtttgcgccactaaaggaatcattcttaaaacatacctccactaaaggaacagtgttcctattattggtgcaaggctttttgcagggaaatttaaaatgaatcgtgattttaatacatttgagtaatagaaggatttgagatctatcgaataatacattaaaatcatatatttcatggttttatcaccatgttttagctgttttcccttaagtgcaccactaatggtacacttgccctacccctatcgctactgacaaaaaaaaggatccgtcatcgtcatcatcgaaatttcaacagcagttttgctgtacaaaactgaaattattcattcgacgaaaatgtgttcactgtgtttcggttggaggttagattacagtgaacccattttcatttaaactttcatgatattgaacaaaaaaactgctttcaaaaattctaaaattggtgacagatcctgccccttaaagttaccagctatcactactggctgccgataagctagttcggctatcatcctgtcgaccatgtgggaaaattccacaatcgaccactttggggcgcgttacagctacaatagaacacgccgttaatttttgctagccggttactgatggatccggaagcctgtccttcacattccgctagttgtttgttttgatggattatctcttatgggtccccctaagagccgctatccatctccgctgtaatagtcgcttttgtgatgccatggttggtccccatctatgcaagcagggaggccatcctagggttgacatagtcctttatggggaaccatattgaccctactatagagcggtcaaggtagaaacaccaggttttctagaaaagcttccggaaacatacccttaaacaatcttgaagtttgatacctatattgatatggtgtcggacatgtttctaattggccactacccccaggacacctgaaaactactaaagacctcttgagcccttctccaatgtttatccagatttagcatgtgagattttcctagtttccttttcctacccctatttccatccatttcctttccctttccttccaatcaggttaaatgatgaaataagctctatatgtgagaattttagtctaagtggtccagtagggttgtaaatccaagaagaggagggattggaccaactaaagtcttttattgacatatatttctttattaataatgtatatgtttgtttcgtttacagaaccaacacaaatttatcgttatttacgaacaagaaacatgatatcggtaagtggcataaaatattattttaaagtttttatataatccatctatgcccccttgacagcctatatttttgaatcgcaacttatcatacatgcgccacagaatgtctcgatcccacaaaacacgtaatgtcttcaaaatcgattcaatgctagcacagaagatgaacaaaatgcgtaacgacaaagcgaacggactgtcgttgactggggaatacctgacactattgtttctgggctttttcgaccagatccaagatgacagtatgtccgacgatcaaaaaatgggagatatgagcgagaatagtggcaagactgtgcaggtggaaacagtgcttttgaagatttctcacaacaagcgcaaagatatatcgtcagcgttgatgcaagtggctgttggcaaatcggaagtgatggtcaatccagtagaaaaggttgcggaagataaggtcccaacgataagcattgccacagaatcgtttagctcggttggaataaatcaggtggccgggccacaattgtccttcctgttgctgtttagggtccatatgcactgtagtacagaaagcaactattgtgctatttcaaatggaaccgatggctttgagaatggaggaagtgacgatgaaccatcaagcaaaaggcaaaaattaagcggaacgaacaaattgttcggtactgagttgataatttatgataaatacggtcgatgcttactgaaagagggggactacgagcttacagttcaggaaattctaccacatcagcaacaaatgcagaagtacaattcaccgaaaaagaatgccacatgggagaccattcagccattgaacggcgatcgtcacgatatggacataatagatatctacaaacaaaatgggatcgatgaccagaacccgatcctaatgttcaggaaatcacccagcctcaagtttcgcctacagtggactaaagaagcattacctgttctagtagacagaccacagcccctgtcaatcgttttgaacagtagcaacgataaagaaaaccataaacctgatgttatgtcgtccactttcaaaagaaatctcagcatcaacatcaataacaatagcatcctaacacctgcagctgccaccgggaattccaatgtccctactccgttggatgccaacactggggcactcgttccgatgggagcgtcttatccaacccctggttcaaccgaacttaaactatacgccgatgaaccgaaaatcgatcacatcatctaccaatttgtgtacaacaacaactcccgccagcagacggaaacaaagtcagatttccattgtccttggtgcagtcttaactgtggcacactgtacccgttgctaaaacatctaaaactgtgtcacgcaaggttcatctttacgtacattccgataccaccaaacggagcacgcatagacgtgtcgatcaacgaactgtacgacgggtcttataacggatcgccgcacgacttgctcggtaccgcgaatgccttctcccggcggggcccaatgcgcaggacggtcgttaccaatctgcttgtgtgcagaccacggaggcagaagcacagcctgaccgagttcatcgagtgcgacgaaaatgagttcgacagtcaacggccgttcatcaccggacatagcaggtaagttgcagagatattgttactcacttgctttgaaccatataaacttgccattacgctggctgtctgtaattgaagagctggtagcagctcttttcagagacttgcccacaattgtaacccgtctccattttaatggcaagtcactaaagtttatatgttgattaaaatggtccttcctctttattctgcttgcaatgattccttgtgctagatcctagaggttccagacaaacctccagagactataacgcgactattaaacaggttcttcaggaatttcttctcagatcctagagggaaagctttacgaatttttctgtgatttctttcgaaatactttcaggatctctttcagaaattcctttggagaatcctttacatctcccagagttcttcatgtgacttttgaacggatgcttgaaataatttctacagaacttactcaattgaatcctttagcactccaacgctactacctccagaaatttccacagtgattactctgaaagttgccccagggactatctcaggattttctccgtatattttttagggttttttcgagaattgccatgccgattttttttttcattccttcgagaattcacctaaagctactcccaggaattgttccaagaactctttcaaggattgtccaagaacatctattaagaattattccagtaattccgctataaaatcgacctgggattcctcatgaagttcatccagcattttctctaggattttccccaatttttattttaatggttacttctgcagttcatccaatcatttcccgagtaatttctcaagtaaaatcacaatggattcttcaaaagttcacacttagatttttccacgagctaatttcttctgagataaatccgatgtttttgaaggtgttctttctgaaaattctgcaggatgttatccagaggtacgattgattttgtttttgaagtagtttagcaatgtagaaaatccttaaagaattttggagttcttccagatatcctcgaaagagttcatcgaagataacttaggcagcatccatttattatgtaacgctaaaattggaaatttttggcccctcccccccctctgtaacgctttttgtatgaaaaatttcaaatttttgtatgagccgtaacgcttcagcctactccccccctccccctagagcgttacgtaatttgtggatgccgccttagagcatacaaaagtttcatccagatttttttaattgtccttcgagaaatttcttgttgaaattttgaagaaacccagaacgacaatttgtgggatatcctgagaaattcattcatggaggcaactctagataaactactggttgaatttttaaagatattgttggaaaaggaagcccgtaaaaatcactgaatgaactctcgaaaaagtcttcggagtaatgtcatcgcgttatgaattcattacgcaacgtttatattacgtgagtaacttgagttgcattatgactcattagacaatgacttcgacaaattgcaaatgactttagatatcctcaaggagcgttcaacaaagttctctatgcccggacactttttgtttttggtgatatttcaaaatctacattaattttaccgtttgtttatgtgcagtctaaaaaaataacaatattttaagtgaaaaatatcaggcggcatccacaaattacgtaacgctctagggggagggggggagtaggctgaagcgttacggctcatacaaaaatttgaaatttttcatacaaaaagcgttacagaggggggggggaggggctcaaaaatttccaattttagcgttacataataaatggatgctgcctcatgagaaaaaaaaaaacctgtacaattcatttttatggtgagttacttcttacattatgtaccaaaaatcgtatacactgaaatgtgtgctctatgctcgcacactatgatctgcaccatcaaattttcacaccaaaccaaatgtattactgcgtatgaagcatattagcgagattattgctcagttccataaactccttgttggtcagcgccatataagtctaggttgcgctagcagttgctcgtattcaggtgagaatgtcttcgggaatcgaccgcgtttgtagttcctgaccatttctttgccagctcgaaggtttttatgcggtctggaggtgtgctcttaggtacagtcaactctccctcacacgatattccgtttctcgatatcgagttagagaaccatagtaaaatttgttgttcatggctacctcgatggtcccttgaatcacatttgcactggtttagtattctgtaactcgatatcttcctaacttgatggtcccatcattatcgagttatggagagatgactgtacaccaaatcttgtggctgcttctcgtacgctcatcatcatctgcttggcattaacgtccttactgttacagagcctgcttcttagctttgtgttcttatgagcacttccacagttattaactgagagctttctttgcctaagttgccattttcgcattcgtatatcgtgtggcaggtacgatcatactctatgcccagggaagtcaaggaaattcccatcacgaaaaggtcctggaccggccgggaatcaaacccagacaccctcagcatggctttgctttgtagccgcggactctaaccactcggctaaggaaggccccgtacgctcatattttgccttaaacgcatcatgtttacatcacattttaagacctcaaaggaccgaaagtttcgttgtttatgcgccttttttgttgctgttcgtttttaaatcctaaatttatggaaaaagcgaattatgaattaaggtgaaatataataaatcttcgagctgtttagtagaacacctataagtagatgaaaaacccgaatttagtactataccatttaattccactagagtttgtaccctttgacagatacgcgtattccgacctcaactgtaaggccgtcttcagtgtcgtgtactacactcgacttcaagtgaaacagtttggaatcaacttctaagattgcactaaaactttaaaggcacaaatctcgcgaagaaagcatcccacaacagtgcactttttattttggctttgtgcactagcagaaagcttaaaataagaagatcaggaacgtttgccaactatttctccagttttgtgcatttgaaaacgtgagtagggtgagaagtcggccattgtgccggccatctttggattccgagatgtttcaccttaaatcccagctacacactaagctcttacggtgaattccaccgaaagctggtctttcggaaatgttgttctttcgttcgccattatcgattcaaatagttcatttgaagtctccataatctggtatcacgaaaatatggtgtagcaaacgaaaaccacaggtttcttagaccggaaacacaaaattcaatggtttgcaaatgagaagcaacgaaccatttggtcgactctccataactcgatattcaagggaccatcgacttatagaattatcgagttatagaatatactgacgcaaaaaattccaaaatcgaaggaacattttttttgtatttccagtacatatatgattacttctgtaagaaagcaatattatttggttgattgtagtttataaactattatttgttaacttagtttttcaggccattttttttttcattttaaggttgttaaacttttatttggcaaatatttattcaccaccgaacaagacttagtccaagtttccccgaataagaaagatttaaaaatggatgtcgagttatggagagacatttacctctcacgtgacatcgattattggaaatatcgagttatagaaatatcgaaatatcgacttatggagagaatgatgtaaggtaccgtggggcaagtgggtaatggaattcgcatagttgagattcttcaaattctagagactttaaattgaaacaaatgaggtcgtgtatattttttagcttgactcccaccaaatataagcagcatgctgaaattgtttttttttttatgaaaaattgaagaaaaaaatacagaaaaagtttttgaaaaatgtctctttacttttcacttgccccaaatgtggggcaagtgaaaagtttaccgttttgaacaataaattcaaaaacaaacagttatattcacgatttctattagctttaacatttgttaaggcttcccaatgaacaataacataagtaacatgtaaacaaagaaaatgttattcttttcacttgaattttcttctgctcagttatgttagttgaaatgattcgacaacattataactgcaacatttcaaatgttagttcttacattatatgacagcaattgcatttctgctctgtagaatttccaccgctcgttatttgtttttgagaaagtcggatatgacgtcggatagctcttcgggagaaatcaaacggaatccttcaataacgtatttagaatcttttttatgtggatagacctataccccatttttatgttttgaactagctttacatagacattccacgagatttccgtgtgttctctaatattacaacttttcagccaaggaagacgttggaaggaagaattggctgcccgaagtaaacatattaatattgtaatgtttggcaacatcttttagaaaagttccatgatttctaataagcgttcaaagtttaaaaaaatgctgtttttagaccgttcttcacaacaatccctccccgcaatgaaccatccctgaattttcttattttttttcagtaaaacttaattaaatttgtttttaaaaactgcagaaaaaccggaaatctattcaaatttggcgaagttaacgctatttgaaattggggtaaatatgaccccaaaatacagacaactaataaacacccttcccttggtgattggtggtgaaatcgattgtataacatttttcggtaatccacttcgcggtgcaccatttcgcggtttgccatttcgcggtacgacatttcgcggttagtaccatttggcggcatgtaattttgcggtcagtaccatttcgcggtataccgtttcgcggtttgtactgagatgtttcatttatctcaacagtgcaaattgaacgacttccggtttaccaaagaagggtaaatcaccgatgaaaatgttattagtgaaaatgccaacaattttcagtgcaactcgtaggaaaaaccacaccgcgaaatggtactaaccgcaaaacggaaaaccgcaaaataatacaaaccgcgaaatggtacaccgcgaaatggttgaccgcggaatggtttacagcgaaatgtcggacaaccgcaaaaatcattacacgctatcattcctccccttactgaactaaggaatcatatcagatttatctgaaaacacatatagtttttttccatgtagcttttcacataacgctcatcaatttatcacataaacttgtgtgatttctttttgattaaattcatctgataaaacatacatttgatgcaaatttttcatacgaacaaatggattttgtcaatgagttttatgtgaaattcagatgaaaattattggtattgttagtgatttttattagatattaaaatgagtttgtgatgattcttcttcagtttttatccagtagaattgatgaacaatctatccataatttaaaaaaaatctgtttattctacacatgcttggcatttgtgtgaataagcgatggaagcaaatacattgaattatattggttaaacggctttgaattcttctggatggtttgttccgttccttccgaccttgttccgttgacttcagctaggaataaagttgatgttttctgggaattcaagtctaacagaattaattcacattcatttatttcgtttataaatatttaaatgacgttttttacttacttgttttaattatgaatcgtggtttacggctaaccagccgagtggaagtttaacaactaccgaaaagctaaacattacatataatttgcaattggattagatggacaaattgatgtgaagattttcgaaaaagttacacgtcttctcagtgagaatcgaaatcacgactccctgatctctaattagggcgcgttacccttaccccatgagaggactcatgagcgcagaagttaacctgaattcgatttcagctcaataatcacgtggtcctttttcgcaaagtgcacctctttcggaagaatttgatgcccatccaaacacaacgctttctatatatatccaatgcccagcccgagagcgcattattttttaggtaatgaaataacacacaacactagccagcaactgtactggctggggtttctattgtcgttctcaaacgaccggttacggaacatgagtccggtgctcgataaatacttgtttttaattatgaatcgtggtttacggctaatcagtcgagcggaagtttaacaattacttactttttgattattccaaacataagtctgtgatccacgttgcgttgaaacaaaattttatttcaaatactccacgatgattctttgagactcaaattcgccattacgaagataacgctatactacaatgacttttcacatctgccaatcccatagcattcattggatttttggtcgtataggtttcatagtgttgataattgaatattatggagtatcataatgagatttatgtgtttcttacatgaatgtcaatggacacatataacgtgaatcggatttcaattgtcgtaagagtatgtgacgttttttatatcttctatgatatttcttgattcagtgtatcccaactgactgtaaggacacggccggcgccgttattaataagtaatatgagatttactaaaatgtgcacttcgagaataagcggaagttcccatcccttattcatttgcatcgaagtgcaattctcaccagttccgatcaatcattgtagcaatcattgacatgtacagtagggtgcggcatgaaggtgaattttcgggttatgaaattatgatcttcagtgaagtctttattatgttttttttatttaccaacaaattttaaagcttttagcatcattctttttgaaatatcaaatatcaaatttgtccaaaaccaaaactactctttgttaaaagtagtttcctccaaatttttcctctttttacttaaaaagtcatttttctttggccataacttcatgaatactcattcgatcccagatctttgtacatgattttaaagctaatttagttgtttgtgtatttattcttagtgctattacctaaaaatttcaaatccaatgcttaaaatggcagaaacctactttgtgtggaagtgatccataattgtggcaaacaatcagttcctggtccatgtcatagatcactagttggaactgctaacattcagtaatcaacaattgaaaaaaatgtttcccaacgatgaatttatactgaatctaagcgaacgagcaattattttgctataaaatttgaattgtatcacctatgctatgagagcttctgaatgctgacggcacttcttacagaaaacgttgccctagcggatatatgaaattgatacatatttttacatgcattaatttatggatgcttcacaatatgtaatagattataatcaatataaataacactatttctttcctcatgcagaatgtaccaccacacaatgacgtgcctgccggttcatcccaaagagttggacatcgattcagagggggaaagcgatccgctgtggttgcagcacaaaaccatgcaaatgatagatgagttcaccgacgtgaacgagggcgagaaagagctgatgaaaatgtggaacctacacgtgatgaagtatggctacgtcggcgactgccagatcccggtcgcactggacatgttcatcgattgccgaggcagggacttgctgcggaagaatctgtatcgcaacttcatactccacgtgtgctccatgttcgatttcggactggtgtcgcccgaagtgatgcaaaatgccataaggaaactacaggtgaagattattttgtgatatgatttttttccatcgatttaagcataccaaaatcaaagttaagacaataactgtcataatcatctatagctatttatcatttgccagtttaacacctaggagaatattaattaattgtcgttttagattgagtaagcgtgtagaggacctctcatttgtagtaataaaacgaaagcaattatagcttttaaattgtaacaatcttaaagtacacatctcgatgatattttgtcatgtttaggaaatgtttataatttcaattgttctgagtattcgtcatttccatgcgcaacattgatttactagacttttcaaattagttggatatccatcaaagaaaaatatttggacattaatcttatcttaagatcttaagattttcataatatagctatggagtgatttatgcttgccaaaaacttttcgtcagcctcgttgttttgctgcctttttgaatattcaaagtaattgattcctttacaatttgatggaaactcaatatactatttgatgctgtttacttgttcaaataataattggtgaaagagttctttaccccagcttttatgtgttgatgctgagattgtgactgttcagtcaaggatgaattgccaactggtgagctcgtttcatacttgatataacacacttatgtatcgtggtggcaactgtacatttatggttaacaattacccgtatccgcccagcaaatggaaaaaaaatgttcaacttggtaccatttcggctattcttgacgaattgtattcgttttagttcgaataggaagaaccatgtggagaaatgcaattatagggatagggtcaacaattgattaggcacctccatgattcactcggtcaaactttatgaaacacgacagtaagataccttgatattttgaaggcaacagcgtaacgtcacacatcgccgggtatttggtatagctctttcttcttcggtcttggttcccatctttagtctccagttaccacgaacgttttccattatcttttcccttctatttttttttgcactaagtgaccaggctactgtagcctgtagtattttatgcgcttattaagattattcgcttctatatatatttgatattactcgtgattcatgcatgcatcggtgccataaaccattttaatagtttaccattaagtatatattggaagggtaaaatagcagagagtacagtaaaacacgtctttacagatcgaggcaaaacacttgagtgagctttattcatttctttctttccattcactgttgagctttatttagtcagctccttctacactcgattggcgcgcgatgctgaatggcgtggggctgccatcagtattgtccgcaacactttacgctttcgttctggtagatataatggtcgggtctatactcactgtctctcgtctcccgcttctgaggcacgaaggtctcctccactgacattagaagcttccatgatatccaacaccgctagtcctacctctatctctaattgcaaccatgtacttcgttttgatagaatgaatggtcgtcaggcttatccctattcaaagctcagaggcacaaaggcctcctccactgacactggaagcttcaatgatatttcaaatgattgttaaaaataataaactattgaatgttacaccgttagatagtggctatagtgtaaagatagatgaattgcagctttttaaaacacactatttgcaatgccgcttaagatttttgtattcattcagattataggaccatttctaacacggattcaagcattcgtttcacgctctcagttatttgggttaggcaccacatcaactccatcgaaatagaatctaacagaacacgatttttcatcttgtttgctttccctagaatttgttgtttgaaaatccggatctccagaagcaggtagccacctctcgaaaagatcagatggaatactggaacactgtaaccgtacacaagcaggcccaaccaaagacagagaaggcaacggatagagctggcgcaggcgcaagcggaactccgtccactccttcccataaagctggctcggcaggatccggaagcgataagagggtcaaaccaacaatgacacctgccaaaaataacttctcgattgtcgcgaacgctgcctccagcagttccatttcgacgattgacaaaaacggtaagtgttcacttagttgagagccgatgtcgtgtgtgccgcatttcgccccactacggtaacgcttcatgttcatatgatcatctcaagttcttcatctggatgtttttatgtgtctacaattcatgtaacatattacagccatttcacaatcccgtcgtcgaagtgcaagtgctgcccttcattccaattcatcattagccaacaacactgccaacaaagacacacatcattcatctgctcaccccaatccatctcaaacgtcttcttatgcttcaccacactccaataaacgatcgtctaccagtgctaacaacagcagcattggtaatgccaccaggagcagcaacagcagtggtaatagcggcagcagcagtgccaacaaaacctccactattacaaccagaagaaagtctctttccgtagctacccaaaggaaacgatcgatcaactgacctttattctaaatatcgtgggcatttggttatgatgtgactgtaacaaaaactgcctattctgccacatagttggttctcttatgcctgaaatatcaaagagaagtcttgaaagagagaaaaagaatgtgtactttgtataaattgggatgtgtgcgtgcgtaatatgtttgcgttagtagaaataagcataattcgatgaaaatgggtttttgtattcgttcttgaatatgtataggacaaaaagtttggcgatgaagatcgattcaatgaaacaattttagaagctaaatcaaatcgaacaaacaacaagttgtagaaccgagcaagcagagctatttcaggattagttgagaaaaaaactcgaaatgaacgtgatttgtttaataactcaaggaactgtacaagtaagaaagtttatgtcagtcaaacactgtaaatgtataataattgaatttatttcactacatcttatatgtcaatacagatgctaagagtaaactacaaacatatttgtccttttcgtgaagttttctaatccatcaacaaaccagaacgtaaatgtattttttgaaaatggaatatttaagctataagaaagcatataagcttatgaacataatagaacaatgttaagcctaaataaccaaaatcagcaaatctattatcagacagaagtgaaaactattccctcattttaaaatttaagcaccgttacaaacaaaagatcgatggtctcatctcaattatttttaacttctgcttgtcagcacgttttcaaactgttccgttgccaacacaatcacgaaagttgtttgtttgtactacgttcttcttctactatatatgccatttttgatgtgagcaaacgcttattcactgcgttagaacgttaaaacttgttgcgagcagctcgaaaatgtcttctttctgtttcattgcgtagtttgagtattgcaataaaattcggcaattaatattttaaaattgtttattagttacattagaataatatcacaaaaaatcctgtcttaatcgttgatggcaacttgttttgaagaccgtaatagagttaaacctccatgagtcgatgttccattacttgatatcgacacatggaaccatattgaaaatcatttttcatggttactatgatgatcccctcaaacggctttccatagcattgctgttccatgactcgataattccagtcccttcaatatcgactcatggagggttgactgtataatcttggcatattgcatctggtgaaccgcctttgattatcataatgctcaatgttagccaatgttatagtttcaatgtaagtgcataacttttaagattttttttttcatctatttattttttttatttatttaggtttacatcaacagactatatatatagtcccaatgatactaaaaataaaaatacatagtatataacaaaacaaacgtgacaaaacattgaatataaaacagtcaagatcgtaaaacatttcaaacttaaaatatgtcttcagtttctccggacagcgaaaaaactagaaaatttacggcgaagcatatttcgtgtcaggtggaa

SEQ ID NO: 117 - DNA, 7841 bp, Aedes aegypti
caatgttaagctacactctgttgtctgtgcattaacatggctgaagacggtgtccgtgtcctttgaaaacatattaatagcatttttttttcaaatgtcacaaattcaaaaaaaaaatagtaacaaaaatctaggaaatgactgaatattttattgatcttcatcataggaagcgtacatgagatatgggaaattttataaagcctcatgaataaataagaaaaaaggtgggaaatgcgatttccaacttttttatttgtgtattcttacgcatacacttatattttcgattttcttatgtttaatttttcaacgccgaatacggcgtgctctgatgtcgtcgtcgatcaaaaatatttcggcgcacagaggtctaggggcaatgtcaatggttatgatatattggaaacagtggcattcgaggtaatggggtagaatcatattatcgaactctactatcaatacatagcataatgtggaactattgtgatattggtttctcattgggagatagtgataatttttttacatgaacttagtcatcactgtactgattcttcattaactaatcggatcattttcctctttcctccatttcagttctgggaaatcatctccgaggagcatggaatcgacgcaaccggcatttaccatggcgaatcagatctgcaactagaacgtgtcagcgtgtattacaatgaagcctccggtaagcaacctccccacgtggtccaatccgatttgtgtttttcacgttgttcttctgtttttattatgatccccatcttcatgctgatcacctatcagcaatttgcaatcctaccactgatcaagtgtgtgcaacatcacgctcctaaccccctactcgatcgcgaacatcacccattatttgttagttcaatgatccgttattagctttcgccggtgtttttttctctcgcctgctgtctttcacttcccggtttcgtggctactgttacctaccgtggctgaccgtggccattaaaaccgtctactatccatactcgactctgagctctgattgagccggtgttttctgctgtgcaacgaagcgcgcgccatacaccttaattgatgatcacgaattttaaaccatcgataatagaacggtacggtatatggaatgtaccgcacttttttttctatctgctgtgcaaaatttgccggttggatagacattttgcggaactggtttgtccgtgagctgagtatcaaagctgaaatgcagtagaggcatcattttaaatattatattcatttcttatatctaaatgtgctgtgttaggcaacactatcatcctaatttcttcttcttctttctggcgttacgtcccaactgggacatagcctgcttctcagattagtgttcttatgaccacttccacagtaattaactaagagctttctttgccgattcaccatttttacatgtgtatatcatgtggcaggtacgaagatacttgtatgccctgagaatctagaaaatttcctttgcgaaaagatcctcgaccagtgggattcgaacccacgttcctcagcatggtcatgctgaatagctacgcgtttaccgctacggctatctgggccccatatgaacatattgttaaagtcatattgcattacatttgcgtagaagttcagatttttactggcgaatttttttagtctttaagcagatagagaaaacgcttcttaataaacttaacataaatatattaaacacttatctaagtaatagaagattgcaacgaccttttcattaaattgcatttgatccaattttttacatttaatattctatgtacagtatggtccataaaaaatgtgaaaatcgtcatattatgttttatggtagttttacatacatacatgttgttcattatttgtattgttaaatctatttggacttagtttatcgctttggacatgatttttatctgttactttcaccttactggagaggaattggaagcttaccttcaaattttatcatgcgttcggtcgtccagttcaatatatttgtggtgaaacgatggggttagattatttgcaagccttgtctccagcaatcgcccatatcaaatcatagaattggtgcgtacctgaatcattggaaacttgaacatattttcgaaaaagcggctcatttcggagagccatggttgaatcttcatataagtgtgataagcggctctgttgtgctagaaacctgtgagctagtattgatccaagttgtttctaatagaaagaacaattttcatctccaaaaaactgttatggaccacagtatttattttttattaaacttttataaaaagtaaaggcatgtcaaacccataggacgcgaatgtcctcaaaactacgaccccggccaaatattttactgtgaccatgaaaaacacgttctctaagaactcctccatcctctggtaccaaacaaactaaaattctcaacaataaagtgcgaaggtggaaagtttattatcagggtatacgacaatcaaacgctgtttctatctttgagcggacaaaaccttaaaacttctttgatttattacatttcgtcagccggtgggcgctgatctttccaatagtcggtctgaactcctcctcctagccaacctgagcgtttttgattttgatgtcgtcgcttgggcagtatgacagctgaagttgaagaatcggcctttgagtctcaacttgcacattctctcattgatcggccaccactcgaatacgcgcctcttcatatcacccatcactataaaagctgttcaaagttcgtgtgtgttgctgcagatctggtagatggtatgattacctctaaacgtttgcaccattgatctcttccaacacacttcctgcaacgctacgatgccgaatccccggtccgacgagtatgcgtgtgctccagatgaacttgagagatttacagttccacgtaccgagcttccactagctagtcccttcacgtcgctgtggtctttgccgattgcttgattttttacggctggcttgtagggcctgacaccaacccccttgatttccggaggaccatatgttcggaggaccatagtgcgcagttcatcttggagtccttctctggccctcggacgttgaacagccgcccctgacatggggaacagacgctgttttgagccgctcctaacatggagtacagatgctccaggtttgcagaagcaaaccccccttccctgtcagcatacgaccaaagttcccaccgggggttggttacccgatcttccctgaggttactcgtaccccggccagtaccgcgaggaggtagggataggagttgctgggcaggagactaaggaccgcacagaggagtccattttattccttcaggtacacgagataccgatggtacgccatgcccagccatttatcaacctggtttctggtcgtactaagcacttttgacgagataagtcccccatccccaagtatggatagcaccacgtctgccaggaatttacacttgctggcaattttcgtagaacatcatcctcggaagtgtcgaaatagctgtagatgccttttacaggaatattaaacgtaacgctgagctagtcattgagcactactccgcgatacttgagggattgtttaaactctatggtgcaatcacttacctagacaaacattctttgctcagacttgcggttgtagatcattactacctgagtcttatgatgggctaatcccagtttcctagccttcatccattcctcaactatggaagcatagtgccctgcggtcaactctactttctcaatcgattaattgtagatcgctagggcgcgtcaatgatgaagcctatgatcttaatatccgtgaaaagggcagtctctgtatgtaatcgtacatcgcattccataacgctgggtctaggattaaaccttgagacgcgttcgtggtgattctgaagcttttctgttcttcttctgtatcatatttagaatttgaccattcaaaaagcatgttttaagccaatacaactgcagcgagacgctgaaaaggtgaagtgcatacgtttatttattcgtaaacttctagactagacttaacctactccgacggagagttccccgaaaggaaggcttcctgaaaccgatcaatccccatcaagagctgtttggcagtgcgctgaggtcggcctattgattacgatcggaatctaatgtccggttcgccggcacactgacaacacaacaccaattttttgtcgcgttctactcaacttatcccagacggactttgtcggagaatccctcgtcaatgactgactgggtgccgtgtggtccagcgattccggatggagcattgatactgcgatgacccaaagcctgtgattctatagtgatcgttggcctattgatctagtcggcagtgctgatattctggttaactattatacatcagcttcggctcaagtctggagcattatggcacttccgctgtgacgatgtttgtcctaaatttgtatcgtagcccagcactaggtatcttctatctatataaataaaaatggagtggtgtttgtatgtcacgaaatggcttacgaacgggtcaatagatttgaatgattctttctccgctttgttcgtcaagggttgcgaagtgtttgtgtgaataaaaatctcaggatattcaacagcaaaattggataaacgagagtgaacggaactgtcattttgtatgggacgatccatagcgttttttaacagcctacttgataataagacgaagtttgccgggaccaggacttgtacagtgtgaaggccatattatattagtataagtttattggcgttcttctcatatgttattctgaaattatagttacacagaataaaaaagtgcgcacattatggtaagcaaagggccttgttcgctttactatgaacacctcattgtttataagacttttttcaattgattgttcgataaaccacgttcacccgactcatttccactttccgtctgttcccttttgcagcagtctcccgttcgtcgggtggcaagtacgtgccacgagcaatcctgctcgatctggaaccgggtaccatggaagccgtccgctccggagcatacggcaagctgttccgtccggataacttcgttttcggccagtccggtgcaggcaacaactgggccaagggacactacaccgagggtgccgagctggtggacgccgtgttggatgtggtgcgcaaagaatgcgaaaactgtgactgtttgcaggtaagatactgaggttaaccaatacctaatcgttaactaactcttattacccatttgtagggatttcaactgactcactcgctgggaggtggtaccggatccggtatgggaacactgctgatctccaagatccgtgaagaatatccagacagaatcatgaacacatactcggtggtcccatcgccaaaggtgtctgacacggtcgtggagccatacaatgctactctgtctattcaccagttggtcgagaacaccgacgagacctactgcattgataatgaagctctgtacgacatctgcttcagaactctgaaggtgccaaacccaagctacggcgatctgaaccatctcgtttccctgactatgtccggagttaccacctgccttcgtttcccaggtcagttgaacgctgatctgagaaagttggccgtcaacatggtgccgttcccacgtctgcacttcttcatgcctggatttgctccactgacctcccgtgggtcgcaacagtacagggctcttaccgttccagagctcactcaacagatgttcgatgccaagaatatgatggctgcttgcgatccacggcatggacgatatctgaccgtggctgccgttttccgaggacgtatgtctatgaaggaggtcgacgaacagatgctggccgttcagaacaaaaacagcagctacttcgtggaatggatcccgaacaacgtcaagaccgccgtctgtgatattcctccaaagggtctgaaaatgtcttcgaccttcattggaaacaccactgccatccaggagctgttcaagcgtatttccgaacaattctccgctatgttccgtcgcaaggctttcttgcattggtacaccggtgagggcatggacgaaatggaattcactgaggctgagagcaatatgaacgatttagtgtctgagtatcaacagtatcaggaggcgacggctgacgatgagtttgaacaagaagagtgcgctgacgaaatggaaggcgaatgcgtctaaaacaaccgccccagaggcatccatcggttgtcgagaagcattttttactatttattacttttagttagataaatcgagccgatttttatgtgtatacaaaccgaagaaatagtctttatggaaattctaacagttcatctaatctcggatctcaagcatatttactaatggacagttcagatcaggaactaggaattctaaaatcccccaataataatttccgttcaaatcaaaatccattcaagcacataagaatcatcaatcaaactaataatgtgtaagtaagagagcgagagtgtgagctagtgttgaatttgtaagtggagacttagccctttctcaccaaacggccatatactgtagcgaaactcgatcatgaaagtctacattcaggcagtatttctagggaaaagaaataacttgcgttactgaggagttacgactttcatatcatactggctgaggcggtgagttgggtcactccaaacggtagagttacgaaggagagtgaaaaacagatgaagctgccaatcgaacgtagtttgtggaccaatttgcttcttgctatacgactcacgtgcatcatacacttagcaatatatccaaagatttttgagaaatgaaggttcggttaaaaaaagttgagtgtcagccagtcttttgtatttataattcgttctctttaagcaagaacaatcactatgaatatcgtcgttctaaaatctttgattcatcgctatttgatatttattattttgaatgtttagaatcaataccgaaaacaatttaaaacttcaaaatacaggaattgtcagttttattttgagctaaattttaatgaggatacagatcaactatctactatatcaactacacgcgtacatcgacgacaatctgggacaattgaaaagtgttagtgcggtaaaataaaacatattttgtatttatttgtaaacatgtttgaatattttatgtgatgacaatccaatatggctagaaacattatgatctttaaaaatatgtaacaaaaacgaatttttaaggacctaatgtattgtcaacaactatcgaataactaaactttacatagagggacatggggcaagagtgacacccggggaaagattaccatcttcaatttcacgtggacccatgataggtccaaattgaggttgtgtaaatattaaagggtaaatgattcggcaccctgagggtattttcggcagcactaacttctcgtccttgttcaaatttatctacggaacaagagttaacttaaatgtactcaacatattccttgaactataatcttccatgtaaatcacatctttcacaaaaatattatataacatgagttttatcattaaatgaaataaatgcttacgaaattatcgtcattcgagagctgccgaataatacaacacaagaacagcttactaaaaactcaccactttaaaaggtccaattctccgctccaatgccaattttttcacaaaagctacgcaatgatcacttatggacttttgaacttttgattt

SEQ ID NO: 118 - DNA, 111209 bp, Aedes aegypti
  misc_feature (52370)..(52469): n is a, c, g, or t
aatgccgagtgtagttactgaaagaactcaattgagtccctaaagaatcttattgatgaatgtctggagaacttcttggaatgatttttaagaatttcctggtggaatcactgggaataatacggtgtcttccttagccaagcccttgggttagagtccgtgcgtacaaagcaaaaccatgctgaaggtgtctgagttcgattcccggttggtccaggatattttcgtaatggaaatttccttgacttccctgggcatagagtaccgtcgtacctgccacacgatatacgaatgcaaaaaatggcaactttggcaaagaaagctctcagttaataactgtggaagtgctcgtaagaacattaagccgagaagccggcttagtcccagtgaggacgttaatgccaagaaagaagaagaattcggtgtaacccatcaaagcattatcagtatacatcccaataaaaatcctccggctacgcccatgatggcttccaccccaaaccggatctcgcaggagattcgcgctggtcgtattggtcgcaataataagtactctcgagacgtcgtgctcgcaatgccaatttaatttcagtacccgtcatgaatttctacgatatgcgaagcgaacgacttcggtacggtatcgctatacaggtcacggcgtgagcatcgagatagatagcggagagggagattcattcttagggtttaatggcaatttaatgagcaattttcccaaggcatcgagatcatatagcgatccgaagtacgtgatggtgggctgccccgcatcttcgaacatctacaactattttcatcttgcgctctcatattttccgcgaaagggaagagtttcgtagaatgaatatttcacgccattgattgctgctccgtactactttcaactgccagcaggaatgttctgtcagaatggaggacacaccgctaaagttaaaccaacttttaatgatattctctttgccttatcacctgccccatccgtttccagagtgtgcttctaataataatgttcaatttctgtttcttcttctaccattttgcaggtctatccaggtcgagatatcacgaatatcgtcgagtcgtctcactatcagaaaatcggtggctggtgccgacaaggtgcactaaactcagccaagtgtaaaggtgctcagcggtggatcaaaccattcagatgtttgggtaagttccaaccatcgaaacgatgcacagtggtttgccttatacaaaagtcggacaaatccttaaatgtgccacaaatagattcaaaaacataattgacttgacagtcagttttttgattttttggtgtagatattgtcaacctaagcaaaaaaaaacataacataatgacgaaaacacctgaaagagaattcaaatctatactataagaaaaacatataaaaagaatgacaaaaacatttttgcgcgtgaaatcgcttgagccactattggtacacctgaaacaagtgttgcgctagtgctcttttagtagctattcggtaatgatgcaagggtttccaaacaaaatagttgattcttacataggttaaacatttttcgctcggagcagcaactaaaatctttagcataaagatcatctctgggactttcttcatttttatgcatctacaggaggcaaacatttgcttacattcaaatgctaataaattttcaaaaaatggataaaactggatgcatccgaaaacatccggaaatttcggtctagtttcagttattggttttgccatgcatgttttatctgccgcttatattttttggcggtgtgaagttgtatagatgtttaccatatcccaagaagatcaatttcaaaattcaatgccaccagacgcattaagattcgttggatatctttcgaaatatgactacttccataaactgttcaatctactgctacatttaaaccattggtaccggcactcttttttttgtttataggacgttatttacaaatttaatttgtttaccgacatatcggtctgctttgcttttttaagttttttgttatacgcactttctgacatagaacacattttgcataacaaagtcgaccaaaaataatgcgatttgtgcaaaactgataagggatgtttcaaagaaatgtaacgtaatcaacacattgataattaaattatttattcaaaaattgaaacctaatcttgttggatacagcaatcaaatatgtaaaaatcagatttgtatcttcaccagtcttgaaatggcagtatggtgaagtcgtgcccatactttctgggacaccctatattacttgaaacgtccttccttgtggctaatgtcccctatgggaacggcttggcgtattgttagaataacactaccaagacagccaaaaggaagaagatttcaagcgccctaatactgtttggcaatcaagcaggttctttcgatcgttgtttacaaatccagtttaaaaagctgttcatacataaaatttgaatgttaaacaaaatattgaacatgttctgaaaatagacaaatttaactttctaatggcgaagtaaataaaattttggaggattgtgaaacaagatagaaatctgtatgttacagtcaccccacagttatggatagcacacagatatggatcagagttggattaaacagagaatatctcatcaaatagcgttgcaattatgcagaacacattttacttacgtgaaccataaatctatacagcatcacaatcaattataacatgcttaagcacaaaccacgtgcctataagcgttgattcataactgtggggcattgaaaaccataccatagttatgaatcaaagataagattccgaaagaaacgccaaaacgtatgctttcactagcacaccattcgtttacctcatagctgttatagtgttctgatccataatatgagtcgatttgaaccataactccctctgatccgcatctgtgggatggataacgtttgaaatttcgaaagaattcgacactttttcataaataatcgcaaattttgaaatgtattcaaaaaaacaagtatattgtgctgtgcctggaaagcaattttgttttgttcagcgttaccatgatttaaatcacaaactcaatcacgatttgcttgttcggtaatttgttatactgggtacgaattgtaaaccataaaaaatactggactttcagctttttgattgaaaactcctgaggttcagcaatattttttactttttactgaactaccttagctgtcatactcaattttgcaacattaccgaacaggctgataagtcagtaaaacaattaccgactattcagtagttgatgttttctaatttttcttgtcgtcaaaatcaaatcaaaacaaattgatacgcatgcgtaaatgtgtcaaatgagaatctcctggctgtatactgctgtatgtatctatagaatcagggacggacctggtgtagtggttagaacacacgcctctcacgccgaggacctgggatcgaatcccatccccgagatagtcactaaaaatatttcagtgacgacttccttcggaagggaagtaaagccgttggtcccgagatgaactagcccagggctaaaaatctcgttaataaagagagaaaaaaaaaaaaaaaaaaaaatctatagaatcagctggccggtgccaggagactcgtggtaagtagacgacatttagtgacaaactcaactattttaagcaacccaaaaaggctcagcgcgattttaactgctcttacgttggtaaattcggttagtttccatactagagatacatttatctgcatcattgagtttgcatacaagaggcaaaccaaccaaataataatgattttttcaaacatctttcgattactttcactgagatacaagcgtaccgtagatgtttattcacaagaaaaaatgctgaataagtccatgtcgcttggttgtttttttgtattgtttttagagaaaaaacagaatctggaggagaaccatgggaaactggaaagccagcaaaaacgctctacaattttactgactaagtcagtaaattccatcaaacaaaacatgttttgtttactggtttttttcgataatcgtaaaaattaccgaaaaatccgttgatccaaaacgcagtaaaattttactggggtcggtaatctgaattggctgtgcacatgttattcttaaaattgacccgtagttgatccataactgtggagtgactgtacatgggttagaattgaattcatcaaggtcgaaaccctactcaaataaatataaactaactgttgggctattatacagcaaaccgtggtggactcctgagctaagaaatctccgtaatggcctcagaaaaatgcgtaagcgttattttctctcaaagagtgacatcgacagagttcagctgcggcagcgtgaagctgagtacgaacaggctctttcgtcaacgtatgagaattatttgctaaggattcagtcatctgtgaagcaaaacccttcgtacttctgggactttgtcaagcaacggaaatccaacaaccgcattcctttctcggtcagtttcaacggagtgacatctcgttcgaatgtggaagcagccaattgttttgcctcattttttgaaggcgtttttagcagaacctcacccgtccaacgtaataaccactttgcccagataacgtctcacgacatacatcttccacgcttcgagttttctcaagatgcggtacgaaaggttctagaaggacagcccaagaaacatttgcctattttataatcatttattaagcaatttttcacaactacatactgaatagttgctttattatattactttgcagctgctacgcacacattgttcaagcaaatctggcgaaattattaagcttcttatcatttagtgactgtaatcatatattgtaattatgtttattcaggtttcacttagcttaataaggattgatgttttaacaacgctagtttaacaaactatattattgcagtttaattcagcatcatgtttaacaacattttaattatttccaagtgaagcctttgttcaggcgttgttcacataaatttggagaagttataaagcttgtcgttgtatattggctttattctacaacttcaaaatcgctttataagcattcatctcagcttttattcaactgccacaaaattgattgaaaacaaataaatgactaaaaatagctaacaccgtatacatcaaatgcagtgtatacctttaccatgaattaataaccacacttttaataattacctgaatactggattcaaactcgagaccttcccatcgtcagcggtataccttgccatctgagccatccttgaattcatatatcagccttccagtgcttaatataaacctcttgtagctgattattgatcatgcttgagcttctattcaacaataactaatcaacacgtgctatgctgatcaactactgaataagcgcattacttctgctgctgttcagtactgatgcgagctgaactcagagggctatttatagtgcacagtgagaaatttttttttcaatggtggtcaaaaataaagtttattcacaaagtaaaaacagtctgaaatgattaatcgaatttcataataagttttaacttgttaaaactttaaatgaattgttcatctaactatactaaaaatcatttattaaatgtttaatatttctactaggttaatattttagttaattgtcgcactttttccatctattaaacattatacaaatataaaataaatttcaatcaaatatcctatgtcagaagactgattcaaaatattttctaaacatatttgaatattgtattgagaaagcatcagttattattgtacccaacatgtttttatatattagtaagttagtgacgaattcgccaaggacgaaaagccactcaaataaagataaataataacaatattagtaagttgaacattgcaatacattaggaatacaacgcaatttttagatattttgtccatttttttaaaatttggctatggtgtgacctattttgtaaggcttctttgttgctgaacaatgtgtttagtaattgttattatggacttctttggatgacctgctcggatgatatatctatgttgtattaggattttataaaatacctattcagcttttaatcatgttcatgttgaacatggaaacagctgaagtgcgaagcaaccaaaacgttagttcgtctcctgtacatctgtttacacaattatatttgttttgtggaatattggctctttaatagaaggaaaaatgacttgttcaactcattagtaaaacaatcttgacaagtcggcagagattctttggagaagtttaataagtgttgattctactattaatcattccaatgaaaaatgttgaacattgacttaaatttggatctaaataccatcttctcagctctttttagggcattttttcagctgtcaccattattcaacaataattaactatgtatatgtttatttttgcaatatctcatcgtaataggctgtttttcatcacgccaatctgtcatgaaacggcctactttcctgcactgaagtatgtagtgcgggaatagtcattacctaactgacaccagtgctgtaatgattcattacgcaacgctttctcattacgcaactgttttgagttgcgtaatgaatcataacacaacaatttctcaaaaattgtaaaacgttagtgtatgcattccaatataatttctgataccctcgagtggtcttttacgaagttgcaaaaaatgttgtacgtaactcgttgcagaactcgatttttacagcactcgtcgtaattatcctactcggcaagcctcgtaggataaatttacgactcgtgctgtaaaaatcatcattctgcaacttgttccgtaaactactattgtgacactggactgtaagttgggtaaccactttcatggaactattgttaaattattatttatacttcgattatcattgaaaattttatgattggtaacttttttccgatatcaataacgtcgcagatgatgatcactacatttggaaaaattaaattttgatatttttaatccaatgtgattcgaactttaccctcgttgatccattacgtcgccattacgtccatccatccatcgcatacacatcttggatttgatttgaaaaacatttgaaacatttgaaaataacataaaaagacatcatgcgttttgcttgaataaaagcatactcatatactgtcattcacattgtttataagttttactaatcatgctggtcaacattttaagtattagacactgaaacttttgtacgatttgttgttaatcaaatgttcaatattctactaaaatgatggctacaacctataaaagctttcaatcagtcaattgttaaacttctcatgtgttgtagaacaaaagctactatatttgcattttaggaggtttattcagctcttattcaaaacacaaactgcaagtggaataacagcttttttataagcggaaatcaatattattcaattaattattcaactaaaaatttgttcagcaatggttgcagctatgcagcttgtattaagcacgtaagtatcttaaaagctaccaattgttccttgggaggacacctcgaaaggacctggcacggatgacatatctccagtgttactaaagaattgcgccaatacatttgcattgcccattgctgctgtgttcaatcgttcgttccgagatggaatttttccaaaggcatggaaactggcggcaattgtaccgatccacaaatccgggattctcaactgtgtctccaactatcgtggtgtatctatcctgtgcagtcttagcaaggtgttcgaaaaaatgattcacgaagttctgtatagtgctgctgctccgtatatctcaattagtcagcatggctttatgaagaacagatcaacgacaacaaacctgatgtgctatgtgtcagaaatatcccgaggcatggaaaccaaaaaccaagtcgacggagtttatgtggattttgcgaaagctttcgacacagtaccgcacaatctgatcatcgataaaatgaagcatctaggtttccccgactggtttacaaagtggctgtactcatacctctctggacgtagcgcttttgtaaaagtgaactcgattagatcaagatactttagcattccatccggagtaccgcaaggtagcgtacttggaccacttattttcattatttacattaatgacctgagcgaactgatctcttgttccaaactatcctttgccgacgacctaaaatttttccgaaccatagcttctccagctgactgtttcgatattcaagctgatattgatctattgttagtttggtgtagtgacaatggcatgcgtgtcaatgagaagaaatgtaaggttatatcttacactcgccgcagtaacgtgattcaccatgaatattgtatgggtttaaatccacttgaaccagtaaactcaatatgtgatttgggggtcactattgactcgaagctccggttcaatgaacatatcaacatcatagttgccaaggcattcacggtgctgggatttatacgtcggcatgcatctggatttaacgaagtgtactgcctgaagacgctgttctgttcactagctcgcagcattttagagtatgccacaccagtttggtcaccttattatgcaacgcatacattgatcatcgagcgtgtccagaaacattttttgagatttgctctgcgacaattaccatggaatgatcctcaaaatcttccctgctaccctgatcgttgcaaactgatcaacctagaaactctctcagcccgtcgtaccaaattacaaagactatttatctttgaccttataacaggtaacgtagatagtccggaacttatccagctgattccgtggaacacaccacctcgacgcttccgaaatacattaatgtttgctgtccctttccacagaacgaactatggttcaaataattctttaaactcgtgtttaagatcatttaacgatgtaagcaacgcatttgattttaacctctcgaaagatatgttcaaacttagaataagaagtatagaataatatagtttttaagaaatcagtctgtacgacaaagtcgaagatggtgaataaataaataaataaacatgaatgtgatttttccccttttgtgacaaacaaactattgttcatttgacagtgtggattgttcactgttcactgcctagtagcagtgacacattattccgaacatcttcaccgtgtagattcttcaaagttttagaaaaatatggataaaggatttcatgataacttttcataaacaattagagacataacttgacatacaactgtgtttagaataataatacagttaactctctcttactcgatattcaaggaaccatcgagtgagggaggtatcgagatacagaacacatatttttaaattttacgcttttcattattttgacaaaatacattcaaagtagtaactttaacgtaaaaaaaaaacataatacaattttaccagatttacctttgtgacacttttttaccggtcaaaaatttggtcacccagaaatgggcagtaaacttatattttactatcaatcataatacagtgccttcccgattttggcaacacccgattttgtctacccccgattttagcaacacccgtttttggcaacaatttattcccgattttggcaacacattgaaaaatattttcaattgattataagacactgaaacctaaaatttcgagttcaaacaaagtgacaatgagtgaaaatgaaactggtagtgaacattgcgagctaagaaaggtaatctggaacgttcttaggcgtcgtccacaaattacgtaacgctctagggggaggggggagtaggctcaagcgttacagctcatacaaaaatttaaaaattttcatacgaaaagcgttatggacggagggggtccaaaaattgccaatttatgcgttacgtaataaatggatgctgccttatgagtagaaatcgtatatttcaaagttattgttaaacgtatatgagaagtcttatgaatcaggcaagctatataaactactgctgacttgtttaaggctaagtagcccgtcattcgttttggcagcaatgatgactttacagcttgcaatttcaaagtgataatattaagtcttgatagtttatattgacttgaaaaaagtatcactgtacgctccaacattcatatagtatgctgatactttttcagctgtgtctgtgcaaaaccaactgattttcttcaattcaaaatctggagatgaataagcaacaatcatcaacgacgcgtacaaatttcaattacggcctacttcgccttaataggcatcataagttggcggaataggatggtaatcgacaataaaagcaagtgtaataaaagcatcaaatgtaaggacgatctgttttactgtattgatcacaaatgttttgttgttattgtgatttcatttttttacatatcaatcggattgtgtgtggcttcaaattctctcgtgatcattgattagattttatttaataattggtgtaatttctataagatatttatgtaggcatttcagtaacaattgttgaggaaaacattgagcacctttgttaataactctagatgacagtttgggaaaatgttgagaatgggttttgacgtagtcattgaaaaacgtttatggaggaattctaagagcgagtaaaaaaagagcccatgtttaaaatttttggacatttttaaatttgtgtagtctcttgcttaagaaattatttctatcatttggaaattatttcttgcaatcaagtccatattgttgcttcttcagcagtcaaaattttttctgaccacaaccttgtgaaagttggagagcggtataaaagaatattttgttgcctattctaagcaccttcacaattgaaaatttcacaaaaaaaatgtttactgtaatcaaaagtaatgtttaaacctcacacattattctacaagaagaaaaaagaaacaatgctactacaattttttttccgctgatttcacaaaattttaactacattttttctgctatcagtttttttcttttggaagttacacaaaatcctgccgaaatagaatcgaaaattgtattgatattgcaagcaattaaagaaatcgtataaaaaattgaacggtattcacgtgaaatgagaaacgcaataaaatgaacgaaaattgaaattgtaaaactttcaaccattttcaattcgaatactactcctcacgttgtgtcaacaattccgacacacatttcttacttgtcataatttttttttttttcaaaaaaatcctttcaattttctaatgatttaaaattgcaactatcagcaaaataatttctgaatctcagcaaacgaatgtaatgcttggtgagatctcgtcattaactctatttctgggtgcttggcggcgccagtctggataaatagcatcgttgtttcatttctgacataacatctgattagcattgattttagcgtagtaatttataagaactgccactgttcccaacttagaaccttgttcacttttaagacgtgtggtaatcataatggcactctatgcaggaaatcccaaaaataaacccacctgaaaggatcatcaaccgaacctgtattcgaaatcagctactttcgatatgttctggttttaaagctgcctatttgctctctagaacagtcgcattggggccttccttagccgagtggttagagtccgcggctacaaagcaaagccatgctgaagatatcttggttcgattcccggtcggtccaggatcttttcgtaatggaaatttccttgacttccctgggcaaagaatatcatcgtacctgccacacgatatacgaatgcgaaaatggcaaacttaggcaaagaaagctctcagttaataactgtggaagtgctcataagaacactaagctgagtagcaggctctgtcccagtggggacgttaatgccaagaagaagaataacagtcgcaaatggccactgaaattaataccacgcgtgtactgtgtacaacaagagtgcttttcaaatggtgcatgccatcagtacatgatgtctctgcttttgagtcaaaagctgaactgaagaaggctcccagacgtgtttcacatcattcgtagtagttgtcatccatttgctgatacttttagagattaaaatgataaaaaacataagcatttcaaaattcccgaatttggcaacatccccattttggcaacataaaaatcatgccttgttgccaaaatcggtaaggcactgtattcaaattcttgaaatttattaacatttggaggacatttggaactttttatgaaaatatcgagttagagaggtaaactcacttgggaaactgaaacagatagcatcgagttagggaacatcgagttagagagatatcgacttacagagggatcaaagcatgctagattgaagggaccacacattccatcgagttagggggatatcgagatacagaatatcgaataagggagagatgactgtagtaaaatctgatgtgtctccaccgcatgtggcaagcaatcaacaatgaatcagatctgaagcacatcaataaacaatggatcagacatgaacctgactgcataattataattcaaacgatctccatttcggatgccaatgaattttcgaaaaacttcgccgaagactcgaactttctctctcatctggttcacaagatagagtttgattcatatgtttgattaattagcttactaatgacatctagtggcaaaattgagaaccaaatggttcgcctttcgtatgtcctgggtatcctgaacaattttgtcgaaggcttgaactttctatctcatgtggatcacaatatagagcttgctcaaaatgttcaattttattgcttactagtgccacctagtggcaacattttgaaccaaattgtttaccttccgagtatctttgactgtctgaaccagggatgagaaatgtactgtagcaaacatttaccaccacgacattcacatttttctacacgaccatcaacatccaaagcaatccatgaccgttcaaaacaaaaaaatgtcacggctcttcaaaactgtaatcttcttcttcgtaacgttttttcaaacccgaatgcgaaatgactcgagcacagtggtgacgcgatttttctgattttcggggttttgcatttttgctcgataaaggcagcatgaaattgaacttgtttatatgtatcgcatcggaatgattgtgctcttgctgttagagctaatagatttcaattagttgaaaacacaagcgaaatattagcgattgaattatttaacatttttttcaatcattcacctcgagatggctgcccgaaaacggtcatagtggagagacaaagacagtcaagcagtgtgtgaaccgttggcagcgcaacacttgatggtattgatgctgctgatgctttgtgttttggttgactggcagaatcgatgaactgtggcaaattgtgatcacagttctcaagcctggtctgaacaactttgctgatgactctaactttccatctcatgtgaatcacaagatagaacatgcttaaaatgcccaatttcacatgctcactatcgccacctagcggcgaaattacaaactaaactattttcttttcggatgtccttgatctgctgaacaattttgttgtagaccgcactattatagatcatcagcatttcaagatatatttcatgttttgaggtgatgctaaacttttcagagtgattcaatgttcagctgagtgttgcaatactttttcgagtgagttcgtatttatgacgggtagtgtatattttgactcaatagaccatttttcgaaattttaacggttttttacaggggattagttgcgcctccgaatgcattcactgatatttggatatcgatggataatctggatacacagccgaaaattgagtgtacacctcctattccattagagattgatgaaatttaggatatatctgctttatataacaacatcgtatatgaatatatgcagtttgaggtctcatgtggaatatattcaaaacacattaattacttgaccatttgacaggttgggactctcaatatgctattccggagaatgaatccaatgccaatgttgatttccatactgttaccgttgcgaagatcttaatttgtttatttatttttcagaataattgttagtttgttgtttagtaaaatttaactaataattagaattataaaaaaatgttagtaaaattgttgtatggttgttaataattgttaattaaatgtattactccggaattagttgttaggaacaaaatatgttaacacacgaaacacacattgaacacgtctaacaataatcatgcaaaaagaggggaaaagtttcagccataaggtatgccacttcaaaaagggaataaaagaaagggtatggaaaagggaacaggatgagcaggctactgggttgaatagcgctaaaaaaaggtctatttcaaattagatctcagtgagactacacggaaatatttccagaagttaagttgaccgttatttagttattgcgtttcaagtgcattattgcctaagtgcatataccgttcgaatcaggtatgagtattgccgatatatacggtatccagaatacccaatagccagcctaacgccctacccataaccctactaccaggacccgttatcgtttgcctgaagatttcggcagaggctcccacgacccgtctaaacacgtggtgaacccctgtagctgccctgaaggcccgcctaaggtccaaggatcaccaaggatacctgaagccgaccatttggaaaccccgacgccctaagaagctggcgcaacccgttaaggatctggtatcaaatccaacgcggagaccgttgggccacaccaagccatccaagccccgtagacttcgggttcagcatagaacgtgccgatcaaccaccacgtgctccacttccggccggccgcatcgagacactacacttcacccccacacgacacccagtaagtccaataaaagaattaaaagttacatagtgcgttttacttgaacccttgacgagctttcgccgaccctaagagtctctgtatttgagccaggtccctctgaccggccgggtaacaatactgtggcaaaaaaatatcacatttgcacaggggacggacctggtgtagtggttagaacacacacctctcacgccagttttcaaaaaattatcacaaacttctcatcaaagtcctctatggattatcatcagaaccctcttcaatctaaatcttctgagtgaaaatctttaatatctccttcctctcatcagtgtcctttaagatttttcatcagtatcgtctatggattcttatcagaattatctctggatttttatcataatcctcctatgattctaatcagaatcctttcatatttctcatcagaaacctctcaagaatctgcatggaattcctatctaaatcctttccggattctcatcgcaatccttccacgattctcgtcgaaatctttcctagattcgcatttttaacccattccttcctgggttcaaatcgtgatcgttccaggattttcatctaaatcttccaggatgttaatcgcggttctaccagaattatgggatactcttaaaaaacgctttagcaaagacgaaataaagacctccatattccttgcagttgcctacactgttatggcatataagagtaaaagtattgttgccagaaactttccaaaagtttcgtcagaaagtttccagggttctcataagaagatttccagaaatcttatcagaaactttcgggattctaatcagctttctttccttccagtaaagtgaactcctataaattgctaagactcttccagtgtagtttcaaaagtttcaaaaagtggaattatgttactgaactagagtttctgcttagttatcaattgtatcaaacaaaaatcatgatagttttacctttccgaaacaatttgattcacacacctcatgtaagaatttcttcaaagcttacattaatgtaatacaagattattgattatttaaggccgcacgggacgtcatcataatcaccctatccatttgaagaagcaaatcccaagaaccactccatatatcgatgcgaaaaatgtattactatgattctttatatgtcgtgcacaaccattttcagcttcatcggttcacttaaggtgaaacagtttggaatcaacttctaagattgcactaaaacttcaaaggcacaaatctcgcagagaaagcgttccacaacagtgcactttttattttggctttgtgcactagcggaaagcttaaaataagaagatcaggaacatttgccaactatttctcctgttttgtgccattgaaaacgtgagtagggtgagaagtcggccattgcgacggtcatctttggattccgagatgtttcaccttaaactcgaaatttgcttccacaaagtttcgatgataattgttagagtgagacaaaagatagggaaaataacacggtctcctgtgtcaccttaaactttgtttttcatttgctggacaattgcgagtaaagatgatgttaaaaatcgacaacatacctgatcaacctaaatttttgagaaaatatcgttcaataaagttatctctctcctactcgatattccgtagctcgatattgagatatggaaccatagtaaaggttggctaactagaagatcctttggatcgcagttgcgctgattttgttttctgttagtcgatacatccctatctcgatggttccttcaatatcgagtcatggagtattgactctaatttatttgttcacagcaagaaaagtagagtatctttctgttaaatgtcaacattttgaaaataaaaaataaaatgcttgaaacgacttccatgcgaacatcgcatcagaaaatattgccaaccaatagtaattcgaaaaagatcaccgggaaaaacattttcccatgactgtctgcaccagtaacgatcatatgagcaaaactcgatcaaatgtatcaaatcgatgtgttgatattttcttacctttcaaacaaaaagtttcaggaagtcaaaccaaaaacaactttgaaaatatcactagccttttgctaatgaaataatctatcacatcgccgaagacgctagattggtttgactgcatcttcattatgcttttaacgtaatgagtaagaaaatctcgataaaatgtatataatttttcagtttttcatataaattccaacaattgtttttgcgttttgtatcttattcaactatgtttttttttatctggatgttacaaacatactgttagtaaatcatttgaatgtataaattaatgtttattagatgtaattggaagattatcactcaataccctataaacccatagggccaagtcaactctctatagttaaaccacagttactgatgatttagacttctaatcttggtatttacagtcacaaactatttaaagaacatcaattcttaagggtttttccggccttgcgccactgtgcacttctgtatttgtgtgaatgtatatgtgaccgtgttttctggggcaccgtgcagagactccgaggccacgaatcaaagcaaacttcacccagggcaccgttatttcctttttccatcatcacagctgtatcgtaatagctgtggcagcggtacttatcctctagctgacacaggatgcaccgagaccgtccatatctgaaattaaattgaatttatctcgtgctttaatctaaaccacccgcagcagtttgctttgtctgttaaagtaatttggattattgttgcgagtgcttctttgtacgttcttggtaactttgtcgtcgaatcgaaatagtactgaagctgacgtttaagtacatctaataaaattagtaacgccagtaactctgttgattatgcaattctacttataattccttagaaaaatatggtcaattcgaatgatattggatttcaattagagatttcctgaaatactcaataaagctacgatgcatggaatgcaaaattgtgttaagattcggtgttaatacctcagagattttgaatcccacttgaaatattgacaagacgatagatttttgtgccaactcaataatgctttaaaagtggttcagatagccgcagcgttaaacgcgcagctattcagcaagaccaagctgaggtttgtgggttccaaagccaccggtctaggatcttttcaggttggaaatattcgtgttttcccaagacaacatttccacgccaaggaatttttccaggcgtgtctcctgattttttttcagtgatgccttcagcaattctttcgaatatttttccagaaattctttcagcaatgattccaggattcctctaacgattgcttcaggattttttttagggataatgctaggaatttcagggatttctccaattattccttcagagatttcttcaggaattccatcaaagattcctctaagaattccgttatggtttccataacgagtttctccaaaatttctttttggattttctgtagtaactccaacccgttttttttttagaatttcacaagagattccgccagaaatttcaccagagcttcctctgacttgaatatttttgatgtggtgttctagttgaacctatcgacaaggtatggaaaagttgtaacgccccgtacgatggtatctgagaagttcaataatatctgatatataaaaatgttttatgctatatcttaactattttacttattttgtgttctatgtactaatctctttaccaagactatgactctttttataaacgacctgctttacccctaaacataaccataatctgacatatttattactgaccgctagtaatacgttcgttcttatcgttagcccccaaaatctgccaatcgcatcaaaaccccaaatgtacctattccctaacgggctttgtctgacctgaagcaatccgacccgatagcaaatcaatagcaaatcctcttacacccggtcatctaccgcttttaaaagattaatcgtaaacccatgcccaaagcagccccaagttttgggtcaactttttatgccgcccgtcctcatccagtgccgtttcttcccctctgcttccagaaggtcctttccagtcagacgctcttctggtgcccgaaggatgtctattcgaccacatccacaacgcatcccggtgctggccgttcatcaggtggaaccagactggcgccgcagcatgccaggaccggaacatgcaaatgcgaagcttcgccatgctgctgccctgtggaatctcgctcttctccggtgtcgagttcgtgtgctgcccaaagcacttcaaaggtaagtgtgcttttgcgtatatcatagaggggtatgatgatatcatcggtgaatctactacttcaatggcgtactcagtacgtagaggaagaacccattcaagcttcctgtgcactccgctgctgttgtccgttaagggtatgcgatattcggatttttaatatcgatacctaatgaaacggtatacaaacactgtcattgacgacacaaaacgaaataagcgtggatattttttaacgaaacaatactgtgatttcatttcacaaaatgtatttttcatcattagggcgagatgagcactagggcggtttaaaatttaaaaatgtttgaaaatccaatctccaatccagttttctaggtagtgatttaaaggtggctcgaagacgatgtaggtttatatggaaattactatgtagaaatttagaaaaatgtccaaacacgttagtacttgaatgtaagttaatagaggaaaagcactaactctttgacccagcactaatttttgacccattcatacaatttaggcctattttgtatgaaaattcgaaaattggcacagaattctagtaggtcgaaaattagtgcttttcccctacttatcattgttcaaactatagaaaaaaaaatttctaaagagagcaagtaaattcgacggatagttagtttctacaactttgctgaagatagcatgccgttaactttaaaatcttgtgagatgcaagcaaaatttgagcttgttaagtgtatttttgaagtgaattttctcaatttacaaaaactacgttctcccagtttttgcagcaaattttgcctattgtatggcctttttaatgccactaaaagaaaaattttatcgaaccaactccattagttataaacatctgaagattgcatagttgttcacttaaatttgcttataaattcaaaatcacaagagtaacacgcttgcgataatcagcaaaaatgtgtatctttacttcctctgcaactcttctgaagaccacattcacgtaaaactgaaaataaaaaagttagatcaaaataactgattttttgggttcaccctaagttaaaactttcaaaatcaatctacttagctcaaatgaagagttagatcagaagtgtcttcgacaaagttgttcaaaataacattttctaaaagtttgcagaagagcgcagccacaaatttcatcaaacttgagtcacaattttaacttaaatgagggccaccctattctactttttttttaaaaaagatgcaaaactcaattacgaacaacttctctgaagacatcgaacgtctaaaatcgacgagaacagagaaaacacttttttccggctaatttgtcgattcggtccattgtgcaatggagaattacacttcggagtatgttctgtccaatcccccccgcaaagtgacagataacgcaattttcacgtacctactttcaacgtaaacaatggggtcatccaccgctgccggcatgatttttcactatgactgagcagaattttgtttcgttgttgacggatgcaaaaatcatcaaggattagcaccaaatgaactaaacagcgcatcaattcacaaattcattcattcatatatgctcatgaaaatattgaattaccgtaatttcgggtgtaattgatcatttttcacgttttttcttgtccgttttctataatgttgacaatgccaaacaattgaatgcaggaaaacaagtacgaaggtgagtctcattgactcatttaccgacattttcttacaaatgtcattttagtgctaagaaatatctctaaaataaaaaatcggggaatctcatttcggggtgaaattgatcacttgtcaatgcgattattgttagttttcaaaccaactctatataataaatttgaggtccctgaatccgaatatgcttcctaaattcttaacaatacaataattatagaaataatgaatagttaaatttcaagaattacgcggaaacgcctaaatgtatgcaatttccaagggaatttctcgatatctaacagaaattcaattattttcaccaaatgtccaaattggtacggagttttggttatgaaatctggtttggggatatatctcaagcatcctgataaactttcaggtttataccatgttcatagcattgtttagaactagaagtttataaatgtttgtcaatattgcagcgcacatgatttttaaattttacataattttcatagaaataaacttttttcaacgcaaaaaacttcacaacacacaattctacaatagttacaacaaacaacgtccattcactgcaggtaaaattgatatttgtactccattgggaagaaataaaatcgagtgacacggtgatcaatttcaccctactgatcaatttcacccgaatttacggtactcattagggcgatgtttgcggaaaattataccacgagaaatgctgttccataaagtgataatagtacatttgtttttggcgattatactttataaacttatcgggctcgattcgatattgacgcatttgctcaaaagaacacgcggcctcctccagagggtaggaacaaccgcagttttgctccctttttacttcattctaatggaagaaaacactgcagtatttcatcgaacgcagaagttcctttcctagaccttttaccgcataaaattttgagaaaatgtgtgtttttggaaaatttacaacagctgcgaggtgtattatacccaacggactagtcaatattaaggtgaagatgaatcgaagccaaacatcaaattttcaagagcacggatctggagaaccaaacatccgtttaagctgaaaaattaatcgattggttactagctgatggttttcagctcaagtgggtgtttggttctccagatttgtgctcttgaaaatttgaagtttggcttcgatttatcttcaccttaagcaaaaaaaagcgcttttatctcggttctgcgttatttacaatacagcctaactgaatttgtggatcgctttgatgctctcaaaataagacacgggcagtaatatataaaagtatttatttgaacgggtttcaattggatcacatactttttcatgaacatttaaacgagttcttcagcacacttcgcaggacaaagcactgaaaaggacaaacatccagataaactttattttgaattgaaattttggagcgtttcacacactcttacaacgctaggatagctcctcaaatttaaggcccatcaaacataggatagctaagcattttacgaagcttagaaataaggagatttgagttaatttttaaactttttagcttgcataaattgcgattcctgattcgttaaaaaatcagtaccgacttatttaaaaatgatcgtccatagtgttgcgttaggtaggataaggagaggcatcattaaactagtttgttaacatgcacatgatcattttcttctcgaaataaatactttttctgtttgttgatattttctattggcaatccttgttgctatttttgccgacatatgtaaaattaaacaactaacaaaaaatcaggaagatggctgctccagaggcacaacaaaaaaatactcagtctaattacatatacaggtcggactcgattatccgggactcgtttatccaggattcgattatccggaattttagactcgattatccggaatttgttttttgatgctcttgttttttcaatttttatgcataaatctgagataattgggtattgcaatatacaatatgagtggttttgcagtttagaacgtttttaagagaagggggggtttgagaaagcggttttatgtgtatgctagttaattttttttcttataaagacccctaccgttcctagaaaaaaattctgactacgccaccgcatcatataaataatataacgaaaaaagataatatttaagttcttttatcaaagatatcaatttttttcttagtgattcgattattcggaggattcgattatccggagtgaaaaaaaaaatcgatactctggataatcgagtccgacctgtattgttagcggtgatcactgatgttacaaatgccaaacaaaaattgtgaatcttttttattattttcatcaaacataattctaatttacgccctatttagagtgcactccatgatttcattgagtttgacagtaccactgaccaaatttgttccgatataagattttgaacccacaattactaattaacaatttcagtcattttaagcgtgagaatgatcatgagcatagatgatcgtacaattcgtagttgctactccgtgcttgagcagaacagtcaaagttgcacagagatttaatgagtgggacttagctgatcattctcaatgtgctcaaatcgagagctcaaattttaaaagccaataatggagccggccatgtccttatggctatcgaggaaggcaaggaatgttagttagtcaaccgttgttactagaaaccgagtatatctctgcatctccacagttgacatggaaaggatattaggttagtgggataaggtagagatctgggagtcaccaatgtttggtgatgcgatccatgatataatgactcttaaccggattcgcgatattattcgataatcgcattgtacgccgaacaaacgtgcttcactcgctctcgcaagagcaagcgacgcgatcaatagatcaaacactactaaccatccgcagtgctttttcacttcactacgcgaacgaggcgaaacatgaacaagcgaaaaggtcgaaagaccaaacaccactctatttaacgacttcagtaaattttaacacaaattaatggtaacacatcagcaaacttcagtttttttatgcacaaaagttgtttttgataggtactttataaaagcaatgtttctagccatatatccttcctcatcttttctacttaacatttcgtcccaactggggcagagtctgcttctgaatattttgttcttatgccactaggctaaggaaggacataaggaatagacataaaagaaacgaaaatttttgtgttgagatatcaggaataataaaaaatcgatttaatcgttcaagatacgatgatgaatagctgttcaatcatcttcaccttaaggtgaagatgaatcgaagccaaagttcaaattttcaagagcatggatctggataatcaaacattcgattgagttgaaaacctaatcgattggtaaccaccagctagtgatcaatcgattaagcttttagctcaatcggatgtttgattatccgtgagtattgtttgatccttcgacctggttgcttgctcctgcgggggcaagcgacgggggcaggatcagtcatgtcgcgcgtcgttagcgtacgacggtggaatagtatcgcggatcgcgttagtagtgtttgatcctttgatctcgtcgcttgctcctgtgggggcgggcgacgaacacttgttcggcgttcaacacgtttatcgagtaatatcgtgaatccggttagacgcattaatttcaaattatgtactcatcgtttaccaaaacgaatcctttacccaaccctctcccatatctaaactcccagtgtctacttgtggaagtgcagaggactccaaggcttctataaagcaagtaacacgtctatttcgcaaaatttagttttatttcgttggttatttttattcaattaaatgatatagaatgatcctaaagccaattttcgcctcattggattcctggtaggattggcagcaccatccaaaatatcgcatacccttagcctgtcacaaaattcgaacaaaggcagaggctcttatctgaccgctttcgttatgattgagtggatgctgataatgactcatcctgtctgctcggctaacgggtaggccgcttggccaggataacaccatgatacagtgttgcgatgtgccaccaaaggactgcccgacaatggtgttgatgatgattgtgtggccctctttgaatttaaatgtcggaaacagtttgttaacacgtttgattttgtttgagattgatcttaacacgtatgtatgtgtatcacaatgctcggcccctctatctctatatcacggcccatttgcataatgctaccgaggacaagtgtgcgacagtttggaaaattcactcgtcgttcctcagtcggatgagtttgagtatacgtacagatagtgtatagagtacccgagcaggtgaaaaaagctcagcaatagctaattttgatatggacatctaaaagtgatattaacttgatagatataagagataaaagatctgaaaatgatatctaaaatttactcctagaatatcattagcatatcatatttagcttttgtaagatctaaccaatatcagcgagctattcatttgatctgcaaacatcaaattttgatatggcttagaagttccaggaataaaatttagatattatcttcagatcttttatctcttatgtcaatcaaatcaatatctcgatttgatggtcagaactttgcttctgctcgggtaatgtggggcaaaggttcgaaactaacttgtctcagaagatatcttcttcttcttcttcttcttcttcttcttcttcttcttcttcttcttcttcttcttcatggcatcacgtcctcattgggacagatcatgcttctcagcttagtgttcaatgagcacttccacagttattaactgaaagctttatttgccaaagttgccattttcgcattcgtgtatggtcggtgttcagacagaccggactagatgatattttggtgttctaaagatagattaagaactacatcaattcttatttttcctctgctagtttgatacagttgtatcatcaaatagataagttccattattacagcaaataataaaaatattttgatatttcaaatgtttgggataagttttcctgaaagcattaaaaaacacttggtccagtctgtctgaataccgaccatatcatgtggcaggcacgaggatacttcatgctcagggaagtcaaggaaatttccattacgaaaagatcctggaccgatcgggaattgaacccagacaccttcagcacggctttgctttgtagccgtggactcttaacactcagctatggaaggccccttcagaagatatctgctgaacttaaaagtttcatttgtttagacttaaggagagatctcccagtaccagacaccaaagccgataacttcaaaattccgaaattatttgttttatatgatcttgttacccatttatgataaatactaccatctttgtttataataaatgaacggtatggtgaaaaaatgaaaacaaggaaatctagtaatattcttagcgttatattataaacaaatgtagaatgctaaatgctgaattattcataataagtataacgcaaagaatattactagagctcctagtattcattttttttactataccattcatttattattattattattattattattattattattattatatatactatatatcgttatgcttgttgtttaagttaaagttaaatttattaagtttgtgtctggcaaaagctcaccttattagatttcaaacatacacagtgttgcctgctattctttatcgtatgctaaaaagacccactgcaaacttttccccaaattactctacacaacaccagcggggtgtgagataaatcccatttaactcgttttccgtctcgcgttgaacgggataacctgccgccgagtctactgactgtgaagggatcctatagtagtgagctgtatttctgcacaatttaaatgttattgttatgcaaatcgaacacacagctctggaaaatctgttactcaaagcggagtgcatttcgagttcagccggcagtggcataaattttgtaatgcactctctggaagtattgttccggacttgtccctatgaagctaagctgagttgagtcgagtaggaaaacgatggtcagataaaattatttatcgctccggtgcacgagattagggagaaaatatagctttattcagtaaaaaaaacgcagttattatcgaaaaccttgcaagtttgaatagttactgttgccgattgattaaaatttctccgagtagtaaattgcatagtaataagaagcttgaatggtagctgcctgaaagctttaggcttgaaaaatacatttacacaaagacttactataaaaagcacctactgcccatgtttcaaaatgcaatcaaagtgttttcaaataatcacaatattgtcaaattgaagcttcttgatgaattgtaaaaatctttatttcaaatgcttgattatatcagtaaatctcaacattctgttccttgcaacatatcaaagtcaaattatcagcaagtgttaaggttgctattaagtatcattaactgcgttaaaaaagtgataaaaatgtttagaaagctggaaatactttcaaaccattaaagtctaaagtagctcaaaagtctgaagtcactgaatgaaaacaaattctcaataaacttaaaattaattcgaaatactaactaatgttctaatataagaacatgtaaccttctcatggcaggcaatgcagctcaaatgttttccattgaagttgtatatctcgaatctgatgcgaggtttccttcaaaatttcatccaaatacttttgcatagatgtatctagctatttttcagaattctttaaaggatcgctatctgaaattagtaggagtcttttcagatttttttccattcatttcattcttttttccagtactccatctactggcagatttatcttttctaaaaagaaaaaaagacaattgcaccgtcttcagcacataggctgcacagactgaacgatcactaacattaggcaacggacaacacgaaacacccagtagcaaagcgatgaatttttcgtttgacgagaagttttcaccgactagagcgggaatcgaacccacactccgtgacacaatacgcctagacgactaacgccgctaaccgtaaggccacgaagcccacaaaaaacaaaaaacattacaaaaaaaagttcaaatcgtgatataatttttgtttgtcaatatttttgcttcatattttttcattttattattattattttcataatctgtttcgatattgatcatcactcatatggggtttaagttattcctatattctctaagtgacagacactttccatgtacagtttctttggtagttatttagtttttaatcaatttatcaagaaactaaaatatggtctatgaaatgttaataagggacttctaggtaaaaaaaaatatacaaatcaattgagttgtttctatgaaatctgaatattactcaaaaatggttgcattaatgtttttcattgttgaatacaagattctcttcaaagtgttgtttttaaaagtgaatagatgaccaatgttaaaaattgacacacattattttagagaatagttttttgagtagttgtgaaaaatggagcaaaaataccttaaaacaaaaaagttacggcgatttgaatatttttcaatgataaaaaatgataccactagtagaagtataaaggagttcctaataataattcctaataattttgtctacatttactattttatcgtaaggatttgttttctataataatttcaatctttctgattcctttatcctgtatcatttatatgttgaaatgaattcaatattttattaagtaatgctcaaagtattcactattacttctggaatttcttcaaatcggacgcctcagtaattagttattaatttatatcttgttacaaattcttcagcagtgctcatttaacttctaaacaggcaacattgctgcacctggcgcgaaagatagcacgcgcaaatcatggctactatgttttactgcatatatccagtgatgcctgcataacatcccaataactatagccaaagttttacaactcattcaaaaatcaataactaattactggagcgtccgatgtaaaaacggtctttagcaaagttgtagctgattattgtatctcatagtataaacgtagttctaatcttcaagagcacatggaccaacactatgaccgattcaatggattggttgtttttcccatagtaattcccatataaactttaaagggcttgtgcagtctcagttttcatctaaattagctcaaattttgggaggacactaataatttgatcttgaatcgaatgaacggtgtggagcaaacacgattttttgaaccactctagtgtatatttatgtcactgctatttcgaggccgcctcttctagatgaatgtcgcttcatcttgaaaatgattttatcataacgtcgatcttgccggatttattacaacgtaaatctcaaagatttttctttagttgatcgaaagtatttatgatatgagaaatcacttctgattgacagttgttgttttttaatcatttttttgctgcaaactactaaaatagttatttgtcacaatatttagcagtgtttggcatttaatgacagcttcaatgttcccttataaaagacggagtgacttgacatttttaaaataaaaattgtgtgtaaaatttattttcttcatttaaatattttacagaattttcgacgaaatttcttgacaaactttttatgtagaatattatgaggctcattaaagaaccttactgaagttatggtagcatacttctgctataattgtaggatgaatatatgcacaattttaaatacatggtattataacagaatttcggttaaatctttctaaaaaaaaggtatatttagaatagcatgatcaataaaactaatattgataattgtcgtattttggattttgaatggcgtacggtatatcagatttctcattaaaaatttattccaggccaatcaatcttatttggagcatttagttttcacaatttagggacaaagtctgtctctcaactaagtgttctaggatcaattccacatttattaacctaaaacttttttcatcagcacaccatttttgtattcgtgcatgcttagtaatacggtcaattcttcctagctcgatattgaagggaccaacttattagggaagtaacgagtcacagaacataacaccagtgcaacggagaataagggagagttaactgtacataagatacgatatagtgctaaagtaagtcatagagaatttaacctcaaaataaattgtgattctgagccgtagctttcagcattgctttgatgaataactgtgcattggccatgacggctatttagtcccagttattcattcaaattcaccagtattgctggaataaaaaaaaacacagtttaaaataaaacatattgcccaaatttggtttttatcctccttcacaaatgttctgatgatgtcctgtattttgagaggattccacaacacaaaaaaacgtaaaagatgataatgacgatcaaaactaccgaaaacacgaaaacctaccaaattgtcattaatctttacaaactttgaaaatggctcaagaggttttgggatttttctcggaaacgttgctgtcattgctgctgtcgttgctgctgctatcagaaagattggtgttagctcttaataatattggtattggtgagcgtgatctagttgaattgggctcaacagcgtctttccattatttaccaatgtcgatatgcccttttctaatgtgttttacttttaaagattttttttgtgcactttacatcagttgaaaagttttctaaaagaatcacaataatattgtgaacgcagaacctcacatttgttaagcgttcatttcattttggctcagcctaacatttgctttcatttgtcttgaaatattgagttccgttgtataatgaaatcacagcatagtgagcagtgctgggaatggtaatagtagtaggcttgaatttagaaacactcacgtggattttcccagtacagtagttcaaaaaaatgaatctcatcaagtagcctatattagatgcatgaattttataaatcgatagtatcattgaaagctctaaatgtgggaaatgcagagggaaatagaacatttttctacagtaacgcaacgggtgttttgctattttcaaggctttttgcctacagcagcgatgggcataagattcactggcttggctactgtagaaagaataaggttagagatttttcccaaccctgatagtgtgggaccgaaatccgtacaggatcaaaatccgtacacttcatgcaaaaagtaggcattttgtatgaagtagacggatttagactcatttctcaggtttactgattttgatcccgcacggtattgagaatttgaaataataaaaataaaagagaatttttcggtttataaatttaaatagatacaaatatggattggatttctacaaggcgcaagccttagaaatgattgatgacagtattccaatcgaacgctatgttcaacaaatttgctcctcacaaacagaagtcccgttgaccacgagaaaataaaaacgaaaccctcaccccctaaaacagtgaaaccatcaaaaccgaaatcaacaatcatttccatcgaaaacccctacaagcgaacaccaaacacaatctgttgggtgaccaatgtcagagggcgtagattgagttcttcttgttttaccatttaacccccttaaggggaatcatcagcggtaggaaaccagtcagtgaggctaccggagagcatagctgtcaactggaattaattgcacggcttggatcatagctttcagcccagcttcccccagcaaacctcacagaacaaaacgtacgttctgcaattggttgcgtttaccgttcgtgaacaaacataaattgaggtccagcgaaaattaggaaactctcggtgcctcagtattggcctcttcgattcgattcatgccgactcacacctcgaagcactacatacaggaggggattttataatatttattcgaaagatttttacccgaatttgacacttagccaaatgccatttacccaaaacgcgacgttaacttgaaaggtacagtcccagaaaaatactagaaaaagggctatgatttttttcttggctccggactgacaaacttcgagtctttaatcatctgctccaatttccgctactgttgtgagtggcttagacttttactgtgaattgtttaattaccagaaaatactaccctagccatacaaacaagaagagactagggttcaaataggtagacctttttccgtaatgcaccacaaaaaggtgatctacccgcgtactggactattcggggaaaagtcgcatgcgagtgaatgtcgttcgagtagatgtctttcggataaatatttttcgggcatttgttgtacaatcacagaggacactctccgagtccctaagtcgagtgttaaaacaccgcggctacatagcaaagccatgctgaaggtgtctggtttcgatttccggttggtccaggatcttttcgtaatggaaatttccttgacttccctgggcatagagtatcatcgtacctgccacacgatatacgaatgcaaaaatggcaacttaagcaaagaaagctctcagttaataaatgcggaggtgctcataagaacattaagctgagaagccagctcggtcccagtggggacgttaatgcaaaaaagaagaagaagtgctcaatgaacacttagctgaatagcaggctctgtcccagtgagaacgtaacgccaagaagaagaagatggaagtacataaattaaaccattgattttcatcgtttgtctgcttatctggaaaatgaccgattactttgcttacagcttattgaaatctgaaccgataataatcgtttgcaacgtcatgccagtcagaaaatgtgcagttatgtagaaaaaatgaccagttatctgccattcgacctcaatgatgtccgacaacggaccataaatttcctgtgaccgtgccgtcgactttttgccaggtattacatgtccaatttataatacgttggcagtggcacattagccgccattggtgcgtgctggattgtatgacatgtcttcctacaagtgtaatgacagtgtgcatatcatatgaggtacacctaaaaagaatgtgaataaaataatgctgcatgttaaaagttaaaccgttctgaaacattcaaagggggttacttatcttatctagctctgctcataggtgcgtagctgaactgcaagacaatgctgaagacgacttaaggctgatatttgcggcaaacttttgctttgggtgtacgaatacgattttatcctacctttgcaaatcgaacaaatgggcgtctaggcggtgggatcaaatggtattggcaactgttccggacgtgatatttgaagcacgacgttgtttgaataatgcgtttgtgtgtcaggatgcttatgagtttccatgtgcgcatacaggggatgagaattgttatgagtggtcatcagattgttaggcgatatacgtatcagtatgaatggaaaagctgcttcacgatattattgaatgattgtaggttctcaggaaggcaaacactaaaattttattctcgaaaaagatattaccatgaaaaatagtttagcacatttacgtattttcgtcaatctaagccgatgccacgtttttgtgcaattttctcggatatcagcagacaaattacgtgtttgtctgtttacatttatgcgctgatcaatcctctatcgatttacaccaatagaattgttaaaagcttttaggaaaagtttttacaacgcatcgaacaggtcttgtcagtgtgactattgtcggcagcctaattttctgcggcagcttttccataaggattgcaggtgattctcttcggcagctccattttgaggtgaattaatttaaattgatcacatcttcagcgaaatggtttgttcagtctcggaaatctcgtcagtggagagctgacacaataaagaatcatctgaatgtgttcatttgggtggtttgatagaaaaattagtactgtgtatttggcgtttgaaatttggttgccgaaaatagtcaaatggtaccgaagctgtaaatcaccctatgtatcgtgtccaagaaatatattttccagttactactaagtctgccttccacgcaaacaagcttatggaagcttctaccaggcagatgaacgggaaacctttagaatttgaaaagttttatattcgcaaatgacgggggcaactataagtccaacatttgggattgtccttcccgcaaacaaatctctgaggcacgtactaggcagatgaatggcaacgtttctttttttttgtagccggaattcccaaagcagaatctccaacaaatctctcatactcattctcattcacaaactaattcccttccgtaggaccgtttgaccccgttcttacacccatgttatccttcaaactctcttcctacgggtaaccgttctattttttttttaatcaaatggaaacacccctacttgtaccgtcactggtaacttttattccacgtcttcatcaatggaaaatcccaacaagaaatcatcagaaaatgcacctatttctagtaaaaagtctttctctgattttgattttttaactgaacaattgaatcaaatgaataatgcaatgttcaataacaccacaatgcaatggttggagtaattcaagtttggtaaaattgactaatataattgtatttgatagcgtttatattatgaatccaaatattttttatatattttgaattggaatgctcgttttttaaatggtgaagaggacgagctgtttgatttttctagcagacaataacatacatatagctattattactggaacttagttgaatactggattaaaactaaaggactgtatattatataaagcgaattgtttatggtatattttttttattaattgataaactcgttttcggttttctttgcatcgtttaactattgttctacaatgttaagaaaatataaaatcttacaaaatgtttttggttgatgaactgaacagtttttccatacctgttcgtcaaagttaagcattatttttcgcataactaatatccttatttttatgaataaattgtatgttggtatcctttactcttctactaaaggttgagttttgaataaatcaataatattccaacattttctgatactaggttactctggtgatttatccttcatggcaaaatttgctgatacaccattcttttactacaagcaaaaaataaaaataaaaagcgtgttaaaaattggttgagattactaaaaaaacgtatttgtatagaagagagctaaatcgtgagttttaaccaattcttaagtataaattctactctttctggtccacaatctcatactttcaaattcaagtccgcatatttatcgatttacagcaatttgtgagcgtttttctcagaatattttgatcggtaatctcagaataacatgttatgcaaataatacatggaaaataaattctatttcattacagaagtgttccatttttgatgattgtaattgtgctttgagaggtcgtctgaaaatatcgcatttgttttttttttctactatacaggtatattcctttttttaacaagatcggaaatttgcacttgacataaacgaaaccatgataaaaatggaacaattttcttaaacaaaatattttacaaatctgaacaagaatgggcagttttgacaggataatgcagaatttcaccatttcattgataaaggctacttgattgcagactccaataaaccaatacggtttatttatttctttatttactgctttagtcaacaggtgaagttcccaccctaatgacaattgatcttaagtctgaaagcacaaaaacatcgaaacaaacatttcacatgaattaacataaaaattgtttaaaattactcttatttgttccacgcgatacattaaaattaactcaagagcggtcgcgcattcaaccatcgcccgcgtcacctcgcttgagctgcgtatgaaaagcgagcataatttgttctggcggaaggaatgttcaggaatagatgaaatcggagatttcggcgacgagtgttgatgtccagtgaactgagcagcagagggctatctattgatcctaacaaaatgtcagagatggagcacccctttgctacattgcgtctaggttcatgtaggcccagatcaataagtttgcagcggctttcatagcttggcaagttcaatggatctctccacctaagtcggcggagggcaaagcgcactaatttgcgttgaacggcctcaattcgttgaatctcgttcctgtagaatggtgaccacacaaccgatgagtattccaggatagggcgtacagttgagcagtataaagctttcaggcaatacacatcggtgaactttttgctgaagcgaaacagaaaacccagctgcgcagaagctttcgaaacgatgcacagtgggacgaaataaaaaaaagtgggacatgtgtgtttgtgctgaaactattggttttagcgtttcgacatgttctacaaagtttcatcatttattgagtacttaatttagacactgaaaaaaatttcacttaaagtgatatacactgagaaaaaaatttaacttttttatttattgtcaaaattgaaaactgtctaaggaggtattgtaggcgacatcatttcatgaaagtttattgaagatggaaaagctctatctcctacactgacgaagttaggggttaaaaatgatgggtacccccttaaaactcatattttctccataacttctaaatttgaatttctacatttttacaatgttccataatgtttaaggtgctgtgaaaatacacatttttgccaaagacactaaagcgctagctcttcacgttgaagatttacgaacgattttctgattttttcacatcaaatttaagtgtgcatatcttgtaaagttgcaagtagtagcagctaattctagcatcatgctgttcctcaatctattccctttttatatatgtacgaataattgcggggtcaagcggggctcatcgcactttgtttaattgaaaattgtatttcctataattaaatatatattttttgtagtttttatttatgtggtatagattttaagttttgttttcattttgctatggaattattaatgttttgcccattttaaacgatgataaaatgttatgttttacagtttttgtcaaaatttgaacagttatattttttaagtaatgtttatttttccgtgtatctgacagcatttttataagtgtatcaaagtgctaaataccgctataagattataatcaactattcaactgattcaactgcacaatttgattgtatatactacaatcttagttataaaaaataattgaattgcacttttgattgatggttgatgatgatgattgatgatagcattcgatacacttgaaaaaatccagttattttcacggaaacaacaacttttcctctacagccatgtcaaattgaaacttgaacagtaaacattataaatttgccgttcgtaaaatgggccaagagttaaatatcataacggaacataaaaaaacattaacagatagaaaaaaacaataattaaaatgtagaaaacatacatttatttataggaaatacaattttcaattaaacaaactgcgatgagccccgcttgaccccgcaattattcgtacatatattcaaacggtataggttgaggaacagcatgatgataaaattagctgctactacttgcaactttacaagatatgcacacttgaatttgatgtaaaaaattcagaaaatcgttcgtaaatcttcaacgtgaagagctagcgctttactgtctttaacaaaaatgtgtatttttacagcaccttaaatattgtagaacattgtaaaaatgtagaaaatcaaatttagaagttatggagaaaatatgagttttaagggggtacccaccgtttttaccccctaacttcgtcagtgtaggagatagagcttttccatcttcgacaaactttcatgaaatgatgtcgcctacaatacctccttagacagttttcaattttgacaataaataaaaaagttaattttttttctcagtgtatatcacttcaagtgaaatttttttcagtgtctaaattaagtactcaataaatggtgaaactttgtagaacatgtggaaacgctaaaaccaatagtttcagcacaaacacacatgtcccactttttttgatttcgtcccactgtgcgatgtaagcaacatgatccttaaacgtcagcttagtgtcgaatagaacgcctaagtccttcaccgtagttacacgttgcagttcaacaccagccaaaccattattaaactgtagaagtgtgcgggtccaaaattggttttaaacggatatctcaacatccaaatgagctagaaggctgatgtctttggcatttgttcaatcatctgtatctcaagatccttattagctagaagacgaattccacccagaatgagtcgaaaaaaacaaaaatcgtgctcgatagtcttcgatttggattaaattttgttcatgtttttggtatggtagaataagtgttttccatagaaaaattgatcattttgactcaagtgtaacttttgaaaatggccagtacatttttgcaagcaacttatttgaaaaattctaactttgaaactgttgattttagagaaaaatgttctatggagaagttgtagtgaaccttttgaactataagaaaaaaatttacactgaaaacatattttgtttattttcataaaaaaatcaaaaataaaacttgaatttcaaattacacaaaaacctcatttttaatattttttaaattttcaccatagaatcttgatagtaaaccatgtttaagacaaagttttatgatggagaaatttttaataaaaaagtttttctaagaacaacttttggtcgattttcaaaattttgattttttgtcaaaataaatacgttctgatgatacagtaagcatcttgaaatgattctaagccataatgattacatgaataatttctctagaagcagccattttcgaattacagtcatccctccatgagtcgatgttccattactcgatatcgactcatggaaccatactaaaaacataaaatcatggttactatgatggtcccttcaaacagctttccaaagaatagctgttccaagactcgatatttccatgagtcgatggtcccttcaatatcgactcatggaggtttgactgtatatcgagtttaatgcaccaaatattttttaaataataaaatacgccatttacattagttattcgtgattctccatcaaggaaaataagtaagtcgaaagaaataaggtctttattctctaaaacgaattattattaatggagaaacgcgaataacttatgaaaatggcctattttaatatgtaaacaatattttttgcatttaactcgatataattcgaaaacggctgcttctagaaaaattattcatataatcattatggcttagaatcatttcaagatgcttactgtatcatcagaacgtatttattttggcaaaaaattaaaattttaaaaatcgaaaaaaagttgttctaagaaaaaaaattttttaaaaatttctccatcatgaaactttgtcctaaacatctttttactatcaagattctatggtgaaaatttaaaaaatattaaaaatggggtttttgtgtaatttaaaatttaagttttatttttgatttttctatgaaaataaataaaatattttttcagtgtatattattttcttatagtccaaacggttcactacaacttctttatagaaaatttttctctaaaatcaacagtttcggagttagaatttttcatataagttgcatgcaaaaatgtataggccattttcaaaaattacacttgagtcaaaatgatcaatttttctatggaaaacatttattgtaccataccaaaagcatgtgcaaaatttaatccaaatcgaagatggtcgagttctgtgactgaccaatttgacatggaatccgtcagaaggttggagtcttcgggaaagctgttcagtagatcaagggctatctgacagtgaaaagactgattgaaaattcatccgcttggtagcacttgtaaaaacaaatcttcaattgtctgtatctcaagattcttaacagctagaatgttggtgtcttcggcaaagttatttgtcagattgaaggctatctggtggtgaagggcatgaatgagcatttatccactaggtggcgttagtagcaaattttcttcaattgtctgtatcttaagtaccttgaaagctagaaggttgatgtcttcggaaggcatgttcagcgtatgaagggctatcattctttatcacgccaagatattaaatctcgtgcacgcgatcaattgtttcctcatccatttgtattgcaacgtctacaatggttcgattccatgaatttagtaaattcaattgagttttatgtacttatattcaatttgaactgtttgtacttcaaccatttactcgcaatgaagctagtaacacattttcatcaattgcctgtatctcaagaattccctctgaacagccttgccgaagctgataaggatgttaagatacagacaattgcagaaaatttgtcactagcgcaacctagtgggtaaactgtcattcagattcttcaccactagataggacaaattctgttgaatatctttggcgaagacaccaaccttctagctgttaagtaccttgaagtagagaagattgtttatttcattttatgagcaccacctagcagatgtatgctcaatcagactcttctccgcaagatagtccttcatatgctgaacattccttcacggagaacaaaatatagtgttcgtaataatttttccggtcaatttaactatattttaaggttaatttggagataactaaaaatatagttgaattgacagtatattgttaaacatatctataccatatagttgttgacaactatatttttgattgaatttacaaacgtcaaacgtcaaaatttaactatattttagttgactcaaagtgaattttattgagtttacaatattttgcaatgtttactcagcattttgttctgctttatcaacatatctgaaaagattcggtgctgctttatcgatctaaaaaaacattgcaaaaatgaaaacaaagggcgagtcgacaaacttgatatgcggtctcctgcgtgagagggtgtcatcttagcacctacaccattccttgcaagttagaagtaagtagatttgtgagcatgacttgaagtctagagaggtgaatgtttccgaatagtgataattatcaaaattataattgttataagtacaagtggatagctcaatcaaagaagtgtgtgtatttgatttgacgttaatttagtgttggcgtaagttaatttcatttcgaaacaactatttgtgcgtaagtgaaagtaattgacaggattgtaatcttaacatacagaaattcttctgcgtgttccgaagacatcaaccttctagctttcaaggttcttaagatacagacaattgaaaaaaaaaaatactacaaacgccataaattctcattcaggccctttaccaccagatagccttcaatctggtgaataactttgccgaagacaccaacattctagctgttaaaaatctagagatacagacaattgaagaatatttatcactagcgccagctaaagggaaaattctcaatcagactcttcttcgtcagatagtccttgaactactaaaaaactttatcgaagacaccaacctgctagcttttgaagatcttgagatagagacaattgaagaaaatttgccactagtgccacctagtggataaattctcaatcagactcttcaccaccagatagcccttgctctgttgaacacatttgttgatgacactaaccttctagctaataaggatcttcagacacagatgattgaataaaattggttactagtgccatctagcggacgaattctcaatcaataactttaccgaagacaccaaccttctagctcatttggatgttgagatatccgtttaaaaccaatgttggacccctcctgtccacgcgttttccgttaccaagagaatggggaggggtcaggggagatgtctcacccaaggattgtaagaccaattaaccgcattaacttcaacatttatttcaaattaattaatctactagtttacaaattgtgctcgtttgaaaattcaaggttcgtctcgggattttaaggcttaaatattgagttcaaatcctcttgatgtgccaaccagggattgaatcctgagaaggttgagagaatctttcacttatcactctctgtaacaaccatgaattgcagcacatcaaacctggaccaaacctggagaacactattgccatcagatgttcggggattgtttatcgtgccagtggaataaaaaaccttcccccaatagtaaacaagagagaaaaaagactttatcatcgctctttcttaggggcgctcttccactgctcctgtttatcaagcctgattcaacaacttccgaattgttatcgataatggatcgctacagatgagatgttttccttcacatactttgatcgggcttctaaatcagcatgaaatgttctatgttttttttctggatgttgtcgtattcgattgaatggaacctattccagggaacggatttttgcgtaaattctgagtcattgcgttctggggaacatcattgggaagacagggattctagaattcgacaaacaatcaaattgatcaaagaagaacagtctgttctaaatccctaaagcgttcatcattaaagcaataataactagaataggcaattccatgttggaatgatttaagatatgctcgaactgaatcacggcactgccgcaaatcattcggctgtcgacaaggcaccgaaaaaaaaatgccaaaattgacagctctcaagaggcatacttccgtaattcacgctctgcatacctttttgttggaataatccacaatccaaaaagggaaaataaaataaaatcatgagccacacgctcatacatttattgatgatgccgccattgtgcacttttctaccggtagcacgcaaattgcggatcgattgctcaagggatgaattattcattgaacattttcattaaaaacatatttcccaaataattgccatttatgacgcattttcgacaagagatcgattaaaggtgatgcacggggtccgattttgtccaaaagtaatgaattttgtcttcaagcagcaaatagaaacttctaacaccgctttgaaaatcaaatccgtgaaagcgcttaacgagcttaaaatgtgcttcggaaattaaaaacgattcaaaactttgcccacccgggatgtcagttttagcctcgccgacatgccgccatttgtcttcgggagtaatttatggcgcatccttgcctaaaggagtatttctcaagaaaacgcactttccttgctcgaaggtccttcgtggaatatcccgctcctgctgcctgtatacatttaaaacccctccacacttcagccgggagggaaaaagtttttcctcatttcatcttgcgcttcacattttaggttaattagatgccaggaggatgcagttggttgcattttgtgcacaacactttcccaaagcaaaggagcgggaaggtccagtttggttcgctcaagtggaatatcttctttctgttgctgttcgggcaagcaatgaaagttgcacgggatataaaagtcttgcttcataacagtcagagtatgattcatgggactacgatcggaagcattcttttgaaaaatggaattggaaagcattactaagcgaaattttccgtttgaatctgagtgcacaaactattccatttgtgagactgtgtactgtagagggtcaacttattttagccatttttgtttatattcattctgaaatgattaacataactttttatgaattaaactttttattctaaacgttgaaaatagtttttaatgaaaatttcttggggattatccattacacgtttggacaaatagttaaaaacaaacagattattgcacatttaaatcactacaaaaaaatggaattatgttctacaaatgttacgttttataacagttttttttatatgtagaggattggatttttatttgaaacgaatctttcaattgtggaattaactatgcagacttgggatggtcaaaaagagttttattttaaccccacgtttcgacatggggattgtcatgggcgtagcctaagggggccaggagagggccgttgtcccccaacccctggctgacgaaaaaaacaataaaaaaaacacgtccttgggagtaactcgaatttctcaatcgagttctcagcaatcttagaaattttcagtctctcaaatttttgttgtctctcaaattttttctagaagtttttttggtttcatccgagaatttctaaaactatttcagaaagcatttctctcaagacccttccaaaaattaatctctggattgtttcagtaattttagcaaagaacatattttgaagtttgtagagattccttcatgtataaatctaagatcactttcgataattcttctccatatttttagaaaatttcatcaagtgttccttctaaaacttgattggaaatcacactcttaattacgcttaaggaatttttaaatttttaaaagaatcgattcatgttttttgtcagatatctgaagtaattcgtccagatattttttagatattaatcatgataactctttcacgattttgccttcaacaaatccatgaagttctttactaacctgcgacttacaaaaagatagttttgattaacccctgagatctccttcaagaactcttttgaaaacacttccagaaatcccattatgtttctggaattaataaattattaaagcccaaccaggaattccactaagaacgtttgcaaacaattcttaggcaggagttcttaaaaaaaaaatactaatattttttccagcaatttactttgattagttttgagatattatcctagcagtttctataggaatgctaattagacttcttccgcaaagtttgcaaaatttttcagataattggaaatcgtttaggaatttgtgcagtattcctagtgattttccataagatttgttaataatatttattttcagaattccttcaaatattgacacaggagtatacatttgcataaacatagatcaaaggggaaaaaatctggacttcattcagtgcttcctttggattaaatatttttaattataatttatctataaatatctctaagaactctaccaaatatgaatccaaagaaaatttctcaacacaaaaataaatcagaataatttctttgcagactttctgaaataatttctgaagtatttctagaagaaattcctgaatatacttttgtgtatatcttcataaacacaatcaaaaaatcaatctgcaaaaggaaggaagtttttcaagatattactttctcaattctataaatttctgcaagagttattcttgaaaaaaaaaacgctggaaaatccttggaggaattccaaaaagaatttatttagtattttttgaagaaattcctgatttttttcaggaattctttgaaaaagtcattttgaaatcaacgcataagatgctggacatatcttttgaatcatgctcaaagaaattttaagaagagctcttgagaaaaaaaaaaactattagatgtttctaagataggggaagtggtgttaaaatgaacaggggtggtaaaataaacaccttgccttttaccgagaaaaaacaaatttcgatgcatttttatcacgcacggacaaattataacataaatcagagtgttcgagttgatacgtaggttaattgaagtgaaaatatcaacgaaaactaagattttagaaaaccacgtttgaaaattagaactgacgtaacttttagcttggaaaacttggggttttacagtgaggtgaatatcgttatgatatgaggtcaaatctgataccaatataattctttttgaatgggttacaatcattaatggatatattttcggtaaggcaataaaaattctgagaaatatttgtttagctcatattttttgcatgatgttcattttaccaccaacagctgttcattttacccacatactgcaggtaaaatgaacatttacatcgttttatgctagcgacaaaaatatgtgaaaattcagctattttagtctgaattcgtgtcactgctagagataacatccctgtttttgatgttgttggatagaactatacatattattcttttttctatcagaaacaagatgatttccttaaggtgttcattttaccaccccttcccctaataatccacagggtagcttttatatcaatctatgcaggaattttggtgagcaaggagttttttttttttttttttattagtatcattccaaacattacattcatttcttatatctaggtgttctgtgttattggacaacactatcatcctaatttggtaaaacaaatttaagatttaattaacattttgttaacaacatattacatttcatttgccgtagcagttcagttttttttacaggtgagttgatgtcacctgcttataagagaaaaaaaatgtttttaatatacttaacctaacttaacctaaacatataacgcattaatcgtggcaatagaagattgtaacgatttttgcctgaaattattaatgattgtatttgacatttgttccaatgtttcaacattggatattctatgtaactcattggtactataccagggaggaagcctcagaatcattttcaaaattttattttgaattctctgcagagctttcttcctggtattacaacagctagtccatattggtacagcatacaacatggctggcctgaaaatttgtttgaatatcaacagcttgttcttaagacaaagttttgattttctattaataaggggatagagacattttacatatttattacatttggcttgaatgccctcaatgtgatttttgaaagttaaattcttatctagcatgagccctagatacttaacttcatctgaccaatttattggaacccctctcatcgtgacaacatgtctacttgaaggtttcaaataaagagcttttggtttatgtgggaatattattagttgagttttggaagcattaggagaaatcttccatttttgcaagtatgaagaaaaaatatccaaacttttttgcaatcgactacagatgacacgcaggcttcgtccttttgcggagaggcctgtgtcatccgcaaacaaagatttttgacatccctgaggtagctcaggtaagtcagatgtgaaaatattgtataatattggtcccaaaatgctgccttgaggaactccagctcttacaggaagtctttcagatctggagttctgataattaacctgaagtgtacgatttgacagataactttgaattattctaacaatgtatgttggaaaattcaagtttttcaattttacaatcaaaccttcatgccaaacactgtcgaatgctttttctatgtctagaagagcaagaccagtagaatagccttcagatttgttggaacggatcaaatttgttacacgtaaaagttgatgagtggtcgaatgtccatggcggaatccgaactgttcattggcaaaaattgaattttcgttgatgtgggccatcattctgttcaaaataaccttttcaaaaagtttactgatggaggaaagcaaactgattggacgatagctagaagcttctgcaggatttttgtctggttttaaaattggaacaaccttggcatttttccatttgtcaggaaaatatgctaattgaaaacatttgttaaatatatcaactaaaaatgataagctactttctggaagtttcttgatgaggatgtagaaaattccatcgtcgccaggagctttcatgtttttgaattttttaataatagttctcacttcttccaaatcagtctcccaggcattttcgaaaacgttctcttgattgagaatattttcgaactcctgagtaacttcattttcaattggactagtaagtcctaaattaaaattgtgcgcactttcaaactgcatagcaagtttttgagctttttcgcaattagttagtaataatttgttttcctctttcaatgccggtattggcttctgaggttttttcaagattttcgataatttccaaaagggcttagagccagggtccaattgagaaattttattttcaaaatttttgtttcttaattgagcaaaacgtttcttgatttctttctgcaaatcctgccatattattttcatagcaggatcgcgagtgcgttgaaattgccttctcctcacgtttttaagacggatcaagagtttaagatcatcgtctataatcacggattcaaattttacttcacattttggaattgcaatgctccgggcttcaacaatggagtttgttaaagtttcaagagcattgtcaatatcaagtttagtttctaaagaaatgtcaacatcaagattggagtcaacatacgttttatatatattccagtcggctcgtaaataattgaaagtggagctgataggattgagaatcgcttcttgggatatttgaaatgtaacagggacatgatcagaatcaaaatcagcatgagtaatcagttggctacaaagatgactagagtcggttaagaccaaatcaatcgtagatggatttctagaagaggaaaaacatgtggggctatcagggtattgaattgagaaatatcctgaagagcactcatcaaataaaattctgccgttggaattactttgagaattattccatgaccgatgtttggcattaaagtcaccaatgacaaaaaattttgacttattgcgagtcaatttacgcaagtcagtttggagcaaattaacttgctgcccagagcattgaaaaggcaaataggcagctatgaaagtatatttaccaaactgtgtttcaacagaaacacctaaagtttcaaaaactttagtttcaaatgatgaaaacagttgatgttttatacgcctatgaatgatgattgcaactcccccacatgccccatcaagtcgatcattacgataaacaaaaaagttaggatttcttttgagtttagatccaggttttaaatacgtttcggtaataactgctatatgcacgttattaaccgtaagaaaattaaacagctcgtcctctttaccattcagagaacgagcattccaatttaaaatatttaaattattatttggatccattagaaaaacgtaatccaataacaatttgatttgtaaattttacacctacttggactgcttcagtcatagtggtggctttgaacattgcatcaatcattagattcaattgttcagttagaaaattaaaatcagaggcagacatgtcatgtgatttcccattggaattttcggtagacgaagaagcggagttacctgtggcggtagggttttttccatttgatttgaaactagtagaatgggtacccatggatcgaacaggggaggagttcgaatttcctgctacgatatcggcaaaggatttaccgtgggtagatacattcgaaattgaaagattcgaacggctacccgacggattaaaattagtttgtgactgagcatgattatgatcttccagatgggtatgattcatgatcaagcgatcgttaactgaaaaatgagcattgttcgatactctaccaggcaaattccggaaacgaccgttatcgtaacggatattatctttcatctgcctggcacgagcctcaatgaccttttttcgtgaaggacaattccaaaaattggacttatggttagccccgcaattacaacatatgaatttggtggtatcttccttcactggacagacgtctttggcgtgagaagaacctccgcaaatcatgcatttagcatccatgcgacaattttttgtaccatgaccccacttttggcaccgacggcactgagtggggttctggtaatttcctccaggtttctggaaatgttcccatgtcacacggacatcaaacaaaagttttgctttttctaaagctttaatattatttagttcttttttgttaaagtgaactaaataaaattcttgagaaagccctttccgaacaatgccagattgggttctctttttcataatgattacttggactggggaaaatccaagtaaatcatttattccatttttgatctcttcaggtgatttatagtcacttgagagacctttcaagacaactttgaacaaacgttcagttttgtcgtcataagtaaaaaatttgtgcttcttctcttcaagatgtttgagaagaagctcacgatctttaagagtttccggcaaaacgcgacagtctcctttctttgcgatttggaaggaaaccttgattcccctaatggagttcaagatctcctgcctaaatcccccaaattcggaacaactgaccacgataggcggcactctttgcttcctcacttgaatcaaagagcctgggctagaggctgcttcgatttggtgttcggaaaatttgtctagagcatcgaactgattgctcatttcgatacaattattcatttcacccttggaagaaacttcgcattccggggaagcgtcctttcttccattcttgccacgtgtagtgacagttttaaaacccacttttttggaaggaagtagtgaattcagagattcacccttccttttgtttgttgttgataccatgtttaattaataaacgaaagaagacgtgaccttcgaaaggttttttcccaagacggtgtccaagaaggattaccaccgctagctttcgccaacgggtccaacgaaaaatcgaaggcacgggtccaaacaaggatcgtaaagggatcaatagtagaaaaaatagtactgaaaagtactgttttagtagcactgaaaagtaccgtttttaattttagcactgaaaagtactgtttttgtagcactgaaaagtactgttttattgctttaggtagtttttaagaaaacttccaagagcagagagaattcgtgtacgcacagcacgaaggtacgatgcgcactgggtgagcaaggagtaattcttgattcttagggtcgttgtacagtgctgttctgaataatagcagcgcatgtcgattttcatacaaaatgctcaactttgacatgctgtagttttgttccctttcaagcaatcgagctgaaattttctccacagaactacaagtatgatcaattttgtaactacaaaatttcagttttttctgagtccctgccgaaaagtgagacactaggtgacatttttcgaaaaaatagcagtttttcattttaaaatttttcttctacaaatattttaaacattttcggtttaggtgtaggtttgataagtaggaggagattgttccaatggtaagtgatatacaatttaaaactctaatgtcaagccgaaaagtcaaatttttaaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcatatttgtagtctgtgagaaatttcaactcgattgcttgaaagggaacaaaaatacagcatgtccaaagtgagcattttgttagaaaattgacatgggcggtttttttttcggacacgcgccgctgtgtgtgttgatccgaaacaaaaatcaggaaagaatttttgaaacaacatcaaggaattttacagttttttcatagatatccctgaaaatttttttggaaaaattattaaaaaatctgacagttttcgtccagaaaaatgtgtagaagaatccttgatagaattgtgaaacatgtatagcagaaaaaaacatgtgaaaagtaggggtaataccttaaaaatatcttgaaaatatcccaaggaacctaaattgataaaatttcaaagaaatttttgaagctgtttcgaatttatccctgaaataaacatttacagtattcttggaagaattcctatataaaaatgaaaccctgagagaatttaataggcaatatccgaagaaatttgttgaaaatttgaatttatcatttgtgggactcttagaaaaatacttagaggaatctttgaagttgattacggaggaatttttgcaataaatatcatgaacttgtttttttttttaagttttgcttttaatgaacgacataccgttttgattcatataacggacacttaaggtctcagggaaatataacccagcatagagcatacaaaataaatcattctgtatgattccttagcgcaatcgagcgtcggaagccctttactttcgagcggtgggtgaagaatacgcttccgcaacttcaataattttaaataaatcaaaatgtgtggccttttcatgattcttattccggacgcttcctcacttttgcctcatattccggacactttgaatcgaattccggacagctcatgataatcattaatggaatagtcaaatcatcaatcgaaatcgttaaaccaccaaagagacatccaaggtagttgggcattataaattttcaaagatatttatggaaaaagtttactaaaacgagccttgaaattgagaacttttgaacagcaaaaattgaaacatttcgcgtgaaatgtttcccatacaaggtatagtgtccggaatttgaagctgtccgtaatatgaatcaaaacggtaactagaggaaaaactgaaatcctgaaaaaaaaaaacttttggaatcgagagacattttcttggtaaatttataatattatttctctaagaatatactattttttcgttaacctaatttgggatgtctgcagaaattcgtgagtatgttttggaagaaacttttgatgcacatgttactctgaaaacaaattgaacaaagacgtattttaacccccttttctactgtgaatgaaaaagatagatggttgtccttcatcgttcaacgtttcatgtaaggtaccgaggttgtgtataataatcgttttcgtgtaaaattcatgaattaattttcaacatcgctcgcccttccctgacgggaattctggcttcgctcatggcggttgtgtcttcctcaggggaactgtgatttgtttaattattaatagtgtttcacaaatttgtgttacttgactttcattaatttgtcggtctaactttaactatcctatgaagagcaatacaagtagaatcagatttgttggaacgaatcaaatttgttacccgtgaaaatttatgagtgatcgaatgtctgtgtcggaattggaatggtcctttttcaaaaattgaattttcatttatgtgaactaacattctgttcaaaatgaccttttcataagaattactgatagaagaaagcaaactgattgtacgatagctaaaagcttttgcagcatatttgttcggtacaaccttgacattttattatttttcagctaaggctgatgagaaactttctagaagtttcttgatggcgatgcaaaatattccatcattgtcagaggctttcatatttttgattttttttttttttattagtctcccagaaatatatatactattgattgagaatgctttcgaatgccttagtaactgattttaaattagacttgcatgccctaaattaaaattgtgcacgcttccaaactgcatagcaagtgttttaacttgctgttcgcaatatgtttgaatatgaaatttctcagttggaccatggcgtttaagttatttttgaaattatctaatattttgaaaaaaaaaaacactcagggacctattttggcattgaaggggaaaagaaattatcacttcttaaataatttcttttcccgagtagtgtttgatgcttcgaccttgacgcctgctcctgcgggggcgagcgatgagggcaggatcaaacatgtcgcgcgtcgggttcgcgtagtagtgataaagtgccgtgatcgcttagtagtgtttgatctattgatcgcgtcgcttgctcttgcgagggcgagcgatgaacacttgtccggcatacaatgcgattatcgaattatttcgcgaatccgattgaacgtaattatatcgtggatcgcatacaaacattggtgactcccagatctctaccttactcactaacccaatatcctttccatgacaaccgtggaaatgcagaggttatctcggtctctagtaacaacgggttcgcgtagtggtgaccgtctcttccctgatgaccgtaaggacgtagccggtgccgttattgacttttaaaatttgagctctcgatttgtgcacattgaagaatggtaagctaatcccaagccccattcattaattccctgtgctacttcagttgttccggtcaatcacggagtagcaactacgaattgtaccgtcatctatgcttatgctttttaaataatttcttttcctcttcaatgccggaataggcttctgagttttttttttcaaaatattagacaatttcctaaaggacttgagcagcagggttcaactgaggaatgttgttgcttgattgaatcaaacttttttaagttttgcagtttttgcagatcctactatataattatcatagcaggatcgcgagtgcgttgaaattgccatcgcctgacgttttaaagacgttttaaaacgtttaagatcatcgtctataatcacggatttgaactttactgcacatattaatattgcttcaacaatggaatttgttaaatgatgattgcaaccccaccaaatactccatcatgttgatcattactaaagaaaattggatctcttttgagtttcaattcaggtttgaaataagtttcagtgatatctgctatatgtatgttattagaatatttgataattgtgcctcaattggtttaagttcaatcacggccacgcctttcagtcaagtgggaaggaacaaagctcagagatcttatcaaactttgtatccttacaagaaggattttggattccatgattcagcaaatggactctgtaacaattaataaacgttttcttatttttcttgatacccattggaacagaacctgtttcttagatttgtgttctaaggactcatcttttgttattaactgaaagcttctcagaaagctcacggatcataactatgaaagtacaaacttggtggaatgttttgctaaacagaagaagagttatattatgcgcacatttgtttgatacgtacgtcgatgacagcatatttatcgaactcatatatgaaactaaattaaattgccaaactttgtcatagtctaatccaatattgttacgaaagaagttgaattttgtttttctattcattttttgtaccgttcacggcagtgcatgcaattcagcttttcaagcgtaaaaactacatttttcaacgcgtaataagaaaagtttacttcaagttgtagcgctttgtgtaccggcaaagttagcaggcgaatgaagaaaccgagggcaaaacttcattatctgcaacttcagctcggttggaaaaaccatttgtcagcagtacaagcggggtgtggcagcccttagttgattggtgatatttacactgttctcttcacgctgaacgcaaaatcgtctgggttgatgaaaataactagggttacaataagaaaaactgcttttaaacctcaatcttcatcctctgccgttacattgtctgctacataacagtacctagtagtagatgcaaaggcttcatagtcaaagagctgcaatgctacgtccttgatgctatccaaacatcattttgcacgccacagcactaggcagcgtggaaacttttcatcctctagcatgcagcactctatattttattcatgatatttaacgaacgaaaacaccaaatgcaatgatgccggtagtggttctggtgaaactctgacatgcggtggaagagccaaagtacgaacgaacgaaaattgaatgtcaaaaaagaattaaatccttccacaacgacgccgaacaacagctcagcaaaagttgaaaatgtgttagacgtcaccggcatgccgcctgcctgcaacgattttgtaagtggcaaactggcacgacctccgccacgccccgacttccgactcgcttgtactacacgcaccgaactgcgaacttaacaagaccgccccccgaggcggaaaagagggaccccttcactcgactcgtggcacacagaggtccggttttcttaaaagctggcgcaaaatcagatatcttgtcaagtaaattgtttttctcttgtttggatcctaaacagtcttcttcttggtattacgttcgcattggaacagagcctgcttctcagctaagtgttcctatgagcacttccacagttattaattgtgagctttctttgccaaagctgctattttcgcatttgtatatcgtgtggcattccattacgaaaaaatcctggaccgaccgggaatcgaacccagacaccttcagcatggctttgctttgtagccgcggactttaatcattcgactaaggaaggcccctaaatcccaaatcataaatagtccaaaaccttaatttttgccttaaaataaacttttttatcttcactaaaactcgtgcagataagcattggcgtagctaggattattttctggagggtatctgagagagacagcgagttctggtgtcactgatgtaggggctcctgggataatatgcactgccgggacaaaacgcaccttgtcaaattcttttaaataaacgagttttgagagaaaaacactatgcggattgatgaaacgttgcaaattgttgacgccctgagaatttggtacattttgaaacactttacagggagatagatcaataaattcgaaaagcacgattctgatgcaactttccctcacttgttgttatgaaagcgatgaattgagaatttttacgacctttcaccataaaacagatgattagagacttgataagttgttgaatacatgatttagcgaaataacacaatgatttctattttccataacattttctgttaagcgcccggttgtggcaacatgcactccattgggcggggcagaacgatcctttccaaaataaactacaatcataaaagttagttcatttgaagtctttactaacgtatttatgtacaattgtatcatcttgtagacgaaaatcatccaaaactcgtgttttatcgataaataaaattacgtttaaaacacgatgtagagttttctgtagaaaatttgacaaaattttattcttgacactatttatgtgatttatttttcaggaatttatgcagaaattatgatcatggagaaaatcgcgaaatcaaagatgcgcaaacgtgtttcgagaatatttggaattttcgaaagaatttctggagattctttgttaatttgggatttgagacctcaaaggaaactttgaggattaaagttcttcttctttcttctttctggcgttacgtcccaactgggacaaagcctgcttctcagcatagtgttcttctgagcagttccacagttattaactgagagctttctatgccaattgaccatttttgtatgtttatatcgtgtggcaggtacgaagatactctatgccctgggatgtcgagaaaatttccaacccgaaaagatcctcgaacccacgaccctcagcttggtcttgctgaatagcagcgcgtttaccgctacggctatctaggccctaaaccgtacatttattcaaaccatttatatgaaaattgcacttcttgatttgttttgaagtgattgaattgaagatttgtaaaaaaattgttggtacaattttccgaaaaatatcctataacattttaaaatgattttttctaaacaaattttggtacaatttcagaatttctagttctagtagctcaagttctttgaattttcatgcagaggaattaagaatgcttttgttgcaaatattcgaaggaatacagagagaactttcttgaaaaaagtcggtagcatattttgagtggttacatatatgttttgacattgatacatatatgttttattcttaatagaatatcccggtgaaatttctgagcatgcacttgttgttttgtagttttatcggaattaccaagattcaataaagttcaagaactgttaaatgtaagagttggtaacgaaattatggcaaattagagtagaagcttttttttatattctaaaaattccaagtgaaaacactataaatgttccatagacttacaggatgaatgtttgaaaaagagattaaataatcttccctacattttttttcattccatattcaatatcattaaaaattagtaaaaatatttgaaattaattgataccatgagtggtgtacacaccaaacaatcacaacttattttccaaataatcacagataaaaaaaatacaaaatcactttagtaaaaaatattttatatcaagtttactttctcgttagttctcgtttacttactttctcttcgatcaataactgagtcacattaacctcttctgttacgttttttgtatgaaacgctagtcaaggaaattgcctttcgatctgtagtgaaaaacttccaaaagctttagtattccattgttataatcgaaagagagcgagaaaggagagactctctcatttgtacataggtcctttagtaatgtttcgcgatatttgtttgttacgcaacgaatgcgtacgatgacgatcgttttcctgttgggcggggcttccgttacatgcgcttcttcttcagttcgctgcgctgcggactgaacacaaaggaaatcttaaaatgttattatcaggaagacaacaagtactcaactcatccaaaatacatcatgagccttgaaatgaatcatcatctgatcgtttgtggaattttactgtagatctttggaatagtaataaggaaaaatcagtcaagaaccttccgggaaattcaccgtgatttgtttttatgaacatcaaaggctgttggcatctgcttcaaaaatctcatgcttgtgttttgtttttgtgcaaaccactcaatcacactcaagccgtcaaaactgattcagttataaagcccttaaaaaactcgtgaaaaccgaacgatgttgtctacgttagaaaggattactataattcaattaggcttaaaagaattcattgctttgttagcgtaaactgtggaaatataagaaaatgagtcaaacagatgagccaacttatccatgttttttgactgctgagttgcatgatagaaaactcacgcatgaaaaatttcatacgtgagttttgagaatattcacaacaatgattatgtcatacatcgatactttatatttttatataatttgacgatttccctaaaatttaaagcccctaccttaggcgtcccctgtttttggctacgtttatcctattatgtatggaaattaaataaaaaatattccttgggattcatgaatttgataaatatttagggcaatcaagcttttaatctatctcatcctccctgctcctacctatgtccaaaaatatttgaacaatcgtatttgtacattacgtataaaaataaattattttaaatatcttaatagaaaattaaaacaatcctcttgtcttagtttaactgaacatatgtatttttaaaaacttgtccaaaataggatttgcaactctcaaacactctcctcacttgtcataatcaaatctgaaatattaagtatgcgtaatttttgccaaggatctggaccaccgtgtgtcgcccagcccaagaacaaaggaaaaacgggtccaactttctgttcgttatgtcatcgctttggagcataataagaaacatgaaaagcgattttacatcgatcctcttctcgggaccttactccgagcactaatccctcaacacaaaatcgagaaacgaaacaacggatacccaccacatatacacagatacatcactgcaaacattcttgttcaaaagtttagaacaaatggcctcgacattatggggtatttggttgctccccagtataataggacaccgatgggtatggctacccacattgtattaatgaaagtaaatacacaacggctccaatacgatttaacctatgtatgggtgtgtgtggtgtggcaggatatacaccatttgaaacggcttcgtgcgttatgggtaaagttttccgtgcgattcgacaacttacgccacggtgatgggttatggatgggaagtggaagtctgatgcggtagaggggaaataaaggactttgggcgggatcattgggcaacgtgacggcaatagggcaatgagtttgagaattggaaatcgaagaaaagttttctgcaaatgcaatagttgccaccatcctgtcactatatagaacttcatcggcttgctatttaagtgatgttatatacacgaatatctttaagttgaaaaatagccaagatgcagaatgatggtgcaaagaatgctgtaaaaatcgagctctgcaacgagtttcgaacaccattttttttaattacgtaaaacgcccattagatttgtgacatttttgaaaaaaaaaatacacaaaatctggcttttagtggcaatagaagattgtaacgatttttgcctgaaattattaattattttgtttaacatttgttccaatgtttcaacatttgatattctttgtaaatcaatgaatggaaggagggagaaagcgtcagaatcattttcaaaattttattttgaattctctgtagagctttcttcctggtattacaacagctagtccatattggtacagcatacaacatggctggcctgaaaatttgtttgaatatcaatagtttgttcttaagacaaagttttgattttctattaataatgggatagagacattttacatatttattacatttggcttgaatgccctcaatgtgatttttgaaagttaaattcttatctagcatgagccctagatacttaacttcatctgaccaatttattggaacccctctcatagtgacaacatgtctacttgaaggtttcaaataaagagcttttggtttatgtgggaatattattagttgagttttggaagcattaggagaaatcttccatttttgcaagtataaagaaaaaatatccaaactttttcaattgactacagatgacacgcagacttcgtcctttggcgaagaggcctgtgtcatccgcaaacaaggatttttgacatctctgaggaaacccaggtaagtcagatgtaaacatattgtataaataaccagaagtatacgatttgacagataactttgaattattattacaatgtatgttggaaaattaatgttttttaattttacaatcaaaccttcatgccaaacactgtcgaatgctttttctatgtccagaagagcaagaccagtagagtagccttcagatttgttggaacggatcaaatttgttacacgtaaaaattgatgagtggtcgaatatccatggcggaaaccgaaaaaaatttcattggcaaaaattgaaatttcgttgatgtggaccatcattctggaccaaaagggcttagagccagggtccaattgaaaaaaattattttcaaaatttttgtttcttaattgtgaaaacgtttcttgacttctttctgcaaatcctgtcatatagcggactttggggcaagtgtgccataggggcaagtgtgccacccctgctttttataaaaactacaatatgtattttctctttgagcttaacaatatgttcccatatagttcacaatacaatgatcaaagtatgatgtaaattgctctatttttcacgtatttacatcgacttttgcaaagacaaccaaatttgagtggatttttataaaatttcgttgtttctaaatagcatggtgaaaaatctgtttttaacagatttttctaacgtaatgtacatcgtgaaactattcaaatgtgtaagttgttgtggcatttgaacagaaaaagtatttagttttacatacgaaatccagattggttgaaatgtatacttattggggaaagtgtgccacctatttggtaaacaaaaattgttggagtgaaatttttaaaaaaatttaaacatcatcaacaaaatcaaaattttctgttcatctgcctagcacgagcctcgacggctcgcctacgcgaaggtcaagcccaaaagtgtgccttatgattgccctcgcaatttgcgcatatgaacatatcgatatcttcctctaccggacagacgtccttagcgtgaaaagaacctccgcaaatcatgcattgagcatccatgcgtcaattttttgtaccatgactccacttttggcattgaatggggttctggcaatttcctccagatttctgaaaatgttcccatgtgacacgaacatcgaacataagtctatctttttctaaagctttaatattatttagatcttttttgttaaagttattatatattattgagaaagccttttccgaacaatgccagattaagttatctgtttcataatgattactcgaactgaggaaagtccaagtaaatcatatattcaatttttcatctctgcaggtgacttcaaagacctgtcgagacgactttgaacaaaccttcagtttagtcgtcataagtaaaaaataatatgcttattcccttcaagatgtttgagaagaagatcgcgatttttaagaatttccgacaaaacccgacagtctcttttctttgcaatttggaaggagaccttgattcctctaatggagttcaagatctcctgcttaaatccccaaaattcggaacaactgaccacaataagcaacattctttgcttcctcacttgaatcaaagagcctgggccaaagacttcttcgatttggtgttcggaaaatttgtctagagcatcgaactgattgctcatttcgatgcaattatcaacattatccatctcacccttggaagaaagttcgcattccggagaaacgtcctttcttccattcttgccacgtttagtgacagttttaaatcccagagattcatctttccttttatttgtagttgcaaccatgtttagtgtataaacgaaagaagacgtgaccttctaagagattttttcccaagacggtgtccaagaaggattaccaccgctagctttcgccaacgaaaaatcgaaggcacgggtccaaacaaggatcgtaaagggatcaatagtagaaaaaatagcactgaaaactactgtttttgtagcactgaatagttgctttaggtagtttttaagaaaacttccaagagcagagagaattcgtgtacgcacagcacgaaggtacgatgcgcactgatgcaacggatctctaatcccatctttatttcgctattagattagtctcagaaatatacttaaaaagtggctcagtgctttggtaagaagcattcacggcagtcgttgaattaccaggactttgtaccacaaatcctcaaattactaaaacatacccttatccaacaaacaaaatgagacttggattcagactggtagatcttatccagtaacgcatcacaaaaaatgatctacccgcgttacgggttaatacttactatattcgctaagtttgctggttgccacacccttctcatactcttcgcttaaccgttcacaaacataataggatgtaaactttcaacgaggacaaaaacaattacgcttatagtggcacatcaggagagtgacatttaatttcactaaactatttcaaattgtactcgggcagaggcgatcatcactttcattttaccatcatatcatggccaggacccgatgtcatcaacatcatcagcaccagctcaacatcgctagacaaataaaatggatataaacaatagatatatcgcagggagaagaagcaaaggaaggaaggaagctgatgctgggtccaaagggaagcccgttgtgtattttcgatcctcggctgaagtgcggtgcaaaagtcatcatgtgaaaagggattaaaacaaataggaacttggcctgaaatgctggctggcgacgacgacaacgacaacggcgatgacgccgggaatgataataaaactttgaactagatcgtcctccatcgcattggggatagatctgagcgccgccaccgcccattttgtggaatgccatgctgaggtatcggcgacgtatcgtttgccgatcattgtcacgcctttgattttgaatcttcacgccgaacaataacccatctcgaaaaaaaaaatattaaaaaaaatcatcaacagtattttgccaacatttttaaaagttctatcgggattctggcaaaaatttgaagagaatctcttcttgaatttatcttggggtttcttaacggcttccagcgaaaattatttcctggggggtcttggagttttttcaacatttaatccattaatttctccaaggaatcatcctctaaaaatctaaatatctaaaaagattctttcataaacatatccaggattttctaccacccttcagggatgctatccggaaatctatgacaactcctgcatttgttgctctagagattctttcagggatatctattacaagtctttcagacattgtagtatgaatacaactgagaattcctccagaaatgattccagagattttattaggatatttcctaagagattttcataagtttcgctcttaatttctccagcattatttccaggtattcatacagacatttctacagaaattccagaacgaaaacgatccctcaacaaaatccttcagccatcgagttggggagatatcgagttctggaacatcgaggtagtcggttcaaaaatatataggcgcataggtctaactggaaaccgagctgttgttcaacgaatggaaagcgtttgccatcctacataagcataactacatgtgcgtaggtacacgttgacaataaaaaggacggcttttccaatggatactgttatgtttgttggccaaagtgcggctggctgcagtgggggtgggtggtaggccgttgatgagaaaaaaaagtgtgagcttcattcatctccgacccaatgccaacggatgtttgcgagtgacacattcagtgcgcaattatgttatacttcacattcaaattaatcattcgatgtcacagccgaaccattcgttggtgatcaggtcgggatgttgggtcaacgcagtgccggaatgtgttttctcatcagccaacccaaaagaccggtgggaggatggcaaacttttgtcaccgagaagagctgacctcgatactttatgtaacgtcaaatgcactcggtttgggttgtatgttatgctgcctcccacttccaccaacatcatcacgtcatggctggtcataatgcaccgagtctcgtttgcatgttgaaagggatgataatttgctgccaacattgcttccattcgtttgtcatagagaagggtttattgtgtgtgactatagtgataatatagtcaatgtcattgctgaatgtttttatttttaaattggatcgatacatcaaaacccagacttgaaatatgcaatcacacaaatgtggcaaacaaaacacggatgatgttgatttttttgggaattgatcacactattagtaatattgaaaatcacttcgtacaaacgtcaactttctgccattgcttgaatgaaacctttaaaggatttctgtagaaacactaccaatggttttccttagtcgagtggttagagttcgcggctacaaagcaacgccatgctgaaggtgtctgggttcgattcccggtcggtccagaatcttctcgtaaaggaaatctccttgacttccctgggcatagagtatcatcgtacctgccacacgatatacgaatgcgaaaatggcaactttggcaaagaaagctctcagttaataactgtggaagtgctcataagaacactaagctgacaagccggctctgtcccagtggggacgttaatgccaagaagaaagactaccaatggtcacaagaagaaatatttcaatggagcaaattccctttaggaaaactgaaaatgatttctgatgaaaatctttaagtaatatctgtagaaactcttgaagagatatctaggcaactccggcagaacccttcaaattaactcctgaaagaatcttaaaaagatctctttgacttacgggtactcttaaaaaataggtattattccgtaggattattttttttcgagaattacatgacatttctgaaggaataaacaaaatacatgataaatcaatgtaataaatccgagtaaacatcctaaaaaaaacttctaaaggaatctattgataagtcacagaataattgacgcaagaaatcccttaaaaagcagcttttgggtatccctggtgttcaactggacgaatactgagaattttttttgatatacatttggacacgagccccaaatatctacacaagatctccccaatgtgacgaataagttatctagcttatctaacaagagggcggtaataatgagatgtacagtgctgttctgaataatagcagcgcatgtcgattttcatacaaaatgctcaactttgacatgctgtagttttgttccccttcaagcaatcgagttgaaattttctccacagaactacaaatatgcccaattttgtaaacacaaaatttcaaaattttctaagcccctgccggaaagtgagatactaggtgaaattgttcgaaaaaaatagcagttttaaaaatttgaatttcggcttgacattagagttttaaattgtatatcacttaccattggaacaatctcctcctacttatcaaacctacacctaaaccgaaaatgtttaaaatatttgtagaagaaaatttttaaaatgaaaaactgctattttttcgaaaaatttcacctagtgtctcacttttcggcagggactcagaaaaaactaaaattttgtagttacaaaattaatcatatttgtagttctgtggagaaaatttcagctcgattgcttgaaagggaacaaaactacagcatgttgagcattttgtatgaaaatcgacatgcgctgctattattcagaacagcactgtagatgtacagttaagtggggcaaaagttcgagtggggtaagagtttctttttaagatttttagctcaattcaccatgctgagggtcgtgggttcgaatcccgctgatcgaggatctttttgtaaaggaaattttctcgattcctatggcatagagtatctttatacctgccacacgatatacacatgcaaaaatggtcaatcggcaaagaaagttctcagttaataactgtgaaagtgctcataagaacaccaatctgagaagcaggttttgtcccagttgggacgtaacgctagaaagaagaaggatgcatcgctgccaagcggtctggagtgaaacagtgcttataagcttgaatcttgtcacctttattcacagaagagatgatttatgaagaaaaatcgatcatgcgaattatgcccttattctagcacacgcttgaattcacttctgatataattctatccaatgacctcactagattactagttatatttcaatggttaattgttgtttttcgtaatcaaataccgttaaaaaggctattgttcggcttttgaagcgtccggaaaattctagtcgcatggtagttggtgataaaatgatcatttttttgtttaaaaagattacatgctatacaaaataaaggatttttcgagagatcttttccataaataaaccttaataagtttgaatggatgtaacagtcacaattttcaacataatactctacatgattgacattcttgtgcttgaaaggagtaattaaatgttatgtagcttcatacgatttgccaagaaaaatctccacatggacttttaattaatgctaaaaacgatctagttttaaagcctagcgctaaaaatgaagcaaacagtttttttttataaacatgagtaaattgttcacgaaaatgagaatgaactaagcaaatttactggtttaaaataaatataggtacatgaaatacaattaatttaaaaaaaaacacaatttcatcaaattttcacgttttttttttaatttgtcgagatctcgggacttcccgagaaatggcaacttcatttcccgttgcaacttgtgttgaaccgcaaacgcgctttatctctgtaccagtgtatcaaaccgaacccggtacatgtgaacttcggttcaaactttggtttaaacttgggttcaaataatggcacaaagcagtcagacagggaacggttgaaatccacgtggataaatttctacgatcatatatggaacttcttggttcaaagggtcttgccttgaggcttgaataatttttgggagtcttccgtagtgttacgacccataaaaaaaatttaaatttggttacaaaatattcgagaaaatctgtgaaatacagataaatctgtatgtttggcaaccctgattgtagagggcgttcattgaaagcaacaaaaaaaggcacaaattgagcactagggttgattttttgaggtttgcttctactctctttactcgtagatttctgcttcgtttcgatctcgcacaaggtgctgtccataaaccacgtggtcatctattggggaggaacagggagggttttgtctggccaaagaacacgatcaacacattttttttgtatagaccaaaggtctcgagggggaggggcccataaataaaaaaaatagcccatgggttatggacagccctcaagctagtgcggcaggttgacacaaaagaagtaacgactactacagtaattcaagacaaccatgatacatttataactgagcaaaaaaaaagtcacagtcatgcgtgacttttattttcagtatcgcaggaatattcttattgcatgaaggaggggttagtcaatgcgtgattgtcacactcactacagtttttgacggtacattttcgttcactgatctagggatattccaaaattccttggggatagatgcgtaaccataacccacgtaaaatatctcagactattcactcttcggaacaatacattaatgaaaaattaggaaatttggtgcagccgttttgagtaataagcatttatgttgctggtaccacgctggccaaatagagatcttgaatacttcaataaaaccttatatcgtaattttcagatatttaaccaattggtatgatttttttttcagagtaccgtaatccggggtaacattgatcagtttttaggatattttttaaatatttaattcaaaaatgcaaatgttctgaattttatatttttaaaacatgtactgtcacccatagctcgtgactatatactgtactttggtttttgaaatattttagcatgtttacaaaaaagttttatgtgattttttcatttagctgatatggggtaacattgatcatccatgtaaacaacgttcggtaatattgaaaatgtcattacctacttaaatcatggcccctgaagccgaatatgatgtccaaacgcttacatctcattaactttttgagttattttaaaattaaaaagacctcgaacagcggaatacgcctaaaggtaggcaaattcctaagggaattcttcattcttaacagtaattcgttaatgttgcctaattgaacatacttataaaagtatttaaagcggaatcgtttttggcaatgccatttttagtgagaaccgcattttccatgctcatatcgcttgcagaactaatgtgagacatgaatcttcggttgtgtcatccttaaccattgaaatcactgtttcgcaaacttgacaaatttacgcataaagtctacgcattttttgcaaaaatcttaatttttaatagctcataaatataagaaagagaagcaacattcattctttggaaatgtttcatcaataaatgatgataccaacttattacgagatgagtcattccgatcaatgttaccccactgatcaatgataccccggattacggtagctccttattgcatggcattgtatagcccacattttatatttttgataagttgacgcaacacaaaatggccgtctaagacattttatgtggtaaatttcgatcgcccaaggaacattggaatattttcaaaaccagatcaccaatcatcaatgttgacacggattcttgaacaagaagagtttttcgagaacttctgaaaaaatggtgcaaaaatacagagaaacaaggaagttatcacgattagaatatttttaaatttgcatgtgcatgaaaggtgaaggttggtacctttcgtcgagtaacgttcaatatacaaaattcagcatactcatcaaaatatttgatagatattaagggtgctaaaaataataaaatttgtccgtttcagatcacttggaaaagctcacactgcatcatgaaatgggaaagacgaatcagagctccaaactatgtacacgtgtttttccaattgaacaaaaagtggttcaacttccgcatttgacaccgttcaagtagcattacgcgcaaaacaagctcaactcccgagtttaaataactaatagccagacactaatcctgtcgaaccaattagagaaatattttatcctctgacggtcttttgctgttgtttctgctggttgttgtgcgctcgacagaattcccatctggttaacgttgcgacaccattggaagcattccaacaaaagtcgggataaatcgaacctaagctaatcgaattgcagaacaagcctcccgctgtagaatggtacctactggctacacagaactcaaatctaaactgagggaccctttggtctgactgtgttctaagcccgtatactgtgcctattcaaatgattcgattttctggtcggatacgtttcattgacgatgccctcctgttcaaaggttccgtctgaccgagtttggcccgggaatttctctttttgccagatccataaccggaatggtttggaatgtttgtgacgaaacgtgtgcacaataatgcagtagtagcaccttgtggccctcctattggtgttcgggtggtttttccatcatgatacagtggggacccgattttgctaacccttcgatgaattttaagatgataaaacaatcttgtcaagaggaaacacaatcgacacacattttaaaattctttctccataaatttggtcacagattacttagggatttcattaggaatcgttgcaaaaataacaaacacagtttttttttactttttttacacaaagcacttattcttcaacaacaaaggagacagttttcctatggaatttaagattgaatcatttgtgacggcatgcaagttattttgcatccaaatttcatgcgtgagttttcgagagcatgtctccaatgagtttgctctcgcgggagagcttaatgattgagattttagtgttactcaaccaacactgaatattcattaggaactcctgcttaaagttactacatgcaatcctgaaaacgtttttaggattatatcacaataattggagaataaacttgaattaatttccagcaaaaacttctgcaaaaaaaaaagaaaaaatcatgtagtaatacaagatgtaatatttgtcatatttaacgaggaactcctatgaaatttcaaatatatccttaggaaaatgtttggacgagagatgagtacataccttatcatttcgaatcagtttcaaaaagtgtttggtccaacaggaagaaaactattttgcctaatattctgaacatgctgacaaaatcggaggttgatataatcgagggtagcaaaatttcatcagcactgtatttgaacaaacccggaaatgggaaaatcgaaccatttatttgcagagaaaacattatttctattctgcgaatttcgtgccacccattcgccagaactggatccgtcgtcctctgacacaatgaatcactggagggggattattttcccatacagtagttatttatgtgtgatttatcctctgaaatatgtgcattgctaacacgcgccaaccaacgcgaggagacagaatgtgggccacccacaaaggtggaatttgatgttcgaaccaacgcggtatgcacggtccaacgatatgtaaattttgagttcaattggagccgattgaagatctgaaaatgttttcgtttatgaatgtgggttttgtaatttggcagctcgtaacaatgataggtggattagattgacacacataattttacatacttgcatgtttgatgaacatatattttgaatgacccatgggtctcctattttatcaggcgcaggtatcatccaaatctcaaaagccgccataaaaaagcaagatgaatcagaagggcccgccttgaaaactacaaaagttatccttaaaaactatatttcccatgtagcccaagttgcgctagtggccgactgagtaaaataaataattaaaaaatatatttatgttgtatttaagccagaaggtaaacccgagcaaaatatattatttggtggttgttgtcttgatcaagtttatagaatatcatgtttgggcaactctgcatctatcgacatgtttcactctttcgtctttcattcctctcacgctcattcgtacgatctagcaatcgctagaaccaaaaaaaggacattacaccgtttccctctcttcgcattgcatcattgttttgattttcaaacgctatacaatatataggaaagggttgttattagtcgccggatttgttacactatcagtgacggtgacgaaaaataaaaagttctcgtcactacctcagctcaacgcaaccaacgacgctcaactaccagcaaccaagcacctcgtcgcgacgaaaaatcttttccgtttttgtctgtctgtgttttcgttgaacacgctcagcttgaataaaagtcagacaactaatcggtgccaatcagggattgaatactgagaaaattgagagaatctctcacgtatcgctctctgtaactatcataacatgctgcacattatgagagactgtttatcgtatattgctacaactttgatcagattggggggatagtagtgcatgataaaacacctctaaacatgctccaagcctgggggacactattgcttttggaagttcgtgggttgtttatcgtgccagtaaagaaaaacacctatccccaacggtaaacaagcgagaaaagtggattttatcatcgctctctctttggggctctcgctcactgcttccatttatcagacttgttacaccttgcgattcaatgacgatcgtggatcgtaacagatgtgatgtttttctttgcttgctttgatcgtgcttcatactcaaatgagagcgaattctgcaatgcctggtgccaattgaatggccaaccaaaaaaggaactcgcaaaaaaaatcagctcgcttccaaacaaaaaaacctaaagattattggtagcacgcgcctaccagcagggctaacacaactcttgagagtgtgcttggccaattgcttacacaagacaccttgttggctagtagttcgttgctctgactctctttgtctgcaattgtgcgctcggtgacgattagaagcttatgttggttcagtgcggaggggtgacgcgaagagtgacgaaaaatattattcgtggactttttgcggctccgtttcgtcgtggtgtccttgtcagttattaaaggcaaagaaaatgacgttcttttacgcacttaatttttttttaatttttcatcagcggttagtgacgtaaccgatggttaccaaccctgtataggaatactatatgcgggtaggaaatgggcagataggctggatgaggtccgaatcacggagaagaatcctttattatttcccaacagcccgcggtgagtgtctgaaagtcaaactttatgtttcaattaaataaaataaggtttttttagaaaaccagtttaactaagacttgttttgacttttgacatatatataatattccacaaacttttcactaatttaactttgaagaaaattatgtcaagaacttcaattttgattagaaaataacaaagttatgaaaaataggaatattattaaaaaatcccaaaaattcttcaacgattttttggcaaatttatttaaaagtgcctctattaatttagttattcatattctataagattttccaaagaaacctattgatattcgctttgtttgaagtattcccataaggattctccaaacaaatccctcagaaactccatttattcagggaatcaagaattaatcaaattctcttaaaatagacattttctctcgttaaattcctctatagagggattccacggaggcatgcaagtcgattttgatcaaccatttcaaaaatatctgaaactttgtacagtttttcagttccatctaaatcgtcattttccgatatcaaatcttcaagttgagtcacgactaacttttcaaaagggtgtatgtgaaaatggttcaaaaatattcaaaaagctgcacagcaaaaacggttcgttcgattgttagacaactaaagaaacaaagttagacaactaaataaagattccaaaaaaaaatacacacagtaaaaaaaaatttgtttgcattaaaaaacatcatttttgtcacaaaaactcaaatatctcaaaaccctatcggaataccaacgtaattttttgagggaaaacggtccattatattagctatctaccataaaaatttggtgatggtaagccaataaacaaaaaagttatgacatttcaaatatttcacaaatttgacacttagtgaaatttttttttttcattgttatttttttttaggaccgcagattgttgctgaattttttgttaagggtgaggttaacaagttgttttcatgatattttattgaattattcataactattatagcatctattagaaagttagacgcgatccagtgttgtgatctaaagtcttgatagtgtcatattttttattgtacgtaactgaagaaaaattctctcaatagtgttgaaaccttttgataaaagaaatctataagaaatctaatattgaagacaaaagctacaaaaaaagtttttttatacaggtatacgactagtttacctgcaaaaagtttacctcgtagagaacaaggcgggtctatacccaggtgatctagtatacgtaaagcaggtcggttatctcggcgctggttttctccacaaagttaaaatctgattacatctgggtatagacccgccttggtagagaatagactttgttaatcatatttgggagaaagcgagtaacttcaacaacatcaaaaacatgataggtacataccatgaacatactcacgaaaaagctaaaaatatactaccactatggttataaaagatttaattgtaaaatttttcttcagtcaagcaaacgacaccaaactagtcagtaaaaatttaaaagtgattttgtttattaaaatctaacgagcaacatgagtagtcgctttctcaactgttgcaggccgtttgcagaaaaaaagtgttcaaaagagctacgaaatctcaccgaaagcaccatagataaactgaaagcggctggttatgctccaatgtctacattgaatacaaatttacgcatttgtacgtcctgccgtttaaacgttgacaaacgggcaatctgtacatcatcggtggatcaggttgcaggaagttcgacaacaacaacaactgaggaattactagatgcaccgacaacaactgaggagttaccagaagtaccaagtgcagatagtcttgccacggtaccatcagcgacatctgtttcaacaaatcaatcagaagatgagtgcatccagaaggtcaacatcgaacgcttcaacgaagggatagctggaataaaagtgactccgattaaatggacgaagatgggttacgtcaattatcccgagaaaaaataccgtgaaatcaacgaagctgtacgaagaaacctcttcaaattaggacctgaggatgtggaaaatacagactacgatgaggtaattatgaatatgaaggaaaggttctcgaatctagccacgacaaggaaagaaaaattattgattttgtcgatgctgccaagctcgtggtctattcaagacgccattgatgagttcaaaaccaatagaaatacagcaaaagaggcaaaacaattcaaaaataactgtcttgcaaccagaaatgctaggtcgagtacttcattaacagatgagacaaaagaaaacataattcaatatttttaagacgatgaagtaagtagagctatgcctggccaaaaagattatgtatctgtaaaaaaagatggaaagcgtcaagcaatccaaaaacgattaatgatgactactttgaaagaagcgtatacacgcttcaaggaaattaacgaaaatattaaggtaggtttttcctcatttgcaagccttcgtccaaggcaatgcaagcttctatccaattcaggaacacataatgtttgtgtgtgcacaacacacgaaaatattaacctaatcttacatagtttgaaaagaatcaatttatcaaaggatattaaaatgttaactggtagtcttttgtgtgaaaatacaacatcaaattgctatctacgatcttgttcggattgtccagattcttcatcattggaaaatactttattcgctgagtttgaagaaaattatattgatcagttatcatttgagcaatgggtgaccacggataggtgtgacctagaaactattgtaaaacctgtagatgagtttgtgtcatttttttgcttgaaattagaaagtttaattcctcacgactttattaaaacagagcaatcccgctttttaaaaaatacgaaaaatacattacaagatggtgaatttttagtcatttgtgatttttctgaaaactatagctttgtattgcaagatgaagtgcagtcccatcactggaacgtacaacaagctacaattcatccattcgttatttatttcaatggaagtacgcaaattgaacattttagttttattgtaatttccgaagatttaagacacgactcagtatctgtaaatttgttcattgccaaaatgattaactttttacgcgttgataaggataaagaaatcagaaagatatatttcatgtctgatggagcagcatcgcagtacaaaaaccgtaagaatttttcgagcctatgtcaatttaaatcaaagtacggaattgatgcagaatggcatttctttgctacgtcacatggcaaaggtccttgtgatgctattggaggaaccataaagcgcatggccacaagagcaagtttagccaaagaacgtgagcatccaattaaaactgcaaaagaactatttgattgggcgaatcgcagaaaagaagaagatttaacaaaattatcattttgttttactactactgaagagtacgaattaactgcatcagagctcagcgagcaatataataacgcgaaaacgatccaaggaacccacacatttcactgtttcattccattgtcagaaaataaaattaaagcaaaactatactcgaactgtactgataatgatgcaaaagtgttcgatattgtaaaaaaattgaataacaataaataaataaataagtattaataaaatgttttcatgatctcataacgcatacccaaatccaaaacttttaaagtttatatataacatttagaaactcatcgatcatactctaaaaaaaaatatcctggtaaaaaaaaaaatattttcgtgtaatttgttaatttattttaatttatacatatatacatatacatataatatttatacatataatatacataatactaatgaatacatgaaaacgacttgtttaattcacgcaaggcccttaacaataaaatcagcaacaaactgcggttcccgtaataatttacaccgaaaaaaaaaatttttttttctactaaatgtgaaatgtcataacttttttgtttattggtttaacatcaccaaatttttatggtagatagctaatataatggaccgttttccctcaaaaaattacgttggtattccgatagggttttgagatatttgagtttttgtgtcaaaaattatgttttttaatgcaaaaaaaatttttttttattgtgtgtatttttttggaatttttatttagttgtctaactttgtttctttagttgtctaacaatcgaacgaaccgtttttgctgtgcagctttttgaatattttttgaccattttcacatacacccttttgaaaagttagtcgtgacttaaacttgaagatttgatatcggaaaatgacgatttagatggaactggaaaactgtgcaaagtttcagctcaatagaaaaaaatgaattaaaaaatttaccaaattttggtgctgttgcttggaatcactcaaacacaggattttaataatcaatttctaaaaaataaaaaccctcaagagacttacactgatatttctgcacgaattcttctattgtttttttctgatattcctctatgaatttcttcgcagatttcttcagacattctttatgtcattcgtgggtgcttttgaaaaaatataccgaaaattgtgcaatggtttttccacatatttttttctttttgagaaagaggacattttccaatttgtaaatgtattttaatcacagtccttcaggtcaataaaaccttagtagtgctcattcactatcaattctaagaattttcctatttttcaagattttgcaccaaatattcgataagttattcttgaacatgctttttatttatattcgttttgcaaagcactttacattgattcatctaacaatttctctaataatacgataagagttcacaagtattttttttttttttttcatccaagtatcgaatattttttgccaaacaatatcctcgaaatatctccaggagcttctcaaggacttcaagcaatttattttataactgttactcagtgcacgtagaatactaaactgatttgcaaactctttcattaataaggtaaaaccataaaggattaaaaaaatgtgaactgatcagcattttcaacattccaattttttaaatactgcgtttaattgcgatacaacgaaccaattacaatgtacggggatgaaccagcctcgggctgaatttcctcttaataaagagtcaatcaatcaatcaaaccaattacaagacaaacactaccgattgtttttaggagaattaatgttctttcaaatagcctatctttccatttatatgcacgcctaaaaaggctagactttaaactgccaacgtacatactgaaaagataaagttcaatatatatcaattgcagatcaagttataatccatgtcctcctcgaggaacaaaaactttttcagcaaccgaaacctagtcactttcaaataatatccatcgaatcgtctccttttccatttccggtcgtgtttcgatcccactccatcaaagccatcctccagctcagttcgtctgaacccgaaagcttgaaaatccaatgaggtgaagcgcttttatccatcatcttgaaagcagtacataataccggctgcgcgatgcccccccgattgctatattctataagcactcaatccgacggaggagaacttccctcaagaagtctgcagggtgacggagatttaagttggattgcgcgtctctaaggcataaaaaagattataaagccacgatataaaagcgaagattttttcttcatccattcaagtcgattcataaggatttgcaaagaacgctcacataaacattcaaatttcgcatattcatatccgtatcttgaagcgatttgtacacgaccgcaatattggaagttttttcaatgtcaatacttttttttcaatttttatcaagtcgatgtctcagacttggttgagaaaagagaccgttcaagaatatattttgtgactctacttcgacaaaaggtaggaatgaaaactattggcaaactaaatgtcaatgttgtagaccttaagaaagaatgacgtgacctgaaaatgtacgtagcaccagacattggtatgtgttctcaaaccaccggggatattcttaaaacggggagcttcgtttcctacttaggtacgtcagccttcttgcgtttccgtttgccctaaccttatcgctcttcataacgtaaatatagaaaaccatttttacgtctccatccaggcgctttcgacccatgacgacgcgcattgactgactttccgctcccatgtaatgatggagccgctttgttgaaatgtcttctcttatgccttctaactactgacatagggtaaaacggttaaatacgcttactcattgaatcatttctaggcgcactcaatttgtgttatttgccaaacgatgtcaaaatatattaaccttgagctgccgctgaaaccatggagctaaactgacgagttttcctttattttttttggtgaaatttgacctctttttgcattataagttttccgatgatctttattacagaatgggctatttccctgctactaatcaaattcatggaggagcttggttgctggttctttgcccttcgtaataaatggcgttctaccacacccattcggaaatttcgaatcaggcccattttaccacgaacttttcaacacgatttaagataaacatacatcgaagccaaacctcgaatttataagagcacaaatttagggaaccagaaaaccgtttgcgattaaaatttgattgatcgctggtggtgaccaatcgaaaaaaatttcagcgcatggcgatttttggttctctagatttgtgatcttgaaaatttgaactatggcttcgtttgatcttcatcttaaatctgtgataaggctcgaattttggaaatgatttcagagttttagctaacaaatattgtgaaataactgttagtcgaggtgttagccttaaactagggatcgttttaaaagaaaacggcacaaatgcttgaaagccacatttcgaaccactttcccctatacatataggccgactggataaaaaatgcctatcgatatgaagtcattacaaaggagccagagcgtgtaacgaagtctgtttgttggtgtctgacagcagagcagtggagcgttgtgtgtcgaatcacagcctgactataggttctctataggttctattctactgtagattgatgctcggaaattgaacgaacattggattttggattgtttgaagcttccggcatacataagatgaatagtaatatttgtttgtggatatttgtactttgaacgccttgaaaagcattggcgtagctatgattttttctggagggggcctagcaaatacttattttacagaagtaatttcggtcgcaataatcacgtttttcacaaattttgtagttttaacagatttatattgattttattcatttataattttgtctcatttcgcggcacatcagtgatattcgtgaatttcaatttgcctaacgaaaaatattcgttccttttgtaatccagtcaaaaagtaatccaatccttcaagatctctagcaaaaagctcacaaggaatgtggttcttccacatttttttccagtattcatcaatgcgctatgaagagactcctctaagaattcatacgggaatttcttaatgagttatttttgtacttttcaatggtttctccaagagctaaatgagttcatttatcagttttcacagttttcactgagtttgtcctaggattcccacggaaaatcattcccagactgaccccaccagaaactttctcgaagaatctctatcaaactgtttcaaaaatcttctgaaggattacgcccaagaatgcattagatattcttttaataatttctccttgaaggtcttctacgtaattattacatataaatttcaattgttagtttaatgtatcctcctgtgttcactgataatgtgtttcggattttcaggaaatactgagggtttatccaaaaaaattctaggaatctcataaaaaatgaattcgcctacagtttttccaactttgcttttaaagttcttcctgaagtttctctacaggattgtttgaaaaaatcgcagcaatagttatccagacttcatgaaaaaaaaaggttggctcttctaagtgttactgtcaggattccttattatattccacaggcattgcatgagcaattaaaagctcaattgagaacatgtaattcataatttttcagagaagttcttcatagatcaatcaattttttttttcaaagataattattttttagattcctctaaaatcaaggagaagtctcgtttttcttcaaaactctctcaaaaatagggtagatgtaccaatagtggaggtactaaacactattgaagttcatttaaccgcctaaattcaagaagcgctattaatgtacatgttaatgttgtaacgggaagtaacgaccattgacttaatgagaaaaatgatttcatcgcagtaatccacggcatgtcagtgaaaaataatacctccactattggtacactgttcctttagttgtggtatatttttaattcatgttcctatagttgcggtatccgtggttttcttatgggatcctccactataggaacactttaccgcaactattggtacaagcaagaacagttttagcaattttagtgatatttcaccagtttcaaagcaatttgaacgctcttttcaactattccgtgtatcaacaagccaagacgtcgattagcagtgtcggatctgcggtgaatgtaataaaatcagtgaaaacggcactaccgcaactataggaacacccacaactaagggaacacttaccctatatgtttttattttttcaaaaatgcctaacgaagaaatgtttaaaggattttaacattcccataatgttcctagcgaaatgcattcaactgttcctgtttattcagggatttcttagagaattataatattgtttccctaaggttcttccgaacaaatttaccagagattcgtctaagtatctccagtgatgttttttttctttgaatcgtactaacgattcttttgggaaatttttaaagaaattgtttaccagatttattaaaatttcacagttcattcctgaactcctcaaaaaatgtctccagaagttccatcatatatatagtattttttcaggttctgaaagttactcaaattttttgcaaattgtaatcttagtatttttccttaaataacattcaaaaatttatccactctccaattgttggtacaaaaactactccaggaatgtcttaatattgctttacaaattcctctacgaatcactccatattagatttttcaaagaaggtttaaaaggaatttgttggttgaatgattgcagattaaattctatatacaaatcgtataatatctggaacttgttgacaatgtacctcacagaaaagatttagtggtcctcgtaggacttactaccaaaattcttgttctttttccttcgtcatttagaacataaaatgattggtgttaaaatggattaatcttttactgaaagtatttgtaactgaaatcttagataatattgtgtatgatctccgaagtttcatgatgaacatatttgagttgaaccaattttttcctaccttaagaaattgcaagcaactcgtaatgtaagattttaataaatttaaatcttaggtaagtcttttgcattacattgaaaatttgttaagagattcctgatagactttcaggattcaggaaccatacgcagtgttgctcagactcatttccccgaaaataacattttccgaactacgaaaccacgaactactacaaccatgctctatcctcctaagatggaaaagcagatggttaagcttgagtactgcacacaaaatcgatcaattttgatcccagagagccaccgaaacttgaattgcggcccaccgagatcgaaactgtcggatcccatgagcaacactcaagccgaaccacctctctctccatctcaagaacacaacgcacagttataacagttcatggctttacaattcgaatttcggggaaatgagtctggtcaacactgaccatacgtataagaatcttgcaattttattataaaagacacggacaccattttcagccattaagctgaacagactgaaacttaatactagacgacggacaagcatgctccagtggcacagccgagaaacattcctgacgaaaagctacaatggctgaggagggaatcgaacccacaccccattttcaatactcctttaatacacctttgttcgcgcaaatgttttgtatacatgaatgttacttttatcactatacacgtatatccttttgtatgtattctgtacactttaatagaaataaatcagtttcaactctctaactgcctttgcaggatgtaaatccaaaagttatattattttactgtgaaatcacaacgtaggaatgaatctcgaccaaacaaccttttcttagattctttacaatgttgctttttgaagtattcaggatttttgtacgaagttcctcaaagcgtcatgcgaaggaaagagaaacaagagaaacaataaaatgttgaagcaggttgaacaatgctaattggtacaatgaaaaataatgtataatctttcctctagaggtaaattacagaatagttcacacctctctaatgaatttacaaaaaaaaacaagtttctcaagaagggccatcagaatcttctttcgaaattatccttgaaatttatccttccttgacttctggttttctagaattctttcaggaagcctctagaaattccaccctcgtatcgcacaaatattcaaactaagaatatggattctgccaataattggtaaaattaattctaaagtagtgttttaaggaagatcaatacacatttctttatgaatatcttaatttttacctccttcctagttattctactacatgtttctctacagattctcttaccgctatactcatttcctaggattttcaaaaaaaaaaatcctcaaaaacatttcaaaaacaatatttttttccaatttttgaatgatccgggaatatgaagcaaaatttctgaataaaaaacacatagaagaatatctgacgaattttttgaagtattttggaaatattttttaaggacttttgatgaactttgcggaagaatttgaaatacaatttttgggaaaactattaaatgaaattcagtgaaatatctcagtcatagatttgacagaatcgatgattttttgaaagaattgcgagagaaaattgaacttgggaaagattaagtaacatttttcaagtaaattcgggaacattttctggaatcaatttgctaataagaagtagacatagacgatggggccttccttagccgagtggttagagtccatggctacaaagcaaagccatgctgaaggtgtctgggttcgaatccgggtcggtccaggatattttcgtaaaggaaatttccttgacttccctgggcatagagtatcatcgtacctgccacacgatatacgaatgcgaaaatggcaagtttggcaaagaaagctctcagttaataactgtggaattgctcataagaacactatgctgagaggcaggctctgttccagtgaggacgtaaatgccaagaaaaaaaaagtagacatagaaggaatagatgttcaccaggaggaattcactttgaaagtatgaacaagtcccacattcttatttgactaatttccaagagatttgcaaaagttctgaaaccacctttcaacattctttgatgaatttcattataccaaaattctatgaagaatatcgaaaagtttttttttgacgttggataacgtcttacggcaacatactggggtacaatttcgaaaaacgaaaaatcgctcgcgtcacgaaaagtggttagattttgactgttaataacttactaacgcccgcataaattttcaagattcttgtaccaatcgattgcaaatctttctacgaatctactcaaataatgaaaactattgattttcatgactaaactattgaaaaataggtaaatatcgaggcatgtcttatttttcatagaaaagcacatttttcttgctgttataaggttttgacgttttgaagtttacatgtgccgtaatttcgggtgaaattgatcatttttcatggtttttcgtgtctgttttcaatcatgttgaaaatgccaaacaactgaatacaagtacgaaggtcaacctctttggctcatgtgccaaaatgttataacaaatgtggttttagtgctaaaaatcatcctttaaatagaaaatcggggaatcccatttcggggtgaaattgatcacttgtcaatgcgattattgttattttttgaaacgactcttcataatgaatatgagcaacctgaattcgaatattcttgcaaaatgcttaataatgcaatatgtaaagaaataatgaatagttaatttcaagaattgtgataaaaacgcctagatgtaggcaatttcttaaggaaaaacctgatatccaacagaaatttaattatttcaaccgtatgagctaattggtaccagtttagaagatgaaatcgggctcggggatatattttaagcatccttacaaactttacttacagtgaccccacagttatggatcaactaagggtcatttttcagaacaaaatatgattaaaacacatggtgatattgtacaaattaaaattaccttcctgaccatgcagaaaatagttgttttcgagaatacagctcaaaattctcggttatttaccaaaaagtgtcgatttcaatagaaattccaaacgatgtccaccccacagatgtggatcagtgggagaggaggattctattatggatcaaatcgactcatattatggatcaaaacactataacagcaatttatctgcgaagtaaacgaatggtgtgttagtgaaagcatacgttttggcgtttctttcggaatcgtcatatctttgattcataactgtggtatgggtttcaatgccccaaagatatgaatcaacgcttctgggaatacggttgacattttatttcatacggacggaaaaaatatacttgagcatattatgattgattacgatgctgtacagatttatggttaacgtaggtaaaatgtgttctgctaaattgcacctgtatttgatgagatattcccgttttattccaactctgatccatacctgtgtgctatccataattgtggggtgactgtactttgaaaaattccgttgtcatcgtcgctacctacatgcaaatgcatgctagagcgatcagagtatcaatttgtcaaacaaagagctaaacctaatcagcaacagctaactagaaaactaatcaaccaacattataattgataaataaattaataaatcaattaatagttatagatgaagtgtctctggttgtaactcttttacatcgaatgacccgttttgtttgaaattgtgctgcaattcaatttaagcgcgttctccacggatacgacgagtcagttggatgtccttcggtatgatgctgacacgcttggcttggatcgcgcacaggttggtaatactaaacaaaccgatcagatagaccattcgcttcctgcaggaccatgacggccgagctctggaatcgcagatttgtctctacatttctccgataccattacgaagcagaaaaagttcttcatggtgcggaacttcttcgagtataacggtctatcggtgttgaagtgttatccgaaccaaacttacacgacagattttctgtgctaacacacaatgtccacaataggacggaattgacatgcaacaaataatatgaaaattgattggatttttatcagtagaaatctctcatatgtttgtgccggtctcgagccaggaaatagatgaagctaacgttatccaacgtcaacttggcggttgtatctcggaaacaacctcttactttttttttaattgctacaaatcaaaacatggggcccagatagccatagcggtaaacgcgctgctattcagcaaaaccaagctgagggtcgtgggttcgaatcccaccagtcaaggatcttttcggattggaaattttctcgacttcccagggcataaagtatcatcgtacctggcacacgatatacgcatgcgaaaatggtcattggcatactaagctctcagttaataactgtggaagtgctcataagaacactaagatgagaagcaggctctgtcccagtggggacgtaacgccagaaagaagaagaaatctgttggaaattaaccaaataatatacttgttttaattatgaatcgtggtttacggccaaccagccgagtggaagtttaacaactaccgaaaagctaaacattacatataatttgcaattggattagatggacaaattgatgtgaagatttgcgaaaaagttacacgtcttctcagtgagaatcgaactcacgactccccgatctctagttggggcgcgttaaccactacgccatgagaggactcatgaacgcagaagttaacctgaattcgatttcagctcaataatcacgtggtcctctttcgcaaagtgcacctctttcggaagaattagatgcccatccaaacacaacgctttctatatatatccaatgcctagcccgagagcgcattgttttttagatataggaatagcacactacactagccagcaactgcgctggctgaggtttctattgtgtgggcttccaatgggtcgcgacgttctcaaacgaccggttacggaacatgagtccgttgctcgataaatacttgttttaattatgaaaagaaagaggaccacgtgattattgagctgaaatcgaattcaggttaacttctgcgttcatgagtcctctcatggcgtagtggttaacgcgccccaactagagatcggggagtcgtgagttcgattctcactgagaagacgtgtaactttttcgcaaatcttcacatcaatttgtccatctaatccaattgcaaattatatgtaatgtttagcttttcggtagttgttaaacttccactcggctggttggccgtaaaccacgattcataattaaaacaagtatttatcgagcaacggactcatgttccgtaaccggtcgtttgagaacgtcgcgacccattggaagcccacacaatagaaacctcagccagcgcagttgctggctagtgtagtgtgctattcctatatctaaaaaacaatgcgctctcgggctaggcattggatatatatagaaagcgttgtgtttggatgggcatctaattcttccgaaagaggtgcactttgcgaaagaggaccacgtgattattgagctgaaatcgaattcaggttaacttctgcgttcatgagtcctctcatggcgtagtggttaacgcgccccaactagagatcggggagtcgtgagttcgattctcactgagaagacgtgtaactttttcgcaaatcttcacatcaatttgtccatctaatccaattgcaaattatatgtaatgtttagcttttcggtagttgtcaaataatatattaaataaaaagttttcttggaaaaatatacttttaaaataacaataaatttattcatgcaaaaatacttaagaaattgaatcaaaatcaaagagagaatttattgctggaataaaacactctggacgattttgttacactttttcataccaggttaaatttctgccattcatctgaagaaaacctataatggccaatatagtgatgcaaattttggctttcttttgcataaatgatttatattatggtaaaaagcatcctctcaaagtttgaaataaaacaaaagaaatttgactgtttacaggccaagatgtatggagattactatggaaaacaacatctttttgtattcagccctctatctcttcgtcataatattttatggaaaagtaaacacaatcttctcatgtgaaatccttccagctacaactttgccgaagaccacattttgattggacgtcaggataaatggctattcataatcataaactgggtatgcattttgcatgcttaaccaactgcccggcaggcaacagtggtgctgctggcgggtagaatagatcaaaataatccaggctactatgttctacagcaaaaaagcagtgttgctctgaaagtaattgaatgatcatctcagcaacgtttagactttgtaatcaataataacaaattatccttacattccatcaaaatatggtcttcggcaaagttgtagctgggaagatttcacatgagaagagtttgtttacttttccataaattattattacgagcaattagaggactgaatacaaaaggtttgcctttttcatagcaattttcatataaacttcaaatggcgtgtgcacaaccaaatttcttccaaaacacttaaaattttgggagaatgatttttattatatttgacaccgttttagcataggagagcaaaaatttcaaaatttgcatcagtctattggccatgccgaaattccttgaatgttaagccttattactcgacaaaaactcccgctttgtattttctgagaaattcctttagtagtttcgtctatttttccaattattcttttctgaaattatacgagttgaagttaatgtatggatttatttagaggattctcataggaaaatcatcatgaccggacacctcgagcagggtttcctccaaaaactagtgaaatcaaaatgcagtgaatagggtgcagaaccacttaggcccatccatataaattccattccaactaattttcatacttgggcttgtttgggagtatacctaaaacattgtcaaaaatctcgaagagttgcagggagtagcagctgtatttttcagacctcttggaggacactctaagaaacatgtctgtgcgtgatttagggtggaactcggtggaacttttttgtattgataatcaaagttacatgttagtatttcataagtttaatttcatagccatctcatcgtatagatttcacatattcaaagttaaaattggttttcttatcccaacaaatatactttagcaacctttagccatgttctcttctagatttttatttaataaattggtttcaacactcttcgtactagttgtcacgaatgctaaaaatatttagtttttctgctactccgacaactgtcactttcaacgcttgttgtactagtattagtgcattttatagcttatcaatacttgtttcaatagtggatgctatctataaacacttgtggatacttattatcgcccaataaaataacttgaaatttgatttttgtctatgcagcaacgcactgtgcgacgggccaacaatggaatttttttaaatttatttatactgcccataactgcataacagtcacattcgacatttttgacaaattgaagttaataccatggagagtcatcaaatggtaaaaactttcgatcaacttaataaaatctgtgattttttgaaacttcagttctctcccatactgccatgaaatgtacactttttattcaatttactcaatgcctacttttgtcgaatgttacaaatatgcagttatgggcagtatagtagggtacaaaaatgcttctaaaccctggcctgttgtttgttggtatggttttgggactcacgttaggcgtgcttaaccacttgaaaactgctcctgttccttgatctcccccagaataacatcacgcaacttcatcggaggagggctgtgcttatgtactttgtctgtctcagcctctagctgtttggctagttcgctgttgaagcttaatggcgtaaaaacgctgttcactacgacatttactacagtgtttctgcgactgctcgttttgtccaattagtggttgaaaatctcgccggggctttacagaaacctgtcgactttttatggacgcacatgtacttttcagtactctacgacgactcgttcttcgctgctgcttttcgagctctcctagttgacacgtccagcgaatctggttgaaggatgacttccggttcactggtgctccgacaactcatgccggtgatacaagtcagagtagttcccggcgggtgatctatcctactccgaagaagatttccccggcggcgaaagatcttccgaaccaatgatatccgggcagatgtcgaggtcggtccggcgtttccggcgtggagagaagcttccggttcacaggcgcccgacgatcatttgccggtgaaacaacgcgatctactggtctagtccccgacgatggaattagcctactccgaagctgaccgggcagatgccgaggtcagtcctacgattccgggggaaggcgccccgacgaccatttgtcggtgctgtttcgcgaattactcagtggattctgccttctccgactcgatgttggtcgggcaggtaccagggacatttctgcaattccggttgatggttgacttccaaattgcaggcgccccgacggcttaaaacccatactatgctacgcacgctctattcgatccagtcccagactccgcccgcggcccggagctctctggtctttacgccagtatctttgcaacgactttgttaatcgcattttgctgtcatgctggcacctgttctgcacgatgttgtccggatttaagacgcttacggtttctgacatcatctcgctttttatatctctgaatcgcgggctgtcgaatataacatgctccagtgtctcttcgacatttggacgggtcggactctgcgtgtccgaatctgtgcagatatttccggaagcatccatgatctgaccaaaaactgggtcaggaagaagttatcttctccatgttttatttagtcttccacatcgacatgttagaaatgagcctgtgggtccactttcctttgtccgaattaatcaactcctgctgccactttaccattgtatccaatctgatgttattcctcagattcattgtgtcgctttgctagtagcatgctatgttcttcgccacaggaggagtcgtttaacacgaggcatcaaatgctaccctcgtctccgtggtgcttgacagtttgaagacgggctgattgggacgttggtatctcgttcaaggcggcgttctaaaccaaggaatcgacattcggcaatagactccgactctcccaaggcgaaattcgggttgtcggttctggggagtctagcagggtgtcgatagtagacaactggcaggttaccgaatcaccggaatttcgggacatcgaaccacacaaggtccaaccgaagtgcttttcgatgaggtagggtatacctgaacctagagaacgttcaatagcctaccttgttttcttcggcagctttcccgtgggaactacaagcgaatctgttcggcagctcaaaatcagctgcattttgaagcgtattcatttgaattgatgacatctctgtcgaaattgtttgctcagcctcggaaatctcgtcagcgggaagctgacagaacaaagaatcatctgaacgtcttcattggtgtttttttttgttagaatttgacgtttgaaatttggttgccgataatagtctaatgttgccgaagccgaaaattaccctatgatcaattagtctcgatcagcgagtggccaatcaagtccaatttgaacgataattttgttctgcagaattgtgttctagaaaatttaaattttggcttcaaatcaccttcaccttaagttcgttcccatccactacacgttacactataaaattcataaagtgaagatgcattatcatttccactacccaactgaacacacgaagcaaactggtaggtacgtcacaaccaacgtaaccgtccatccacccgttcgatgatactgtgccaattcagcttccaacaacactccactaaataagtatcccgcagctgtgctacccttttgcgaactgctagctgaggtgaagtgctgtgagagctgtgagtaagccttcatcgatttgtgcccatccatggaaaggaggtcaccacacaccacacaggccggatattcctataggtaactgcagagcttggtctgggttcgctctcgcggtcgtaaaaaaattatcaacacgctttggccccgcacaaaaggaagtctgctatgcagtttccgagagtgtagaaggtgataataacaaatggctttccgctgcaaccattttttttttcaatttccctacagagccccgcgcttttgccgcactgattgcggttgctgccaaattttcaacaaagctttcgtcgctcgatggaacgtggtgtttgttgaagtggattttttttttgttcggcgtcattttgtccaggagaccgataaacatgttctttctttcgttccatgtggcaatttttggtgaccgagattgaggaaaatttaacctagagctcgtcgaatcgaagcaataacaatgttctaggttcagaggtttacaaatgcgcgttggatgtgaaaaggcaatagttcactagggaagccgaagatttgtatctcatctatgactttctggattcttttactaaaatcaccgattgaaatgttttgcttgtgagaagatataatactgattagttctccaaaaaaagaaaagacaaccatattgatacaaaccttgctatacttaaatcgaaaaacatttctagcgttatcggaaactatcgaaaaactttcttattccgctgctcaataaagttgttcattgaattcttcgacgtcctcacccaagttacttttactttttagttgatactgctaaacgttgagctgttccgaaacgaaaagagcaacattcagtcagaatgccgtcgtgacggtaacgattaatgttcttgacatttttattgtggtcattattgagccaagggttcatggagtcgttccacgcgaagcatgagaaagcaatatgcgaacctttagggatgcaggttgttcgaggtttctattggttacattcacagattgccttcggcagcaaaagtttatttagaatgagattgatggagcaccggtggcttgtgcgggaaggaaagcggaaacgcgcaaaagtaaatgagaaactgattaatgcgaaacattttaccgtttaatgtcgtctgaccgttctgatcgtaatcgtactaatgagatttttcctttgctccatattcttacagttccgatgaaagtgaaaaagaccgaccttccggtgctgccacaggaaagcgaagttcttccagcattagatgatgccgacgctgacaactccgaagatgatgatgacgaagacgatatcgatgatgatgaggatgaagatatgctgggtgatgaaccaattgagagcgacgatgatgagtacgactctgaagaagactttgacgctgacaaagaaccggatactgggtcggcagcatgggatagcttcagcacacctatgccacttttcgctaaagacaagaaggacatctacacaacaacggcttccagcaccaccgaaaagcaaaccgagatcccaacaacaccaataaccgccattccaactcccgatccatacttcactcacttcgacccacgctacgaacatcagagcttcaaggtttgtaggataagttcgttgtaatatatactgttcgtagagtttgcacgctgaatttcaggaagcgcaacaacggctcgaagaaagccaccgtgagaaggtcactagagtgatgaaggactggtccgacctggaggagaagtaccaagacatgcgcctagctgacccgaaaacagctcaaaccttcaagcaacgcatgaccgcaaggttccaggtaactaaagaccttcattctgatgcaaaatcatgtcatagattttccaacacctaatacccgtccgtagttgaaattttttcctagtagttgaatgcactagtttgaaaataccactgtagcagccggaatgatagaaatagttattcgaaaacattgacatgagtttcaacagtttgtaatgaacgtccgaatgtatttgtaaccttttagacttctgtgcaggcactggaagaggaaggcaactccgagaagcaccagttggcggcaatgcatcaacagcgtgtactagcccacatcaaccagcgcaaacgggaagctatgacgtgctacacacaagcactcactgaacaaccaccaaatgtaaggcttctgtcacttcaaaagcttttattcagtaggggaactgggtgtaaaatgcgccatcggggtaaaacgcgccaccgttgttttgaacaaacgacgtgctttgggacgctgtttttctcccgagataatagaaaatgtattgaaatgcttacctatatatatttttaagtgttttcctggcaaaaatcatgaaaaactcaaaaaaatgatttttgctgttttcgttgtaattttgtgttattttctaggtcatttttcaggtcgatatacaactaaacttttgaaactatcatcgagaatcgacttgtgcactcccatagtttgtactccatgcgaaaaaagtgttgaatttatccttaaaaagcgtattgaaggacttaaactttaatcaactcgtggggcaaaacggccacacctatttcataacaccaaaacagccgtttgaattcaaattccagcaaacgtaatgccaagctgtagttacgtgccaatttgaaccttacaaatgcacatttttcgaatgagcatgtatactataatcgaacaataacatctgatcaaacgcccttatgtatgcaacgtatttgcaagcatgattgcgcatgcgtgcgcgcgaacgactaacgccgagatcaggtggcgcgttttaccccgcaaaaaataaaaatgcagataagcaagcattttataaaaattgatttattaactccagaaaaacgaaaatggatggctgtatctactatttgatagaaaacatgtttgtctatgagataatgatttaaaaagagcttataataatgttcttcatagataaaaacgcttccttccttagagggcgcgtcttacccccagttaccctaatctaaaattgaaacaatttcaggctcatcgtgttgagaaatgtctccaaaaactgctgcgcgctcttcacaaggatcgtgcccatgctctgtcccactatcgtcatttgctaggatccggaggtgctggtggactggaagcggcggcctctgagcgaccacgaactctcgaacgtctcgttgacattgaccgtgccgtcaatcaatccatgtcgatgctgaagcggtacccggaactctccacaaaactatcccaactgatggacgattacattcaagcgcttcgctcgaaggatgaaactccaggttcaatgctcgctatgacggaagatgctgaatctgcaatcctcgacaagtatcgcatggaaatcgaacgcaaggtcagtgaaaaggaacgtcaaaggcttgctgaaaaacagcgcaaggagcaacgagctcaggagcgggaaaagattcgcgaagaaaaactgcgcttggaggccaagaagatggaagctgcttacaagcaacaacaacaacagcagcagcagattcagcagcaacaaccgtcgcaacagccccagccacagcaatcacagccgcttcagcaacagcagcctcagcaacaacagccactggtccaaacacagattccaatttctgaacagccgcagactcagaagcaaatcgagttggaaacccaaaaggacacggaagctacgcgagactacactgaagaggctaccatctcgtaagtggaacacttcgatcgatcgactttggaaaatcggttaaaaagtttatctctttcagtaacagtcctcaatccaccgctctgccaacggtcgacgacgaagcagtgcagcgtgccgtcgaggaagtagcagccgcggttgcgcaccaagaagcggagcctaaaatgcagcacatactctcccatgataccggacacagcgaaccagtaagtattgaacgtttatatacatgccaaattcaacaatttgaacactttatttaaaaaaacaccatggagcatggcaaagtatttttgcaacaagaagcaataaaacgcatattgtaaccagatatggatccatagcagatctcggccctgtgttctatgtgtacttccaaagttagtgactgagagcttaatttgccaaaagaccatttacgcatcgtgtatcttggcatgcacgatgttattatatgccttgagatattaagaaaatatctaacccgatacgattctcgataggtgagacgcgaatccgtcattagtcatgactatagagcttagtgacatttgaacacacgtagactagcatacgctcgtcatacacagtttgtttttgatttcctcaaagaaacttgcacacgctttccagactcaccaaaatgcatatggaaatattacccaatttgaaaaatttaaacccgttttctgcgtgtttttcgagactgagtgcatattgttttcctctaaggttcacaactacatctacactagggtacccatacggcagaccagtggcgcaaccaagggggagttttgggggtcgaaacccccaccccccccagagctgaaaaaaattaagggttgccgagtatcttttagaaattcaacacagagcagtaacttagtttgattcgtgggaacactaggaatgtgaatgattttcacatatattttgatctaagtttcattttttaaattcataaacttttcagggagttttataaaaacatctgcgacatttcaagcctcttttaaaaacaaacagaaggcgttgtgtccacagtagactggcccttaaacaaaaaagttgtaaaactcaacggggcaccccctagatatgagccttagggtaagaaaaacgctctctaaaaatttcaactcaattggttgctccaccagctggcgcattcgatttgaagtttgtatgggatattcgtctaaaatatattgaaaattggtcctatgtcactgtttcgttccgtatactaattgttcgcgttcaaataagcccagaatgacaaatacactagttgataccctaatgaacataattgcagaaggttgtatctggatttaatctcattttcattactctttcagttgttgaaagttaggcttagatcagcactccagtacagttacttatatgcatgcgacatgtgcttcagctcgcccagcgtcataggtggctaaaatacaagcagtaatgcatgataaacttcagatggtaaaaacaccaactttatcaattttgatcatggtacaatcttctacaatattcttcgttattacatcaagtagtgtttttgacattctgggtccaattgaacgcgatcatcaattttcctgaatcaaacagtagatgatgtgctgttgcccatatgtttgagctgaaaatcccatattaatttcaattcaaatgcgccagctcatggaacgaccaaatgagctgaatttttcagaaaggcttcctctaaccccaagaaataatcttgaggggtgccccgtggaatcatacaactttatttttctcccatactgagctgggccagtctagtccacagtttgccaaaccttcagaaccttttcattgctgcagcatccgaaatatcaaaattcttatagttactcaagcattttgccaaatttggcgacctttagagtataccaattctttgatctttaaagattattagagaggaggaaaattttcgaatgctcttgaagtatttagctgccgattgaatcatttcggacccatttggaacttatgataattttgagattatgtagatgtggattaatactttaattcttcaactcttctcaaatatattttaaaatttacaaaaccccccctagaaccaaatcctggttgcgctactgcggcagacaattaatcgttccataaaaaaatataaaatttccataaaaaatgcaaaatttgccagcaaagaaacaagggtaaaatcaacagaaaagttaaaaatttacataaaaaaataaagaagtgcatagaaaaaacaaaattttccataaataaagcaattttgagcaataaatagattcaaaagtgcagtagaatcgacaataatctcactaaaaaaatatcgaattttacatttaaaaacctcaaaatgtccctattttcttcacgaaaagcaagaaatatttataaattttccacaaaaaaaagccaacatttgcaataaataaataataattcgcccaaaaaaatatttctcgccatgtagaaaaaataatgtttcatacaaaaaatcatacattaggggaggcaaggtttctaaaaatcacaaaaaaatgtttttcaatacaacctatcgttcggcgctacaattttaattatttcggtaaagttgaaatgaaacatggaacatgggatatctaatcttccaatattaggaacacttatgtcactgcttgggttatgtccaactacattgatggtaggagcttatgctctcatgccccaccagccagggaactggtgtttacaaactaagcatcatttgtggcaacactttatgcggcatgatggaactttgccgagcgcgctaagtgttgttagaccgctgacgtagttgcatgaagtgggtgatgagatacaaaagtagcgttacaacatgcttaaccatatttgtagtactgagacaacccattagatctaaaaatgaacctattagaagatactttaaaaagcgttatgttcgtatgcaaataaaaaaatatatttaggaaaaactcatcaatagaagtatacacatttctgcaactgctgtgagcagttacaccaaagatgaatgtgaatttccgtattatgagtccgtattatgtttaaaattactcgccactagctcagtagagaaacctattatacaaaaaaacacacattacactgcggaacacgtttttgtctccagcatcaaaatacctctattttctcaattaagggttgctgaatccattgccgtttacagaaatatcatagcacgtctagtttttgagatattggttttgaaaatgcaaaaattgactatttcagccaacttgcatgcaagtttgccagcttgtaaggcaatttatttgcattatttgtcacagaattcaaactttatgtgtataatagtacttatcatcaaagttcataatatttttggagcggaaaagttattttttgatggtttagaaaagtattgtattttgccatataagagaaacgaagaattttgtatggagactgcaagcatgttgaaaaagatcggtttaatctaaatttgatcgtgaaatttcaaccaaaatatatctaaaacgaaagtttaagtcctcttttgcatgcttagtggataagatcacaaaaaagtttgataaaatatgcttcaaattttaggtaaacatcaataaaaccaatgttttatacaactttggcgacctgtagctaaaaattgtgacgtgctgggaaatttctgtgaacggcatcagattcagccattccaaatctactagagacacataatttgatccttgagacacgcaaaaatgtcatttttgttgcgctgtgttattactcattattggaaaattacgttatttttatggaaagttttacttaaatattggaattttctacaaaattttcatgtattgattgtcattttgaattgctcagttgggtttgtttattgcaactttgcatttactgctattgctctttttgattttatgaatgaaaatttttgatttattgtgggcgaattattatttatttattgcaaattttggcttttttgtggaaaatttataattatttcttgctttttgtgaagaaaatagggacattttgaggtttttaaatgtaaaattcgatattttttagtgagattattgtcgattctactgcacttttgaatctacttattgctcaaaattgttttatttatggaaaattttgttttttctatgcacttctttatttttttatgtaaatttttaacttttctgttgattttacccttgtttctttgctggcaaattttgcatttttaatggaaatttcatattttttaatgggatgttaatattttagccgtacccataccattgggcgtgaaaaccactatggggctctgcacaaaaatccttctctctctttcactcttccatgaaattagtaaacaacaaaaccagtaaacgtcaaaatcccaaaaaaaaaaggggcagaggcctatgttatcctcgatgtaacctaagaaaagatgtgacaatgggattcttttaagtttccttctactcttttatggtctttgtgcttccaaaaatttggtgcgaatcgatgaaaatttaaaatgacagcagagtccggaaggtgccgatgttaccgtaaaataaccattactggcaacgctgttttgcggactaataagggaatggatcattttggtcccaaaaggagataagtattgtcgagtctctgtctcagaatgtaacatgtatatcgcgacctagggtttgaattatcggtggaaatggatttgataatttgatcgtcactcaatagaagagataagaataaatcttcgttcgatctcttcagtagcaatgtaaacatcaaatttggctgtaaacatgtgacgtcattcctatcgtaacataatcggtctgcatcactacacgaaaaaaaaacattctacctaatttttgagttgacactaccaaaaattgagtacggagacttacggcttcggcaccattcgactattatcgtatcggcaacaaattacaaacgccaaatataggcgtaagggtttcaaaactaggttttgttaacgatgccgttttggttaccccctcattttcatgtcaatcgttaacacaagacgaaggaagcttttcaacattcatcattcagggttggtaacgactgcaggagtaatacttggatttcatgctgaaataattcctagacaaaacaatattgttcaaattgttctttgaaaataataattctaattccactgtaatttatatcatttgagagataagcgtaattcaacctcagctgtaaggccgttttcaggtcgtgtactagactcgacttgaagaaattcaacgtatgcacacgttatatatttaaactaggtaaagtcataattccctttcctcttttgtggaaactttaagatttaaagctgatatacctaacagcttttcaaatacagtaaggacccgattttgtcagcccctcgatgaattttaggctggcaaaatggggaacctgacaaaatcgggtcgtattattttgttcctgtttttcaaattttgacgtggtacatggttacatggacttttaagagggaaatggacatgggcgtagccagttttttttatcagaggctcccccctcccttatattgataatatttcccattgccccctctggcaacgcccatgcgtgcatgacattaaacatcatcatcagttttaatttaaacgtgataacaattttttgacaaatttaaaataggctgacaaaatcgggttaaaaagctgacaaaatcgggggcagacaaaatcgggggctgacaaaatcgggtcagtactgtactctgaaataaacaatagattttaagatctcctagagtaacaactggtgaattcggttgaagggttagtaaaaacaaatctggaggaaattctagggttgttttggaagaaaaaaatcaaaataatacaagaggaaattactggaggtaatagttttggagttctaaggatggagcaaattcttctaagcatcatctgaaaaatctgccagaatttctggcaaataggtagagaaatctctagattaattcctggagagatccctttatagtctctgaaggtttcgttggagccagtaaaaaggaaattttagagactattttggtcaaaatagaccaaacttacctatacaaccagtgaagttattcaaattccctcagctatttctagaatataaatagttgaacagcaaacattatgtgaatttgtgtattatcgcaaaagttttcaggaggaactgggaatgtttgaaactccatcaaatatttcgctggaatttcttcaacacaaacaaaacaaaaatcgtcatagtctgctctaaatatttgtatcaatgatgccacaaaatatcagtaggaatttgaccaaatccattttcaggaattaactaaaaactatctccagaaattgctacggaaattttgaatcagacaagaacttctagagagtgtgctgtgggagttctataactccactaaagctagattgacccatcggttacatgaggaggggacatgtctccggaaaatgaaatgatgtttggggatgcccaaatgttactcagttcagctaagctaaccctaccgaagcttgttccctgtaacaatttaagccgatccaatgaagcttgtcttgtttaacaagagaggccaatcacgaggctacatctgttgaaatgctaaatgcactagttcctaccagaagttatacccgaaagttggttcaagggaagaaagagtagaagtaattatgatatcactgtgcacctcaaaaaagagtagagcagagattgattgcggaatgaattgagaatatttctcacttattgtctctgcaacaattatgatcatgaacacattctgagagtctgtttattatcttctgctacggctctgatttgatcgggggatgataaaatccatgcctaaataagctacgaacctggggggtgcggttgcggtatggctataggatgttttggaattgttcatcttgtcagtaaaataaaacccctactccaatgacaaataagcgagaaaacgggttttatcatagctctctctctttggggctatgattcgctgctcttatttatcaagtttgttacaacttgcgaaccattgttgatcatggaccaatacaaattgggtggtgtttctgcgcttgctttcatcgtacttaaaatcaatgagagcgaattctgcaatacctgctctgaatactgagtaccgtaatatcgggtataattgatcagaagggtgaaattgatcattgtatagcacaattttatttattcctaatggagcacaaatatcaatgtaacctgcagtaaatgaacgttgtttgtcgtaactattgtcgaattgtgtgttgtgaatttttttgcgttaaagaatttctattactatgaaaataatgtaaaatttcaaaatcatgtacggtgcagtgttgactaacatccttgaacttctagttctaaacaaggatttgaacatggtataaacctgaaggtttgtgaggctgcttaagatatatcccgcaaccagatttcatcaccaaaactcgtaccaattagctcatatcgttgaaataattgaattcctgttagatatctttggattccttaggaaattgcatacatttgggcgttttccgcgtaattcttgaaatttaagtattcattatttatattaataatgcagtgttaagaatttgacaatcatattcggattaaggaagctcaaatttatcatgtagaattgttttgaaaactaacaataatggcattgacaagacatcaatttcaccccgaaatgagatcccctgattttttattttgaagatatttgttaacactaaaatgacatttgttagaaaatttcggtacatgagtcgatgaggctcaccttcgtacttgttttcttgcattttgttgtttggcatttcttgagttaatgtctacaatgtctgtccttaaaggcataactgttccatatggaaaaagtaggcattgagaaaatgacgctcagttcgaagtttgccttttcatatgaaagttcataattttctagtacatttccgcatgctatattcatcaagcacaaccacacccatcgagttagggaggtatcgaggaacaaaacacatattttttaaattttaaacatataattatttatatttaaaaaacattatttaaatacatcaaaaatcataattttaacctgaaaaatattacaattttaccacaataacctacgttacactttttcaatggactgcaaaaattaaaaaatttctttctcttaaatgggcagttgatcttatttttactatcaatctgatcataataaacacattaaagtggttcaaaaaatcgttttggctccacaccgctcattcgattcagttattgatttacatccagtcacaaattcttcagcagtgctcattcaacttctgaacaaacaggcaacattgctgcacctggcgcgaaagatagcatgcacaaatcatggcaaatatgtgttactgcatttacccagtgatgcctgcagaacagctcaataattatagtcaaagttttacaactcattcaaaaatcaataactaattaatgggacgtccgatttaaaaacggtcttcgacaaagttgtaactgattattgtatctcacagtatcaacatagttctaatccccaagagcacatgggtaaacactatgacagattgaatgaattggttgcttttttcatagccagacaaccagaagtcgcaaaaaggttaacgaaataactcgttgattcatacaaattacattaaacccgcaaaacactgtggataatatcgtcagattcctcacataaacttttttttctgacttcatttgtacattttttttcgtctcgtacactcgtataaagtaagtcgaatcaatatgtagcagctgtcaaatcaacatttgttatcataagttaagtcgcataaaatcacaggttagctcggtagaaaatttttacgctcgcattgtatgttattattcatcacataatatatgcacgtatatcgcctccacttatgttcatagaaggcttttttgcgacatcttataagtgaaattttgcatatgcaaagcctccaggtgatttcgttatacatatattttggttggctgggtagttattcccatataaatttcaaagggcttgtgcagtctcagttttcatccaaatgagctcaaattttgggaggccactcagaatttgatctagaatggaatgagcgatatggagcaaaaacgattttttgaaccagtctaatacacatgaaattcattaacattttgaggacatttggagcttttcatcgaaaaatcgagttagagaggtatactcacatgggaaactgaaacagatagcatcgagtttggtaacaacgagttagagatgtatcgacttacagaagtatcaaagcatgctagattgaagggaccgcgcgtttcatcgagattcagaatatcgagtaagggagagttgactgtattttcattaaaaatttaaaaaataaaacttaaatttaaaattacattaaaaaaccgcatttttgatattttttcccatagaatcttgatagtgaacaaatgtttgggacaaagtttcataatggagaaatgttttatacaaaagttttttcaagaacaacttttgtcgattttcgaaattttgactttttgttgtgggtttgaatcccgctggtcgaggatcttttctcgattcccagggcaaagagtatcttcgtatctgccacacgatatacacatgcaaaaatggtcattcggcaaagaaagctctcagttaataactgtggaagcgcttataagaacactaatctgagaagcaggctttgtcccagatgggacgtaacgccagaaaaaaagaaaaaagatctaaagtttaatgcaaaaattataaattcaataataaaatttcatctggggtgcgtaatagatatcaccaagcagccaggctgctgtcaagctaaaattttgctttattggagttattgcctgcatcaaactgcagaagctttgtgtgttcacattgaaggaccaaaatgctcaagaccgcaccttccagattttcattagttattcgcgattattcatcaagaaaaatgggtaagtggaaagaaatatggtctttactctcaaaaacatattgttattgttggagaatcacgaatatctaatgaaaatggcctattttaatatttaaccttccagtcgtcgcacggtttgccaccgccagaacaaccacgctgctgctgtgcacaaaaagcgaggtttttttatctgtgttgtacaaaatacaacagcgcgacgactgaagtgttaaataatgtttttcgcattatatttgatataatttgaaaagggctacttctagagaagttatttagatagtcattatggtttagaaacattttaagactcttatagtaacatcagattgtatatattttgataggaaaccaaaattgcgaaaatcgaccaaaggttgttcttagaaaaatgtttttattaaaaattcctccatcatgaaacattgtcccaaacatctgtgcatttttttgttgtaactcatacggttcactacatcttcttcatagaacatttttctctaaaattcgtagtttcggtgttagaatttttcaaatgaattgcatgcaaaaatttataggccattttcaaaagtcaaaataatcgattttttttatggaaaacactcattctaccataccacaaacatgtgcaaaatatactgcaatccgaagatggtcgagtctgtgactgacagatttgacatagaattcgtcagttggtgaaatctacaaatctattatctacaaaaatgattacatagttctgtacaaggatggaattatgaacaagttgttaatcaacttaaattatctcttacactgttttttattatacgtctaacacagtgtattctgtgctttttcgcccttggcatctctgaatatataccaatctggtattttctctgctgatctctttcgtgctatgatgacaaatagcttaatctttcctagttattggtagtagctagggttaaaaaaactcaactgcctcttgatacctgcctgtagtaagacatcatgtagtgtaaaataaaaaaaaaatgcatataaaacaattaacaaccatcaacaaaatcccattccagacattttcggttcggcgagaaatctacggtcccaacggcagagagaatcgaaacgtgtacttcacgctgatgttcgccttcgtggctttgatgggcgctgtgttcgtgggcgttgccgtagccaagtggaagacttcgcgatcacctcatgctcaaggattcgtcgaggttgatcaggtcagttgaaaaatagatcccagagaacaattgaggggcgtggatactaattatgttcttttttcgttttcaggccgttggacagccaatcacgccggaagagcggcacgttgccaacatgcagatcaacggatacgagaatccaacctacaagtacttcgaagtgaaggaataatttgtgaacctgtaggccaagggcactcatttgatgaacaatgatattgtgtggaatcgttttcaacggacaccggttgaatactcgctgtgaacgttgacaaatctcaaagaatctgtttgaatggaaatggatttttacataattacgtttgatctcagttcaaagacgctgcaaagttaggggagtaagagttcccaagaagacggaagaaacgtctaacaacatgttgatttgtgactatgacgcaaaatataagcaaagataagtaagactacgtaaggtcagtattttgctttcggaagtatggattttattttgtatgaagggaagtactaaactatcgttaaaaagtgtgattgtaattgtatatttgcccgctagacactaatttataagagcatgcaaagggagaaatgggagaaccagattgaaagtcatcaaactgaaggatgccgccgttaccagtgaaataaataaccacatcaccaccagtttgagcgatttttcaactaacaatactaacacattacacatttagaagtaacagacttcacactttttttttgttcaggcacatcctcttgcatcgtagctgcg

SEQ ID NO: 119 - DNA, 15726 bp, Aedes aegypti; identical to SEQ ID NO: 66

SEQ ID NO: 120 - DNA, 18853 bp, Aedes aegypti
aaaaacggagtagaccggttgggtgagctggttccattatcaattaccgtgaagagagtggagaggggatggcgtgcgaatgcgttggagtgagacaaccggtggttgctggtgaggcgactgtcccgttttcacaaaagagtgagagcgagttgatgatggaactggttgttgctaatgacgatgatgatggttaaattactgatcggggtgcgtagagcgtaccgattcacgcacgaggagaggacgcaatcccgtcgtcattggcgatgacggttgttgagcaaaggaggcgagtgagagagaatggaaaatcaagtgaaaggaggcgagagtgttgagtacaaggggtgaaaggctgcgcaggagcgggttccgaaattctgagtagagagaagaacgtgttgagctaggtcagcaaacactaccacagtgaaagggaggtgagagtaaacagtttagtcgggagaggaatttccttttgcatgtgccgtgttttttaatgtgaatggggtgggtgagagaggatctagagcaagtcctgttgagaaacggtatcatcgtgacgacaggacaccccgtgcggtagtgttggtgcttcgtcggtagtcatgaggcagaaggatctgttagggcgaccgcagtgtcatctcgtcatccatcgaaagtgaaactcgttacggagcaggacgggaactgattccttgcgcctttttttttgtagtaaccacgttacaccgggatgtgatgtgctctgatttcgtaacttcattcaactctcatcgcgtgccaccactactgccaacctcattctctctcgctctctctctgcatcactccttctcggttgcactgattgaggttgaacactagctccagctactgctgctggacatcaacaaccacgcgacacctcgtcatccctccttccacacttgcatgtggagcgttcagcagagctcatcgaagacggctgcgaccaagacgacgacgacttcaacagatcggaaagaagcgacaatccaaagaagcggccaaaaattttaatgggtacttacctcgcgtgccatcgacgacaaccgtcagtcgtgtattgattttctcgccgtgcagacgtgtgtacgacgacgctctcccggtacgacggttgcagcgttttccgtgattgtcaaaacagtgaaagtagtgatcgaagcaggcggcacctgaaaccacacaatcgaagcataggcgacatctaacgcaacgcaacgcaaaatcataactcgtatttgaacaaagcaaccaataaaaaaacaaaggcacggcccaaagttcctcccgcgaaaacacgaaacggaaaatttaggagcagtcttgatctgatccattccgtatcggttcgtagaagcagtagtagtcctccttggaacgctcctcgccaaatccgttgaatacgtgtgataagttttaagtgcaaatacccctgaagtgaaacccaccgcgattattatggattaaagaacaaaagtgcagcaacacgctaaatgacagaagaccaccacaggactgacgttaagtgaagtgatatcgtaagcagaagtgagtgcacgtgggaagaattggagattggtgtgagaccacaccacctatcttccagtctacctagaatcagattgttagcgacgcgacgagcgctcgcggaaacgcgacaattgagaagctgattttccacggcggtccatccaggcaggcgatggccctgtcgctgctgcaggaagcgcaaacagctcaaggtaagatgaatggggaattctatggggggaagttaaggttgggttacactttgcggagaagcgaattgagcgtggcaattgatgattaaattattgttggatggatttgaaaactacagtgatattatggcttcattgaacgcttaacatttttctcaaatggaatcatgagtttaattattgagatctttgttatttttttataaatcatgatttgaaataatttccattgcaatcgctagcagaactgctccactgttgatgttggatacaagtcgagtaaaatctaatcacgtgttgtcaaaacatgccaattttttagaacgcctcaagtaataggcaaatgttttcaatgcttagtaatatatttatataattgaataatcatgaaaatcagtaatgaaagtcttcaccaaaattatgagtaaaacaaacgaattttaacaatattcgttgtggggccaaatcataattatttcttaagattctattgagtttttttgcctcagtttataacccatacattcagccgcatttacactactaacaaagataatcttatcttattgcataagtatttatagtaaataagaagaatgatagatcaaaaactcatcaaaagctgtaacaaatctgtgctaacttttcagaattatttatacagttaactctcccttactcgatattccgtatatcgatatccagttagagaaccatagtaaaagttggttatcatggctaactcgataattccttggatcgcagtttcattggttttgtgttctgtaacttgatacctccctaactcgatggtcccttcaatatcgagtaaaggagagttgactgtagcaaagtttgacagaacagttttgaccgtcggtacttgcaatcgaaacattattagtgatcgtattattcggattcacagcaactgttgatcattgattgttaaaaaacattctgatctagataagttgtttttcaagtatcagctcgaaacaaaaatcactctcaatttgttaacaataaatattctaaaaggaattcgaagtgtaaaagtggctgaaattgattatccgaaaattacaatactttccatacaattaagtatttcttttggtttttcaaatattcaataatcggattcatcgatgatttaatattcgattgctgtaaaccattctaagttgaataacactatttcgtcacattcatggcaaaacagtttcaaaatttgttttgttcatagccgacggtacattaactgggttcagaattccattattgagagcataactgcccataaaagcataactatcccatattgattttcgaaccaacaccttttttcatcgcaacattcatgttttaatatacaactcacttggcatattaaaatttatacactttgtttgaaaatgttgtggaaaaatatgaagttggtgcagtcccatattgaaaaataaaggcataacagtctctatatgaactttggagcttaatagaaactgcaaaactgtaattatgttcaagtttatacttttcactgatcaatattaacaaaatgagtattctgtggggtggatctaaaagaatatggcattcaaaaatttactagaaatttattaaaatttgtatgagaatgcaaacttcaaactttgagcgctattttctcaatgcctactaattcaatatgggacagttatgcctttatgggcagataagtgagaatatgcaatataatttaacaatgatatttgttttagaaagagaattccgttaattgttttacaattatttagtacgtttgacttcagatttattaaacactagtggtcccggcaaactttggttttgccatcaagtaggctgtttttgttttcattcggttttgaattgttttattcatggctgattagttttcactcgttttttaattgtttgactccatgaacctgttctcaagccattccatgacatacaaacactattccatgtttatttatatggatcttaaaagttgtcacacaggccgtaaggaattcgattcaatttgagtgaagtctcaatattacggttctttcgaaaaaatttcactctgcggtagccgccaagtcctaccgcagctgtcaaagttctaccgcaggcttgaaaatcgttgtatcgtcgaacacagctatctaatcgaagtgtgctttgaaaaacagcagaaaacaacagtcattagcgtggtttccaaggtatcagcgcagccgatcgttgatgctttgtgcaaatcagtaataggactgctgcggtaaaattgcaatataattgcttgttttattgcggttttaaagactaatttcaagttttaaacacttcgaaaactatgaaaatacaaagatgttattttagatggtcattacaactaaatctcccggtttctgctcatgggcgtagccaggatttccatcagaggggggcaagcgacctcaaaaacttatttacgcatttcatgaaaaacaataattatacacaacctttttgcattaaacggtaaactttgaaggttatccacatccttttccttttacagtagcaaagtggagttcaaaacgtgtcttgatttaattttaattgtgtgagtaatgggtccattattgccttaaaaaattccggattggaaaacgcctgaaaaaatagatttcacatgtattttttttacaggaatgacttccaaatttttccatgcatcttgcaagtattcttccaaggaatcagaaagaaattccctcggaaattgtctaccgattaatgtagagacgtttccaggtttggtttttattttccctttaggtaatttgaagtcttcaagaagtttttccagatgtagtttatcgaattgattgctttccacaccgaagtttatcaagagattcctccgtaagctattccattgttttttttttagaattcgacctaatattttttccaaaacatggcttcaaacaattcctcttgaattcatctatgcacgggttcattatttgacattttagcggtgccgtgttatttatggcaccatagcaaccagtgaatttggcaccgctcaaacgtcaaattagtgaactcgtgcatcggtccattacactcgaaattcctctaaaaatttattagaggatattgttgaagcattccaagaaccgattcgaggttttacaaggaactctctcaaaattattctaacatttttcttgagatatactcaagatgtttcctaaaacattactcttggtaattttgctggggctctgcagataattttccatgaactccaaagaaatatctatcaccgagctcttccctgagtttcattatgaatctctagagattcataatgaaactcataccagcagtctatcataatttgtttcagtgatatctttgagaaaaactaatattatttctgatcgccaatattcctacatatgtttattatacaagaatttcttcacggatttctttggaaacatctctaaaatagtaagaaaaattcctcaggagctttcccaaaagataattcggaagaattcccccagaacttcatatacagatttcagaatgaatgttctcaaaaacgctccagaaattcatcgagaagtttcttatgcaattcctcctataaatactacagatttttttaaggaacttctccaaggatctattcaaaaaatttatccctttcagaaactttttgaatcaaagaagaaataccctaaaaaaattcctacgaatttttcagaggaaattttggtgttctgagaggcataagttgaagtcatgaaaatctctgaaacaatcgctaatgtaactgtggaatgattcctgtttgaatatttggaggaatctttagaaaaatcattaattttttttaggaaaactacttaggcgaatcaattttgaaattattttttcgaggggactcttgaaatattccggatgctcatcaagaactattgaagaacttttaagagaactgcaggaaggatattgaaatccaaaaaaactgcctttctgcaagaatcgttattatttttttttataatctagaaaatatacacatcagaatttgtgtaattgtgcatttgcagtaattgtgggaggaatttgcaaacttcttcaagctcaaaaggtatttctgcagaaatttgtacaaaaactatttaaaataaatgtatttgaattgcaaatttccggaagaagctttgaaaaagttctaagcggtatttctgaatcatgaatatataaaaaaataactaattggaaccctgtgaggaatccttgacggagttcatgcagttattcagcaattttaaacaatttttaaaggaatatcttgaatatacaaaggaataaaagaaaaaaaatactgaagtggtacctaaaaatatataattcctgaagcggaattccgggtttattttctatccgagttcgaaaggcaatgcatggaaaatttctttaaaaatgtgcaaaagaatttccgaaggtgccatctgaagcaaatttttctggaagaagtaagttgtaagttctttgttagaactcttgaaacaattcatgaagccctgggtttggaaaaaaggtctgatagcacttcgaagatacattcccaaacaaaaaccttgagtaattgctgaagactcattgaagaaattcgagttattccgagaaaccgattctggaataaaccttggaatgattatttatgaaatctttagtgaatcgtaataaaaatatctagaaaaatttgaattgcttaggaatatgtggaactatctcttatccattttttttgacgtattctttgttgtactcctggaagactatgtttcaaatattgttgacagattacacacaagatatagcaaaagctgttgatagtatcataagacaagacaatttacaccgtcttcagccaaaggctgcacagactgaacaatcacgaacattcgacaacggacaacacgaaacacccagtagcccagtgaagaatttttcgtttgacgaaaagtttctaccgacaggagcgggaatcgaacccacgcttcgtggcacaatacgcctagacgactgacgtcgctgaccgcacggccacgaagcccacatcaaatcatcaaatgatatctggtgagatcttgaacggaagtataattgtttggtttatttgacgaattctttaaaagtcaatcagaaccccttttttttaaataagaatgctaaaggaaacttcttagaaattcaaacaaaagatcaatttccatggcattttttttcatcgggcagggaggggcaaggcaaagctaaattgtctaaatgattgttggaaagatctttgacagtctgcttttgagaagggcgcttagatgtatcacttattgttcaattagacatgaatgctgaaaatatgttttggaaagtttaaacaatattttatccttcatataaaactagttaatttgatttttttttctcatcggccagtagggagcaacggcaatatcctgagcccccctcatttggctacgctcatggttctgccgaaccaaatattttatataatgaaacccaagcttagaatcttactttattagacagcaagtagtaagcaatggacaatatacctaaaacttctgggttctgattgaatatgaggtttgaaatggatttttttacctaaaggttcagcagaatatgaataaggtcgaccaaaattatttaatttcctagaaaattagagaattttacaaaaacaaatttttgaaacagatttaatcggctttttggtttaaaaaaggattgaagaaggaataagaataaggaccaataactgttagttctttatattggactaatcagtaatggatcaaaattcacatgttattgagtacttttttgagtatgttctacaagtatatcttctgcttatccaaaagactacaatttaactgaatttttcaaatttttcgagtttgagttaactgaatgcaatagggtttttctaatactttcgacaatagaaatcattttctgagcgcaacatttctggaaaatatgttgacatatctttctgggttttttggccctaccagtctttgaacagctgaaatgagttttgcttcaacttttcgacgtttcggcgtgtattttgccttcttcaaagaattagaggctgcgttttgttgtctgtattagtgtctgatctgattgcgatctgattctaatacagacaacaaaacgcagccaaaaaaatccttgaagaaggcgaaatatacgccgaaacgtcggaaagttgaagcaaaactcgttttagctgctcaaagatggtagagtcgataaaaccaagaaagaaataagccatcacagtcgatagcacccacaaaatatgttgacaaagtttaccagattggactctagtgccttctagtgccttattatatacttgcaagcgggttttctcaaaaataaagtggacttgagccacaatgcccttatgtgaagggccaaaaacgtgtaaactgacctgctagtaaagagatttctgtgagtcttatggagtagtcatagcttctcctttcggaagcatttttcctcaaaaaaaaaaaaaactgttaaaacctgcctttcattcagttctgatgaaaggagtgtttggtcaaaagatcgcaatccattttgcttctattaggagctctgtggatcgtatttaatctcttcttataggtaatttttgaaatttaatcaatgaatggccatcacgaaacctcatgaaaccatctaatgcacataattcgcaattgaatcgcagttgatgctaatctttgttgaaaaatctattcaatacaatatgaaaatcatattttttactaccttcattttggtaccgaacttgcgaaattgttcactaaataaaactacaacctccgaaccgcacatctggcaccgagcttctcctggttggcaacatccgtcccaggcgttcctgggctcataacctgttgaaataaaactacaaaacaacaaggctcttccttcagacatcatcgctgcaggatgtgtgatgtacctgctctccaacactcctcctcatcacacaacttccgaaacgcacttctgccaccgagtctcatcattcctcgaagctccttctggcactgagctcctcctagctcccgaactcttcctagccacgagcttctcctggtcaactgcagcatcgtcctcttggacaaccgcaccatcatccaggctccttctgactttcgagttccttcaactcttcctccgatcaatcagcttctgccggctcgttctcagtatctcggcctccgactcgtgagtccgcttcaacaacctcccgtccggactctacccctctttgaggttctgccgcatcgtccaggtgcttcctcgtggtccttcactgaagtcgcctcagcatcccccaggcgttcctgggctcataaccttttgaaatagaactacaaatcaacaagcctcttccgctctaaccgcaggcttctgaccgatatcttacaatacgttttcctccagacatctccgctgcagggtgtgtgatgtacctgctctcccacattatttacctagtgtaaaccaaaaaatgaaaatatttaagatattcgaacatttttttatgttttcaaggagctgacaaatattctgccgtagttacactgagtgatgtcagtggcacagaaaatttccgacataccatggaatatatccaaagtatacaaatttcgaaactctgtagctcagagacgaaagatcacgtccaaattattcatattcacataaaagctaaacaaagaaatactctcaatatttcataatggtggacgctcaacatcccgaaatgtaccgtttatggtcactttaccatattatagcagtcttgctgaaatgaaagtcttgacgcatcaaaacttactaacgctgacctgcgcaggtttaggagtcaagtatttcactgcttctggtttttgaaatattttctcaaactgtcaccgattgcttcttgcgtgattcggaatagattcagcagcattcaagtcgattaataaaagaaccaattctactcatttggtagttcattgccgtttcacagttcaatctgacgtgatgcaaaacccggtgtaaatcaagcttaaccgatcaacttgtcctgttcagtggcccaaattttcttatatcccattactcttcaactgagcgattaccatcgtgtcaaacaatagtcgtggtccaccctttgactgacacattcatcttcccgacaaaaaaaaaaaaataatcatccgtaaaacaatgcaaatgatctcaaccatagtcaccatctcttgtttttcagcaccatcagcgctgcgcttcgaaaagtctcgaaaacttattcaaagagtctcaacttccacatatcgatgatacgtgtttcgcagacaaaattctacacgttccgctcttaatcagctcgatttttcacttttagaacgtttaatttccggatttacaaaacgacctaagtaaaattttcaactttcgcaacctaaccggtactttcaccgctccgttgcatagagagacaaagtgacttaaccacgaatcaaaacaaaacactacttgagtcgattttacacgggtacaaaatcgtcgtaagtaactgaatgacacggcttatcattctgttaaatttaagcgatgtacaccatgaaaaaatcgtaataaggtgaagactgttttagaacacattttgtgattctccctaattaattttctcaaaaccgtatgcaagttactaacgtcgttttgaaaaagtaatcgagaagtgtcaaatttcgcctcgcaaccccgctcgaaagcggcgagcgaggcggccattgcacgcttcgtgtgaccggcggcggccgccgtaaatcaaattaatgccccttttaattattcaaacttgtgttcccgacgagcgcttcgatgcaatggcggccagcacatctctcgacgagcagatgaccattaaaataaccccgaaacgacgagtagggagttcaacccgcctacttgatgatatgattcgcttgattcttgttttcggcggtggcggcggcctgcttcgattcaaccgcttttgattgaatcatctccggcggcaaggcgggcacgcaacgccgcgagacgaatcgtcggacgctcttcggccagtgatcgatttgcataattcgtcaaacggaattcgacgagcgcggtcgctgatgaagacaaagtcgtttcttgaaacgccattcccgatttgacaggctcggaagcaaatgtcgccttaatcaaaagaagggtgaaatttaaatttaaatagctcgctttaaaactttgcctcggtgtacataacccattccctgcgtgcatttcccagatccgtatcgcaaatggaaaacgggtgggtggcgaattcgaccctttttcccattacaaaggggaaaacgaacgggatgatgacgaagaagacgaagacgaggacgacgacgccgtaattagtttgaataagggttattttcttttaatcttgcaatcgctctcgcgagcggtattcccatgttccatcgtcctggtctgggccgagatacataaaagccgaagagcgattccaggatccctcgtttcccgcgctagcatccttcttatttcaggcgatggggagccgaagtacataggcggcgacggcggcggtggtggaaaagacgaatttcgccaacaacaacagcagcgccaccaagtatccaggaggatgacgaagacttagacgacgaacactacggcgttggaagaaaggaaaactcataatgaggacggcggctgatttacgcgttgcggaaggggagagaggtgaaggagtgggacacgcgaaaattttcgcttttatccctttcattttcccggatgcgatcatagcaaccagagtcggcggatggaatttcaatgctcgttgggcgtcaactctcaccactgcactatgggacagggacgcaatctggcgggacaaaattaataactcggtaacgaagcgtttccggtatttggtgtcttcggcaaagttttttgtaacaacgaggaccatctattgacataaacggatagttcgtaaatcgtccgcataggtggcgccacaatctaactttttactttgacgttatagagacttgacatgttctgcaaagttgttcattttaataaaataaaaaactttctcgaagacgtcaaaattccacagcctactgttttcgagttataagcaaaattagagaaaattagagaaaaaactattttttcaccgaatttgacatttttccttagaatcatgtcatataatattttttgctgataaatatataacaaacgcaagctctggtggaaaaattttaataatacgacgcataaaaattaggaaattatgaaaaaacctgagaaatagagcattttttgaaccttaatatctccaaaagcgcaaaaaatcgcaagctcaaattttcaggcaacatagagcaatacttgatgaaacggatgtcaaaattccagagaggtatattttggtgtttttgagatctatcatttattttacaatgattatatttctccaatacagttaatttccatgaggaatctgaagggacgatcgacttccagaaataacgagtcgtggaacaaaaacttacagaaaactgtttaaaaaagccatcatagtagccatgaaattcagtttaagagcagttcttgagttgatatcgagtaatgtagatgaaagtgtagattaaaactgggtacacaattgtttttcttcaataattcaaatgatatagtatggcatgaaagacttgatcatgtgtcagataattgttgtcatcatggttcgaggtgagcaatttattttgtgaatgtgttacttttaacacgaaaaatcaaattttaaagcatattcatgtcggtaactctaaatactaaaatttcagagggcacgatctcttgtccggagcttgtaacgcggaaagagcgttgattcttggatgtttcgaaacagatgatacagttcaatggtatcaatttggagattccttcgattttgagaactgttaggttgtttaaccttaaatatgtgtttaatcaccggatttgtttaaattttgagcttccggaaaactgtgacaacgaattcgagatgaaatccaaagccagcttgtactgtgagcagatataataatttcatgaaataataaaatatatttttccgataatttaaacatacacttaaatatttgccatgacaatattaattgctctatgttgcctgaaaatttgagcttgcgattttttgcgcttttggagatattagagttaaaaaattgctctattttacaagttttttcataatttcttaggttttatgcgccgcgttattatttttttccaccagagcttgcgttcgttgtatatttatcagcaaaaaatattatatgacatggttcttagaaaaaaggtcaaattcggtggaaaaaatcgttttttcactaattttatctaatttcgcctataactcgaaaacagtaggctgtggaattttgacgtcttcgagaaagttgtttattttattaaaatgaacaacttagccgaacatgccaagtctctagaacgtcaaagtaaaaagttagattgtggcgccacctatgcggacgatttaccaactatccgtttatgtcaatagatggtcctcgttgttacaaaaaactttgccgaagacaccaaataccggaaacgcttcgttaccgagttattaattttgtcccgccagattgcgtccctgtcccatagtgcactgccttctttgttggcactttgatatcaatagatcattaaaataaccaaaacagccgctatgaaaagcatagatagcgccaccgtagtcgtgtgtgtttgaaagaacagcaacgccctcacaatttcatatgcctcatacggtggcgcctttgttttgatgcggtgagtgctgcaaaagtgaccttcaatgatccattcgaaatactagagagagattctacgttaacgtcaagaaaaaagccaggttcttaaatcattgtgacctgaactcaaaaagctatgacgtaggaacgacagttggcgcccgacaggaatatggacatgtatcactacataaccgcattttacatcgaaactaagttactttacttaggaaaccacactcacagctgtacgttcacacgagccgactctgaccagaaaaaccatcgccaaggcaaacccagccaattccaaaaaccactaccagccaccctattccgggccatgattaatgccctaggaaaaaaaaggggaaagcgagaacaataatcagaaaaaccaggaggcattttttcttcatttgcttgcgtggcggtcccaagcgaaataaactctttcgcttactggcattacttgtaatcttgctaagaaaccaagcagcaacccgaggtaaacacacaagaagacgtcgacgcctcgcatcgcagcaatcggaagtcaagagaagagcccgaaaaaaaagcaatacggaagagtaaacagtcgctctcacgctcgagaaggcccataaaaaaggggtgaattcataaacacataataataaaattataaataaaggattagcttcggcactttggtgcggtagggttgctgccgaacaatgggaaatcaataaaaattggatttcggttcaggccgggttacactggaagcgaacgcttcgctttccagctacctgtcaaatgccgacggcatttcgaacgaactaatcgctgcgaggatcaatcaccgatagggaaagggttccatccataacaaacaccttgatacacatgtaccaaacggggaccggcaattcccgatgaaagtaagagttccttactatcccgaacatcctccccctcttcctcgtcgccatatggagcatcaaaaactcacaagaatccttgctcgtgtcgtaaccgttggcaatgatgtgtgcgaggatccaacaagcgaacggtgcagggaaaggcagacgccaccgaagaagaggaacgtgctggcaattgaaccgtctagccgccgtcgtcgtcgtcttcgtcttcttcggggcggaagcatatcccatcgtgaacggggttgagggaaggggtttttgttttgcttcctgatttcgcgcgctccgctcacacgctcatatgtgtgtatgtgtccgatggagtttgggccacacacgctaagggctgtgtagcgtaacggaaagggctgcccctgagagcgagagtttaccgagagtatagcgggagaaaggattcacatgtgaagtggcgcccaagcaaatcgtagtagtcggtttgtttacgttttcattcatcgtcttcgagggcctggcgttgggatgggagctgctgagtggtgtgcagggaactgaaccccctaggtcgcctgctgtgatcgcagccaatctgtcaatcaggggtggggtaaacgacggattcgtcatcgaaagcaaacacgtgagggaaacaatcagctggcgcagaatatctatatcaaatatcctacccaactgcttattatgttaactaatttaatcttgagacgcgtcggttcgaaaaaatcgatggctttttacttgctccgtttgcttctttgccactttaacaagaacctaccaaatcaaattattaaactccgttttttgcttctcttccttacaggattagccgccgtccgcaatagccttcagggaatgaaacgtgaagaggagcgtagcatgtccgtgtcgccaccgttgaccggtcagcaccatccacagcaccacctgaacatgaacgtgaatcacagccctaccatctttggcggctaccctccttcatctccttccctgggaatgttggcaccgcagctcctggcaaaccaaacggccgcggcgctgatggccgctggactgcccatgtcgttgcgagctcacctagcctccggattgttccctccacatccggcactcttcggagcttgggcacctcccacccctaacagcaacaacagcagtccacctccgccacaaagccccatctcgccggccttaagccacaagagctccaaatctctcaagctaaccaacaacaacaaccacatcgtatcgacgacctcggagattctacctcaacagaaaaagctcgccaaacgaaaacagctctccgtcaagccggacgccgcactgctccagtctccaggtcacaccatgcccgtagacatcccggacatggtcagtccaggccctatctcaccacctacctcaggctcctcgccacaatccaacggaagcgtcgaccttccgcaaaccattactacctccactcgggatccaacgcgggacaaggtcttcacctgcaagatctgcaaccgctcgttcggctacaagcatgtcctccagaaccacgaacgaactcacaccggtgaaaagcccttcgaatgcccggaatgccacaagcgattcacccgggatcaccacctcaagacccacatgcgacttcacaccggtgaaaagccctactcttgcacccactgcgatcgacagttcgtccaggtcgccaacctgcggcggcacctccgagtgcacaccggcgaaaaaccctacgaatgcgagatgtgccagcaaaagttcagcgactctaaccagctgaaagcccacatgctcagccataacggcgagcgaccgttccactgtgataaatgcaacgccagctaccgacgcaaacaccattggtaccatcacaagtgcaacgtcactacaagcccaccaacgcccgccatcagccccaccatgtcccactgtgaccaaaaatcccgttgctcggaagcctccgacctctccatggaacttaagccctcagtactcctccaccagaagttctccggcatcggcctctccctagacttcagttccgccgaaaaccgccacagtcgtcccatcggtggagccatcgacctccgctccatacgatccaaccctgttcaaatcacccacatcaagtccaaccttccggaacaaaccgaaccggaagatctcagcatgcattcgccccgctcgcccgtcaccatggaagaactcgaagagctggacgacgccgcctcactgtacctgaaacaacgccaacacaagttcgccctggccgcggccgctgccgctgccgtcgccagccaacgtcacggtatggaatcctaaatctcaaacccttcccaaaaaaaacccacccctagaatcccacccctaactgaaagaaaaatcaaatttgttgttgacaaccgataccaaataatcaaagcatgccaagaaaaagacgaaaactatttctcgacaaaaaattacaaagtagcgcttagtcgtaagagaacagagagccatctaacctatataaaaaaatataaaactatttaaaccaataaatccgcggagcggatccgcccgccgccatcttgtttcgaatcccacagctgttaaaacgcgccggtgtaaatacgaaaacaaaaaccctctaatgtaaatacaatcaacgccgaaacaagatggcgtctacccaaaaaaacgcaaaccaaacgggttccaatgcatccaaaaaaaatcagggaaaaaacggttgttgatcgcggaaccaaatcaataacacttcagttcagtttactttttcctcggtttttttttccagcgagtacgcgtagtaatggtatacaagttcctcctcccaaatagtgacgaaaaaacacgacggcaaagcactaagctgacaattactaatcgatgtgttaattgaggtttccctcccgaacacaatccaaaaatcaacaaaatggagtttactttcgaagctagagggcagtgcgcgcggttgggcagttcggattccacgttatttatctcagtagtgcaaacagaaagaaaaaaacgttcgtaaacagaacattgcgatgcttgtcatgacatgaaaaaccacgctgtttttcgccgatttgcgcggtcgattatctaatcattattattagtgctatttctttttgactgtctgtgtacatgtaatgctagtaattcaaaattcaacggttgccattggtttagtcgattaggtttttttttcttttgtaagatggaatggaagcgaacaatcaaaattcgatgtttaaggttttaggttcacattttttatattattattaatattattattattgcattataagtttttaagcaaagtgcgtgcggtttctcgtccagagtataaattgtgaatattggtattttatgatatttgtgtttaggtgaatgacggaaaaaagttattgaaaataaaatatttaaatttattatcaaagtgaaattgttgattatgagtttttgtgtattatttattgttatatcacattctgttttttatttttatttaggcgtcgtatgtcattcttccaaaattatttaaattttataacaacgttcgagtatgcttcagtattgttttgattctattttacttaattttgcatttataaaaaactaattaaaaaatttaataattttgatcaatttagagattttaaagaatgggaatgatttttattacggtctgacttttattgtaatagggaaacatgcaaaatgtcttcaaatccatagaaagcatgtggatcgtcactgtttaatgaacaacgtgccaagttttgaattgaatttgaaatactgtcggtgatgggtttgaatttaaggcccaaagcaaatgtcaaaactgtaaaagcaattttctccgaaatacccgccaaattgaaaaaaaaagtcaaacacacagctgttttatttcataaatagaagagctatgtgtttttatatgcatctgaagcacgttacgtataaccatctgatccaaaatacactctttattggatttccatgttgaccttgttcttttgaaggattttaataatga

SEQ ID NO: 121 - DNA, 12300 bp, Aedes aegypti
acttttcttagcttcatcgtgcacaaaatattttataatgtttgtcctacccatggttccgaacgtggacgcgcctctgctctagtttgggcacacgtgatgcacacgattcatcaactgttttaaaaatcttgccaaacaactatgtgttgcatttttttacagtgtgatttgaattttagctttccaattggaatacgattctacgaacatttgtggagcttcaactaaattcgcctcaaatgtgtactcaaaacgagctttgatcgagatcacatttagaaagctttttgatgcgaaaagcgctacaattgttcagcgaatcgtttcgattctgattagcacgctaaaagttgttgccacacacgaatgaattttgatgttctaaatgtattcagtaatatgatgattattatggctcaggggcatgtttacaatgttgaaaatatattcaatggacctgcaatataattttaaaatataaacttcatttttgctaccttctataaaacttttaacagtgccagttttaatgaacgttaattagcgtgcaaggattgtgaaaagcttcgaatgtcaaaaattgtcatctgatgctgatcctcgttcgtcataaaggtcataaagcggtgcaaacgtgaagcggaagatttcccggtgttataatctgtaaacaagttgcttttaaatgattttaattcagagcattagccagcggaacatcaaatggtatgtaatgttacatcaatttgtttcctgatttctgatgctcaaatctcccgtcaactttcagaacgtaatccttttgtaaaacatgatcccaacctctggctgatcgagatcaacgaacaaaatggagaacgtcaattcatattattttcttgctcctgcaattaaatcattcaacagcagcggcgattccttcgaatccgatccatcgttgatttacagcagttcctcggattcggatgtgaatgaccttaccgccactttccaggaattggtaattgatgtgaacggaatggtgagggagcttttcgagaagaacacagatctccatcgggacacggattccatccggcaggacttcattcggaacggcatagattcgtcaatgacggagtgcctcagctcgagacgattgcctcctccgggaattggtgttatctcgaaatggccgctgtccatgtgcgataatgaatcatcttccgctacaaatcccaatggcattaaaacggatgactcagaaaggaaacgcaataagggcgcatttcaatcgttcaggcgtaaaaggtccaaagagaacgaagacgtaagtactcgaaatttttcctgaggtaaattgaattgtgtttatgtagggctgtctactacttggaacacctggaattctcaacaaattatggctattatcagagaaagtacagtaaagtactctaaggaagcaccagaactagtaaattcaaaaggatttttcgccacaaaactctttcaatcaaaatacttcttgagctatgcattagtgtgggacaaaattgagattctcgctctagtccactttttggattgcatttgagtgataagctgaaaaatggtaaatataaccaacaggcttacgttaagtttaaatgaaataaatactaaatactagataacagctgtccaaatttcagttcgactggtgaaactattatttagcgccgttcaaagtttgtatgagatttactatggaaaaacacttttgcaatgaaaaatcgccagaggtcgcccattgacctcggtatagattctgaacttgatagcaattttacaatgtacctatatacttgtgaaaaaagttacctattcaataaaaactgatcggtaagatgacattgattaacacgtaaagcaataacaaaattgggcaaaatttccgaatagtcattgcttaataacttttttcacaagcatcggattgcttcgcgttcttcgacaatattgtaatcatagtatttcttatcgagttctttttttttgtatggtattcatttggagctgcctgacagctcaacttgtcaaggctgaaccctcggtctggcttttgtcaagttgcccctctaccaagaccaataggggtaccgggggcagtatggacaccccctgtatctttgcataagcgaatacttttacactttaaatgcaaacaatatttcagttgcctgtcggaggagtaaattatcctctaaaatttcaggaaaaatgttcaaaacattgattttaaatagaaaaattgagcatgtttttattagcgttagcgtagttacggtatacttcgtagattggatactagcaacattcatgtttctttttaataatctcatcctgactactttcaagaacaaggcaggggagtataccttgttcaaatcataaacaagaatactaaaagcatgaatatcgctattcccggccacgcccatctttaccgtaacttaggataggggaaggaaatgttgatgtagcacttacttaatgagaggccaccgactcagcgacaccctcataagcgctacggagttggaggttggggaaggtatattgtcaggattcgcctagaaagctggcgatagaccatcaatatttgttgttcaagcgttttcaaattaatcttttgaatgccggcaatcaaaagagaaaacaatagcttatttatagtataaatagtatttcgcgaaatgcttgtcgattgtgcagtaatatttttgctcaataaccagtaaaaagcaaaaccgatccctccagggtcattggattgtataaaataacgatacgcgtaaaaaaaatcacgcctattgaaaaactgtactgtgcccattcaaaaactgtactgggtggtactgtatttttagataatcgaaaaacgaaaggaagcgcgttcgagctaaacaccctaggataacacagtcggtttttctgctcaaaattatacgaaaagcagaatcgatccctccagggttatcgaacggttaaaaagcatccacaaccgattgttagttgcgtaacacccgcccggacagaatgcgcaatctgaacataattatcaaactccgaaaataacattttccgttcaagaaacgatcagaagttccacgacgcggacaaaaacgatccggaaggctcacaaaagaaaaagtatcatactggaacaaactcaccggattgattctctaaatttatgtgctgcctgtcacttccggatggttcggtgaacttagggcagccaaaaaccaacagtactgaggacacaaatcaaacaaatcactttttcatttttcacttttcactattccatttctgaatgtaaaaactgtcctgcttgggcttcacgaagcactcaaaaaattgagcatgtttttatttggttcgaaaattataacattcacacctcaccaaatatggtttcagaggcaaatgcctgcaagttgaccgataatgtagctcttgattgaatcttcaattatttatgctatattcaaaaatttagtagatttttttctggtactttaaaacattgaaaaacttatattgaaatttcttatactgttggggcaatatggacaccgggtgacaaagtagagctgacacttcaaagagaaaaaaatataacttcaaatacaaaattatccaaaaatatttagcattcaatgcaatgattatgaagcggaaccacaaatcagttgaaaatcgtcaattcttgattaaaactaacctggaggcaatattgaaagcatctttacgaaaaatgtcgtaaattggttttaatcatgtttccagtggcacagtgacctgtcactatgatttcctgaatatgaacttcatctttcgaggttttgagaacgatcgcgggacaattttcctataaacattagggtgtccatactgccccatgggggtgtccactttgccccgctagcttgatggtgactaccaaatataagctttttttaaacctatttttgaaaacaaaatatgtttttccaaattatgcaaccatgtttaacaaatgctgaagaactctaaaaagcatactgcacataaaaaacagtataatattcatatcctcacagtcaaaataggcaaattccttagggtgtccatactgccccgtgtccccctactcagacggactaggctatggtgccacacatgaaaatcagcatctccatcagaatttgtttgaaatagtagtgtagtagtgtcattactaatactgtctagtcgaaatggttttaaatgatttgtcatttaagtgctattctgattactcctgtcttttacgaaagattaaagtcttaaatgtcaattgtcgtcaagtcttaacaaaattaggctgattagtagaagttctagttaatttcattttttgttgttaaaagtatggttggtttgactttattaacgagatttttagccctaggctagttcatctcgggaccaacggctttacttcccttccgaaggaagtcgtcactataactttttacgtcataagtgactatgtcggggatgggattcgatcccaggtcctcggcgtgagaggcgagtgttctaaccactacaccaggtccgtccccgttgttaaaagtatttattggtcattacgttcatatatccttaaagaaaaaggtcattttccttgtctgttcaacaatgtctcgaaactagcatgtgttccctaatgatcgatctcagcgtcttactttccatagtcatttttatagtgaatatttaagagtaaagtcaggcttctattacagtctcctacaagattcacttttcggtggcaaatgcaatgcttcacaacgcctactttctacttgttaattttgcgaaaatgaagctggaattagattatttaccatgcccacaccgttacggatcacccacagtgacggatcactttggcgttcaacatcggataactcgctcaaaacataaacgttgacgtaaaacatatttttcccatgttatactatttgtcttctaccgtagttctgtttgatctttcgaccttgacgcttgcttttgccggagcgagcgacgagggcaggatcaaacatgtcgcgcgtcggtctagtaagttaaaaaagtggcgtgatcgtggagttcggttggagtaagttaaaaagtgccgcgatcggttcgttctttttgatctttcgacgaccttcacgcttgctcctgggcagtgcgtcaagaaagcccgagctgtcgtccgtgtttttttatcgggtcgcgcgcctatttttttttttttttctgagtgctagccgagcaaacgagtgaagctgaaagtggattgtggctgctcagtcaaggataacggatcaattggtgagctcgtttcatgctactatttctaatctataaaatatgtattactgacatttaatcgttacaatggtgggatgtaaatatgatgtttcaacaaactatggatggttcgtcactgtgagtgtcgacacaaactctgattcatgatttatttatgtttaacatttttttttcagaacacctcttatacctttatttttgtaattaaaaaaactttgaatggttcgacactacaagtgtagacttgcgaaaggttccctttattcaacaaactttggatggttcgccactgtaagtgtcggcataagaataagagtgttctatgatgtcccaaccaattgagtcttttgtttcttttcaaatgagtaaaatataataacacatgctttcgtactgacagctgtaggaatgttacatttaggtatttgttcaacaaactttgaatggttcgtcacctcaagtgtcggcataattttcctctacatagaaattatatgaacaattatatttacgtataagcatgtatatatctcacaaatcattgtttatcatggtctaatcgcttatcaaagtgaatcctttgacccaacgatcctccccattaacaaacatccctcccagtaacctttgtggagatgcagaggcaaacacggtctccaaatagcaaaggttacacactaacattccttccctcaatcccacctgactgcaaggacgtggccggcgccgttattgaccttgtataaatagaggcactgaattatgcacactgaagaagattatggccaatcccagctgaacttctagttgattctttgtgcattttcactgacttcggtcaatcacggaatagcaaccattgatatgtgtagtcagtctaagctaagctaagctaagctgttatactatttgtcttctaccatttgtaatgttaagcacaacattcaagcgctaaataacgatgtatttgacaaatctttagttgaaagcacacagctatcattgtatggtcgttttctgtaagaagtgccgtcagcattcataagctcccacaggtggtaaaattcaaatgttatagcatgatttatgctcgttcgcttcgatttagtatgaattcatctttggaaaatattttattctaaatacagaatattagcacttctaactagtgatccataatatggaccaggaaatgattgtttgccacgtttatggatcacttccaaagaatgtagatttctgctattttatgcattggattcgacattttcagacaatagcactaaggataaaactaacaaaacatcatggtttgtaaatttcatttttagcagacaaaaatgggtggaaaacttggtgtggagcgaaaacagtttatgtctcagttactacaatgcagtatcacaataaaaaggacattttacccttgtttccagctctaacactgcttttttggcagtaatatatgacacatagttaacattcgccataccatgcaatacagatgcattgagttgttaatctcttgattttgcgcactgatccgtaatatgtcacaatttgatccataatatgaaaattgatccataatatggttttcaggaaccgatacaattcataatttttatgcaatcctatgtagatattacactcaaaacagtttactaaccgaagttccaatttgaaaccattcgattcgtgcttttaaattacaattttacgttttccatgtcgttttattgaattttataggttggactcccactatttgatccataactgtggggtcatggtataccgttgttacaaaagatgtattccttattatggcaatgtgaaaaccttattaaaataagattgtcgccacttatttctactcagaggatctactagtcattttcctcagagtaatcttccctacgtcgtatatgataacgatgtgtctagctagctaatagtaagagtggctgcggatcattctggttagcaaagggcaaactgatcgacaccaatagtattgatgtccacttcgaatagattaattatttgaaatgggcatcaattctatgaatgacgcagaaagtccgttggatcacatccgagatattagtgcgtctatgtcatatgaattatgacgcggctttaagcaaaaaaatgccaaaatgtgattaccaccactacaggttacgcttttgatttccatcgtatgggctaatggattatgccctcccatcgcggcaaggtcgcataaccaaggggagggtagtatttcttatcgaggtctttgagtttttaaatagatcaatcgttgacctctggcgttttttctttacaaaagtaagtttgaccatagtaaactccttacaaagtttgaacggctggcgctaaattatagtttgaccgattaagctgaaattcatcaccgatgttatggagtgacaatttatatttatcatataatcgtgtcccaggtttcccaggtttttagacttctatctctaaccgttcttaacccatatccgcccagcgtcctaaaaatagaacagaaaaacgctcaccgtgctataaataggacagcacatgtagttccaaaatcttgaaaataaagaggcttagaagaaaaactatcttctgcaaagttgctcacacgactgctgacttccactcgatgaatgttttaattcaggattcactcaccaggtggcgcacagaatccaaccaaagtcttataaaacaactggatatagacggtacactttcaaggttttttttggatccccaccacagacatgattttttttaatgaaataatgtcaattccaattgagcctcatattttggatccccaccacagacatgattttttttaatgaaataatgtcaattccaattgagcctcatattccctgggcttgggattatattttccagggagcgatgaattttgataattgatcgctgttgttagtagttttgattagatgttgggtaaatttcaaagcaatggcaacctttttattacaaaatttagatttcatcttctgacctaaagattctggttaaactactgtactatgcagttgggctgcactacgctatcactcatcaaaattactttcacttcgggaaaatataatttcaaactggcgagaagattacagactgagggtgggttaggagcacaatcagacccttgaatgtgcaatgtggggtagtaattgggaatgccattgacggtttgtaatcttctacgaggttttcgaaaaccaacagggcgcgtgcaccgggttgcggataggagcaaagggagatcaatagcatctacctaaaataatagagcaaaaagccgttccatgattaggtaatgtttagcgatcttctatggtgttctagtactataaaattcttcactcactgggaattctggccttgataatatcaatagtgataaaaacataaaataatacctaatacttaataagtacaatgtagcttcaatgtagtaataaatgaaataaaattaattttctatacttgacaaggttttgaagacaatcaatgagtgaaagaactacctattcgaaaagccacatcagctaagtctatacatatacaaatgttggtcatagggtcatggcgagcattcggtatgtatgtctatgactgattcttatctaataggggcactagaagaccacgcggacaatttcgaaacaaattatttttatacatcggtcttatgttccgaaaggctcagctacgctgcaaagtaattttataagctattcattactgctgtttaattgtttataattctaacaaaactacataattaactcattactaatcacggttcctatattctctttttctctccttcttatctgttgcatgattatgagcatcactgatataatgcatgagcatgcacaataagaataatttcaggattgaaagcagtacatggatacctggatagaatagcttcgaaaagggcgctcaaaatataatatttctggtcagggaagtattttatcaagggtatgtaaaatttttccattattaacacacaaacaaatgaactaatatcaaatatttttaaaatattttttatataaatcagcatcgtcaatcagtgtaaaaacagataaagtttgtaaagttattaccatcgattaatttgcgctctgtatagtaatgttcaatcagtatcaaaatctcctgaagcgtcgcattgtgccatcagcagcccttagcatcactctcatattgttattattttgttgtttataaaatttctagaaagcgatcagcatattctttcttacttgtacaatggccgatctatttggaattttaataagtcaaatcaaacttcaaaactcaaattaaattactttcagcacatttacattttgcagcattaatcgcattactgtgccaagtcttctccattccctataccctaccccaacccttcttatcctttccgatggtgttcaagtggtccgcatagactattacggccattacctatcccttaccccggctttggactgacttgcgctctcattgccccaccaaacgctgcaaaatgaaaatgaaaatgaaattccaattgagcctcatattgacaaaatcggtgaaaaatccgtgagagatcgagaagataatttaaggaaaaaggcactgagttaacccctctatcggcagcttcattttttaccacaaaataaatattcaaatcattataacttttttgtttttcaatatttttacaccattttttcacaagttctcaaacatctcttctagtttagaaatccgtgtcgatattaattattggtgatctgcttttaaagatatatagatgttccttgggggatcgacattttccatataaaatgtctttggcggccattttgcttttgatcaatttatcaagaaaatagaatgtgggctatataatgccaggtaataaggatctactctgaataaatcacacaaatcggttcagtattcttggagatatctgaaaattccgatatgacgtttttgaaagtttttaagatctttattggcccagcgtggttccagaaacctaaatgctcatttcttaaagacggctgccccaaattacttcattttttcccaacatactctcattaatgtattgttccgaagaatgaatatccgaatccgattaaaattctgtaccctgagaaattaaggggggggggggggggggggttctagtttcgggtcggtcccccaaggaattttggaatatctccaatacctgatgaccaatgatcaatatcaacacagatcctaaaactagaagaattttttgagaacttgtgaaaaaatggtgcaaaaatattgaaaaacaaaatagttataacgatttcaatttgaattttgcggtaaaaaatgaagctgccggtagaggggttaattgaacaaattaacgtatagtaatcgtagattgtttcgaagcgtttttaaaacactgaaatatcgacaatttcaaatgtatgaataaaacgcttaaagttccttcgattccaataagaaatgctttgaaatatagttttgtgctaattatatcgacacatgtgtagcttttgcttgattaaactcaaaactgttttccgaagaaattgtatgcagtcccaagtaaatgtgtattttcttttgccatctagtattgcgttttctgctacaacaatcgcgaggagcaggagacatatctggggcattcatgtcgcgatggagaaggtttcgtcgtgtgcccgaagcttcagaggtacgtgtgcccgtactgtcaggccactggacatttggcccataccaaaaagtactgccccaaaaagccgatcatcacaccagacgacctgcgaggcatgacagttccatttgacgggccagcgaacacttccggacgtaatcgaagtgttggacggggaaagaaatcactacgattttaattgtttttttttatgaaatgtttctgactgtgacagaagtcaaagttattcggtgtttaagtttggttattttttatgaattgtattgtaaccgttctgtgctatatgagaaatcgtcgaatgattttgtttaaggaaaattcgttaatcgaaccatagtgatgattgtatgttcgaacgtacaatgaaactgtatttgctttgtaactgttttgatctgattatgttgtattttttatgcctctacaaactcacgttattttaaaaatgctgcataatgttgaaaaatcttttttgttcagagaaataaaaaaacgtgttcgatttagttttcttccttttgagtttatttttggggttgcttgggcacgtcttgaggaaatcatcaatattagggaccgtccataaatgacgtagtattttaggggggatgctggagtctacgattttatgacgaaccatgtattaagtatgggaaaataggcaacgatgggggataaggtatcgagaattggtcaaaaaatgctacgtcatttaagggcgctgccttgaggagaagatgaatcgaagccataacgcaaatcttcaaaagcatacatctagaaaacaagtcgacggtccgatgtgaaaacttcatcgattggtcaccacagcaagtggttcagcttaaacggatgtctggttctttagatttagatttgaggtgtggattcatttcatcttaaccctaatttcgttttctcggtctaaatagtctaagcttgtttcaactggcaattcacaatttcacactaccctgttctggtgggtaaagtctaccttacaggtgacccctcattcatgtgagttaaatcaaagagtggcgtgaggtgagcattgtcgttctcgtatagcgaggtgacaatactcgaatctattaaagtgactttctgtt

SEQ ID NO: 122 - DNA, 2595 bp, Aedes aegypti
tatgattatttcggtttttgtactatcgatcaattgaattggcgcacggacccggtctgccgaagtgtacaaggaggtagaagcgtcgaagtacataacaatagagcgagacagtgaatggctgctcccgtgtgaatcgaaagtgtgagtgagacagcacgtgggcaaaacaaaagaaaaactactaacaatagaacccggccactagtagtgaaaatccaaagggggtgaaggtttcaattaacaaagaagcaattgtttgaattaaagttgcgactttaaagccgagtcagtgtcagtgaccagaagaatcgtcactgagggtgatagcctgttaagcgggaataatgattgttcgtgggcgaagaagagcatgctaaatgtttgtggatttatctatgtttggatgatgtgtgttgttttctgtggggatcaacggtactgaataacaaggaagactaacgtgtttcgcgctgcggcggttacagcttataggattaaatccgttcgcgggtgtggttgtgtattatatttttcctcggtggtttttaactgaagaccttcaaactgtttgcgtacaggcaaagcaccgccgacgatatgctgaccatggagtctgatatgaaaggcggcatactgcacgccacaatgccgccgcatcatgcttcatctctgcatagtcactcgtcgtctccgtacggagcgttggggtcgctgagcatgatgaacatcggtcaatcacagctgggtcatcaggcgcaacatttgagccatcagcagcatctgtcgcatagcaacaatagtaattcctatggacaaacccattcgaatccacatggctctccactgcaacctggttccggccttagtcctaatggaccatcgcaggcatcccagcaacagactcctccaacgacaggactcggcaaccatcacatcacctcctccggtcagaaccatggtcacacaggcgttggaggcactgtaaatcacaataataacaatactagcaaagcagcgcaattgaatgccgaccgtgtaaaacgacccatgaacgcctttatggtgtggtcacgtggtcaacgccggaagatggcttcagacaatccaaagatgcataattcggaaatttcgaaacgactgggagcgcagtggaaggatctctcggaaacggagaagcgtccgttcatcgacgaagcgaaacgattgcgagcggttcacatgaaggaacaccccgactacaagtaccgtccacgtcggaagacgaagactctgacgaaaaccaaggagaagtatcctcttggggtaggttcactgctgcaatctagcgaaggcaatacaatccggaataccaatacaatttcggcggcacaacaagcggccgcggcggctgctgccaatcgtgatatgtaccagatgcctcccaacggctacatgccaaatggatacatgatgcacgatgcgtcggcggcagcgtatcaatcacagtcacactacatgagcaattatcaccgttacgatatgggtcagatgcacaacgccgcctcaacgggttcactgaactcctacatgaatgcgaccagctacggtatgtacggaaccgtatcgggtggacaaacgtctccatatggtctgcagcaaccgggatcaccatacagttcaatccaacagcagccaggatctccctacggcttgaaccaacctggcagccaaatctcctgccaaagtcatagtcccagtgattccagtgtgaagtcagagcccgtgtcacctagtcctacgtcaaccaacaacaatctgataatgaaacgtgagtatggacaacctaccgggccggatctaagccatctcatcaatatgtaccacgtgccagacatgcaaagcgcagaacatcaacggaatctaatgcagcactatcagcatagtgcgtcgcccgatcttcaatctcaacagcagcaagtcctgcggacgatggctcccatctcgcacatgtgagatttggccagttccgttggtctgcagtccataacctcatcttcaccgggagcgctggcaccgcctttatcgccggtgctcaactccggaactggtccgccactgttccacggccatccggcggggcctccaacgcaatcatcctcatcttcgtcctcgtcgccgctatcgtcctaccggcatcatcatcaccatcaccaccatcatcatctgagcaatggcgggggcaccggtcttaccatcggtgccggtggttccagcagcagttgtagcagtctcagccttggccataacctcaacgcaccgtcctcggtgtctcccacgggcaccgaagccggcagtagtctaggacatcagcttcatcatcacatcagcaattgtgttagtaccgatagaactaatcatttaatggacatatcgccactctaatcctcactttgccaccccctacttcgcggacgtatcgcgataacgtgaacttctgggagttcccgttgcagcgacccgaacccgtccggttattgagttctcgcttcccaaaacgtgtttgtacgttgttaagtttgacccgttccctttccgatcgaatcccggaattca

SEQ ID NO: 123 - DNA, 40983 bp, Aedes aegypti
  misc_feature (10291)..(10390): n is a, c, g, or t
ggatctccgtttgtagataatgccatacaaggaaatgtttgtctgtctgggaaaacgaatccaccaatgggcttgtgaaaggctctcctcgtcatcttgtacaagaaacgtaaacgcttgcgcaatcttgttctacatgcaacatcatttatgtccataagcacacacttgttgattctgataagaacgcctagcatcttgctagccattcaccatcaatcacacacgcatcgctgcattccgtaatcttgctagccttgccagtcgaccagcaatcggaacgaacaacccgcgcttttgtctcctctactaccgccaaaccggccccatctgtacagtaatagaactagtttctcacgattatgttcttttccaactccctcattacagaataacagctcatcgcatctaaacagtgccggcagcgataagcattcactaaactcgcataccactaacagttccctcggatctaacgtcagtaacatgaataacaacaataacaacaatcacaacagcgtcacaagcaatggcaccagcgtcaacgggctagccaacagtttaaccaatatttcgttaaaagaaaaacgcgaggcgatcatgaatgccaacaaccaccacgatgtgctgctgcagaacaacggacatcacgattcgaacaaaattctgaacgaacggcacgagaaggaaaaaccggtggtcaaatctaagcccaaggagctggacgggtacgtcgggttcgcaaacctgcccaatcaggtgtaccggaaggcggtgaaaaagggcttcgagttcacgctgatggttgtgggtaagtttccctgaatgcattgggttgtttaagcacatgataattaacataacttaaatatataaagcatttatcgtggcaatagaagtttgcaacgaatttttgtttttaatttatagatgttttgtttttcgagtatttcaacattggatattctatataattgaatattactactccagggaaggagctacagaataattttccaaattgtattttgaatctttcgcagagctttcttgctggtattacaacagctagtccatattggtacatggctgacctgaaaatctgtttgaaaatcaaaagcttgttcttaagttaaaatttcaattgtgttaataagtatttgttacatttagcttgaatgccctcaatgtgattttcgaaagttacatttttatttaacatgcgtcctagatacttaacttaacttctcttatcgtgacaacatgtgtactaaaagggttcaaataaaaagcttttggtttatgtggactgaaaatacaagttgagttttggaagcatgaggagaaatcttccattttggcaagtatgaagaaaaaaaatccaaacttttttgcaatctaatacaggtgacatgcaagcttcgttcttcgtcattcttgtgtgaagaaacgtccttcgtgctttagtgttagtattagaatgaatatttattgaaccaatgtgacaatgtataacaatcaatactgcgatcctacatctctccctttttctaataattaacatcttgtgtaatgaaatagtaagtgtaaatacaaggattattgattaaagcctttctacattatataacgcaaaatcttggaaatgcttagggagacgttttggtctttttgattcggctactctggactctggtggatattgacgttttcgtctttcttcattcgatggcaattggcttgaaatcacatctgaaattcaaatacattttataccaatatttgaataggaatatatctatatagatttataataatcaaataattgttagattatacctctatctccttcttttgaacacctaaatgggttttgattaccaatcctttttgtatggttaacatgtcggttggataaaacacctgtttcaaggttttccaaatgaaggcgcgtcccctctcttttgactactttgtgtttttgagggttgaaatttggagatagtttattctttcgaatgaagttctttaccactaccaagtctccaacatcgatagtggattgttttgcattccgtttttcgtcaatatattgttttcctttttccttgatacgtgcatcgttttgttttgcttgatcgaagtttactttacgtgtggatcgtggtagcttatctcgcaagttccaaccgaacatgagttcagcaggagagaaattggtaactgagtgtggtgttgatcgatacgcatgtaagaagtcttgtaggtcgcatttcaatcgcgacccattgcatcgctgattttgatagatcttaataacgttctattttgtctttctacttgtccgttttggaaagctgcatgtggaacagaatgttttatttcaattccgtttgttttacagaaagtagaaaactcatcagacgcaaatggttggccattatcacaaactatttcttcaggatatccaaatcgtgcaaatatctctcttagttttgtgattgttagtttagctgtcatggagttttggataactacttctaaatatctagaaaaataatcagttacaaccaacaaatggtgccctcctggaatttccatgaaatccattgcaattttcatccatggtctttctggtatttctgttcgtgtgattggttgtgtctccggaatcgaaactaaaacgcatcctgaacaatttcctacaaaatgttcaatcatggagtccattccagaccaccaaacttttgatcgcagccgtcgtttcattgatgatatgccaagatgaggctcgtgtgctaaaaccaacgtttgcttttgcaataccctaggaaaaactattatgttatccttcatcacaactttctggtttgtagtaatgcagtttgaaagtttcttatatctcattaatgttttaggccatcgtcgagctgcatatggtaaccatttgataagctcttgaagttcctcatcagcataagttgctttttctatttcttgtaacgacagagctatgggacacgtatcttgagtgatatatctgattattctttccgtttcttcatcaaaactaggtccgttatcgggtatagtttggcataatcgagaaagggggtcagctatatttccttttcctggtctatacataattttgtagtcgtaagacatcagtcgtagtatccatctttctattcgaggtgatggtttaacccgatctccaaaaattaccaccagtggtttatgatcggttattaagttgaatgatttaccatacaaatagtagtagaactttttgcacccccacactagagctaatgcttcccgctcagtttgtgcatacttcttctcagtagctgtgagggtctttaaagcataatgaattatcttaaactgaccagtgtcatttttctggaccaatactgcaccaagtccaaccgggcttccgtcagcaattacatatgtttcaaaatctggtttataaaatcctaggctctcgtctttctttaatatatttttgatttgatcgaatgcttgttgatgaacagaatcccaatggaactttgttcctttgtacgtaagttgatctagaggatttgttattgttgccatgtgtggaatatatcgatttacaaagttcactaatccaaggtgttcggatagctcaaatcaaataaaacatgtggactgtaattttactctttattcacacgcggttttaacaatcgatttatcacgtcttctcttcgcgagatcaagtggaaaacttatagcggaaacggaaattcatctgacagctcggttgagcaaaagcggcgctttacaccgtaaacaaaaaagcaaaactaattcataaaattaaccctaaatttgctctctttttcattagctttaacatagaccccccttgggctaggcacaaccctgggttactgtttctattcgttgtctgcaataggtagaacaactacctgcgttgttggtcgacagtattctccagtagcggtacgcaccttgacgactcggattatgccgtccttgccggcatgcgttgcggtgattcttccaagcttccaggtcttcggaggagtgttatcttctttcaagaccaccatcatgccggtccggatgagtgacggtgtcttgaaccactttccacgtcgttgaaggtcggttaggtattcgtcagaccaccttctccacaatgcttgcttcctcttttggatgattaggtacttcgttagtgcattatcccttacctcgtgatacagcggctcgggaattgctgtcagctctcgcccgatgagaaaatgtcccgggctgagcgctctgtagtccactggatcatccgattgttgacaaagggggcgcgagttaagcaccgcctctatttgaataagcagcgtattcatttcttcatacgttaggttcgactcgttgagcactcgatgcaggtgatacttcacgcattttactccggcctcccaaagaccaccttgatgtggggccttgggaggaaggaagttccaattgatgccacgaggttgacaaaagtcatcgatgcctttcttaagttgctgggaattcaacgccttcatcagctccttgagctggcgctgggctccgacaaaatttttgccgttatcagaatacagctcatgaacgtttccacgccggcctacgaatcgctggagggccgccagaaacgattccgttgtcatcgatgtcaccaattcaagatgtatggccttggtgcacatacatacaaatagcactatataacccttcactggcgcacggagtctcccttgcttaaggaagactggtccagcgtagtcgacgccagctctagagaatggatctgctactgtgactctgcacttcggcaagtctcccatgtgctgatcggtgtccttcggctgcacccgaaaacacttcacacaacgccgtagcactcggttgatagacctcttcgcattaacaggccaaaaattcttgcggatcacagccaacaatccgttcaatcccacatggagattttcacgatgcaaggcttcgatgagtatttcggtgaaatgatgtttctccggtagaatcaatgggtgcttctgatcttccgggagaaaggcataccgaatgcggccgcccaccctgagcaaactagttgcattctccaattcgggcttcaggttggctagtttgcccttaactgcttcattcttctttacacactttatttcttcacggtacacttcagcttgcacaatcttgaccatagcgtgctgtgccattcggtagtcttctctggtcaattttcctcgacgtcgttcttcaatttttacacggcaatttcgaataaacctcatcacgaatccgaagatcttctccaacttacggtagtcgctattgttcataatcaccttcagcaatcggttttctgcaactgtcgttgccgccactatttcactcgcagcttccacaacttgctcgccaggatgagcatccacggtttcgaagagcgaaagcagcacagattcaccatcgttcgatctcaggaagactgggccttcccaccacaaatcacttttaacccgtaaagtggcaggacggaccttagtgcacaaaaatgcttcaatctcagtcaatagtcatccgaatccaattctttaaaaagttatggaaaggggattagtgtacctacattttggggggtgacccatccctccatacccctccccgcttttgtttgactcgaaaaaccttggctctttagtgtttttctatagcaattttactaagcatcatgaaaacaaaaatgccatgcagattttcgttctcaaaactggtcaaaatgatgaattcagaccaacgtaggcattttggaccattatgatcctctcggaagaggacaccggtgaatccggatttatatacatttcggtataatttcttgcaatttatgggggaacttttgggagtctttattcactaccaatgaaagatcttggaatctgaaagaaattttaagatatcaatagagattctgggattcccgtatgacgtcaagggattcagttgaactacactgaaatttagagtttaagtgtgggttttcaagaatttcggtgagaatactataatgtctatagaaggtttaagaatttgagaagaatcctaagttttcaatacgaattctcagattccgaaagcgaaaatgttagttttatggtatagtttctgtaaaaatggcaatctggaattttttagggtattttattatcctgatcagcatctagggattatgggggaattactaacattacaaggagaattcagctatttcaataggaatcctggtattatggaaaaatcctgggttttcaatgtgtgatttcaatcttcaatttcggtggaaataaatggaagttttataatgggtattgtggcataagctggaatactggaattccgattattactggaatttggaaataatatatatgatggaattcagaaaaatagtgaatataatataatatctggtgttgtggtaggaatccaaggattttgatagtgatagatagggagaactatagttgtgagatttcgatgagaaggcgattgaaactgcattggaaattcaggtttatattgtgtgtacaaaaatttcggaaaaaagacggggttggtggtctgatggctactgcttctgcttcatatgcagaaggtcatgggttcaatcccaggcccgtccctttccttgtactttgtagttgtatatctcacacttgcttctatcttccattctaaatatatcacactcaaactattcgttcatagcaaacgctagaaccagagacggactagaaaccgtttccctacccgactaagggtacataacaaaattatatcagcatatgttattatgttataaggttttttcgaacataggttgttacaaacttgatgcaggatgttgttaaaataactaaaattataacaaaaattgtatgactagtaacataaacataacaaaatgtgtttcaattctatcaaaaacatatcaaaacaagttataatgtttgatacaaagtatcaaaattataatactgttcgatatacgataatattctatataattgaaatgcataactatctatttattttgttataaagttgttaaaaatgaacaaaaaaatatcttaaagggaaataaaacacattatgttatatttctgttttattatgttctatggataacggagcctaacaaaattgtatcataatatgatatgcatatcatattctgataaaattttattatatttttgttacaagcctctagtcgggtaacgcttcctacttccacgcgcacgcctttcttacgcctgatacataggcagtctgctaaccacaaaagcaaacctctctgccatgcctttctcccaatccatacactcccgcatgaactgacgtggatgcagtggaatatacggtctacgtgggagtcagttcaatgcatcatcaattcctcccccttcccctcattggtctgcattctgacgtggcaggtgccattgttgcctaaaaatagaagatcaccagcacttatacactgaggatgcctgttagtcccaagcagtcattcggttggttccttgtgtaagtgcagctgatctggcgatactggagtgcatccacgggcggccaatcaagctcaagctcaagctcaagctgtgtacaaaaatttcggaaaaaatttctgaagaaattaaaaaaaaaagataattgttgtaggatttcaaaacagaaatttagagatacagggattcaaaaaaaatctcgtggattggatttttgtattccgaacgataaagattattggaaaacggcatccgcttgagattttggtggaaatccttggattcctgaagatcttttctaaattccaaaattccaatcggaattccagaatttcaaccgtttcttctactatagtcataagccaaatttcatatgccattcgacatcttaaaatatacctgccaaggcattcaaaattcccaccaaaattcaagcgagtttcaagtgttttttttcggaatgttagaacttttgaggtatttcatatttttttcttgacattttttaaatatccaagacttctccatattccttttttataaattcgagttttccatcggatacccgcaccatatattggaattcctgaaattacaccaaaaaaatccctgacagaatccaagaattttatcgatattcaaatattacaaccggacatttaggagttcagaatcctccgttgaaaatctcattaaatctaaagagaactcagagaatgtctatccaaatgaaaggattttatcctcaatcacataatgcttataggatttcctcaatctcagaatacccactatctcatcaaattctcagcattactttcgaattccaagaattcttcagaacactcatcatgtatcaagaacttctatcaggatttcggaatcaaagattctctgccaaaatcccagtagttcaaaccaaagtattggatagatacattttcaaatataggaaccaagcatgtaatcgatttctccgaaattccaaaattcccattgaaatgcatggacgtataaacaaaatccggaatgtctataccattaccagcactttctcggaattccagaacaatgttcataaaacctgactcccactgcagttcaaccaaaatccaaaaatttctttcgaaaatccagatcctcaagatattagattcctttttttgaatttcccgaatattggacaaaaaaaaaacatttgccaagggtgcctgtttttgatgtctattttctgataagtgaaattctgatgaaattcctattcttagattttgttagaggttataagatttcggttggtggtaatctcaaggttgaggaaagttttctgagaatcgggtagaagctcttagcagtctcgtatgatttctgagattccgtggatccgaaacgagttctggaattgcgatgtgtcttctgggattgcaataggaatatagttcttctggttttattgtgggtattctgagatttaggtgagaatgttgggattttgaagtaaaatcctggagattcactctaggatattggagcaatttttgagtttctggagaaaattctgaaatttcacaattctaggtctgtggaaataattctggaatcttgatgggaattcttggataggttcctcaattttcttactgttgaaattttggtaggttttcttaggactttagttgtaactgtttggacagcagttgttgtgggattttggtagaaattgtgctatttcggtggaagttactgaatttggaaggaattgtcggtatttcttcttagattcaatgaaagtccctggatgtcactgcaaattccaatagtgttctgagattgcgataacatttcagattcaaatatgcattctgagattatggaaagggttcttttatttcagtaacagttgtgagatttcaataggattccgatagcactctggaattttagatataggttccagtgaatcctgcgatctcaatctgaattctagaattttgtaaagctgtaaaaaaccaatgaattcgatggaaaatctagaatttgggtgtagtttttagcttaggaagagttttggatatcggttcaaattctgaaatgttcatagaagttttgagttatgaaatagatcgatcacttcggaatagattgcagtcaaatcagctgagtttatttcatttgaactcaactcgtccaactttcactcaattcatgtgagtacaacgagatggttcacatgttcatatcgcgttctatacaaataagctcaagtgacttactcattcttaccccaaatcccacattatgtgaggatgaagatttaggagggagtcataagattccggtgagaatcctgaaaattcaatacaagtccgaagttttgaagaaatttctaggattttgaattcctgggttttatttagttctttctttttagaaagttttgggttttgatgggaaatttcaggtttttttttgcatattctaagaagaatactggttttgcactgagtatcatgcgatgttgatgtgaatacttgaatctgaataaatatctgaggatattagaggaacacctaacatgtatgtggaaatccctcgttttcaaaacaatacttagaattttacaagtaatcctagaaattatatgaaactannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggattacggtaaatgggaatcattataggaggccttagattttggaggaacttctgagaatccggtggaaattgttgaaattcaaaatattttttttttaattttttttgagtccagaaagaataatattggattacagtagaaattctaaaatttaaaaaatcttgaggatctggattttcgatggaaatttttggaaattggttgaactgcagcgggagttaggttttatgaacattgttctggaattccgagaaagtgctggtaatggtatagacattctggattttgttttttacgtccatgcatttcaatgggaattttggaatttcggagaaatcgattgcatgcttggttcctatatttgaagatgtatctatccaatactttggtttgaactactgggattttggcagagaatctttgattccgaaagtagttgtgatatttttatggaaatcctgatagaagttctagatacatgatgagtgttctgaagaattcttggaattcgaaagtaatgctgagaatttgatgagatagtgggtattctaagattgaggaaatcctataagcattatgtgattgagggtgaaatcctttcttcagaaaatttagccgaaatttttgtacacacaatataaacctgaacttccaatgcagttttaaatggccttctcatcgaaatttcacaactatagttctccctatctatcactatcaaaatccttggattcctaccacaacaccattatattatattcattatttttctgaattccatcatatatattatttcaaaattccagtaataatcggaattccagtattctagcttatgttacaatacccattataaaacttccatttatttccaccgaaattgaagattgaaatcacacattgaaaacccaggatttctccataataccaggattcctattgaaatagctgaattctccttgtaatgttagtaattcccccataatccctagatgctgatcaggataataaaataccctaaaaaattccagattgccatttttacagaaactataccataaaactaacattttcgctttcggaatctgagaattcgtattgaaaacttaggattcttctcaaattcttaaaccttctatagacattatagtattctcaccaaaattcttgaaaacccacactaaaactctaaatttcagtgtagttcaactgaatcccttgacgtcatacgggaatcccagaatctctattgatatcttaaaatttctttcagattccaagagctttcattggtagtgaataaagactcccaaaagttcccccataaattgcaagaaattataccgaaatgtaagaaatgatactgtaaccgtggaatttcctaccgaaatccaaaaatttctatcgaaataccaatacatcagaaatcaaaagatgtgttttcaaattccatcattcctcccaaaatttccagacaggattctctccggaatcacaggattctctccaatgttccaggatgatcttcagaattctagaattaccacaaaaacacccgaattcttaccgaaatctacgaattttctaaaactctagtaacctcctgaatcttaatacatcagaactctcaatttctactgatatcccagaactcccatcaaaatcgcagaattcttacaggaatccaaagatttcaactagatgcccagaactctgctagatgcccgaaatttctgatcgcccattgaaatccagcattcgcaccaaaaatttgtaaaacctcccataaaacctgcacggtttctgtaggttcctataaatcccggatttcttactaaaaacccataactttcatcgaaaacccagatttcatataagaatcctgagagttcctacacgatttgcagaaatccttgcaaaatttaaaaatttccacccatagaaatctgagaattgctttcagggcctaagaactccaaccagaagcacagacttccaattggagtcccagcataccttacatgaaatctcaggggaattgtcattgaaatcatggatttcatccggaactcaacactgcccctcataatttcttccggaatcgtagattatcttcaatatatcttagggttcattggaatttcagagttcccataggtattttagaattcttactggaatcctagcctaaatcttagaataccaacaatttcaactgatatctcagaacaaagaagttttgataacttagaactttcattgcaatctcaaaattcataccggtgtctttcttgactgacgtatagccaatattttgccatctataaaagtccttccaaaaaattcgtactcactgctgtccagatcagtttcagaagggccagacaggtcattgtaagccaggaaggaattctgccatcattgtgatatatgtggaagatataaactgctttgaaaacagcctctttgcggtagtaagcaaaatttctatagttttgcatgaaaaatcataaaaatttcaaactaaacatcgaggggaatggactaggggggatgcgtcaacttcaagcgccaccaaaaagcctaagggtttgctaccgaatgctggctacagaatgccatttgattcgtatatgactgagatacaaccattttcacatgaacactcctatataaatccggattcaccggtgtcctcttccgagaggaccataatggtccaaaatgcctacgttggtctgaattcatcattttgaccagttttgagaacgaaaatctgcatggcatttttgttttcatgatgcttagtaaaattgctatagaaaaacactaaagagccaaggtttttcgagtcaaacaaaagcggggaggggtatggagggatgggtcaccccccaaaatgtaggtacactaatcccccttccataactttttaaagaattggattcggatgactattgactgagattgaagcatttttgtgcactaaggtccgtcctgccactttacgggttaatcagttgcttcgggtacaacccacgcgaaatcaaatccgctgaattggcatttgtcggcacatacttccattcgaatttccctgccaacttacgaatttgcagaacacggttccggacaaagacgggaacgtctggcttcatggattctatccaacccaacacaatcgttgaatcagaccagagtatcacgcggttcacatctatctcgagcgcttcagtcacctttgcaatctgctgagctagcagtaacgccgcacaaagctctaatcgaggcgtggtcaattcggtgggtttcatgtcgtccttttcttgtcgatctagttccttcagcggagccactcgtgacttcgcacacagtaaattcataacagctggtccttccgattgcacattccgtatgtatacacagcatccctaggccttccgagaggcatccgaaaatccatgcagctcttgataacttgcagcgtccgtagtcactcttcgtggaatcttccttcctactatctccggtaattctcgcctcagcttcgtccacgttgctagttggctctcagctaacggctcatcccactgcagtcggcccttccaaagatcctgcatgatcagtttagcaattacgactgtcggacccagtaaccccaacggatcgtaaagcttcgctatgtcggacatcacttgacgcttagtcacgctgacattctcaccgtccattggcctcactaggaagaagaaatgatcgcctacaggattccaggacaaaccaagcgtcttggttgttacattgatatcgttgttctggaaatccatctgcttctctcggagttcgattggaatatcctgtagtagttcagcatcgttcgcgcaccagttgtgcaatccaaagccgcctctagccaacaatgccaggagctcttgctgaatctcccttgcttcgtccagcgtatcagctccggaaagtacatcatccacataaaaactcttcttcacaaccttgctcgctttaggaaaattttcctgctcatcctcagccaactgattgaggactcgggtcgccaagaatggcgcagtcgcagtaccgtatgtgaccgttgtcaattctatctccttcagtggctgcgaactctgttctcggtacaataccttctggaatttggtatcgtcgtcgtgtatcagaatctgccggtacattttcggcacgtccgccgtaaagacgtacttaggtagacggaaacgcaacatgatgctgaacaatggatcctgcacctgtggtccaatcttgagcagatcattgagtgaagttccagaagaactcttcatggaagcatcgaagacaactcttagtcgtgtcgttgagctgtctgggcggattacacagtgatgcggcaaataatatcccagattaccgcttgcttctggattctcgacgattctgcaatgtccgagggccaggtattcttccataaactgtcgatacagcttctgttggtcaggattcttctcaaggtggcgttctaattggtagaaacgcttctcggccatttgccgagtcattccaagacctccaacatctcctttgaacggtagtcgtaccttgtaccgtccgtctgcagttctgctgtgcgtttccacgaaatgtcgctcacaatcatcttctggggatccaacgtcaaccgactgatcgtcgatcgaccagaacatcttcatcagcttcacgagatcttcgtttgcttcgtcgactgtggcttgcaacactcgcactgttccgatcgtcgttgcagttttcactcgcccggatatcagccatcctagcctgctctctatcagcattggaaggtcaggagacatcctgatcctaccggctcgcaagatttcataaaatgcttcagcaccgactagcaggtcgacttggccgggttcgtagaacttcgggtccgccagacgcaaggtggtaggtataggccagttctccacgttaactgtcgattgcggcagcgtcccggtcacccgagggaccaccaggtagtccagacagaactcgtaatccgaatactgcgactgtacattagcgtgcaccttatgcctcacggtgcttctcattccatttactccgacgatcggtagatctacaccctgtttccgaattcgtagaaactcggccagcgattgagacataaagtttgccattgcaccagagtccaaaagcatacggcatctgtgccccactccagcagcatcaaatatattcactattgccgtccctagcaacacttgtttcgagtcatcatcactgcactttgccgaacactgcgccactgtcgtttcactgctgctaccgataccaggtttctctccggtagcatctccggcagcaggtttcaccggtgcagcagacttctccttcgtaaagttttcttccggatgcatcaatgaatgatggcgtttggagcattttgagcacgttgcggtaactttacagttcgacgttctatgacctctcttaaggcacatgaagcaaagcccgaattgcttggccttgtcgtagcgtcgcttcacgtccaagatcttgaattcgtcgcatttatcagcactatgcttgcttgagcacagagggcaggtatcatcggctttatgggtagtcgtcactgtgtgcaccttgcttgcagtttgttgagcccgagttggaggattcgcggtccgcgaccttgtggtcctcgcgttttcacaacgttccaagatgttcaggtgatcacgaagtgctgtcatcatctgcttgtaaacaggtagttgtcctcttttaacattcgattcccaaacctttctactgtcagcgtccagtttcgtagaaatcagcgtcgtcaatatggcctctgataatttgtctacattcaaaccgtggaactccaacgagctaacgcacttgtctacatcgtcgattagtgccttcaattgttggtaagattcacacgtcattggtttcaaatgcaacaacttgttgatcgtatcgttaatcagggccggcaggttttcgaactgttgggttaggctcctccacgcaccttcgtaatcattatcacgaattatttgagcatcaatcgcaccctgcgctttgccaaccaatgccttatcaaggtagtggagcttggtggcggcagagtcggcagtacatttgtcggcaatatctctgaacatctgcttgaacttgaaccagtgttcatatttgccgtcaaatgtcggtagtgctgcctgctgtaatacaatggtcggggggaatcgtacttgggaactcgaaggcgccgcatgcacatcaagtctgttaaccaattctagggttttctttgaaacttcataagcttcaatcatttcacatagcgctatgcaggtaaactcgtagagctcctcaaaatccacgaatttaggttcgaattccgttttacgcgtaggatcgacaaggtaaatcttgttcaggtgctcgttgtattcttcataggctgactcaactgtttttttgtacagcttcagagcgtgaatactaaacttctcatgatcaaggttagctgcttgtacagcttgttgaatacgagtaaccttaccttgtgctctctcgcaacattggctcaaagacgcaatgctttccgccatcttggttttcgccttttcctccacgtgctgaattttctgctcggcgacggatgctaccggtgtcgatatcgtcggaagatggggtgttgccggaagagaaaaattcagccttacaggacgcccggaacggagaaacattactttctttcgcctttttctttttgttttttagcacttcaatcacagcgccttctcaatttatgaggttatgttcacttcacttcggcgattgctcttccgattttttcgccgatcacttatctcgtgcgaggttcttccgtgttcaaacagcttacttgagctttcttccagaagctcatcaataacactgctaaattctgttcagtgcacactgtgcaaacttcttatgctacgcgtagcagaatactatcaatgtttccagaaccaagccgagatcacacttttcttcctccgttctccatcgaacgggtcgaaattccgccgtgcagcggtcaaattaccgcagtgcagcgatcaacaccaaatcactttttcgaatggctcaaccatgacgaaatcactcccgacacgttacaacgtgttcctgaactttttctacgttgcccaataacaagtcacagagggcggagtcccattccggaacacaatcaccgcgtggcggaatccattaacacgattcgacaagaagcagatttctgtcactccgcaagcgaagacttcgcgtttcacgaggcggaatccactttcaggacacttttcaccggtgccggaaacttattcactgttcgaacatatccggatcgaaaacgaccatgttcggatagctcaaatcaaataaaacatgtggactgtaattttactctttattcacacgcggttttaacaatcgatttatcacgtcttctcttcgcgagatcaagtgaaaaacgtatagcggaaacggaaattcatctgacagctcggttgagcaaaagcggcgcttacaccgtaaacaaaaaagcaaaactaattcataaaattaaccctaaatttgctctctttttcattagctttaacacaaggaaacttcgaacttcttcagtcgatttaggtgcatcgagcttatcaattgcctccaacttgctcttagaaattgatataccatttggggttatgtggtaaccaatgaaatcaagttctgttacgccgtattcagttttatctgcattgatcaaaatgttgtattgctgtagcctttggttcacaagatccgttctacaccgcaattcctcgatattcttggctggtattaaaatatcatcgataaaaattatcagccaaggaaaatcggcaaatattgtttccatcactttttggaaaagttcaggggccgccgagagaccgaacatgagtcttttgtaacgcattaacccaagtggagaaatgaaggtcgttatatacctacatttcttattcaattccacttggtgaaatgcttgacgaatatcaagcttcgtaaaaatagaatggccacctgaaattttatggttataattataaatcaagaaaatataatcaatatcattattgatcccaacctatttttttagtcatttgttcaagcatcggtaagggatgtacttcgcgaatgacagctttatttgcctcgcgtaaatcaacaattatacgtacttctgtttgacttttccttttgactatcattggagaaacgtccttcgtgcttcagtgttagtattagaatgaatatttattgaaccaatgtgacaatgtataacaatcaatgattactgcgatcctacattgtgtcatctgcaaacaaagatttttgacatcactgaggcaactcaggtaagccaggtgtgaaaatactgtgtaaaaaatgctgtctttaaaaaaacagctcttacaggaagtctttcagagttggaattcagataattaacctgaagtgtacgattggacagataactttgaattattctaacaatgtatgttgcaaaattaaagttcttgattttacaatcaaaccttcattccaaacacatttgaacgctttttctatgtctagaagagcaagaccagttgaatagcctgcaaattcgttgcaacgaattcaaattcgttacacgtaaaagttgatgagtggtcgaatgtctatgtcgaaatccgaacttttcattgtaaaaaatgtatttcgttgatgtggaccatcattctgttcaaaatgaccttttaaaaagcttgtagaaaattccatcatcgcaaggagctttcgtatgtttgatttttttaataatagttctcacctcttccaaatcagtcccccaggaattttcgaaaacattctcttgattgagaatattttcgaagttctaagtaacttgattttcaattggactagttagacctaaattaaaattgtgcgcgctttcaaactgcatagcaagtttttgagctttttcgcaattagttagtaataatttgttttcctctatcaatgcttctgaggttttttcaaaattttaaataaattccaattactgatggaagaaaataagctgattaaaaaagctcggcaggatttttgttaggttttaaaattactacaaccttgttatttttcaatttgtcaggaaaatatgccaactgaaaacattttttaaatatgccaaccaataatgatcagctactttctggaagtttcttgatgaggaagtaaaaaaatcgatcatcaccaggggttttaataattttgattgttttcataatagttctcacttattccaaactagtcccccaaaaattgtcgaattgttctagctcatgtctgtccattccacaggtgaggccggtttgggaaagtcaacgctaatcaactcgctgttcctgtcggatgtgtatcatccggagcagcatccgggtccatcgaaacggatcaagaaaacagtgaccgtggaaagcacgaaagtattactaaaggaaaacggggtcaatctaacactgacggtcgtggacacccccggtttcggaacggccgtcgataacagtaactggtaggtgttccctctaattaaacgatattgcatttcgaatgattaacttcctgtttcttcccccttctcagttgggtccccatcgtggagtttgttgagaacaagtacgaagaatatctgacggcggaatcgcgcgtccaccggatggcgattccggactcacgagtgcacgtgtgtttgtacttcatcgctccgtcggggcacgggttgaaaccgctggatatcgagttcatgcagcggctgtgcgacaaggttaacatcattccggtcatttccaaagcggacacgctgacgcccgaggagattacacactttaagaaacaggtgaggggagttgttcataggtattctttgaatttattgaaacaaaaacagattgattttttctgtttgtgaaaaagtctcactctgattacctacatgcttttttaaataatatgctaagtattcgaaaataaccattttcaatatcatccttatcaagtagtgcatcttaattatctaaaacagtatagtgatcaaactgtgtctctctttgtcaactttttcattcatatcgaaaaacgaacattatagcagttttattttgtaaaactaagtgatacattgattaatccttattaaagcgttcaatgaaagttgtccacaatacatgacatggcgaccgtgacgcaacacgtccagcaaatgctatctgagttattggactggaagtggcctatggcacccgtaacttttctatcatcgccaaagacttcaaagaacgaggatccaatctaattgtgagatattattttcaaaattttcgttcctatagtgcagaaaaccgtttctcaaagtatgtttagtatactctgctatataatatagcaggattgtgagcacgttgtaattgccttcccttcttctgttgtcttatcttcttctcacgttttaaagaccgatcaagtgtttaagatcgtcgtctagaataacagattcgaatttcatttcagattttggtattgcagtgccacttgcttgaacattaaaatttgttaaagttgagaaagttttgtcattatcaaattgcgtatgcaaagaagtgtttgcgacaagatagttattgatgtatattttatattcatttcaattagttatttgagaagtagacatcttaccaaaagtaagaacatttaaaggattttccgttgatgatgagacgcaattgaagtgtacccgcagcagcattagcataggcagcacttttcgaactgactgatatcgaacggtactttttggatattctatcttcaaaattacgggcacgtttaacgttcccgttctgcttggtacgatactgcataatttgtctgcgcgaagggcaatcttaaaagtacttataaacttgttggtattttcttttacaatcatttgtttatttatttagttcatttaatcttacatgcaatttacatatagtttgatttttaaaccgagatttggtggtccagcagtaatttaacagttttctatatgattggaattggtttgaaatattaagcttacaaagaaaaatgagggaaaaactatgcatttcgaaaaaaaaaggattgataataaaatgaaggacatatcattgctacaaagcactcctacttccagaatagcagtgaaaaatgcagaatattctccggtaacaacggctatctaataaggattccgtggacgaaaccgttatcaattttaaaatgtggagagtaatgtaattgaaaatggtgaaaacctaaatgctgagctcgatcttaatggttctctatcgtggttgatcacagagtagcaactattccattagttgatcgacttctaaaagcagggacgaaaaaaatcatgctcactatactcaattcactgacatttatgccaccatcaaagtaaccgcaccaccaccgaaatgattgcaccaatgaagatggcacaaaagtagatgaaaaaacaaacaacgatgcccgtacgtcgctggtgtttttgattatcagaagcagaagagtgccagttttagaaaattgattatcattgaggttcatactaattaaaaaatatgctgctttacgggtaatgaacgatacgatgcacggaatcgatggtgttgacgcgtctttactgtgctttgtacaaaaattacaacttcccgaagcggaatgtaaaaaagtcaagctgtccagaatgaatatcattttttgcttccgatgatcataatgcggttgagtatcagcagggtaaaaggaaactgacaatcttgcggcaagcgctttgccaatctttgttgtgttgtcaaggcgaggataaaaacaaataaaaatcaacgaagattctacccagcaagtatcaatgtaggcgagggtagattgagtattttcgtccctgtctaaaagtatttgaaaaaagtaacgttcaattttattgtcgtaaatgaaaaaaaatataccttttatcttcacgatttttgagaagtagttcgtgatctgatttccctaatagggttgaatatatcaagaaattaaaagcactggttctaacaaggagatatagatttttccgtattgacgttatgacatggcgaccgtgacattacaagaccaccgcgtgttttcttagttggtagattacgattggtagaatttcttgatggaatccgtagccgtcgttagttcaacattgcgtatttaaatatcatttgaagaactccttcattactaaggagtgatttagtagaaaatcttaaagtaaaaatttaactttgtgcaaacagaaattgccattaatctagtctagcgacttttcaccgaaacctcaatccttaattaacctttcgacagattctcaacgagattgcccagcacaagatcaagatatacgatttcccggacccatcggatgaggaggaggatgccaaaacgctgcgacagctgcgaagtcgagtgccgtttgccgttgtaggtgctaatgccatcatcgaaattgatggtcgtaaaatccgtggtcgtcggtatccgtggggtgttgtagaaggtttgtgtctcaccgctcaacatcaactaatggtggtgattattaacgatttcaatctgtccacttgcagtcgaaagcctagaccactgtgatttcattgcgctacgcaatatggttatccggacgcacctgcaggacctcaaggatgtcaccaacaacgtccactacgaaaactatcgctgccgaaagctcgccggtttgggtaacgacggaaagaccaagctgagcaataagtaagtttcatttctgcagaaaaaaattaacagtacatttcgtaaaataagcagcggaaaggccactaattgttttgtacatatgccgcgcgctcgtttgctttagtgcacttgctttcaacacatgcacggcactcacaagtattcagtttataggttgattggttcggtggctaccgccgaaccaacctaagcacgctctatttaatatgcctaaatttattcgattaatcatgcatcacattctttccacaccaccacatcatttctaaaacgaatcgtctcattctctcatctaacctctgttaccacgtctcacccattcagcttatgcaatattggaacgattaatgcaaactcatttggtactggatggtaagtttgttttgagtttggctttcagaacggtttccttgagttcagcataaatttgcatgccgctttcatttttcacccataacagtcacgcaatagttaaacttaaccgaagcacgtttcgaatgcaatgcactaaattgtttgtacacctattcaggaacccactggcccagatggaggaggaaaagcgcgagcacgaatccaagatgaagaagatggaagccgaaatggagcaggtgttcgaaatgaaggtcaaggagaagaaacagaaactgaaggattccgaagccgaactcaccagaaggcacgaggagaggaaaaaggtaaggagtgtgaagcttgcattccaaaaagacacaaactaacgctgtaaaattttattcctggtcacaggctttggaacttcagatccgcgaactggaagatcgccggaaagcgttcgaaatcgagaaagccgagtgggaacaacagaacggagtcacgctcgaagagctgcggcgcaagagcctcgaagcgaacagcaaagagtaagtcaaacagaaacatttgccttttcgggcgccttactaggtgttgataattattggccgatctcgtgttcgatttccaaacgtttcgcaatatttggttcgatagcgagagacagtgcctcgtctcacttgtctgttctattttagagtcttttggttttattgttcgcaaggattattatttcgttgaaggtttccttatttattgtttcgattatttttctcggggtggtccaagaattctaaaagttcgtgaagttcaaatgatagtttttcaacttaagtccgtttcaaacccaagataaaacaataccatttctagtcaagcgtaggtatctgatcataggtatctcggtgtttatttgtctttacaacttcgcaactttcttctcttgtgatataacactgctatattagtgcaaataccgcattcaaaagttactcccttgcacataatggtcaatcagtcaaaaaaactctcatttcataactatgtatgtgctttcagtacccaactgacaaacaagttttattccagagggtttatcatgcaattggcatagcccattccattttggtccttcccctgaccgacaaaaatcgaaataaatgaataaatgaaaatttgaagattgtctccaatgttcgtgttcattgaagttgcgtcatgataaacttcttggagaattacttgaatccaactctctggcaaaatccgtaacgggtcttgcagcaaggaatctgtcaaaaatattactatgagtatggcattcccccaatctctggatcttacgagcagaaccatactgccgtgaatcgcaagtcagtcccatctgtaaaaagtaggtattgagtaaatgggatctgatttttccaaactcgttttccatacaaatattcaaaaaattcctaagaattggagcatgttcaaatcttaatgaaactttcacaatttgctttttactacgatatcttcgagaaaaatatgaagatgatcaaaatacggttcatttgcgtgttacacaatcggaatctttagtgggactgacatgcggttacttttcattatgggacaatttgacttgctgttttttttctattttttctgaacaaatcatattatttcattagttcagcttaaatagtattggaagatatggtgaaaactgaattcaactcaattttgacgaaaatgcagatgggactgacttgcgattcacggcagcatacaatatgaatctctccaagaagaaacgacgatggattcgtgtaggaatatctcagagaaatcctccaggcattaggtactctgaatgttttacctatggattttttcaagaactgtctcaagaatcactactgtgattttttctgggaatatttttagacagtcctcatcaattcctctcgagtctagacatttcctcagaaattcattcagaagatattttctctaaaaagtttatatgaatttttcaagtatcatgattaaaaatagcataatggatctatataaacactcatccaaaaaggcatcttagaatttctggatgcataaaaaacagaaaaaaatatttataaattattacagttattattacagggtgtttactacctgggaaaacctgtaaaatctggagatatcagggaattttgttaaaccaaaaaaaaaactggaatctcagaaaatttcgataacaatcaaggaaagttctttgagtcagtaatttatggtagaatatgtccatgtcaaaggatttcacgtccaaatcccccaaaaattccggctgcgccgctatcaaaatactccttgagctgttcagtgaggatcttttcgggtttgaaattttatcgacttcccaaggaataatatagcaatggattcacataccttcacgcacgttttcaaaaattattcgaaatttgaaagctggaaaactgattttggaaaagtaatctggaatacaaacaactttcaatttgaaacgtcgaaacaacaaatttattaattttagaactggtagcaggtctctttttagagacttggtctttattttaatgcaagtttttatttttgatgaaaggtctcttggattttttattttttaaccgaaatgacctctaaggtctcttttccatatcttgcttacaaaattatgtgggctccagaaaaaccttcagagactgttacgagacttttcaacaatttctttaaaaaatttatctcagatttctcgaggaaaagctctaggaattatcctagtgacttctatagagatttcgtctggaatacttccaggaattcctacacagatccttccagaatgttttctagagattcctctaccaattatcttagaaattattccagttatttttcgaagaatatcttttgaaatttctccaggaaattgtggatcacttcatcgttactatctccagtagtttgctcaggaattaccttgaaaactttaaaaaacactatcttaagacttcctctagatatttttcattatccttcaaccgaattttccagttgttattctaggagatcttctaaggattttttttccaagaaagaccgcaaaggttaattgcacagtttttgaaagaaattgttcagaggtttttattttcaaaaaatacccgacaagaatttctacgtcatttcatccacggtaagaccaaagaatttctccaaggactcctcgagcggttattcgaggaaatctattaggaactttaaaaaacaatcctcaatctcgaccctgtgtttcattatggagttcttctagatttttgttttctagaaattcgttaagattttcatcgaagaattacaactacagctcttccaaacatttctcaaaaaaaatcccatgaaacttataaaagtttatttaaggttcagaacaaatcaactaggtttaatcccaacaatttaactagaaactctcctaaaaattccacaatgagttcttttagtaaccgttattcatcaaagatgacttggaaacttacacaagtttcatcagagattactttaaaatttgctttataaacacttcacgattcttttttgaacatctgctcaaatttgaaaaatatttcattcacatttccatggattaatgcctagaaaaaaaatcctggcagaatacttggaaaaatctttagacttccttaagaaatctttaagaattactattcctacattcctgaagaaatctctgagtaattactggaggtatccttagaattttatgtgaaactttaaagcaattatgaaggacaatatttaagaaattcttggaggcatatttggagaaacttctatttgaattttccaagaagtttcaaacggaattcttagaggatgtcctaggaaaatcgatggaagaataacggagaaaatcctagaggactttcttgaacaatatccggaagaatctgtaatttagaaatttttgacgatctttgagttctctgttgttatatttgaaaaaaaaaacgggttgtgcttttgagatatctaaaataaaattctttcacgaattgttcagaaaaaatctcgaagtaaatcttcggagtaataatttttgggcaaatacttgaaataatttcagatggaattccttgagtaaataattgaaaaaaatgtcgtaatgtaaactgtaaacgacctataaatgttaaaaaacaggaaatatcagggaattttgtttgtgcaaacaatacagtatacttgttgtacaaagatccttttgatacatactaagagtttgacgaatttgtctaggaatttcactaattagaattccgtgcaaaacatttacatattaaaaaaaatttttaatcattccctcttaatctagaaaggattattcaaggcttttaatctttgagttgcaacaacctaaaactttggaaatctatataataaagaaaaataaaacattttaaaagtttatgatcatatctcaaagtaaacattataacatttcaaaaatgtaatgagtaatttcttaaggcttttattgaatgttcttgataatgctggaattcaccattaataactctttgaagtcctgcacatattcacatattcttccagaaattccatttattttgctgctagacttctttcaaagtataattcaccaaggatttttgcaatgacttctgagagaaattcttcccttttgacaaaaaccagaacaatacaataatgcttagataataaaataaatcagctcttctcagtaaaacacaaagagtatcgaaatgtaatcgtgtaatataattaactcatggttttacagctgacgtaaaatgatctatcaaaccgaagccccaaacgaaatccactgaagtgagctctcaccattttattcatgaattcaaaaacattgaatgaatcagatccagatatgaagttttactttttctcaaaacaacaaatggacggacaagtagtaagtggtccttcgatttcgttgtatactcctgtggggtggacgacggaatcgagaccaatcgggctcgcgttttgcgaaaagatattcatgttcagtcgaggatgaattgacaattggtgagctcgtttcaagcttatgataacatattatgtaattttcaaacaaactatggatggttcgtcactaatagtgtcgacataaacctttatccccgtttcaaatagttttaatatacatatacagccattccatgaaaaaccgatctagtgggtctccgaattccgtgcaaatttgctattttgttccttatccgaaataaggatacacgtatttttggattttttgattagggtgaccatttccgaaatagggtgacaggaaaaatcgcgatttcgcaaaatttttatttttaaaaaaattataacttttgaaccgtttgaccgattttcaatctttttggacgaaatgaaggctaaagattttgacttttcggaaaaaatataaaatttcacaaaaattgtgttttttacatgaaaaaactcaatagtttccgttttttcgtgttttgaaggcctcgggaccaaagaggctattgctgctctcattttttctgtaaactgtcaaattttcagcgatgtatgttttttagtttttgagatatatttttttgaaaataaaaaatcagtcatttttcatcggcacacactgtagatctcagcgcattagatttgtaatgtttaaaaaaaatcataacttttgaactgctcaactgatttccaatctttttttatggaatgaaagcttaaggtctcaactttttagaaaaaatagaaaactttgaaaaaaaaaaatttcacattaaaatatatgaaagtttctaaaaaaactagaattttttatatttttttcacgtttaaacatattttcatcagatttttcacttttgtctgaatagttgaaattttaagctttcatcccatacaaaaagattggaaatcggttaagctgttcaaaagttataatttttttttgaacattacaaatctaatgcgctgaaacctacagtgtgtgccgataaaaaatgactatttttttattttcaaaaaaatatacctcaaaaactgaaaaacatacacaaattttctgaactttcaagaaaaaatgagaacagcgatagcccctttggtcccgaggccttcaaaacacgaaaaaacgaaaacttttgagttttttcatgtaaaaaacacaatttttgtgaaattttatatttttcctgaaaagtcaaaatctttagccttcatttcgtccaataagattgaaaatcggtcaaacgcttcaaaagttataatttttttaaaaataaaaattttgcaaaatcgcgatttttctagtcaccctatttcggggtcaccctaatcaaaaaatccaaaaatacgtgtatccttatttcggataagaaacaaaatagcaaattttcacggaattcggagacccactagatcggtttttcatggaatggctgtatacctttcttttctcgtcattacaaaaaaaaacttgtttgacattatgaatgttattttattcttctaccaatggggctaccattatattttcatggtaagataaaaattataatctgtttcaagtaagagtcgtattttccttgtttatccatggatcgcatcaccgactaaaggtgcccaaaacttttccatgcttcactaatcaacaccctttccgtggtgattgtggagatgcacaggtattctcggtctgtagaagcaacaatcactacacactaacattcctttctcatcccaactgactgtaaaaacttggccggcgccgatattgatcagtaatatgagagctactaaaatgtgcacttcgagagtaagcggaaagtcccattctttattaatttggatcaaagtgcaattctcaccagttccgatcaatcacgaagtagcaaccattaacctgtccctaagtcagtctatgctttgctctgctatgctaaacaacaaatggacagacaagcttcaattttatgaatagtctgaggatctctttatccaaactttaccaaaatgatggttgaattagaactatgtttgaattttcacgaacagcgtattattggaccccccgcattatttcccttaatcgttttgcgttttcgccctctacctgtccaccaacaccgaatgattttctcatacgcaccatgccacaattgtgaacacttctacactgacacgatacttttacggtgcgcccgcacacagatcaaaaatcgcaccttctctggatagaggaaaacgaagcaatgaaactcataccaattattggttcattttgcattcgtttttgttaacaatcgttcgttgattggttctattgtgaactactgggatattgtatcactattgtttttttttttttttcaacacgcccatctatttttatctgcttttttgccaaatttgtaaatgtgccaaaaagcttcgaaacaatgcgcaatataaggtttttgtgtttccttctgtgtgattctctctttgtttacatttgtcactgtttcttaaatctgttcatccgctttcggatttgatcttttgctctcactaacattctatctgatatttcctatatttactgtcggttctatgcaaaatcattccatgttgatgcatactatctattactgtttcttcagttcttatttaaaaataatataaaagagtattaaaaataaaaccctaaacagaagaaatggattgaactgattaaactgattacttccccctaatttacgcctaacagcattgattttaaaacaaacgtttccgtttcttcttcctttcttttcttactcttgattacacctacaaaccgacattttttgtgattgactaactgcccaaaatacaaacaaacaaaaccgccaatcgctctcgttactgggcgggtacattcgtcatacaaaaaaaaaacgtactcccaactcaatcctcaaacaacaaaacgcacaatgcaaaccaaaacgattaactgacaggaaacgaaatttttgtgtgagtaacttttttttttcaaaatcgtactttatttttgaaactatcatatcgctactgtcacaattacaacagtgcccaccacaaacagatactcaacttcagtgaggttttttttattgcgttgactttggatatgatttgctgcgattgattttactttctcttgtctcaccttatgatggacaatttgtgtaatactttttagggtactattgtttctcttttgctgcttattgccttttccttactttcgtttattttttgtagctgcttatttttatatcaatctttgtaaggaattacttttggtacatttggtttgccttctttgattgcgatggtgtaatgtttgatcctttttgtattgatggagagtttttcttgtctgctgagtatctctatttaacggtgaatggtaataattttaaaggaagttagaaaaattgatgacgatttcgaaatcacagacaaacagagataacactggcgaaacttccgttgattgagctttgaacgatcatttcaaattgaatatgttttatactacacacgtttcacactagtgccttctacaaatcttgttgcacaaaaccgtacatatttcgcgatacatggtcacttagataataaaagcgtgacatggacgatggattacaaatgaaattatagattttacgtctgaggaggctcgacgagcttgaagtttgtatggagaaaatcttgaatatttataatgaacccttcttctttctggcataacgtccccactgggacagagcctgcttctcagcttagtgttcttatgagcacttccacagttattaactgagagctttctatgccaattgaccatttttgcatgcgtatatcgtgtggcaggtacgaagatactctatgccctgggaagtcgagaaaatttccaacccgaaaagatcctcgaccgatgggattcgaacccacgaccctcagcttggtcttgctgaatagctgcgcgtttaccgctacggctatctgggccccattgacccatttttacccgaaaaaaaaataaaaagagccaaaaaagtaaatttgagtattgtacctttaaataccgcctcataaaacacactatgacagatatgcgtaattcgacaacgttttgtagccttcttcagtattagtccttcaaaggttcattacagagtttctggtataattcgtcaacaatttcgtccaggaatttctcaaaaggtccaaataaattttcaagtttatgtttatcatccgttggattgtcgtagaccatttcacctcagcgccatttaggtgttcctcgaaatactgcttccactttccgattaccagccattcgtccgtcatgatccttccagtagaggttatcccattcgaaagatacatttcacataaggactgtaactgtgtgtgtaattttttgcgaaatgggccaccctcatcatcagatctgaaaggtaacatcctggtttcccctttcatattttttgtcacgacggattgatcttctgatgaagcttccgcatctcctcgtatttttcttccaggatttctaccatggtgctctcagtttattattttcaaaacgctctgaattgttcgttaaatggtgtatcgctggactaccccttttccattatgtcacatttgtacaccacggatttaggctaaccagatgttatccgttgggagtacatgttctccttttcgatcatatgtcctcccgtcctctttggactgaaaatgtcctcctttagtgagcaattgatgcaattgatatccataactctttcttaatattgttgatgaatagtaataacatttctggcttgagtaaacttcgataaaggccccagaagtaagacggttcaggttgaacgagttttcatcagttgttcaaatggttttcaagtcgaaaccgtattgctctccttctgacatgattctaaagtaatgaaattcggggttgttgtctattcaggaagctgtaattcgaagttttagcagtcagtattatgtggtgtgggttgcttgcatttgaatgttagtgaaaaatcaatggttttccctatgccaaaagctatgaggccatcaaagaatcttttaataagctgtcgcaaggacctggtcagggtagctttcgatttcgtaatagttatttttgcaatttctcatcgtaataggctgtttttcatcacgccaatccttcgtgaaacggcctagtttcctgcactgagttatgcagtacgaaaatagtctttttgcaattcctttgcaaatcaatcaataattgagaagttgatcaacataacggcctacttttgctactgaaagaaatagtgctgaaaagtgctacttttcagcactcttttcggtgctgaaaagtaacacttttcagtactattttggtatgcagtcaaccgcataacccagccttttcatgacatgcttattctgcacggcgtgtgagtcgagacgagtcgttctcacttcgggtgacgtgatgcgactaatgttagggtaaaatcaccggttttggccatcctaagagaaaatgtcaataaaaattaaatgggaatccgtatttatactacaaatatgttaaatgcaagctttcaatccatattatgtgtgtaaaatatcaaaactgagcttaaatcattttttcgctttgaaaatcggtcaatataggccaacggaaccagtttcggccagagatttaacttcggttcctaaattggtcaatcgcatcggtttctcatgagagtggccaaataaggagtgcccggccaaattaggtgtatgggagttaaaattatcaggaaaatgaattgtttttcttatgttttcaatcaatttggacaagtaaatgaatgtatcatgtgaatgtgatctactgaacacaaaaggattcatgctgattggctatgtaaaacggtgcacagtggcgcatggcttttgtccggcctcaaaaattcataatctcaaaatcaattgttaatattctttatagacttcaataccattgagtgacgacttctcaaaatttgtaattgatctgttttgttttcgatttttggcagcatcgtaagtgtgggaaagtcagcaaaattggactacttcaaattcatcaactatggttcaactagaaaacttcaaacaactgtatctcaacgaaatcataatcgatttaagctcaataggctttattttaaagcgcaaatttaagcctatattttggctaaaattacttaacttttaaggtgaaacagttttgaatcaacttctaagattgcactgaaacttcaaaggcacaaatcacacgaagaaagcatccaacaactgtgaactttttattttggctttgtgcactaacagaaagcttaaaataagaagatcagaaccgttagccaactatttctccagttttgtgcttttgaaaacgtgagtaggggcacaagtcggccattgtgacggccatctttggattccgagatgtttcaccttaacatgttatgttgttatttgtaacaaaacatgtaacaaacagtttttctcccaaatttttataaattttcaaataatcgtacgttttatgtgaagtttttcgtgaatatgagttactcactacgaagcagcatattatccatactttcaaatgtacaatagtttttcttgcccctctttgcccctagaggaaattccattttcattttacattatcatttatctattttataattcaaatctgcttcatgtgtcataacgcgtttaaaactctacttaaattagtgaaaagaagttaaatttatatctgttgttcaggtttatgtacaaatttctgcattacaaccaaatttttagtgaaaatagccttctcattcgattggatgaaaaaacttaattaagataaatttcacttaaaaatcgaattttaaatttgacagttattttcaacgggataatataagccatttaaaataattaatataataccattatcaagcgatttaggacgtatttgaggttttgtccgacctttgcatggaggcccgccactgtgcggtgtataatcctctatggctacaactggcgtatggccaaaaccggtgcttccaccctaatcaaatggaagcgagtcgacacctcaccgactcgtctcaccttacaagccgcacatttgcatttgattcttggatttattctacgactggcgtgaggtaagaattgtcgttgtcgtaaagcgacgtgacaattctcaactcgagttaagtgactttttatttggtttacacggcgagtcacttcgctagagtctatatccgttgtgcgatctggttccgacacaggttggtgattctgatgtgggatcggatcgtccagcattctgtcctgctactgtctttgctgtcttcattcctccaatggaccgatgcacgagttcactaatttaactgtgcaaaatttcagcttgttcggagaaactatatttacgcgccagccgttcaaagtttgtatgggatttactatgggaaaacttacttttgcaaagaaaaatcgccagaggtcgcccattgacctctataaaagttctgaagacggactctgataggtatttttacgatgaagaatattgccgaagaccgcgaaacaatccgacccttgtgaaaaaagttgttcaatgaaaacctattggcaaagcggcgttgattaacacgtaaaggaataacaataataacaaaatcggccaaaatttccgaatagtctatgcttaataacttttttcacaagcatcggattgctttgcggtcttcagcaatgttgttcattgtaaaaatacctatcgaggtctgtgttcagaatttttatagaggtcaatgggcgaactctggcgatttttatttgcaaaagtaagttttcccatagtaaattccatacaaactttgaacggctggcgcgtaaatatagtttctccgaacaagctgaaattttgcacagttgttatggaacctaaatgcaatccaaaaagtggactggagcgagaatctaaatttttcatttaaccgtgtcccaggctaatgcccatgtgggttctcttgaaatgtatgtgtgtgcttttagagtgcatccagttgaaacaatatttttcgaaatagcaaaaaaaagttgtatgaaactcgtcgcaaaactctattttttcagcactctataaatgtacaactcgtgctgaaaaaattatcattttgcaacttgttgcataaataactattacgccactgaaatctcgcgtaacattactaaaggacctatctaacattgagaggctctctttgtttactttctctttcattaataactgagtcacattaatctcttctgttgctttttttgtatgaaacgctagtcaaggaaattgactttcgatctatagtgaaaaacttcccaaaatctttattattccactgttataatcaaaagagaacgagagaggagagaatctttcatttgtacataggtcctttagtaatgttccgcgagaaatcagttgaactgatttgagttgcgtaatgaatcattccttaacaattttcataaattgcaagattatgggtaatgcattctgatatggtttcttataccctcatgtggtcttctacgaatgttgtatgtaactcgttgcagaactcgatttttacattacgaatcatcattctgcattttgttacgtaaactactattatgcaacaagatgcaaaatgattttttttattagtatcattccaaacattacactcatttcttatatctaggtgttctgtgttattggacaacactatcatcctaatttggtaaaacaaatttaagattttattaacatttcgtaaacaatatattccctttcattttttccatatttgcgctccaacaattctgatttgtctgatgcattttgacacagatgtatcatcaaatagttatgttccattattacaggaaataatgcaagtatttcgttatctcgaatggttcaggtacgtttttctgaaaccattaaaatcacttggttcagtctgtttgattgttgatgaactgtaccattgaaactaggctatggctgaaattgcattgttaattgtttatttaaccgtacttcagcttttcttaggcttaggctctttcgaacacgtttcgtttacacgctgtacacaaccaaatgtcgattaactcgattaaaccaaatgtctattcattcgaaaacaaggttttatttattctaatgattttttcatactgcactttgaagtaattttaatgtttacctggacaacttgtgttatgtttaacgattcttttccaattcaaaaaaccagttgcaccatttgcaactgcactgaactaactgcctttacaccgtacagagcaactcagcagacatttttgtattttgcagtacttatgtagataagagagttttgtaaatttgttgtatatggagttgtggttagatgaactcaatacggtcgctttcgactttgcttagtaaaacagattgacttcggtcggtacgagtgacatatcgcaaaatctttcctttagccattaagcaatcgactacatgtaatctagaaatcgaacaaattatcaaaccattactgatgtgtataaacccttcactctcctttcatcctctcacattttcccctaacctgtgaccataacctcctcgaatcccgtgtatgtgttcgtgtccccggtattggacccattttacaggaccgcgtcacttgcatcaagaagttccgatgagtccaagggcaggcgcgtgtttggatcactgctgcgtagacacactagcttcggagcccccgataccgtacgtggcggcaccgggctcttgggatcttcctctgccattactaccactactagcgccaccatcaatactaataacagtaataatagcacggtgccacccagtccgcaagagcataacgagtcctaagcaagttgattcccgagacacctatcttttttcggtcaccaccggtcgtcgttttgtcgggcaggacttggctctgcactagcttcacacaaattgatcattaccataccgatggaagagcagagaatgcaataacttgtgctaacgaccacaattgagaaaggaaaaagcaataacgcttatcctgcgtaggttgcaccaactgtttctactagtttcacttctaccatagccgaggaagataaataatatcataggaaagaaagaagcacatcatcgcttaaaaacacatacacaagcaacacatcagcacactcatccattgtgcgaaatctagcagtacttagcaacactaagcaaaaccaatgggaatcgcatacccagctattaccacttattagggattagtctacgtaaataaccactgctaaattaccatttcccttcgattgctcgcttgtttgtatcctttaaacaattttttaaccattaagtactctgtttcgaatcgtttcatttgtgacaagggacaatttcatgacaatttattataaaactatgtaggaaagtaacgataaatctaaaacattaaaaaatcgaacaaacgctaaaaatatatcattaaaacgaacgatcacatttgtacacacactcgtttcaacttcatggaccatgtgttttgttttctgaaagtgaaaataaatctatacacgaatgtgtcattacattgaaaatatcggttttttatcattcatccattcactactcatctctgtatgtgataaaccctgggatcaacctttcttgaatgtttgccattatgttttctctgtgctatttccgtttcagttgtctgaccctatgtttgttagttcagttgtgtgtttgtaattgttttgggttctgtgtgccgtcctcaccctgcgttgaacagctctcgaatcgtaccacgaaaggttctgattagttcggttttatgttctttcagtatttgtagtataatcgtcccatcgtcattatcttaatgtaaccctatatttaaataatattctatgtgatatttgtctaaaattctcatcttaaaccatatcctttccattcatgtagccgttgataacgtatcataggttgtgtgttttatgtagacatagtatttattgcaaaatttagcttgaatatcaacacatattgtattagtatcctaggcatgttttgtttagtgaatgtatcatggtaatattttcattgtttctcaattgattgaatactcatcaacgtatcaaattctgaataaggatcatggcaaaagcggatggttctttcggatctagatccgactgaggatcattctatctgcaaatctttacaattatcgcatggacagctcctgtcagaattgtggagtacttatcccatttgttatgatttctgccggaattccgaatgttttgtctgaaccagtgcagaaaaaattgtaagattatagatattcattcaggattaccgtaatttcgggtgaaattgatcatttttcacggtttttctagtctgttttctataatgttaacaatgccaaacaactaaatgcaggaaaacaagtacgccataaggtgccataagtcgatgattatgtaccgaaattttctaacaaatgtcattttagtgttaacaaatgcctctaaaataaaaaatcagaggatctcatttcggggtgaaattgatcacttgtcaatgccattattgttagtttccaaaacaattctatatgataaatttgagctccctgaatccgaatatgcttgtaaaattcttaacaatgcaatatttatataaataacgaattgttaaatttcaagtattacgcggaaaacgcctaaatgtatgcaatttcctaaggaattcaatgatatctaacagaaattcaattatttcaaccatatgagctaattggtgcgaattttggtgatgaaatctgatttggggatatatctcaagcattctcacaaactttcaggtttataccatgttcaaatccttgcttagaaatagaagttcataggtgtttgtcaatactgcaccgtgcatgattttgaaattttacgttattttcatagtaataaaca

SEQ ID NO: 124 - DNA, 39919 bp, Aedes aegypti
  misc_feature (35198)..(35460): n is a, c, g, or t
gatcttttcgggtttggaattttctcgaattctcagggcataaagtatctttgaattttgcatacgatatacataagcaaaaatggtcaattggcaaagaaagctttcagttaataactgtggaagtgctcataagaacactaagctgcgaaaaagtctctactactactactagactacatccaatatctctgtaagtaatctatgcaacaatgtactacgcaacgcgagcaaactttgacccggtttgcaaaaaaatatattatggggtattatctcttgaagcagcttttgatttttattatctttatgtcatactatgaattcatacaacgttcaaaatcagcaaagaatgattacgacctaagaagcctcacttacggatcctcacatatcgaacagttcgatatcataaataaccgccctattcgccattacaaatcgaaccatcgaaagtacatgtcgatgtatacgagtatttttatctttgtactattatggtgtatccttatcgcccaaaatcatgcctaatatgcggtttaatatatacgaaagcaactgataaaaacgatttagtcatacgaaggtttcgatcgcagccggagctacttagtgttcgatcatacatttacagtgtcgtgtggcagtgcgatttgagcattcctggtattcggacaaacaattcattcgtttatcgcatcgataggactgttgtgattgatactggttattaattttcgtgaaacggtgttggaacgtgcagaagaattgtgaaattacctaactgattgtgaagccgtttcgcggcccagtgtaatatcaatgaagatgggatcgtcgaaaaggaaatcatcgtttaggatcgatgatatccttcaccaacaagcagaacaacagcagatgattttccagcaccaacaactagttcagaatagtgtgcttaaacagctaacggatatgactaccgctcaaccacatgcttctaccccgtcttcgacttcaccggagtattgccctaatggtcccagatcatcgtcacctccagcttcgcccataccggaccaaccaagtggaccagaatcgccaaaaaagcccacagcgctgtatccgaatctgttagattttcagaaaaccaactttccacttcacctaccgttgggtatgccatccttcaatccagcgttcaatccagcattcaatgcagcatatctggagcagtatgcaaatatgttgcacaaaggtatgtcctttaagctgatttcatcttgttaaaacaattgaggtgattatgtatttaagccactctttcaatttccaagagcacaaatctgaagaaccagatatccgctcaagctgaaaacttgacccattagtcactcgttgttggtgaccaatcgatcacgcttttagctcaagccgttaccaagttctcaagattcgtgatcttgaagaatttgggtatggcaccgattcatcttcaccttaagaaatggaaacgttttaagccagtggtcctcagcctaattgattacgcgggccatctcaatgctttcaaaacacacaagattcgcaaaaaatcgttttgaaggcttccggtgaaatatcttttttctaacactcagataacaaatctctgggtctctgagctcactcctgaagaacagaagaacccattgaagaggtcaaatacatttgaatttgcataactttgggacgtgccttgtacgtggagtcatgttcaatatgatcgttaaagtatataaactaaagaaaaagtgcaccttggaaaaaatagcttagacttaaggtgaaacatcttggaatataaagatggctgtcacaatggccgacttgcgcccctacccaagcagcacagtttgctgcaactcaagaataaaattatctcttgaaactaatcagagttgtcaattgttgaaaatatgacttacaattgcactgaatagcaacgccaaaagcgcaagaggcggaatctatttgcaacatattcaagtaaaatcgaaattgcttatttgttgcaaaatacttaaaagaaaaaaatgaaaacaaaaatatgaacgagattcgaactcccgaccttaagatcaccaatcttctccctcctctactcactactccaccagctcttcgaacacttgtttcgccaatgcactataaaagcgaccacatgacccattaatcaaagcttgttgcttataacttgactgcacccttcggaatacaagttcattaccggcgaaattaggccacgcctgaactaatcttaacttttcacaaagacttacgcgcaacacatgaggaacaccttttaaacaaacaaactatcgctagaccatggtttcgttgttagatgatacttaaggtgcaactaaaccatattgcaactggattgaagcaaacaaacttgtagctgtcatacacgtagttcagtgcaactttcttgcaactatgatgaatctttttgagttgtgggtatgggaacgaaaattgaatgcaagctgcggatgtttttaatgaaagtaatgtgaaacataacattaaaaccagctttttgggagaagtttcaagagtttgtttgaaaagttgctgaaaacatcttgataaatttgacttcattgctaattgcaagggacatttgcagcaaatcttgtcgtttcaaaaatgttgaacatcaaacaaggagtgaaatgcatgttcataggaacggtaattaaacattatgagccttgaaattgatatgcaaccgaactagaaccaggtaagttacataggcttttattgatatgcgattgaaaccatttttgaaaagtatctctttggaagatgtttcgcgtgctagtcgagtactcacgatttcaaagacactaaactggagaactagggtaggtgtaccagttatggacatagtagttccctatttcgccatacgtgattactttaatgtcttcaaattttgaaaatttttgtgtgttgtagtagttaggtttaagatatatcttgatgttaaaacattcaaaaagatttaaaatgtgaaaattattaaaatttcacatatggccaaaaagggaaccactattgccataactggtacactttccctagttgccaaacatttctgatcttcttattttaagctttctgctagtgcacaaagcccaaataaaaagttcactgttgttggatgctttcttcgcgagatttgtgcctttgaagttttagtgcaatcttaggaattgattccaaactgtttcatcttaaataccttcactaatttcaaggcctacaaaacttagactataaacgttagagactgcgaagtcatttttagagtaaggtgagaattggtctgaatgcatccaatttcattgaacactcataattgaacttgaaatattgtttgcaatgtgtgaacacgttcgtgagtaatgcatttgcaaatgtttaaaattatcagaaattcatttatttttcattgatttatcgaagtttgattttacttaccgtcaaactggatgacttgcaacacatggtagtttaaagtcatatttttctataaagcactaatacaaaaaaatgttttaacttggtattacaacacgtttgatccacatttcaagcagtggccactatcaaaggtgataatagaattatttttatatatcactctttttaaatgtattcattacggcgaaaatggggttctgtgaggctcaaagccgaattctcctaaacaggttgcaacatttcattaacgtttgcgaaacagctaaaagctatgatttattatcgtgattattccaaaacatgtttttctttcagcaatacttacataaatggggcatagccggtattttatatatcatctacaactaaccgtagcattctgctgattcatctatgataatagttatctaaggttagaattttttgttttataaaaatttaggtgacttcagggataaattctgtgatttgttgaatagcttagcttgataattgtaggcaattttactattagatctaagtatattcagcatttatttcaattataaagctctatttgaacaatattacaatccatgagcttcaattcgctaaactagtataattaaacatatctctccttcttcgttctcttgtatgacaatgttaatctgttgctatgacctagcacggcagtgctggcagtaatagtcttcaaacatgatggaggttcaaagtcgttgcttgaaaacctacatggtgtttctataattaatgattaataatgcgccacattttattgtacaaaattgtagcaacaacttttgaataaaaatactttttaaaaaatgttcctatgagttttaaaacttaattgattggcaatttagagttttatagaattagaattaattttattttttctactttataatcaaaagagtaatcattcatcaataaactatgaacacttattatgaaagctgttcattcaaactagaagatgtaaaaatatcacaattagtttcttacaaacaggtactccaaatgatctcgtactggctagaaatatgaacaccaaggtgctcccctgattgttattataagaaatctccctcaaatctttactcaccagtcgtttcctatagttaagctgcatgtcaaaataaaaaaagttgcaggcccgtttagaagttcgctcttttgattatataaattctaagatatttgaaacgtcattttgcaggtgtaaccattaaaaacactaattttaaatataataattaggtattataatactgttgaggatgttcaaatgttttcactggcacatttcacttacatgtcgcagaagtctttaaaaatttattgatttttcattgactcaagtgctctaagtcattacggagccaattttatcatgtaaccaaattagtttttatagcttgtgccggatttaggcgtcggggccccgtgtcagatatcttgatgggggccctagatgcaacatgagtcgaaaacactaatcatagtaaagcttagtgttatgaaaaattgctgcaaattttattttttcttactattagagcttcagtagagacttaagcaaattgggtgcaaggtactacagtgctgttcagaataatagcaacgcatgaaaattttcatacaaaatgttctatttcggtatgctctagttttgtttcctttgaagcaaccgagctacaaaactgcatttatgctagcgttgaaaaaaaaattgtccagaacatcgatgcttcgatgaatcgagtcacatttgaactcccgattcgattcaccgattcaatggattcgaatctaatgaaaattgacatttatgcattcgatttcaacatccttcaatcaaatcggtttcagaaatcagacgaacagatttactatttcaagattagttcaaaatatgttttttccacaaactcattaacaaatatttatcaatttcaataaaatgaatcgaataaattaatcgaatgaagagaatcgattgacccgattttaagtgctccaaacatcgattcaaaaaaatcgatcaatctgaaagcaaacatcgattcaaaatcgcccaactctaatttatgttaaatttcgtacctacgaaataacatttttttccaaaccgctttcgaaaagtgaaatagtatttgaaattgtccgaaacattagtcgtttttgattttaaagtgtttgttctacacatattttaaattattttgtttagtgtgttaagctgaacttagttataaacatcttccacaataccactcataaaccaatatgagccggtatcgggctcgccggtatcgagatctcgttaataaagataataatgataataatctgcccacaaatgaaaaagttcaaaagcatacggaattattaaatttgcatgtgtaatttaaaatgtgttgttggaattataattctagtaccctgttaagaaaaaaatgtattaacgaataacgggaatttaccgcataaagcctaattcgctgctgacaagtaatttcttggcttatcttgatgcatggaaaattcctgcaaggaatcgatcaaggaagcgcttttttctgatcgcagtacgcagttgaaaagagatgtcagttcaaacgggagtcgctgtagaaaatttcttttcagcagcaaagcaggcttaatccattcagaactctgtttttaccatatttcatatatctttataaaattatacttcttaactctgaatttcattaccccaattaccataaacctgtagaccatcagcttgagttccaggtcctagaacggcattacttcgaattccattctcatgattactttcgcatttgtttattgtatggcaggcacgatgatattatataccccgggtagtcaaagacattttcattacgaaaagattctggactgaccaggaatcgaaatcagaaaccttcagcatggctttgccgcggacgttaccattaggctgaggaacgccacattacatcaataggacatatctacattattcaccaccctaattttttaccgttctgctacgcatataagcataaatcgcatagtattcattaaatcacttcatttcatcatctcatattttcatttcatttgttatggtatttcttaattcgtcacccccatcagaatctttttcttcttggcataaacgtcctcactgggacagagccggctacataatcagcgtagtgttcttatgagcacttccacagttattaacttagagctttctttgccaaagttgccattttcgcattcgtatatcgtgtggcaggtacgataatactctatgcccagggaagtcaaggaaatttctattacgaaaagatcctgtaccgaacgggaattgaacccagacaccttcagcattagggtggggcttatttccaaaaatcttccgtagtcaggatttacaaagtagaaaacgatcatcggtcccaaaataacatcctgtgcaaaaatgagaatttttggtgaaggtttagaggtggcgcaaagggcgtatgtgcagttttttcattttaatgaactctgaaaaaatttggtatgcttttcagcttgttttggtgattttaggacccttaaggacaaaaaatcacctcaaaattgcgatatcttcactcctttagatgatatttgacaaaatatatattatgcatgcgatttttggcccttgaaaaggttacgctgattgattaatatgaacccgaataagcatatgaatagctggggagaattcctatgctagtagaatgaaacaaagagcaaagaagaatgagagaaagaacaaagaacacataagaatgtaaggtggggtgggttaagcaggggggagggtgtaactgatgatattatattagaatcaactatggagccgtgaaaatatctcggttggatgtatgagatgtgatttatgcaagtttaacactgatttagtattttagaatgtacgtttgatataactccagcaattgcttttataatctgaaagaaattacagaggggcccaaatccatacaggctcaaaatccgtacacttcatacaaatagaaggagttttatatgaagtggaagggtttagattcatttcttaggtgttcggattttgatcccacacgatatatccttattaggtaaatccttaaacgatttttgctttccagcaataacacttcttgttagaatttccacaggaatttctggattttgatttcagctattaattgcgtttgggcttccaatacttcactttcgccacattaccttcaacataacttcggacaaacgaaaatgcagatgaggttcaatacatcgttctacatctgtattgaaacaacagcagaagaaaaaaaaatcggtagtcaaatttcaaattagtgcacgagcttctatagggtgcaagagagcattcaaattgctttaaaactgattaaatatcacgaaaattgctaaaacttttcttacttgtaccaatagttgcggtaatgtgttcctatagtggaggattccataagaaaacaacggataccgcaactttaggaacacaaattaaaaatataccgcaactaaaggaacagggtactaatagtggaggtattatttttcactgacatgccgtggattactgcgatgaaatcatttttctcattaggtcaatggtcgttacttcccatcacaacattaacatgtacattaattgcgcttcttgaatttaggcgattaaatgaagttcaatcgtgcttagtacctccactattggtacatctaccctaacactgacggaatttccatcgaccaatcatttaacgcgatcatttcaaatttgatatgttacaaatctcacaaccagaggcgcgcccatcgtttttcttcgtgtttcacgttttacactacggccacctgcgggtttttgttgcacgaaacagtatttcgttcaacatgcacacatggtgtaaactgggcgatgaagttaaggaaatttattttaagcgttacgtctgtttgtttgtgtcttaagtgcacttaatacaattcaaaacggtaaatccggtatttgatcaggcttgatcttttgaaattatgtcagtatcggtatttctgtaagaatctgtttgatatcagtgggattcctgcaaattctggtccgaaactttggaattcttgtatataaaaactgattttcagttccgtcaggatttcaaaggaaatatttaaaatagtataaagccaatcctactggactcataaaagtttttgccgaaatttctagagattcctcccagagttacaaaacaactttctcaattcaaccactattttaaaaaaaaaaatttatgtttaggaattccagggaaactaccaaaataacgagaaatacttagaatcccatatccatctttggaattcaacatgctgttaaaatcgcagaggaagctcaaaatttttccgctatttcatcaaaatctcagtggaggaatcttgaaaatgcctagcattttataattattatttcataattactgcagtctcaagatcccttcataggatacagatttctagctataattccttaagtcacaggagtctttatgaatgcacatataacggaatttcggatttattgcaaatttacactaaaatcgtgtataatacataacctacatgaatttgtgtgaagtgtcgcgtaatgtcgctacatgctgaattaccagatatatatatatatatatatatatatatatatatatatatataaatatattttttttttaatgatttataaaacacaattttccttagggtggcgaatactggtacactcaccatcctcaaaatcccttcgtatagctcacaaaaccttctcaagggccccgtgagacccaaaggcctcagtttggcgatcactgtttccagctaaagatactcgcatttgtgcaaagtaccacgttgatacgtgtaatgggattaccttatcattccaacaaagtcaaaggctagcttggtacttgctgcgatgactgggtgatattcaaacctctcgctaaccaattgacgcattaatcacacaaaattgtggcacaatcagccgagactttccaggtaggacgttgacaaaatcgggtgtgacacgtcgaaaaccaatactcggtagatccccccaaaaaggttgaacactaccctcgctaatcctgccagcgcaatatcgataccagctaacaacctcattcgaaggcaatgttcctttgaacgtagtaccggtcaaagggagccgccaccgaaaataagctgtaatctttcaacagcgagatttatgaacaccaccgccactgtaacctcatatcaaaaagcgatttgattgcgttgatttacaatcgatcgagcggcaattgtgatgttttttttcacttcccgcccgattgctggcttctgtttgcctttgataagttcaaagtaccaactctctgatggcagcaccgatgatgcatcattttgtacgaatgtgtcgaaaacattttgagtatactctccagagtatctatgtaaaagattgtagcgaacatttgacaaagtcccattactgttcttctctttgtcattacgtaacaactgagatagagcctgcttctcagcttagtgttctaagagcacttccatgattgctttcttcgcatatttgatataaagactgaacgggcaaaaactggtcaacttaacattgatgtgtttctgttaaaatgcattaaaaaaagatgaaatgctgcatttgaaagttgagtgtatatacaatggttgctatgatgctatgagttttcaaaatgacgtccaaatagaagttactacataagaagtcatccttttgttttcagccctctaactgctcgtcaaaatattttatgggacagttcacaaactcttcctagatgaaattttcccagctacaacttagtcgaagaccacattttgattgaatgcctggatgatttgttatgaatgtaactaaatgattatatggagcaaaaacgattttttgaagtaccgtaatttcgggtgatattttatcacttttcaaggtttttctttgttgatttctataatgttggcaatgtcaaacaactgaatgtaggaaaacaagtatggaggtgagtctcattgactcaagtaccaaaattttctaacaaatgtaattttagtgctaaaaaatatgtctaaaataaaaaatcggaagatctcatttcggggtgaaattgatcacttatcaatgccattattgttagttttcaaaacaactttacataataaatttgagctccctgaatccgaatatgcttgccaaatttttaacaatacaatatttatagaaataattaatgtttaaatttcaagaataactcagaaaacgcctaaatttatacaatttcctaaggaatttatcgatatattacagaaattcaattatttcaaccaaatcaacgaactggtacgagttttggttatgaaatctagtttgggaatatatctttagtatcctcacaaactttcaggattataccatgtccaaatccttgtctagatctagaagtttagtgatgtttgtcaacactgcaccgtacaagattttgaaattttaaattattatcaaataaataaacatttttgaacgcaaaaaacttcacaacacacaatttggacatacttacgacaaacaacgttcattcactgcaggttacattgatatttgtgctccattaggaagacataaaatcgagtgacacagtgatcaatttcaccctactgatcaatttcactcgaatttacggtaccctgttgtagcattttttcatgagaaatacatcagcaaatataaccaaccgaaagtgattcggaaaaggtcaccgggacacattgttctagatttaaaagatcatgataaaagctctatattccttatattttactattttttaagtgttttgaaacatgatttagagttgaagactctattttaggcttagtctcaatatatggttctcctcaatcggtgaaactatatttacgcgccagccgttcaaagtttctatgggaaaacttttttttaccaagaaaaatcgacagaggtcgcccacaagtgtcgttcacaagtgtcggattgtttcgcggtcttgggcaatattcttcatcgtaaaaatacctatcgaggtctgtgtttaaggactgttcattttataaagtggacactttggacatgcaatatctttttaatttatcaatgaaatcgaaatcggttttctgtacatcgttcgactaatattttacaatgctgtgataataaaaatgttaccaaaataatatgatttcacactaataaggcacaacgtttagaacggtcgatttttggaggttatcaaaatcaaggattattaaaaatcggcaggaaaattcgacaatttatattttttattttcaaaaaatggttgtacttagaaagcatcatcaataagaagcttgccaaaaaatatcaagttatttttggagaagcaattttgcagatatcataaaatcattttttatcaatttttttaaaagaaaatatcttaaatttaaatggaactgatatgagtagaattttaaggtttaaagtacgtccagacggaagtaataatacagtatttataataaaaataacttacgccttcatagagttgctaatttagtccccacgtcatattttaagcacaatagaaaaacaaataatttattttcagaagaccactcaaagcacaatgacaatcatcaagattgggaacactgcttgaattaaatcaaatttattttgcatgtattattttcagaatgtgttattctgagactacctatcaaaatatttggagaaaaacgcttacagtttgctctagatcgataaacatgggtatataattttaaaagtatgggatttttcaataaaacgaccataaagagtaaatttggtacccaagaatgcggttaaaactcaagattttgcttttttttatacatatatagtttctttagtaatctaaaccagttttgaacacgcttattactttactttttgctggtagtaaaaagatggtgtatcagcaaatttgaccataaggaatagatcactaaagtgactcagcgtcaggaactgatggaatattattgatgtttttaaaagctctaccttaagttgaatagtaaaggataccaacatacaatttgttcattaaatttaggatttttttcatgcgaaaaataatgcttaaacttgacgaacagtttttcttaggagtttttgcaaaaactatttagttcttcaaccgaaagcattttgtaactttctgtattttcataacattgtagaataatagttgaacgatacacagaaaaccgattacgatttcatcaataaataaaatgtccactttataaaatgaacagtccttagatttttttatagaaataaataggcgcctctggcgatttttctttgcaaaagtagtaaatcctatacaaactttgaacggctggcgctaaaatatagtttctccgatcgagctgaaattttgcactgtcggtatgggacctaaatgcaatacaatattgtatattgggtatataattccctctttccactcctccggtagctgctcattcgtatcaaacaaaatgtcacgattcttgtgatggaattgacctgatgtaagatatagtgagatttaccaaaaccatccctatgctctcttttagcattagcattaagcaattcgcacaaattcgtaggtggtacagtcctggatcattgtatgagggttgcctttttcccgtcagttaccaaactcagagatttgggactaacctctgattcttagacaagattgacgcatcctccaacagtcgagagctgtcctggccacgtccttgcgaatgctggggaaatgggaaggaataaatcactgaacacctacttaagaaagatgcagacaactctacgacctctcataggttacgggttgttgtggaatgttgatgggaagggtaatgccatattatacgttcggtagacgtttggccagttaatgattgatatttatacattacctgcagatcggaacaaactcacccaatttataatctgaagctctattgcaattcgctctgctttcttggcaaatttagtaaaaaaaaacacccgcagtcacgaaaaacataaacgcacttgtttacacattcatgtaggggaactgggggtaacatgaataccctaagcaattttcatgttttcatgcttatgaagtagtcagtttcttttgcaattgctcagaattgaagaaggatgctctgtaatgtaacaagttgaaagattatgatggaaatagaattttattaacattattaaaattttgaaaatttctttccactgagtcaatgttctaaaatgaacatgttacggtggtattatcaacataaatttgggggtaagatgaacatatactggggataaaatgaacatgtagtgggggtaaaatgaacatcattcaaattgaacggattgcggcatgattctcggcatcttgtatatgatcaatgcatatctcacaggcatttcggaatcgatggaacgtttagcagcgaccatttgaatggctgtcgatatctgtctttgtatttttgccggaaaactctcggcatctaagattaaatccggtagtattcgccctgccgtggtgttcatattacctccatcttgggtggttcactttacccccaaagaaacaacaaatttaattcatttgttttaagaatttagaagataaaaatactttcaatttccgtctacttatcataaatactctaaatatatgatgtgctacgcagttttatagatttttgatgattttaataataaaaaccttaaattccatccaaatatttttagaacctgtactggttggatgtttattgaattaaacgaacaaaatttttacgaagtgttattataataacaaaaacatttttagacatcaaaaagtggaatttttgattccggggtgaagttgatcaattagtgtgataggtttcctaaaataaagaggtatgccatttcctaaatttggggtcactgattctgaataaagtcttaaaactcttacaacttgtttataaactagtcaattttggatttgaatgttgtgcattacagaatacatcacattaaacgcctaaaagtatgcaattttctttgaaattagcaactcgctaacaaaaaggctatttttcgcagaaaatgagtttttatccgtaatgcaaatacaaaactggattcacagaacatatctggaatctatgaaacagtttatttaaatggtgtcattaaagagccttggcaatagttgaatgtttggagaagaacccttcaacagttcatcaaacatttccaaaaaaatctgttttccgtggtataactatcttgaatggcgaaccgaatttcgaaacatcaataactgctatcaggtaatgcgataccacataaattgtaataattgataacgaattgtagctctcttgacagtttatacacgtgggtacgggagtgatcaactaaattacggtaccgtaaaacggggtaactttgataatgcgggtaactttgatagtgcgcaacacatcacatactaaacgaagtataattatttctgttaatcagttaagcaaaacgaatgcaaaactaaagaatattactatggcacttcatgtaagagctgttttcatttgaatcaagaacatttgaggctttttatacgaatttaaaaaattgacacaattttagcgttttcgaaacgcttacaaacaatctgttctacgatcactatttcatgtagttttgaatagttggccacttatctttgacagcctagttatcatagaacttgaatacggtctcaaatcttttagcgaaaagcattttcacaagctgggaccatttttgtaatctaagtcagaaatttccatgtaacgttaaacgccttgaggtatgtaatgccctacaaatgttagttattcattcaattttgttcgattcatactccattatcaaagttaccccataacagaaaaccaactttcgattatatgaaaaattatatatccattcaaaataaatcttttggcaatctaacgactttaatccatagctaggatgccagtacttgttttaaaaatataaattataattctttgaaacagcatgcataaatattcaagctttcttcgaaaaaactatcaaagttaccccgtttacggtatgaatcgaacaaaattgaatgaataactaacatttgtagggcattgcatacctcaaggcgtttaacgtcacatggaaatttctgacttaagctaagtatgctgtttcgctcaagaaaagtaaagaaattccttgactgaaagggtcaagaaatttcctacagagagcttcctttgaagtgacatttcttctcacctgcgtactgcgatcagaaaaaagtgtttttcttgaccatttcttgggagaaactttccacgcatcgagataggcgattccttttcttgtcagtagcaaaccggtctttagattacaaaaatggtcccagcttgtgaaaatgcttttcgctgaaagatttgagaccgtattcaagttctatgataactaggctgtcaaagataagtggccaactattcaaaactacatgaaatagtgatcgtagaacagattgtttgtaagcgtttcgaaaacgctaaaattgtgtcaatttttaatattcgtataaaaagcctcaaatgttcttgattcaaatgaaaacagctcttacatgaagtgtcatagtaatattctttagttttgtattcgttttgcttaattgattaacagaaataattatacttcgtttagtatgtgatgtgttacgcactatcaaagttacccgcattatcaaagttaccccgttttacggtactcgaatggtcactggctcaaatttaacaaaagaaacgcaatctctgagaggtacacgcttaatcccgccttagaatggtttaactggagaacttaaaaccttttaaggaaaattgaagcagcaacctgaaaaaacgcgcaattgaagtgacctcccttacaattgcactaaacataacgcaactaaaaccaaaaactactcgattttgttataaataaaaattcaactgggggacggacctggtgtagtggttagaacacacgcctctcacgccgaggacctgggatcgaatcccatccccgagatagtcacttaaaatttcagtgacgacttccttcggaagggaagtaaagccgttggtcccgagatgaactagcccagggctaaaaatctcgttaataaagatagaaaaaaaaaaattcaacaatttattcattttcggttaggacatacctgcgcagggtttttcttcgtcgacttgttgaaccttggcgacgattcgaaactgccaggaacttcggcgatggcggcgagaaccttcgtaacgatggcgtcgctgcaggaatagtgtgcagcgtgatgagcccgtgcaaatatggctgaactagagatgcgaagcgggtggcggttggacggatggcctccgattttctcttcagagcttttgcctcgaccgagtgtcgtgcaacccgtggttgatcttcttcccccggattagagccaacgtacctccgtacgctctgaccgtacttgatgaaataaactcttaccctttgcttctgacccggaacgtgatgcgcaattggcgacgcagttcacgatccgtgctctcgttttccttggtccggggttgtagcggtggtgaaccgtctacgacgattaattggcgattgtctgagagttcccttgcgaatcaccacgctccgattgactaccccgaagggtgggccttggtggcctatatggatagtttttgtaataatttagtgtgacattctatgtaactttaagagtagaacagaaccccgaagaaacaaattgcgaaacttttcaaatttaagagatacagccatcacgtgcggcccgtgggccgcactttggtgaccacggccttaaagtaataacgaatccaacacttttaatataaataagctttgaaaattgcaacacgaacttctgaacaccagccgttatagaagcgaaacgatcgagtctacttctttggagcaggctagaaacctgctcacataaagagcctattctttctaaaattgcgcccaaattaaatttgatgtggcgagagttcgtgctttcggtaaacgagcattactaaacgaataaaaacactacaaaggtttgcacatcactacacatatcccatactgggtgacgtcaatttaaaacatttagtctagacacaaaccttatcgacaatatatgtaacgctgagctcaatcaaattcaaattcaaatgattttgcttaaaaagataaaaacgtcaaaagttcacaaacttttttatctttttttaacgaaaaaacgtgaaacgttacaatgtaggcgctaatttacgaagagcttttctatgttttttaaactttaaacttttttaaaatttcagaatctacgggcgcctatgaaagtagataaggtaatttttgtgctcaaaatagtggtctatgatattcaagtttcctcgcttggatagtcatgaatacagattcaatttatagaatacgcaactgattatgatgtagtttgaactcagggtggttttatctgcatccagttgccaccctgataacaacaaaactatgaaaaattgcgatattttgatcttttttataaattttgtttgtatttcggtaaggtgaccagattgagttggtttatgcagcaaatttgtttcaatttcattaatttacaactttgtcaaagacccatttttgaaaatccttaaataaaagagctgaaatttgcagcgccacctgtgttctggttatccgattataagaaaataccacccatattataaaaaaaaaattaaaaaccgacaagtcaagtttagtacacgacactgaagacgacctcacagttgagttcggaatacgcgtctccgtcaaaagatacaaaacctagtgaaattaaatggtggagtactaaattcggttttccatttattaatcattagtgctttgtataactaggttgagttaggagagttgtgtgtggtcttttgattatgttgcttgttcgtgttgtctatattgtatttacaaactctttggatggttcgtcaccagaggtgttgacatatttagtgtgaataacagaatagaagaagtctatgttaaaagatatctttacaatttgaggttacattaatcgtatcacttaccaagatgaatcctgattgtgtagcttcccattaacaaaaactctttcccgtgacaaccataaacatgcagagtatgtaggtcttaaataacgatacactaatattcctttccttctccggtgaccgtaaggacgtgaccggcgctgttattgactttattattttaaattctccaaatcatacacccgagctccgtctgttgtatcattgtgcaattttaattattccggtcaatcacacattagcaactacgagttgtacggtcctcaatgttcatgctcatgtataactaggttcagttaaaattagaatattaaaatgcctcatcttgaaagcaagcagtttaaattcatctaaaaaatctaaactgcaacggcaaatcaattttaatatgttgttaaatatttgaatgttattagccaaattaagttgtatgatgataacacagaacagctggatataggaaataatgtttgaaattatactaataaaaagagggtatttatgatagtattcccaattcctgctcgctaaaactaaacattccaaatgataaaattagcagtaagttggaaatcgcctaaggtataagtgctatctgaaaccactttctgcccacccaagaaagtggcatgcgcttaaatgaacaaaaatacgaaccatttcctgtaccgaataagaatgagatgattcaatccagatggatattgtgtacgctgctaacaaaattagatcacagcgtgccatgtttgagtatcgtatcaaacgctgtcaagtagcgcatcgccgatatttggcctactaatttgtatcaattatttctgaccagccatgaagagtttgtcttttattgagtgcctgaggcaaacagctccgtggcctgcacatagaagctagctatcagcttcacatgcacagccaactgaatatttgctcatcgattcgttattctggccacaaaacggcgaatccctcatatcgcttcaggacaaggggtgtcttgtcggtttggttttgtcgggttttgtctacaaataaagccaaaatcactgccgcagatagagtgcggtgatacgtgctactaatcgttatcatttttgggtgttgaacattgattctggtattagccaaatctagcagtaagcgatctgcttgacggcttaacaatgtgtgctgttttctggcgtatttttatttcatatttatttagtgtgataaaaaaaaacgtggacaacgacgttgtattcgcctctgctatcctatctattatcgattcgagtacgaagagattattggttgactaatcctcataaaatggtttttacgaaataatttaattgaacgtaaatgtggacgatttcgtgaacaacgttaagtccttcaggggaagtcaattaatacactggctatagacgttgcgatgaagtgcaaagtcgagtgtctatcatcatagcaggctttgcttatcgcaacctggttgtcagaagcagtaagccaacaccatcggtaggttgctgtgatgatattcatattttgagatattcttcatcatgagtggacgattcgaagacggcgacgattgattgatgattgcctttccccctgctggagcctaatggacattttcatgtcacctttcgttaagccggtaccctttatatgtgtaccctgtggtagatattgaacgtacgccgtttatcgagctaatcagacagagcacacaacacgacagcgcagttcgacatgcgtgatgggttgcttggatccacaaaagtaattattatacacttcccttttataagaagccaaaactggaaggggtaacaatgtgttatttttcaatttcggcgtacactgatttctaggtgggattaagccataaacgactgataggatcattgcggcgccaacaacgatagtcactgcagtctggtgactcgcgcgttaagctcttttcgtttactttggtagtaatttattttattacaacaccatttactgctgaacccttggtatcataatatggaacctaatcggtctctgtttgctccctggctgtctattggttgttttcccaatgtctcgcacgcaccattgttcaggtgactttgaattgatgttcgacgacattgatataaatctcgaaccgttgaacattttttgacggaatcagggcggcgccatgtcgtgtttgattgataaacatagaatataacgttgtttgaccagatcggatgcacacagcactacaattccgataaatcaatatgcccatgctgaacattgatcagacttaaaacaagcatacatttttcaataagcaatatttgcaaatatgtttgttgaggcaaatgaactaggccgatttagtttaaaacctcactaataaaaatgtaaatatattacgaacatttaataaaaattgagaatattttattgcagaattacaaaactaagtataaggtggggcaagtctgtctacttgaaggtttcaaataaagagcttttggtttatgtgggataagttgagttttggaagcattaggagaaatcttccatttttgcaagtatgaataaaaaatatacatttttttttaatcaactacagatgacacgcaggcttcgtcctatggcggagaggcctgtgtcatccgcaaacaaagatttttaagtcagatgtgaaaatattgtataatattggtttcaaaatggtgccttcgggaacaccagctcttacaggaagtctttcagacctggagttctgataattaacctgaagtgtgtgatttgacagataactttgaattattctaacaatgtatgttcgaaaattcaagttttttaattttacgaacaagcctgcatgccaaacactttcgaatgttttttctatgtctagaagagcaagaccagtagaatagccttcagatttgttggaacgtatcaaatttgtaacacgtaaaagttgatcagtagtcgaatgtccatggtggaatccgaactgttcattggcataaatcgaattttcgtggatgtggaccattattctgttcaaaatgaccttattactgatggagctgtttactgatgaaggaaagctagaagcttctgcaggatttttatctggttttaaaattggtacaaccttagcatttttccatttgtcaggagaatatgccaactgaaaacatttgttaaatatatcaactaaaaatgataagctactttctggaagtttcttgatgaggatgtagaaattccattatcgcccggagctttcatatttttgatttttttaataatagtactcacttcttccaaatcagtctcccaggaattttcgaaacgttctcttgagggatggtacacaaattatgtcacgctaaatttcgactttttcgaccccctcccccccctttgtcacgttttttgtatgagttctctaaaaattttataaggcttgtcacgcttggcttgacgtaatttgtgcatgacctctgattgagaatattttcgaagtcctgagtaacttgattttctattggactggtaagttcttaattaaaattgtgcgcgctttcaaattgcatagcaagtttttgagatttttcacaattagtcagtaataaatttatttcatttttcaatgccggtattgacttctgaggttttttcaaaatattagataatttccagaagggcttagaaatttgtgaaatttaattttaaaaatatttgtttcttaattgtgcaaaacgtttcttgatatctttcagtttcaagagcattgtcaataccaagctttgtttgtaaaggaatattaacatcaagattaaagtcaataggtatatgtttcatatatattacagtcggctcgaaaataattgaaagtggagctgataggattgagaatcgcttcatgggatatttgaaatgtaacagggacatgatcagaatcaaaatcagcatgagtaactaattggctacaaagatgactacagtcgtttaagaccaaatcaatcgtagatggatttctagaagaggaaaaacatgtagggctatcagggtattgaattgagaaatatcctgaagagcactcatcaaataaaattctgcctttggaattactttgtgaattattccatgaccgatgtttggcattatagtcaccaatgacaaaaaaaagacttattgcgagtcaattttcgcaagtcagttcggagcatattaacttgctctccagagcattgaaacggcaaataggcagctatgaaagtatatttaccatgctgtgtttcaacagaaacatttgaaggttcaacaactttagtttcaaatgacgaaaaatgttgatgttttatacgcctatgaatgatgattgcaacttcctcacatgccccatcaagtcgatcattacgatgaacaaaaaattaggatctctttggagtttggattcaggttttaaatatgtttcagtaataactgctatatgctcgttattagtcgtaagaaaattaaacagctcgtcctttttaccattcaaggaacgtgcattccaatttaaaatatttaaattattatttattggaatcattagaaaaacgtaatccaataacaatttgattagtaaattttacaccgacttggactgctccagtcatagtggtggctttgaacattaaccattagattcaattgttagaaaattaaagcagaggtagacatatcacttgaagtgggtacattatctgatgactacccgttagaattttcagtagccgaagaggcgcaatagatgttacctgtggcgacagggtttttttccattccattcccatcctcctgatgggtatgattcttgatcaagcgatcgttaaatgaaaaatgagcattgtttgattctctaccaggcaaatttcggaaacgaccgttatcgtaacggatattatctttcatctgtctggcacgagcctcgtaggcgagttcgtgaagggaaagcccaaaaattggacttatgattgcccttgcaattggcgcatatgaacttatcggtgacaggtcacttccttctaatgtccttggcgtgagaagaacctccatgtgactccatgtgacaatttttgtaccatgaccccacttttggcaccgacggcactgagtggggttctggtaattccctccaggtttctggaaatgttcccatgccacatggacatcgaacataagtctagctttttccaaagctttaatattatttagatcttttttgttaaaatgaactaaataatattcttgagaaagccctttccgaacaatgccagattgggttctcttcttcataatgattacttggactggtgaaaatccaagtaaatcatttattccatttttgatctcttcaggtgacttatagtcacttgagagacctttcaagacgactttgaacaaacgttcagttttgtcgtcataagtaaaaaaaatgtgcttcttctcttcaagatgtttgcgaatttttccggcaaaacgcgacagtctttcttcattgcgatttggaaggaaaacttgattcccctaatggagttcaagatctcatgcctaaatcccccaaattcggaacaactgaccacgataggtggcactctttgcttcctcacttgaatcaaagggcttgggctagaggctgcttcgatttggtgttcggaaaatttgtctagagcatcgaactgattgctcattttgattcaattatcaacattaaccatttcacccttggaagaaagttcgcattccggagaaacgtcctttcttccattcctgccatgtttaaagacagttttaaatcccacttttttggtaaagtgtttagtgaatagacttaagaagacgagacctccttagaggttttttttcccaagacggtgtccaagaaggattaccaccgctagctttcaacaacgggtccaacgaataatcgaaggcacgtcaaacggggtatcttgcaacaggggtgaaacttgcaacagttcgacatgtaaccgaattgtcgtctcgttcaacattgagttaaatttttataacttattacgccgtttattggccttagttatacaacataagattttggcaagggtttgggtattgtttcttttttggttggtttgctggaggagaaaatcatattacataggattgtatgaaattaatgctgaaaatcgttcctcgtaccacacaaacggtagaaatatgcaattcgaggcatttgctatcactgacagtacttaatagtgtacaaattgacaatataaatgtttcgatcattttttgcttaaacactattaaaattcaaaaacgtttttgaaccttgtggggtaacttgcaacagcaattttgatctcaattgtttgatatttcctgccgtgtgtcttcaaaaacacacaaaaaggcgaaattgaacatatatttgtaaagtaacattaacttttttgtacctcaatcaattcaatacgcgtttggtagtcattgttagaaaatttaaataaatcgtattattattatatttagacttattttcatcatgaaaataatgaataatttagaaaatctgcatgaaaattaactttcagatctgccattgggaactctctgcatgaaatatgataaaatttatgtcaaaacatcaacagagacaattttaagacatacatatcaatattttatacagtgctttgatttaaatatgtctaaaaaaagttatgggaagtaaaacctaaaatacctttgtatctgtagaaaagttgcataaaaacgttttaatggctttccaataactgccaagacttatgatatgctagaattttcccgtgtggacaccctattcaatgccaatgcagttttcaatcaaattggttcaatactaataattcaatcaataatacttagttttctaagagaaatgtagcctgtttctaactgttgtcatgcttttactgcagaaaattattaaatgatcataataacacgataaaggataagtttttaatagtgaactttaggtagcactgtgtgttgcatgttaccccgcatcaggggtagcattaaaaatgcttatttttcgcctctcctgatcccagaaaactaaatactgataaaataaatagcgcgtggtattctttacgtggcgattagggtaccagatggtttttgtctcatctgaattctcatatttttcatccatatagctttgaagttgaaaatttttgcaagttaccccgtttgacggtactgaaaagtaccgtttttaattttagcactgaaaagtactgttttattgcttaattttttgttgggtaggttgtggcatgtctctttttactattcgcatcattgaaggaactaaaactgtccaccatgaatcaagtgaatagcttaagctctttgacgcgtcttttcccagtcaggcaaaatagagttaataaaacccacaaccttactggggtttccagtacaaatttcactttgttgtaaaaaaaaccgtttaggaatttggatctgcgcttgtataatgcactactactgcagagcagatgttccgaggtttcgcgatccatattacagaaacgacagatatcattttgaacctgaccaatattctttaaatgatacaaaaaactttcttgttgagctctaagagtcttttcgtgatagttacatttggaactaaaaatctttcagattgattacaccttgtggtgaccatccaattggtcattatcctttgtcgttcccagatttttagttccatatttagtgcacagtacgatatgccacagaattgctccggttcaatgaactgtgtaattgaaccctgtttagcaagctcttctgccttttcatttcctacaatgccattgtgtcccggaacccaatacaaacatacagacttctcttggtacacctttcgcaatgagagaatccattcccagacaagtcttgatgagcatttatatgcgcccaacgccttcaacgcagcttggctatcagaaaaaatatagatacagtacggacccgattttgtcagcccctcgatgaattttaggctgacaaaatcgggtcatatattttgtttctgtttatcaaattttgacgtgttaatatttgcgtatgaaccacgtttacaacctacatagacttttaagggggcgagggacacgggcgtagccaggtttttttttttgtttagcaggggtgagaagagcagcccttacaatttcattctcaaatttcgcgccaaaacaatctttacacacagcctctgtatcctttttgaatgatccataaaactatgcaggaccactattctttttcacagtaagctaagaatggtcctaaacgcgtcttgagtaccgggtccatttaaagtcttggagaattactcattggaaaaattctgaagattcgattcgtagtgatccctttgcaattttgctctgcccagtaagacagccggaatcaatctgaatcctagttctacttgaacgttgaattatctaagaatttttctaacggcaccgaaaaaaaaaacataagaaaattcttttaagtgttttttctagaatttcttttaaaatggcatcagcaattgcctcgaatttcttcttggaattcctttaagtataattcatagaatgtttcaactggagatttgtatttaaattttcttacaatctgttttgaaactcattcagaagtgttttgaagactttaatagaattatgtcagaaattttccatgcatttcatcgagaatttgactcggaattgttgttaaaatattcttacagtatgaaaaccaaaatgtaatatttttaaaacactttctttagttttcattttttgtgttcttattcttataaatgacattcgatgatgtcgtgaatgaatatctgaaattattcctatgcctcagacccgcatctaaccggaacaacctgcaatcgtgcatgacatcgaacatcatcaacactattaaagtaaacgtggtacaacatgacgaagacagttttttgaagtacttaaaataggctgacaaaatcgggtcaaaaatctgacaaaatcaggggtatagaaaatcggaggctgactaaatcgggtcagtactgtatttgcatgtctgtattttctcttaagacaaatatttacgcattctggtatagcaaaaatctccgcttggaatactgttggatagcttcccatcgccacggagacgtttgtcccagggccatagattcttgctccagtttgtatcccaatttttgagccatccgtgaagaattttatggagccttgacgaacgcgtcatatcgcatacattgtaagagatatcagaattgtccacagttttcattcagtcttcatgcatagtcatcactggcccacaatggatatgttgtggaatattcaagagcccaacaagatctcctgatttgaacttatttaatctatttatttaattaattaattaattaatttaatttaatctattaaaactcttctccgcttctaattgtaaaaattcatacaacggtagcagatgaagaataacatctaatgcttttgacggagtgcttcgcatcgctcccgttatagcgatggacacaagacgttgtacttttgatagttttgcttgtgttgtggcctcttttgtttttggccaccacactagcgaagcatagggggagatccccaagtagccactaaattcataattcgaaaaatattgattttatgggcttgtgttacccatttatgataaatattatcatttttatagtgtacaataataaatttgaaaatataaatatgaattttgacattgtgttttgatgatgtattttagtaccaaattgatcgatcttgaaaggtagcacccaataccggacacgatctggaaatgcctcgaattctgtaaatttgaacatcattgaatgtgtacactatagaaatagtttataattaccaattcaatgcaattgcaacatttacaaaaacaatttgagtttttcttagtttgcaagatgcctatcaaaaacctctttcatatatgatgaaaaatagcacattttacgatcttgttatgaatgttcattcttcttaattttattgcatgtttgataccatggtcgacggaacccatgaaaaatgaaagtattttgagacactgatgcaataattacaaagatatcatacaacaaatcaagctgtccgaaactgagggacagcaggtgcttaaccaaaattgtaatttgtccatatttacttcaattatggtacaaaatacattcatactatcaaattaggattatgttcgatcatgcttgcgggatccaaagtattttttcattttcaaaataattactaaataggctcaaaattaagaaaatacgtcaattttttaaagatttccaaacttttctacttttttaaaaagggatgtatatttcaaggatgtgttattctacgcaaacattagtctacataatagctttcttttctactaatacaccatcttgattggaccatgatttctcaatgtttcaactttgtccggtattgggtgctgtccggcactgggggatctccccctatattacttttgggcgaattacggacaagtaaattcacattatcttttttggtttcaaaccccatcttctgcccaaaattttgaagcgtgcccaaaacgaactagtggctttatttgtcacatactcaatataagcattccaattcagttaagaatccaaaataactcataagtatttgacctgttaactaaggcatttgtactccttcaagcttcaaagattttaggatgaatttctttttcttacaaatttctatcattcacaaatttcattcacaaatttcttaacgctagaggaggtgggtgggtgtcgtaagctattacggctcatacaaaatttgcaaaatattcaaacaaaatgcgttacgagggggtgggtgagtatcgaaaatggccattttcagcgttatggaatttgtaaataaaccctaagtgcaagggacaattactacttttgaaggatttatgttaaggccctcctgaatacacaaaaaattggttaagtttagggcaagttgcattcgatctgaaatgatattgtcaaactttcctctcacaataatgagtatatcatctgcaaatcctataacttcgaaacctttttcttcaaagtttcaactactaaagaccacaatagaggcgagaggactcctccttgtggacaaccttttgtagaattaatgtaatcatacaacactttttccatagtctttaacaaaatttatgagagactaatagttctatatgactttggatgcattttatctcgttttcctattttaggaataaagattaccttcactgctctccaatcagatagaacatagtttaatcttaagctcgccttaaacatctcacattcagtaagaggcgaaatcagcactgcttctccgttttgaatcagtgctgggaatattccgtccattcctgtagatttgtaagtagattcgtgagagttctcgtaacctttcaagtttagtgttccaccaaggcacgtccctactagaaaaagattgcttcatgggacaattagtatggaacgaatgaataattttctttcctcttgagaaaacgactctagtttttgaatagaatcaattttttcatcctttgtaaatgagttgaaattcaagcactatgcatattgttcccagttggttttcctgagatttcgaaaagcaatacgcggataatcaccaccgatgtatttatttgtcatagaaagatgctataagatttttattgtatttttttccaaaacttcgtcaatgatttttttttcattttatttcaaaataatataacgaaccaaagtttcaagaacgaccttttagaccgttcaaatacagtgccgtttgtcgctagagtcaattgtttccattcttgtgcaccacacaatgatatgacgctctggatcatggctactatgttttactgcatatatccagtgatgccagcagaccagctcaattattatagtccgagattttcaactcatacaaaaaccattaactaattactgaggcatccaatttgaaaatagtcttcagtaaagttgtaggtgataaatgtatctcacaatataaacgtagctcagatcatcaagagcactcgggtaaacactatgatcgattgaatgaattgctttcgtttcccatagtaattacctgggagggagaaaccaatacaaaatgtctgtacgtcatagtgagccggaattccgctgtcacgaattgtcactgtgaacccagatctcaaacattggactaacatggaagaagcgcgcaactgattaaaacacattttcgcatttcttcaaaagtgacaaaaatcgaatgaaaatcaattcatgcacacaatgcaagtaatgtcacatgagcacctttcaatctgattgaatataaagcattgaaaaacgcatcattttactatttccaataaaaatgaatatttaatgcatagaaaactgtggccctttttccatgtttatcaggaaaaatcgaaagtacacaacaaaagaaaactaacgattttccccaagcctgccttgattgttgttggcaagctggagttatcttgcagttcaaacaaacgttgttctatatttcatgtgtagtatctgtgccacccttccaggtaatttccatacaaactatgaaggcttgtgtagtcttagttttcaaccagatgtgctcaaattttgtaaggacaatcagaatttggtttagaatcgaatgagagattgcttttttaacatcaattcctcttcttcccctcattggtctgcattataacctatcagtaacagtcaatttgcgattattggccacctgatcccttaaaatactacttttcatttccaagattttttctttaattcctcaggaaaacaattcagggttctgctcatacataccttttcaggtattttaccttatatcatgtcttgatttcctgcagggctaatagatttatttttccagcaatttaaacccggaaaaccaaagctcttaatatgtgtttcgctcttttcagcatctccccggatattcccattctacccgccacactacagctatttgataccgccctgtggttccaaacgcaaaggaggtcaagtacggttcacccctcagcaaacccagagcctggagcggcggttttcaaatcacaaatacctctctcccgaggatcgcagacatttggccgtgcagcttaagcttagcgatcgacaggtaagatttcgtcaggttctttacaattaacacccggccttgcgattcaccaaattgttttttgcgttgcccctggtagtctcatgcgtcatagactttgtgtccttcaaatattgaagaattcttgtttgccgttattcaatactgttcatgtaggtcattgtcagtgccgtagcgtgcggttggccaggttggcatccgccaagggcgccagcctttggggggcgccaaaatacgtcacgcatttagtcaattttgaaagagattaattaaatacgggcgccttttaagtcacaattgcaacaggaattcctatcgtaataatggaatctttaaacaattcttgaattgcttccaaatattatttcatattctggataatgcccataggttaatttcaaaattaaacattggagtttgtataataactttacaaatatcttagtgattttcctgtattttaaattactgtaaaactggtttcgcttaaaccagttttaacggctaataaaatttagattgtggtgttcatactgagaagaaataagggaatattcaaataaacttggtgaggtttgtaaagactttttaatacacagcaccaaacaagaattctatacagcgtgaacgaaagttattgtctaacagatatattttacaactacaatcatagtaaattacaaattgaattctcacaaaatctagaaataaaaacacagaatatttcgcagggccagaatgccataattatcatagatgcaaagttgagtttagggcggatttatttttaaaacatctttacagctgggtacaacattcaaaaaatctgaaccaggcaaaaactcacagaacaattgcagctgccaaagaaaaagcgttatgcttgttttcaagcgttatttattaattaataaaacaaattcctaattttccatccgttttttttatttctaaaagatatcttaacgaaacacaaatttcctttcaaatttctctgattttacttaaaaaaaaactttttaggatttatttaacttgatcaaaaggaatttattttttcgaaaactcttggcaaaacaactaaaaccatgttttctgaaggagttgttaagcataatcattatacattttttctagaagctttttcaatatatttttgaaacaaatgaaaatatagttagcacattgtatttaagagatttaaataaattgtccagcgaattcaagaagaatgtctgtaatgcaatgcttatagaaacaactctgcagacgtgtctcaataacaataattttcttatgaatttcttcaaagcatcttttagataatcttcaacagttctcgagaaaatctagtgactactcagttctcaacacgacgcaagacaacagtgaatacttaaatctgaacatgatatttttgtgggattcgaaaatcatttcataaaatagtcgtcaaaaaataattgatcgaattgatccgtatgacacgtttcaatgtgtaaatttatattacatgttgggtagtcagctccgaaacgtttaaatacttattgatagcagatttgtttgatcagcttcaatgctggaaatttatttcacatattatctattctctaatagccaaattttatgtacaacttgcattatggtatcttctaacattccgaagttcactttccaactatgattgctattctcctaattctgcactactcattagtcaattaaataccgctactatattcagtctcagcagtgttgccagtttcaccataaaaatgcaaaaacctccacaacattacatttcatttaaattttgccttcattttaaaaacaaatggaaaatggtggtaaatgcgatgaagctcattttgctacatgcaactcgatgtaacattttttaattgtaaacaattaaagttgatttaaagtgggacagtgtgatgtaataattcataacattagctcgaaatttaatcacatacaaacttgtaaatgaaaacaaaattgacttaggggcgcccaaaggaatgttcgccaagggcgccgtgaggccacgctacggctctggtcattgttgaagctacttgccccattcacgacgtaagcgatatctgatcgtgtgcaacaaactgcaatccttccaaccaatccattcctcaactataaagatagaatacgttgctgtcaactctacttcctccatcgattcgccatagaccagtagggtcttaacacccgttggaaacggcagtacgtcatcgtagccttagtacgtcatcgcacatcacattccataacatcggatccaagattggaccttgagatctttctggcgttacgtcccaactgggacaaagcctgcttctcagattagtgttcttatgagcacttccacagttattaactgagagctttctatgccaattgaccatttttgcatgtgtatatcgtgtggcaggtacgaagatactctatgccctaggaagtcgagaaaatttccaacccgaaaagatcctcgaccggtgggattcgaacccacgaccctcagcttggtcttgatgaatagctgcgcgtttaccgctacggctatctgggccccactgaccttgagatattcccgcgataattcgaacacttttctgcccattatctgtgtcatacagtagaatcctaccatcaaaatagctttctatgggcttacacatctacaaaaaggacgacaagtaggattgcgccaacttgcggcatccgttactgggcagtttgcacactggatgtgaagaatgcgttcaacagcgcaagctggaaagcgatagcccacgcatttcaccgcctcaaggtaccgtcagatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgtgtagtacaagcctttgcgcgaacggttaagcttctcataaaccttccgtgtgtctttagcgcggaacaactcttccatcgcctcgcgatctcgttcttcttgctggcgctactttcttcagaagatcgagttttgtatgttccttgcctgtttataccgtgccgtacggtgttgcacccattctgcgttcttcaactgctcgtattcgccgtcgtaccactcgtttgtctgattcaaggccgctgaacctattactgctgtcttccattggtaggaccagttccaacagctgcgcgtaatcttggccatgtttagagtgcatgcatacagcaactaattgtaatgatccgaatccatattcgcactgcggtatgtgcgaacattggtgacgtcggagcagaatttttcagtttgaatatcgggtgatcttcaggtgaccctatggatatctttgcgggacaagaaggtgctccagactaccataccacgagaggctgcaaagttgacgtatcgttgaccgttgtcattcgatacggcgtgtaggctgttctgtccgatcaccggtatgtacatctcctctcgtcctacctgtgcgttcatttcacgatttttacgtcacgcggcgaacatccgtcatatatctgctccagctgcgcttaaaacgtctcctcatcttcgtgtaggcagtgtacgttgataatgctgtagttgaagaaacggcttggtaagaaccaattcggtgacggactgttgcagtttgacgaagttgtctccagccttgaagttcttttttaccgttttgattcatattacggacacttaaggcttcagtgaagtacaactaatcactacacatatacattgaatcggtctgtacaaaactttagcgtaatcaggccttgcaaacacttaaatttcaaatgttgggtaaagattcagcttccacagctttaattcactttaatcaatgaaaatgttcggcctctttatgatttttattccggacacaaccacactttcgcttcatattccggacactttgattcgaattccggacagctcttaaaaaacacaatcagaaaagtcaaatcattaatgaaacgcactaagccgttagaaagacgtcaaaaatagggtttcaatgctagtaatggaccccttagtagctgaaattcattctagacgcttttccgcaatgatatctcagacgcatatacgttttgtggagtcgaacaacaaattcaatgtctttacttcatagtacatctataaaacatacaaaatcattcgatttttccagcgaactatgcatttgaaaaactgttgtccgaatgcctattatggaccctcccggggtccataataggattgtttacaaatttgacgttgcgtattatggaccctccatttgattcccatgtaatccggctcgctgccgacgagcctattatggacccacctggaaatgcgtattatggaccctcttgtgtgatttcatttacaaaactgttcaaatatctgtatttatgcgtctcaaaccaaatattttgcctgaaactgctgactaacaatgtaatcgaagttcccccggtgaattttcataggaataaagttgctttgagtgttaattttatgtttttctgtagggggtccataatacgcaaaggatccataaccggcatcgactccctagttgaacattgtaaattttcatggattgctatgtaaaatgtctataaaaatcatctttcaaattgggacctttttaacggcgcattttgaaacatttcgagtgaaatctttcccatacaaagtagagtgtccggaatttgaagctgtccgggattcgaatcaaaacggtattctgtttgaaaaaaataaactcttgaacacgcacattccgttcaccgatcaaggacatttggcaactgtggaattgtaatacattttgtagcaaactgtctgcctttgcttacaagaaggtcctggagttctcggtggtttattcaatgttcgcgatggccttgcagaaaaagactggaacaaaatggtagcggaaagccaatgcaccagcttcaaaacaagctgcttcgaaagttgtggagcgcatgcatatctggcaagtttaagtgaatgcatttgcaacactacaagaaccgcgtcaataatttctcgccatacctcacgaatcgcagctgctatcctcctctctcgactacgacccatgctcgccaaatcttgtgcccgctgtgatcctcgctttattatacctgtcggatcagaagcaaataccatcatcgcagaattgttgtccaacattcttataacatgctccacccagcgtatccttcctgcttttactaccttcaggttagtcgaagagttccgccgtggtttatttttaaccgccgttatcttgcacaccgccaaagatcattccggcttttccacccgatgtttgtaaacttcaagtgcatgcaggtcctccttgagcatggtccacggttcattaccacaggttctggagctcatagtaggcacggcttccacagatgatgaatttacccaccacctcgaaagtatctccgtcaatcgtcccagagcgagcccagccatgttcgactccgcctactagcatgcattttgatgtcgacgcattcacatactcgtgtttcaggcgggtgtatgtatcttccaccgtttcaaatgttcttccgtcgtcagcgaagcaaactgactggaccgtgtgaaaatcgtaggtacatcggctattagacctggttatccgcatgtaaccctctagcacaatgatgaataacaggcacgaatgttcattagcttgtcttggcaccctgcgcgttttgaacaaactagggtgctcgcctgagatctttatgcagttctgcttagattgtcgctctaaacagtcttgtgagcttcccggaaagctattctcgttcatgatcctccatagctctacgcggtcggtactttgtatgtcgctttaatatcaatgaacagggtgaagacctgatactcccagcattttttgaggttttaccatactgtaatgatctggcatgtcaacgagcggaagccgttttaataactcaggaagccgttttaataactccccacgagcttcgttcgctttttggtgaaaggcagcagaggatgatcttcgatctcctctgggcccaccttaatgtgttccgcttcgatatatctttaccaactgtctagttggacggcatttttaactccccttaaaagctggttgatgctcgtcgtagttcgtcgcgtccgtgaggtacgacaactcatttttttcacattcgtcttctccagtcggtccttgttctcttggacgtgtgatcctttaacttgtgtctaatcttttcctttcagttctgttctaatctctgtattttaagattcgtttcaaggttgaatgcaatatcctttattataatagtattgcttttaaaaagtttaagcgcatatttcctagattatgaattgcactaatattatcattatttcaacaggtcaagacatggttccagaaccgccgtgccaaatggagacgcgccaacaatggaggccaaacctcagattcacccgttgacctgggaccggacggtgcacacaaagcgtcacattccgccaccattacgtcatccaccagttcacccgcagatccgatgaaaacatactcgaatgaatatcgtgcaaccttgaatgaaccgtacgattgcaagagttccgaaaactattcagaacacgaaacctccagcgaaggggaggacagcagctacgaggacggaggtgcctcgcccatcaatgttatttagtttaaactttatctatgctgaaaatcaaataaattattcaacttctcacgcggacagacacggtgtcgtctgatttcatgccgagactccatcaggtctaacaaatttgcgaagcgacctttgaaaccaaatacacggttgctgcgattgataagcctaacgttaccgcaaatactcagtaggcactgcaccttgcctttcagtgaaacatcatcaagcaattaatcacggtcgattgctcattccttttcctaaccttttttacatcgtatattcattatttcgacggtgtgataacgcaaaattcacccatatccaatagtcgttcgttacgaattgatttgataggtttttcgaaaccagtcgatatcggcccagctacatgacatcctacccattcttaattgatcatccaatattgatatagccagtgagtgcgctgttttgtgatttccaggtgaccgcatgcattgccacccgacttatttggggtgtatcggccattcgattgcgtcaaatcaggcagctccatcatcatcatctagattagttatgaacgatttgagaaggaagttgttttcagcctgcagcgagcacacc

SEQ ID NO: 125 - DNA, 45571 bp, Aedes aegypti
aaattgcttgaaactgcaggaattattacttgtatgattaaaaagaattacaactgttaaactgctgtttaggtcgctttacactgtctttctacgcagaactgcctcgccgtgtcattgagcataagggagcaaaaacttcaaaatttgcattagtctcatatatcttccttacggtaagattgttataccgtcaattccccataactcgatattaacaaatctagagagccagacaaccgtttgtgctgaaaatttaactccctgtctctcgctggtggtgatcagtgagttaaatttccagcacaaacagttgtttgattctctagatgtgtgctcttgaaaatttgaggtttggcctcgatgcatcttcaccttaaagggaccatcgagttatagaaaacaaaaccagtgcaaatgcgatccaagggaccatcaaggtagccttgaaaaccaactttcacgatggtgatcttactcgatatcgacatatgagatatcgagtaaggaagagttgactgtagaagtattgttttcgaacttcaaagtttcgcataaaacgataatcgtcgcgaaagcaggcgttattctatattcaacatgaagtactcagaagtaggcgcaccaaaccctcgtgaatataatttatgatcttcgaactacatagcaatctatcatcactgaccacccctaagaatgatcgcccgagaagagacttcccttcgtttgccgactcatccccaggcaacttcgattgacttcttcaactgcaatagctaggcagcaacaaggaaaactgtgctcctctatcttttgcattaatctcgcacacaactacatgcccaaagtcgaatcgtcgaaacccaacaacacacggctgccggaataattggccgcatgtgtgttattaggcatttactggggcttaattcatgaaaatatacgatacctgatgctcgtcgtccctccttgcgcaccttccttccgccttccttcttggcgcccgctgatgttgcgatggaacggagtaggctttgagcgcgcgcgcaagcggtactaacttagcaaccgtcgtcgtcgtcgccgtcgtctccgaggatcgtccgatgatgagaggagacaacgcgacgcgacgggacgaggttattgtcgttcgtttgttgctttgttccagagccgttgcgacgacgacgacgacgaaggtggactaaaattgtagccttcttcgattcgattgttgctcagctcacaaaccacacacaccgcaaaagaggaagcgcacggcggcgcgccgctctcggtgtgatgtgtgctttatcgagacgatacgacgcagagttgaaaaaatcaaaaccgaaaaaaaggtgggcttccttccgtcataaatgatggtcgtcgtcgtcgtcttctcggcttgtgtcgattgtcactgcatgtggtgggcttgtggcgtagaaaaacagtaatcatacataggtgaatgcaaagtgctctagaaaagatcaggtattagagactcgaaggcgtgacagcttcgaatagtacagggcgcagcgccggatttacgaatgtgggtgcccctttccccagaaaactttttttcatatttcatacgagatcatttccataataattgaaaatggaccaaagtgcatatgtccaaattgattgtagaataactctcttaaattgatttgcaatattttttccagtatgggaatacgttcatgggtaatttctttgtatatttcttaaacaactttttgaaatttgatatttataaatgtatgaaaattgacccattctcaccacatccgagggagtgacattgggtcaaagagaaccatggtgctcccctgaccgttattatcagaagaaaattcatcaaatctgtgctcgccagtcgttttcaatagctaagctgcatgtttgggcaaaattttaaaaacatcgtagggcccgttttaaagttacgcccttttgatcgtttaagttcacaaattcaaaggaaatctgaaacatttgaacggggtttcacttaccgtgattatcagagtaaacataatgttataatttgaatcaaagttggttaatatagtcatttgtaacttatgggcgaagttttggatgagaaaatccacaaattttggagttacgcccttttggaggtgtaatcattaagaacactagagtgaaatagaataatcaggcattctaatatcgttaatcatgttcaaatgttttcaatgacacattgtgcttgtatgccacaaaaatatttcacaattagctgattttgcttaggctcaagtgctataaggaattacggagccaatttcaccatggaaccaaattagtttttgtagcacaatattctggctaacttggtgaacccatgtacgatgcagattagttttcatgcaaatcattggtacatgttatgtaacgaaacgtatgtatacgtatacgtcaaggaatactttcagacttttaggttatgggtagcagtagtagaacaaaattaacaacgtaaaaagcatcgatacaaaatgaaagaaagaaagtttagaacatacgttatcattttgtttaatggaattcaaaatcgtagcacttacagagcttaattttaattgttttgtcttcgtcagcttgggaaagtttggatcgctctccaagtatgatttttttcgtttgtgtagggtgctttacatagaaatcttcagtttatgtaggattcgaaccatgttatgtttggtagaccagcaggtaaccaacagggccacagaacaatttacgattttccgataaccaaaactaggatttacgcagaattcatgaagaactctgttttttaccatatattacaaatctttttaaaaatataccccttaactctgaattccattaccctaaataccataaacctgaagaccatcacatcgagttccagttcgttgttatcacggggcatttcaaggtatttgtatatttgggtccatatcagtcagcgttatagtgcgttcagagtgataacacttgggttaatgacattcggggaaattaagtccgaggtttagttatagaatcatctcaagagaattttgattgttaaggcagacaagtaaaataaggcttttactattgcattgtttgtgtaattgaaaagaccggggaacctttaggtgaaattgtagatttgtgaaaaatctaaatgaatttgtgaaaaatactacaaattataacaaaagtattgacagtggtcttgagtgacataggttggtcaatacttacttagcaattgaagtttatgttctggggtagtacaaagttagccgacaaagccgagagggtagctagttgggccatagaagttcatgaataatagtacatacacagacaaacagacgtaacactcttttttattcataacacagcagatagcgcccaattctaatattttgtagttagccgacatgccaatcgtggcgctcgcatcacttttgttcgagtttgtcgtttgctcactaccgccacctagttcgcggttggctaaatgaagtatttttagcattgagcgtaaatgttcacgtgacaatgtttgaaattgataattgttcgagttattacgtctgtttgtcagtggtacataatatgctccgtaatgtcttatagcacttgagtcttacgaaaaatcagttgatggtaaaacacttttgctgcatgtaagtgcaatgtgccattgaaaacatttgaacatgcttgacggtattagaatgtctaattattctatttaaaattgatgattttaattattaccgctccaaaagggcagaactccaaattttgttgatttcctcattcaaaactccgcccataagctacaaataactatataaaccaacttaaaaccaaattttaatggtatatttcttctggtaatcacggctaatgaaaacccgttcaaatatttcagatttcctttgaatttgtggacttaaacaaacaaaaaggcgtaacttcaaaacgggccctacgatttttttttaaattttgcccaaacacccgagcaaagcttgagatcatattgaaaactaattttgatgttgtgatgtcgtggattttgataactcagtttgttgtcattttggtcgttttaacggttaaaatatcaaaaatgagagcagaaaaatgttcccatgatatcaaattgaaaactctctttggtgtcagtggaagcaaattgaaaacagtttctattatcattgagagcaaattgagaactcattgagatatacacatttttgattgatatggaaatgtcccaagtaacaatttaaagctgctcaagcgcttttataactaagtcaaatcagcctttatttgaacaaaagctgttcatagccttcccaaacttttattcagcttttaaacatctagttctggcgattttattcagtcttaagctgaattgaagctatatggaaggttgaataaaggtctagcttgctcttattcaagtttttttcaataacgatagttctattcttagaacagatggcaaccttcaaaagcttaataatcgcttattcatccattattcaacaataaaccaaaaaaagttaaaatatatacaggtgcatatatttgggttttgtcaatgccgctaatcctttgaaacacatagtagagatattagctggaatttaaagattattaataatgatcaattgagaattgaacacagattcactgttttatagccacttaccttgacaactactccacatgagactgtgtgaacatcattcagaacacgagaataacttgccgacatgtctgaataagggcgatgttaaaagttgcatagaggcaggagaagcaatatcagtgcttcgcaacttttcaattagctgtcaaaagtgtgttgcgatttttgttttaaaatagaatcctcgataaactttaatctgtttaattgttgtcaactaattttatggtggttatagtgaaaaatcagttatttctaacgcttcgttcagttaatgaaaatatctccgtgatcgagtgtagtatttcatcttgttgtaacccaaactcatcgatgcaaaattcaggtgtttttttttatcgagaaaagaaatgcctgtgtgcgtttgaagtatgtccgcttcgcgatgggtggatttgttgttcaaaaagtttaatgaaacggttttcaaataagcaggacgtacatacatgaacgaccaaaactttggttggtgtatttttgttcccgtacgatatgacaatttttcgacagtagattttaatttgaatcaagctttaaataacctttaatcagtgtaattattgcttactgaacaaaagtaaaaactgtagatgaaaaaagtttgttcaacttgatattcagctttgagtgtattgctgaataagattgtttaataagcttttcttcaaattattgttcagctgtcatgatgttcagccttgtacactattgttcagccaatgttcagaaataactcttgctgttcagctttcattgttacttggggtggctgtgactagataaatgctttatttttatattctcatagtatttaaacatgtagcacgaataaacttataattaaataaaaaaaaaatataaacaaaaatttaaaatgatagccaaaacgaaaacaaaatatgatatcgaatatttcattgataaattgatatcaaattatgatatcaacttgatgctgaaaacaatatatattttcaacttgctttcattttgatgttggactttgctcgggcatgcagcttagctatagaaaacgactggtgagcacagatttgatggagatttttttctgataataacggtcaggggagcaccgtgataacataatcggaaacattgatattttttctttgttctttctatttggtcaaattaaaaatatcaatatgattcgctaatggccggattacattaacaaaattcgatcatgcttggatttgagtcagaaatgtttgcactaattcttaaactgattccacagacaaacagacgtaacacttagaacaaatctcgattaaaatcatagtcacgaggacatgtacgcccaatgctaaaattagtgtgtttggccgacaggccaacagatggcggtagtgtataaacgtcaaacgcgaacaaaaacgatgcgagcgctgcaggtggcggattggccacctaccatatttttgaagcgaccgttaaaaaggtggtcgatgcaaaatgatgagagtgtgacgtctgtttgtctgtgctgattcctccagttgctactttacgaaattttccaaagattcctacgacaattggtcgaatgacatttgatcgtaagaacatttggtcttctttcgtcttcgttttaaccttcgagctgtcgcgctgttgtactttgtacaacagttgtgatttatatgctatcattttgcaacgaagaattctatcgacatcaaactaaaatgtattcctcaagaatcttcttaagaacccttctcaacaggttttattaacagtgtggccctttataatacggtaaaatcaacaaatgtacatggaagtcgcataataatgaacgcactatatacggttcaagtaaaccacagtttgaaatagatatatctcaaaatccagataatatagaaacttggggtctttagtgaagttgttctggtaaaaggtaaagggctattggatggaacctcatttaattcggaatttgatcgctaggtggcactagtgggcatggaaattttacttttgttttgcagatatatcaggatcctgaccatttagaaggatggcgtcttcggcaaagttgttcgataactcaagaactatcattgttcgagctaattgattcaaaatttttccaccaggtggtgctagtgagcattaaacttttgcagatatctcaagagcctgaccacttagaaagatagtgtcttcggcaaagtagttcagtagatcaaggtctatcattgtttgagccaagaaataggatattttgccaccaggcgccgcttttgcggatactgctggatcttgatcttaagaagttcaaggactatcatgattttacaaaatatcgaactttaagaattaaacaaagaaagaattagagctactgaacaactctgccgtggacaccatctttctaagtggtcaggatcctgagatctgtgaaacacaagtttcatgctcactagctccgcctagaggcaaaatcccgaatttcttggctaaaatgatagcccttgagctactgaacaattttgcccaagacatcatctttctaagtggtcagactcctgggatattcgcaaaaccaagggtattgtacaaattacaacgcgtgactactcgcgttacaaaaattcgcgcgactaccgaaaggataagcatcataaagaatgtactcgaaaaaaaaatgagacacagaaaaatgatcgccaaaaattcattttaaataggatacagcagtttctcgattttatcactgctcgttttaatttattactcgattttagcacgattttctgttcgatttcatcacgcatcaataatcccaaagaatccacttatatcaatttgacccacctcttgcttgcttttcatgtcattcgctttattttttcaacaaaaagctgaatattatatggtagaaaaatacattttcattatatcacgtttcggtatatcacgccaaaaaattttggattcgtgatttaatcgagatattactgtacttctcaaattttcagggattaaataactatatattagctatgtttcggcgtaatttatttattgaattacctcccccaagctgaatgctcgtacatttttcttaatactgctcatgacatcttggacgaggctttggccatctttcttacacaatttatcccagtttttcttcaaagcatcatcggttttgaatgttttgcgcttctcttcaacttcttcttcattatcgcccaaaacttttcgattggacgaagttctggtgtatttggcgggttcgcctctatcgggaccacattaacgcccttcgcttcgtaccaatccatcacaggattggcgtaatggcacgaagcgagatccggccagaatagcgtgggaccacggtgagagcggaggaagggcagcgaagcgcttctgcaagcatatctctcgataaatctgcccgtttatggtgccggttgtaacgaatggcttgctgtaccgtccgcacttgcagatcgcctgccacaacttcttcgcgaatttgtcaatttttctcttccagaacctccaagcgggacgcaccgacaaaaaaaactcgaggccatggatttgtttggtgtccgcttcgatgtacacctcgtcgtttatgacaagactggttgtactggttgttgaacttggttcgaacttctccaaaaaaagaacctcgaagccatgtctcgggtggacaggttggggtaattcttgaagtactgccttatcttccgcgccttctctgggtattccgttttcgggtttcggccgctttcagtgcgtggtcttcgtctccacaatcatattcacaacgcgggacacggtggaatggaggattccaagccttttgctgatccatctgtgcgactgatcaggattatcgatcactgcacccaagattttttggcgtaactcttcttgtttcgaatgcatcttgaaaacaacttgacagatcgcaaaaaaaaaaattgctcatgtaaacataacactctaaaccagtattactcaaagtttcattatgttttatccacgcacgataaaaagttacacccaaagcaaagtgtctcatttttccgagtctaatctttacttcatttggtttgtcattcgaagctaaacaaatgtcgaaaatttggatggttattcgaatacactttgtacatgtttttttttcacattgtctgaaatatttttgcttgtctcaaagatcaaattatgtgtctctagtagatttgggattgctgtatctgatgccgttctcagaaatgtttcagcacgtcacaattttaggctacaggtcgccaaagttgtttgaaacactgttttcattgatgtacacataaaatttaaagtatgatttatcaaacttttttgtgatctaatctaccaagcatgcaatatataacattaactttcatctaagataaaatttggttgtaatttcacgattaaatttataattaatcgatttttccggcatgcttgcagtctccatacaaaattcttcgtttctctcatatggcgaaatacaaaaataatttttgagcatcgaaagtattaagaactttgttgataataattgttatgtacatgaagtttaaattctgtggcgaattaaccgaataaattgccatacaagctggtaaacttgcatgcaagttggatgaaatagtcaaattttgcaaattcatcagtcattgggtcgtatgaataaaatgtagtaaagttgagtttactacattctcggtagtaaacgctatatgtggaacacgagtggaacatgtttgtgtcattttcctttctacacctttcgaacatactacaaataacgcattgctatgaataaaggtagcatttactacaaagctactggtagttagcttcagaggttgctacacatgctttaagattgcggaattgaatggaataatttacttttgagtaaaaatcatgggaaaacgatatgagttttgatatttcggaaggtattttgagttttgcttaggaattctgaggttacgaaaacattcgccccgccaatgctgagattccggtaagattaccggcagtagcaatttgtaatatccgtgtgaattctggcattacgataattatgttattttctaggaattttaggttgtcggtaggaattcagatatttataatgtaatttggaatttaacttgtaaactctgacatctcagatttccttttgaaatccggaattcctgtaggaactttgagtttccgattttttatgataattctggaagtttaaataccattctaggaatattgcggaaatattaggaatctggtaaaaactctagaattggggtgggaatgggattccgaatattaatcttttggaattctgtgggtatctttgagacggtatttctgtaagaatctatgagattgcggtgggattcctgcgaattattgtgtgaatatttgtaattctgaaaatcatcttcgtaattattgtaaaaacctttgagattccgttgatctccagttccgttggaatttcaaagcaaagctttaatataaacgatttgaatgtcggtaaatattttatagatttcaatgggattttttgtgaaatcgacaagaattttgataatttcaaagggaaccctggtgttttaggggagatcctcattgaactctaacgactaccaatggaatcactaaaattcccataaaaatctcgacattctaagttctagacattccaaggatactatcagaaaccccaccaaaataacgagaatatcgcagaaatacttagaacttccggaattcaacatgctgttaagaaaacacacgaggagcatcaaaattctaccgcaatttcaccagaatctcagtactggtgctagaaaatattttgttccaaatttgatagctgtaatctcaagatctcttcatagatgttaagctagtatttaaaaaatcatcaatcactggcgttggcgaaggccgaaaaccacccagaaaattctttgatgtaccatcatcataaaatcatagacataaagagaataccagactaatcgcaaaattacactacaaattttgtcaaataacagcaccttcatgatttgtgcaaattgtcgcgtaatcgattagattccatgcattttcttcatatgcatgattgtattaatttttggcgtcactctgaatagattgttctttacgtgcagaatcattctgcactctgaatggaaatttcttaacgtgcagcttcagtcactgctcatgttcgaaagtagtgagtactacatgttcgaaaagttttttattcataccaaaagtgaagtaaactttgtggattttgtttttgagtagatgctacatgtagtaaagtttaaagttttttattcatatcacccattatcttagaaactagacgttctatgatatttttgaaaacgacaatggattcagcaacccttaatatagtaaatagcggtattttggtgcttgagaaaataacgtgttccgcagtgtaatttattattttcttaaaataacaccactgcttctgctcaaccagatatcttgtttctcatcgacgtgaacataatgattttctgaattcattattctttcaaaacgttaatgttctttgtaatgacctgctgatttgtatctgatggaagcattcgaaaagggtgctctggaagctaacggatgtgagtaagattttggaatgcgcaaatcagacttaatacggcagaaaaaaggcttttaggaaaaccttcatggcgaagtaaattttaagtgtcgacaacagaatacattctgcgtattgtgacttccagcttagcaacattccgtgagcaaatatatggtttcgctgactgtgtgaatgatttcggatgaataacagagtttgcagtggaagctttgaatggttatgatgagagcacggagaaaaagattgatcgaaaataataaaaccgaaaaatgtgcttattctgcacaatgtgttcaacatctcttcctcaatgccaacaaagcaattctcgatgaagatctggtaataacacgactaactaactggatttcttttacgaagcgacactattccctttgcttttattcatttatttgcattaagtgttggtcaaatatttcaaaaatattggaaccgtctttgaagactcattatatttgtttgccttttctttctgtagtttttgaatgttctattgcattggcaatgcttgtttaatttaaggactttatggactctcgcaatttttgacagatttttttgtaaaatgtgtgtgaatttatagtgccatatttgactgtggcttgattaaaagaatcactcaactagggttgtcatgtctattacggcttaaccagccgacggtgttttgaaaatacctgaaggtcgtagacacaaaagtcaatttggacaaattgagatgtaaaactgtgaaaaataatagaatcgttctggtgggcttcgatcccacgactgccaatacgctagactgggcgcgtaacgattctgcagcgcaatcggccaacctgaaaccaaagtccgtcacgaccccattttctccttcacaaccctacatctccttcggctctctaagatgcccaattcgactctcctaagcgtgcttacgaacaacagtgagagattttattttaagcgtcgcactgttgccttgtttgtgccacatgcacatgcagaatcgttactcgttatgtggcgtagttggttaacgcgccaagtctagcgtattgggagtcgtgggcaagcatggaaaacactcactcaactatttcgtttccctcactcgcttccatgcacggtcgggagcgagaaagccgttgctttaaccaagctggacgtttcaatttccagtacccaatctgcttcttcggcgagcacgagaaaaacgaaaaacggcaactgattgagtcgctaccgattctgaagccgaaagcagccgaatgcaataccgaatgattgtttacattctgatcccgttcgagtggcattcgggtttgagtgctgatgagcgttcactgactggcaatccacaccacgtaatgattcagtgagtgggaatccgctcactcagttcaatgcattcagcgattgggtgctaaatgcgttcactcgtgcctcgcagacacatgtgttttggtattcacttctcttcgtgttccttccgattctcgcttttacacaatcgatttcgatgctttcatgctacatttcacccagtacgattcagctattttcccatgcttggtcgtgggatcgaagcccaccagaacgattctattatttttcacaattttacatctcaatttgtccaaattgactttttaaaagaatcagttttttctctaacttctatatacatatacataaattctacgatgcaaaacccaatggtgctttgcgtattattttaagatccttggagagtttcaagggtgatcctaaatatgaagcagcgtaagatttttgaacaattcatggtatgttcatgacgacttttttgtaagattattcgtcgaggtttatgtttgccactatgacctaataataagattctttattttgatgatttggaagctcaaagagactgcaactctgaaaagtttgggaaccactgaattaattgaagtgacgaaagtcggcttgcttcgatttgagatcaactcttctcgactcgcagaacaagtctgaatgaaaaagttgtataaaacgtaaaaaacgcaaggagtggatcaatatgttgggagtgtatagttcattaaattggataacaaaataatgctaaacacatattaaatgctggacaaatgaatagtactgttcccaattatttattcattctatgtataagagacaaaatggtaatctcgacgataattcgaagtacgcgttaaactttctttttatccgatttagattcgagaaaaagttctttcgataaaatgtcggttcgaccagatgtaatatgttttctattgcaattaaacttttcgaccaaatgtccattcccgaaatgtacgttcgacgaaacatactttctactaaacgtcattcaagtaaatgtcatttggcgaaaagtctttcgaccttatgtcattgattcggaattttcatttaggtttctacaagaatttttctgtagatactccaagaaattgaacttaaaattcctggaggggtattcgaggaaatctattaagtactcttccaggaattccagagcttttcattaagttactcaagactttttcctaggattttcattagtattttattacttttgcaattcgttctatttctttctttttttcaatttttttgtttcagcgacagtttttttagggttttactccagatcatactacagcaattatgccagtcattattcagaaaattctacagtatattatccagggattcgactgttgctttttttaattatttagataaattgttagtatctagtaaatcttctaaaagttcctcaaaagtatagaagttctttcagaaacctctgtttaacaagggttgctttagaatcaacaaagcttcatagaaagtctattttatgattttgtagaaatactcacaagatttttttcaaaaatcatttcaatattttgtgaaaataatctgcgtaatttccttggaagaatttcagagaaaaaaccttcattggtctctgaaattaattcttgaaggaattctcggagaaattcctgattcaagctttaaataaatcctaaaataaagtttcgaaggacatcctaaaaaaaaccggagacatctctggaaaaattaccaggtgaattcttgaagttttttaaggtaatcttgaaagaatttctagggaaacagattttagaattattagagaaactgttacttcgaactctcttgtaaaatttctgaatttttaaatgtttcaaacaaaattcttagaggaacttcttgggaattccgtaaaaatacttgatgaactactgaaaaaatcttcggaatactttttgaaatgaaaaaaaaaattgttaacgagcacctgcattaatttctgataaatttctatgagaaatcgtataaacatacatacagtatttttaaaaagaaaaagagaatatgaatatttcatcaacattttcaaagctgtatgaaatctgttttatatatggcagtataaatttgtttccttccattgtcctttaaaacttcactttacctttctagcaccttcgaattggtgtagaagtcgatggatgaatctaacttacaaagtaacaaacctagagaatttttttcttactagtgtgattgaggaagagcctttttacaaataagaacgagttatactattgaataaaattgtatgcacttcatcccacggaagtattcaattcgcctcgataggggtatctggggtaaaatgcgcctcggggcaaaacgatgaatattttagaaaaactgaaacattttccgaggattttttttgtcaaatcaacaacaaccttaccataagtatctgatgaaaaattgttcctaattacatcacaagtagtcttgaagggtaatattaccccccattctctaacctttttatctttcaacccaattttttatctcgttttccgatatttgatatgatattatcatcatgaatgaattcagcaagtcaaacatatatagaactcggaaactaacttattttaactttaatgtgttgtcattttattgccttatcccaaaaatactttttgtattgtcacgaaataaataatccaagagaaatgtcagattctacgagaaataaaactcttaactgtttattcctttaaggtgaagctgaatcgaagccaaataccaaacttcaagaagcaaaaatctggagaaccgaacttccatttgatctgaaaatttgattgattggtcactcgctgatggtggccaatcgatcaggttttcagttcgccggttctccaaatttgtgctcttaaaaatctgagttgcaactttgattcatcttcaccttgttcgtgtttgttgttttcgagacactaacaagtcctgagagagtcaaacagagtataaacagagatgacaacttatcgaatagaaatcaggaagttctcacagaactacgttaaactaaccctctcgtacccaatgtttgtttatgagtatttccggattttccggcaattttcacagtttgcgagggtcacattaaggaacaaagttcacctaacggttccggagttattgtgtattctgggagggtcaaaaattgctgtaatacttacttacttacttatttggctttacatcaattatcttgataaagcctcgccaacaatatttcgccaattccctcggttcatggccgcttctctccatcctcgactgtgacccacgctctccaggtcctggtgtacctggtcaatccacctagctcgctgcgccccacgccttcttgttccgaccggattcgtggcgaacaccatctttacagggttgttgtccggcattcttgcaacatgccctgcccagcgtatccttccagctttagctactttcacgatactgggttcgccgtagagttgagcgagctcgtggttcatccttcgccgccacacgccgttctcctgcacgccgccgaagatcgtccttagcactcggcgttcgaaaaccccaagagcttgcaagtcctcctcgagcatagtccacgcctcatgcccatagaggactaccggtcttatgagcgttttgtacatcgtgcatttggtgcgggggtgaatctttcttgaccgcagtttcttctggagcccatagtaggcacgacttccgctgatgatgcgccttcgtatttcccgactaacattgttgtcagccgtcaacaaggatccgaggtagacgaactcgtccaccacctcgaaggtatccccgtctatcgtaacactgcttcctaggcgggtcctgtcgcgctcagttccgccaaccagcatgtactttgttttcgacgcattcaccattagcccgactcttgttgcttcgcgtttcaggcgggtgaacaaatctgccaccgtttcaaattttctcccaataatatccatgtcgtccgcgaagcaaacaaattgtccggatctcgtgaaaatcgtgcctcgactgttaagtccggctctccgcatgacaccttcaagcgcaatattgaacaacaggcacgaaagtccgtcaccctgtcgtagtccccgccgagactcgaacgaactggagtgttcgcccgagatcttcacgcagttttgcacaccgtccatcgttgctctgatcaatcttgtgagcttcccgggaaagctgttctcgtccatgattttccatagctctatgcggtcgatactatcgtatgccgccttgaaatcgatgaacaaatggtgcgtagggacctgatactcacggcatttctggaggatttgccgcacggaaaagatctggtccgttgtcgagcggccgtcgatgaaacctgcttgataacttcccacgaactcgtttgttataggtgatagacgacggaagagaatctgggatagcactttataggcggcgtttaggatggtgattgcacgataattttcacactccagtttgtcgccctttttgtagatagggcatataacgccttgcttccactcctccggtagttgttccgtttcccagattctgactatcagccgatgcagacaagcggccaacctgtccgggcccatcttgatgagttcggctccgataccatccttgccagcggctttgttgttcttgagctgttgaatggcatccttaacttcccccatcgtgggagctggttgatttccgctgtccgctgtgctgacgtagccatcgccttcgctgtcctgaccttctgtgcctgtgtactctgcgccattcaggtgttcatcgtagtgctgcttccacctttcgatcacctcgcgtccgtccgtcaagatgctcccatccttatcccggcacatctcagctcgcggcacgaagcctttgcgggatgtgttgagcttctgatagaacttccgcgtttctcgagaacggtacagcaactccatctcttggcattccacctcttccaggcggcgctttttgtcctggaataggcgggtttgctgtttccgcttcagtctgtatcgttccacgttttgccgcgtaccatgctgcagcattgcagcccgcgctgcattcttctcctctaaaacctcttggcactcctcgtcgaaccaatcgtttcttgagctccgttccacatatccgacaacgctttcggcagcgtcgttaatggctgctttgactgtcctccagcagtcctcaagaggggccctatcgagctcgccctcatccggcaacgctgcctcaagatgctgcgcgtacgcattagcgacatccggttgtttcagccgctcgagattgtaccggggcgggcgtcggtaccgtacattgttgatgacggatagttttgggcgcagtttcaccatcaccaggtagtggtcggagtcaatgttggcgccacgataggttctgacgtcggttatgtcggagaagtgccgtccatcgatcaaaacgtggtcgatttgcgattctgtctgctgaggtgatctccaggtgtaccgatacgggaggctgtgctggaaataggtgctacgaatggccatgttcttggaggcggcaaaatctatcagtcgtaggccgttctcgttcgtcagccggtgggcgctgaactttccaatcgtcggtctgaactcctcctcctggccaacctgagcgttcaaatctcctatgatgatcttgacgtcgtggcttgggcagcggtcgtactcgcgttcgagctgcgcgtaaaatgcgtccttgtcatcatcagtgcttccggagtgtgggctatgcacgttaattatgctgaagttaaagaatcggcctttgattcttaacttgcacattcgttcattgatcggccaccacccgatcacgcgcctttgcatatcacccatcactataaaagctgttcccagctcgcgtgtgttgccgcagctctggtagatggtatgattacctctaaacgttcgcaccaatgctcctgtccagcacacctcctgcagcgctacgatgtcgaaaccgcgggtcttcagtacatcggagagtatgcgagtacttccaatgaagttgagagatttgcagttccacgtaccgagtttccaatcgctagtccattttcgtcgctgtggtctttgccgattgttccggtccgtattctctcgttgacgttcctgtgctgatgtgtttttacggctggctcgcagggcctgacaccaaccccctagatttccggaggaccattccccctaaatgttcggagggccatagtgcgcagtttagcttagagtccttctctggcactcggacgatgatcagccgcccctgacatggggaacagacgctgttgtgagccgctcctaacgtggagtacagacgctccaggtttgcaaaagcaaacccccccttccctgtcagcatacgaccaaagttcccaccgggggttggttacccgatcttccccaaggttactcgtaccccggccagtaccacgaggaggtagggataggagttgctgggcaagaggctaaggaccgcacaaaggggtctattttattcctgcaggtacgcgaggtaccaatggtacgccatgcccagccatttaccgcgctgtaatatgatgcattatatcagattacttgtcaagagacatgtaaagtggcgaacatgtctgctgaaccggaacaaaatcgaaatgctcgcgagcatcagagagcggatttactcgtatctgtcatgctcgtgagtaaacgaagctaacgagattcgtgaacgtgttcgaagctgttcagagtttattgcgcttttgggaaaacaaagctatttccattacgagatttctggttttcaataattgttgactacaaactggtagttcactgtcgattcgatgtatacacaattcatttgtcagacaaaaccataataaatcacaccttgttcagttattcgtgagtaagtgttcacgacctttcgactatttcttttggtctgttctcccgagcaggcgggtgcaaacttactcacttcaagcctgttcgcgagtctatcatgtttgttttacgttggtttccactcgtgaggtgcttcgtgatgcgaacatttccgccactgtttgttaactgattaaattccatacactatcgaagtattcaaccatttaaaattaactagggtaaatgatggcttcggcaccttgaaggtattttcggcagcactaacttatcgtccttgttaaaatttatctacggaacaatagttaccttcaaagtactcaatatattccttgaactataatcttccatgtaaacctcatctttcacaaaaatattatataacatgggatttatcattgaatgaaataaatgcttacgaaattatcgtcattcgtgagctgccgaataaaacagcacaagaacagcttaagaaaaacttaccatattgaaaggtccaattctccgctccaataccaatttgtcacaaaagctacgtaccgatcactcatgcactattaaacttttgatttgtctataaaacactcgaaaatactgattttttatgcttcaaatcacaattcaaaattaatgcattttgctttcctcggcaatcactttttattacgggtataggttgccagaaaaccatattcaattgcggtgtattttttattcacaatttatattcatagaaaaaattgaacacaactaattaattcattggaattaggcaacaaagcatgcattggtaataattgagcctttcaatactttccttatctgaagattgtagcgcattaacttcaatatactgagaaacatataaaatatgcgtctttcaatagcttaactattttggcaacactcctgttgttctacaggcaatcagaggttgatgtttttgtgtcaagtcataagtacattgatttgcaaagggcctattctgattttctcatacactgagaataaaatgaacgtaacaaaaaaaatgtaaaaatagcctgtagaattttcaatttcgcgttaccttttagcgatttattgcgcatagacactagggtgcggcttattttccaaaagttctcaaaatcaaaaattcgtgtgcttttatgaattcaaattatactaggagagacacctcaaagcttaagccaaaaatattaagatttaagctctcaaaaccaaaaatttttgtactcttatgaattcaaatcatataagaagagaaacatcaaagtttgagccaaaaatattaagatttaggggtggcgcaagcgtcttgaaggtgaattttcaagttataaaaaatggtcttcagtgaagtcaccataacttcggttatttctaaccaattttgaaacttttagcatcattaattttaaaattgaatttgtgaaaactttgtagaacatcaaatttgtcttaaatcgaaacaagtctttgttaaaagtagttttctcgaaatttttcttcattttactgaataattcatatttgtttgaccataacttcatatatactcaacctatttcaaatatttgtacgtacatgtttttgaagctgtttccatactgttcatacaacacattttcctaaaaaatggttttggctttgttttgtaacaaaaactacccaaaaacatgatttttttgaagagaaaatcaaatttctttggattatttaagtttttttgccaaaaattacattttttctataaaacatgtgtttataaagcattttattgcattataaagcaaaaatattgtttaactgacaaaaataaaaaatcgttagaaaatcatggttttggtcagtttttgttgaataacttgatcaaatcatttttttagtgaaatgtggcgtatgaaaagtatgaaaacaattaagtaagcttctaaaccatgcaaaaagattaggaatcgattgagtattcatgaagttatggtcaaacaaagatattattttagtaaaatgaggaaacatttggagtaaactactttttattgaaactagttttgattttacacaaatttgatattctacaaagttttcataaattgtgtttttatgataatggtagtgaaagtttcgaaattggttagaaaataccgaagttatggtgacttcactgaaggccatgttttataacttgaaaatttaccttcaagacgcttgcgccccctttaaatcttaatatttttggctcaaactttgaggtttctcttctaatatgatttgaattcataagagttcaagaatttttggttttgagagcatatgaaaaataagccgcaccctaataaacagtagtgtgagtagcgaataggggcatgcatataacccattcaaatgcaattctaaaattcaagtaatccgataatcgtgttccgtggattattcttgcagagcacaatattatgaatcaattaaccatgacgtcacgctgcaacttcaaggctggattcgcacttgctttaagtttataaccatgacatggcaatttttacagtcaaaatgctgccatagtgagattgaatacaaaaaatattcgttaaaataaatgaaaacgaaataaggcagcgtccatttatgacataacgttaaaatgtacaattttcgaccattcccccctccgcaacggtctctgtttgaaaaaaataaattttgtgtttgagccgcaacgtttgagcctactctccctcctcctagagcgttacgtaatttgtggacggcgccttagtctgcataaatttagtggcgttgtgtattcaatttgactctctgctatcctatttataactgcaattctgttctcagtgtagtctgtatttttctgctttggccctttcaacgagtaaaacataatgagtgacgtttaatttcaggatttgtcaacaaatacgaaaggttaccaatacataaactagtttttgcgcagttttggattgccgaagtgaacatttttattgccgacaatagtaattgcattgccgataaaagaacaagtgcctcgtgactttggtgaggaaaaatagaagattaagagaataaaataatgtgtataataattaataaatgaagactgctcaagtgtagttaaggtgtctcctgcttaatgttgtgctctattgttgcgtaaaattgcccacttaaaagttcagctgcttaggctgccgacaatacgtaagttcccctatatgtgacctctgtagaaaaaaaaaacattctacacataaaaatagctacaccgaaagacctgagtagcatttctggtcttatcgtggatacatatatgaatggtctgaaaatcttattaaaaccaaaattattacaaaaacctgttaaattccgtcctatttgcttatctttcggcagatagatacacatatttgaatactgattgttgatcatttaattcattatttggcaaatcataaggtttgaggagtcacacaaattctttcgataacatcgtgggaccagaacatatctagcacaaatagacaaattatcgtgctttcagaggtcacagattcttaactatgtatgattgtgcacatcgatagtattcatctataaaactatcgaatataatcagccaataattcaaattattggacacatcgtaatccaacagtggttttccccaacgaaatccgtaataactccggaatcgttaagtgaaccgattccataatgaggtccaaattgttatttgaaaatctttaataaccgatgttcggttagaaaaggttaaactaactcttgaaattccaacgctaagagcagttatcataacgatcatcacaatgcatgctttccgttaacgatgagcaaaaatcgatcatcaacaaagacgacctctgttaaattacatttacaccaggaaaaaagcgaaaacagggggaatcgtcgtttcctgctgttcctctcagcacatcatagcaggcttatttaaaaatcaacccgaggcgcgtactgaaatgagcaacctgtaggtacgcaatgtgaacggcagcatgatcgaacgaaggtggcggtgaccttccgactgttcaccacgactactgcgatcgctccgggtcgatcccttgcgtttaaatccccctttaatgagtttgaactcttcctgtcctgtcggacctgcttttcgttcgttgtgttgtttctttcagttcgataaaatttacgatcaccgaccgaccggacgatgggaatgtgtgttgcttttttttcgtattgcttttgtagccacatccgtcgttttggtcgtcgaagtcactcgattttacatgcaaactcccccgaaaggctcctcgtttgtaaatgcgaacatcttgtctattgcgcctttgtttgtgtgtatatttcgttttgattaacattttttgaacttttatcttttccgtttttctagccactggctcctcatttacatacatgaatatgtgtttttctttaattttctgtttcttcccacaaggaaaagccgttacattatatttactaatgcgttccctcagatttcccatatgttcgcttgcatttacctacgatttcaactgttgttttaatttatctaattaactcgaattttattcaaacctatctgggtcgaactgtcactaatcgaactttcttccccggtgcgttttgcgggctgcgatttgtccgcttgtttgttttcgttttcgttctcttttttctctgttcgccgaatttccgcactttccacgcaacaggtcacggtggagttaaccagttgggtggagtcttcgtgaatgggcgccccctaccggacctggtcaggcaacgaatcgtcgaactcgcccacaacggaatccgtccctgtgacatttcccggcagctgcgcgtcagccatggttgcgtctcgaagattctgtccaggttggttcatggcctactgatatgatgaattacatttcaattaacgatcgaacgcttattcgccttcagatattatgaaacgggaagcttcaaggcgggtgtcatcggtggatccaaaccgaaagtggccacgcctccagtggtagatgcaatagctgcctataagctgcagaatccaactatgtttgcgtgggagattcgcgataagctgcttgcggatggaatctgcgtccatgacaacgttcccagcgtttcgtccatcaatcggtaagtaggcgagtctatttttttcaaatcggtttctgaaagaattttattatcaaatttggcaaccatgcgaatttaattcattctcaaatcgaatcaaaatctaaattctttctagttgaaatcgaaattgatctggatttggatctttattcacatttgaatatggatttggtccaaatcatttggatttgtattaaccttccggttgtcgcgcgatttattgtaacgcgagtagggtaaattatgtattttggacaggctaaggatatgtctggaaacggcgatcgattaactgccttagatactaatattttattatgttatgatacttatatgcttaatgtatcattgttttctgagtttctgaagcgaaaaagcttacaaactgtagcaataggtgccaaaatagcgttttttaattgcctgtctgttatacatttcggacatcaaatatacattttggacaccctcatgtgaatataatttggacaggggcgttatctcactatctattcaatggtttcttaaaagaacgatcatatcataatgtttgaagagtttacatgtgacttatgcattttttcgcttattggatgtgtagattagtgataatctataatttcatttcatggaagcaaatatcatcagatccacgaaatacgcctgcaagtatgcatgcatgcgacattccagtgcgtttcatcagatggccaaattaaatcaactgaacaaaaaccgtaatctattttggacaccacctgattgatgcctcatatactaatgttaagattttagatgaacttagcttcaagtttagacatattttatcatattgccgcctttaaactttttatgaatgcttattctgagcgctattattgcgtttaaagtatgttcttgaaacatacatcctcttgcattcgtaggtttcacaggtgttcttttgatacaatttacagttttgatatttttgaagccaatttgtaattgttatgaaattggtcatcattattaagtagcatagtgtattaataatgcaatacatgattttccatacataaattccttatcatctcattgtaaatgagcatagaacaagcagcctgtccaaattatatgcatgtccaagttatatacgttaccctagtcgcgcgttgtacttttgatggcgtcttcggcaaagttgttcagtggcgcaagggctataagtgattgagttagttgattcttaattttgccaacaggtgacgctagtgagcatgaaatatttgttttgcaaatctcacgatcttgaccactcagaaagatggcatctccggcaaagttgttgagtggctcaaatcctttctttgtttaatccttgaagttcgaggttagctaacataatgatggtccttgagctacgcatcaactatgtcgaagatatcatctttctaaaaggtcaggatcctgaagtatcagcaaaacaaaagtttcatgctgactagcaccgcctggtggcaaaattttgaatcaactaactcgaacaatgatagtccttaacatactgaacaactttgccgaagatgccatgcttctaaatgctcaggatcctgaaatatctgcagaacaaaagtaaaagttccatgcccactagtgccacatagcggtcaaattccgaaataaatgtggtatcatcagatagcgctttacctccagaacaactttactgaagcccctatgtttcgaaattatatggattttgagatataccgatttaaattgcgatctactcattattatgcgatttctatgtacatttgttgattttaccgcattataaagagccatacagtaaacaaaaactattgagtattgttctaaacagtgttgattgactcacactcaaaatctcaatcaatacgctctcccatgagagcaaactcattagagatctgcttcgcaaatctcacgcttgagattttgatgcaaaatcaactcaatcaactcaaaccgttaaaaaaagtttcagtcgcaaaacccggcaaaaattcgtgaaacccgaatgttgttgaaaggattaacataattttaccagactaacaagaaattattgccgtgtgtgagtaaaccgtggaaatacgagacaatgagttaaaaaggtgaaccaactcatccatgattttttgactgctgagttgcatgattgacaactcacatatgaaaaatctcaagcgtgagttgtgagaaattgagtttttcacaacactggttctaaagaagattcttgaggaaaacactttggtttggtgtcgatagatatctttgttacaaaatcatagcatacacacaccccaaaaatcgtgcgattttacgtcttttgcgagccaaaggacgtgaatttgtgtcacattttaaatacgatggtgtctgattcggaaaatgtcaatcatacgggcatcgctttcatggccttcatcaagtaaaattacatttttctttcaatacatctttcagaacccatttttacgtcatttcatcgcttacatcatgtggcattcagtcataatgtgaattacgtccggaatgattctcattatttttaagagtgtatgaatcacaactgttgtacaaaatacagcccgaaggttaaattttgaatatggatctaaattataatctgaatttgaatctggacttaagtctggatctgtattagaatctaaaaggacttcagttatcgattcgggactgacattagttctagttcttgaagatagtctggatatggaagtagattcagatttcatttaaatatggaataatatctgaatttggatttgatcctagatatgaagtatagttcgtactagatttgaatctagattttaatatgattttaaaactgtatttgtatctgtattaggatatggatctcaattaagacctagatctgaacttggattaggcattagatttgattttaggaatggatttgaattttaatccagatcaggatatggatctaaattttaattcgaacaaagatctaaatctgatcttggaatgaattggatttggacttggatttagattaggatttaagagtatgtgttgggcggtggagtttccaagttcctttaacattcaacgctccgtcatcgtaatcatcgtcatcatcgaagcataaaaagcagtttttcttttcaaaactgaaaattattcattttcatcgtgttcactgtgcttcggttggagaatagaatacagtgaacacattttcctgtcaattttcttgatttttaacgaaaaaactgcttatgaaaatgctgaaaacaatgacggatcctgtccccttaagcaaacacagtttcttgcgtgagcaaaaagctattaactttttattaatacatatattagtttcatgaggaatttattagggccaattaggccaaaaaaactgtaaatggtataaaaatgtagtataaagggcaaaattatttttccagcgatatattaacctcaaactatttctcgagctcaaataacaaattgagaacagtcgttttctggctatttgtcaccaaacagagatattctacattaatttgaacaaattcacaagaactacaataaacttaatgctatcaaatgaaggaaataattcactaatatatctaatttcggaaaaataatgtgtgtagcttcagtggcttttgatttcaatttttgttttaccttttttttatcgacgtctcgtattatgcgcagagccgtagcgtgccctcatggcgcccttggcaaacctttatacaggcgcccgttagccaaagccttattgcggtttatttggcaaaatacctacaagtttgtaggagaaataagtcttcgtgaagtatgacatgcatacgtattccaaaaaagattatttgaatgctagagtgatgagatcttcaaaagatatcaaggtgtatttacataccgtcgatgggggtgacaatgggtctagggggtgagattgggtcaaaacggaaaaatatgatttatgaaatatttcagctaataacgctgattttatttaaattaataattcatatgttagggaacatattattacacgtaattcatcacaatatacatttttagaaatagtagtttttgttttatatatcaataaacttgtatgttgaaactagacaaaatttaccacattaaatttctcctgttcaaagtacccaaacttttgcacgatgacttgactgactatttcattaattttgaatactttccagatttttccgccaaaattttgtggggtctcttcaaagaatataagattacgattcaaatgacactttgatttaaaatttttgtggatccaatgctgaggaaataagatatggtttttcagtgtgttttttttttaaatgtcactactttaagtaaaaatttagtacacaaagttctaaaaatgtttttggaaaaatacatacgaagtaagaataactctttacctttcgaatgcggcttttgagagtttcgattggacttgtaatcacagagatatggactgaacacttttgcatgttttttacgggggtgaacccaaacttatgcactggagtgtacttttttcatagctcttcaatttttgttggtataatcgttcttttatgtgggtttatcatacctgtgaaacatcttagatatcttttcgtcttgtttgcatcgtatttcatcaatattcctcacctgtgaatggttttgcaatcatattctcaaaaacaagttatttcagttacagtgacccaatgtcaccccctctatggggtgagattgaatcatttttcattcacttgtggtgccgcagtgaatgaatatttttctttaattttttgaacagttgttaatgtaccatccatatccatccaaaccaagtacatacacaccaaatttgaagtttattggatttttttttcttttttttttattgagggattttctaccgtaggcaggtttatcccccagtttattggaattgaattgcgatagttattcaataaataaatcgtacatatcgttttttgacccattctcacccctaacgaaggtatttaaataggtacattagactacaacctactagtcaagactcatccgttgattaacaagaattgagacaaattccttgagtaaggaaaaaaagccttgtttttaagaaaaattgagatgaataatttcaatttttttatggaaaatgaaaatttccggaaaattagttaaaagctttaattcaaaatatttacataaaagtaaatggaaaagggtaaggtaattattaaataatatctgtgaaaatgttacgcagagttcttcgtgaatttttaggcaattttcactcctaataataaaacatgtttttataataagagtaatttacagacgaatgcactttcatatgttatctctccttgaaacgaatgatttatctttaccaggcccacccaaacttctgaagggcggatttaatcacggaaagaattgatttgaaataaataaaaaaagagtaaaccttgttggcgcacaaccatctcaactaaacattttgaacattttcgtaaatacgattgtcagttgttggaaatattctgatcaaatttctcatgttataaacaatattcaaatttacagtctataactcacgttgtttgttactgtaatgaaattctctcattctcaaatgaaaacttgatattatgcctgtttgattatttcaaactttttgccagcaatgcaataggtaaaaattagtccgagccacgggttaactttttttcaacttaactgcattactagcgttgagtttgttataaagtattttttacacgaatcaatcagatacaatatcaagcttttacttgaatagcatgacaaagatcttgtaagaatctcactcaaagttttgtgaaaatgtggctaaagttttctggaatccaaataatccaattgttcattcgaatcttgttaagcattctgaagatttctttctggattgttcaaaattgttctttgaaaatttctacaagggttttgtaaaaattgtaattgtgactattcatattctgcaatctcatttttttttttcaaatttgtcgtgtattctggcgcccccttaaggctggcgcccttggagggtggcaacctggcaaccacacgctacggcactgattatgcgctacttgacaattcgttgtcagttgtcattcatcgctctccttccgagaggtattcaattgcgattaaccgcacgagatctgtgcaaaataccgtaacagttccccgaaccgtaaggctggtccggtatctccggttcggctttactcactgctacatccaacttcgctagcttcgcaaccgttcgatgaaccatgccatccgcagtcttcagcttctcgtactcgtccatcacgtctgagatcttggttacacgtcctcgtatccacgcattgcgtatctgctcctcaactataacgaccaagtccccgacttggattggattagcctcctcaaatcactccgtccgatgggcgatagtgggagggtattctcttacccatcggcgccagaattgatctaccatcgttctgcacaggttctagtcagcttctgcacaggttctagtcaagcttgtttcgggtctgtcaattttcgtggagtctgcgctaatctattcgaacttataagtaagaagtagttcggtgtgagagcttctcgttgcgtcgtcgtctccagagggatgtctgtaagcggcctagaattaactacaccctcagcctctatcagtattgttgccaacgtctcctcattcggtattcgtcaagtatccatcgcggcaagtacggttttcacagaccgcgccaaaggctcccacgcctcacccatgtgcggtgtacgtggcgggttgaatacccgctttgtatttgcattgatgaatgttttggccagctaatggtcgattttgcccatttcgtgcttcaattcgttacttgatcccacgaaatacgtgcccctattactgcggatctcaactggtggtcctcgacgtccgataaagcgcctgatggccatcttgaaagactctgctcatagcgtatggacaacctccagatggactgctcgagaggtcatacaagtgaacaatccgacccaccgtttgacgatggtacgatttactttgatgctcattggtccaaagtaatcgacaccgacgaaaggaaatgaatgcacgtaggaatgtggagacattcgtggagtcgctggattcttccatgaacggcggcaactttcggattaagctggtcttttccagccgcacctgttgattggtacgcttgtcccttcaaccaaaaagaaccgccacttcattcgagtgaatttcgctttgcgtccagcggaaaattgtggcttcagcgttacttagctctttttgcgtaagtgatccttctatacgttgctttttgtttgaagtacgccgctaattctgcacataacgatgaatacacgcttcgttgcaatcgcgtccactttgagaatctatcccatttcacaagtataccatgcaccatctcagttcttcatccgtcgtctgattggccggaagcgcttaagatatccactgttcttgcggcagatacaaatcttcctctgcccgaaaccatcggctattgttaaacatacagggatcattttccccacttggtcgcttcatgtacaatgcccttttagcagatatccaatgccattgttctgctctcgactttgacaggatctctcccactctgcaggcgacaaactgccggtagttgcgatggtacgagtatatccaagtgagtaccagccttgaatcattccaatactttatcgatttttagcgagtgcccgttgagtatggtcttggctgatgtgatccatttagtggaacaaatttatccaccggttccactctcctaacattttttttcggtatcggctgatcccattctgtcttcgccacaaatcctgtatcaaaatcttgccgtgtatgagcgagaaactcaacagtccggccgaatcgaatggactcatgacttctcgtagcgcttgtcgttttgttgggtgatctgcttgcggtggaaaacgtgaatacgtctaacttccagaacatcccaagtggcgctattcttgtccagctgtaagcatttctccgcgatgaggtttgggactggctcgccctccccggctcgtgcgagaacatctttggtgttcgaaagccagttccatcgaataaatcctcggagtgagtgaacatgcttgacgtcttgtgccaagtttcacagcctcttcctcgtcgtcagcactgtctacacactaagctcacttcaccggaatccatgaattccatcgtaatcttatcagctgaacagcttggtacacacttagtttttttctcgttgttcggtaattttttttaccggaaacgaactgtaaataaatatttaactgaagcttcggtattacaaacgagatttaccgaacacccttgaatatataaaaaatcaaaacaatattcgtcctcttttaccgaaatcgtcgttttatttaccgaaaaaaactgtaaatcgtttagattcgccgtagactgtaattttttaccgtatttcagttcttagtgctttaccgaaccaattgtaatttgatatttttgtggccgccatattatttgctagtcaacacgatagtatcgaattcaaaacctttaatttctgtgattgtggccataaacactgttttttgagaaaaaaaaaatgagactacgacagcaggatgagcgtctggaactacttttccgtaagtacaacctcggggattttattaaaaaacctatttttaaaaattgaataaaatattttcgttgtagtatccaactgcccaattacgtttccggatagaatcgtcacataaacgaggataaacacccatgacggaatcggtggtgatggtggtaaaagggatcaacagctgcaaatgagccaggattgtagcccaagatttgaagcgcgcgttcgagttgttggtgatgccactggtggtatcaacttccatctccatgaaaaagataagcagttcatcttcaaacggttccaaaacaaaaacgcgaaataaatcgatgaacatttgctatcaatatggtttttgctttgttttgatcatccttttctattccgactgcctgctgttacgaacaatgcgttcggtagtttattttacaatacgttcggtaataattcacgagcatattgtaattttttgacagctgcgagtcgattgcaattacagattgttcggtaatccttaactttaccggaagcattaccgagcgctcagcggtttatatttcggtaaaaaaattaccggagtcggtgatattttctaagtgtgtagcataacaggcgcagcgcatgtcaatctgctggtcgtgttttaatctggtggaacatttccttcagatctgcgcccaaagcaacacacttttctcggaaggcgaagagtacagaaaattcggattttggatggcttcttggggttgattatcactcccaacggtaaataccacgtacgccttggatccgattcttcgagctctgttcgctttgtggatgtatcccttcttctgatactcggacatttgtttccgaaaactctcttcgataactgtttcgttctgcttgcacctcgccaaacactgcagttgccgaactgccatgtggtagctatctgggaattctaaatagtcaaacttccagagaagacccgcttcaaatcgctgaccaatccgtttggttgtttctataagaatccgcttggatcgttgaattccagcggactctacggcaggcgtctcggatattcacagactttccaccaaaaaaaattgctaaaccagtccgtgtaacgtctgattgtcttcctgacatttgcaaatgtggaagctgtgaattgtccattgtccactggcttttgtagcctggatccataaaccggcaattgggttgctcggctgtctatcccttaacttcaatgttgaagtaacatgcacattatcgttgccaatgaggatacgagtttggccaattcagcgtatcgtaacgactgccgtggtagttcccgcttgcttacagtgtgcactagagatggtcgggtctcgggttttcaaacgggtacgggtttgataattttaaattattcgggttcggctcgggtttgaaggctacaaaattatcgggtacgggtcgggttcgggcttgaaaaaagtcgggtttgggtcgagttttggtcgggtttgatgagaattgtgaacagagcaacaacctgaaagctcccttatgcatcagaagcgatgaattcatcatcttgttgacctcgggtttcattaggatttttcttacgaacatttttttgggtttcgggtcgaatagtgaaactttttcgagtccgggtttgaagaaataaaataagttgggtacatgcacatcggacaaggaatgcttggttgaacatgagtgccccgcaatttctaaagtgactcgttgcgaatttgcttccgtactcttcacgtttgctgtccactggaagcacaaaggctgtttttctcctacaacgccgaattgcttcaccacttcttcatccaccaatgtcatctcccatccgtggtctaaaaaggcgaatacagtcccggaacagttgttcccgtggagtgttactgggactatccgaaacagcgtcgttttcccgctgaaatggtgactggtggcgacttttgattcactcggcttcgcttcagatggttcaagcacggaattgcttcgttttatattgacgcctggtgctattgagttgttgtctcgtttgctttctatcatcccttcttcgttcgcctccctgtttctgttcagaatgcagcaacggaagatggcgcaattgacacccagacatgtcacattgcttgcgaattttgcagggtctccttccgtgtgctcccagacaaagacaacataaactgaactgttgtattagcttccagcgctcatctacgccttccttgctgaactctatacaatccgtaactcgatggtttggattgttgcagaacagacaagctgcctttgatgagtgcgtcgcatctccaactgcttcggttttcttcgcaccctctgcagcgtgggcaccacagaagttcttatctgtgctgctcttctccttattatttttttaaggcgctctgtgctcgtgtccactactgtgccggaatcagttgatctgtagcttctttaccgatacagatctattttcaactaatctatatttacatctactttcactctctcctattattttactctcacaccgagcaggtactgatactgacagaggatggatgtgctccgcaaagcacggtcctccgtgtggcgtcttctggtggctggacgggttttttttttgaggggctggaaatcgaacccatgaccttcgcttatgaagcgaaagcataacctcaaggttacagacccccttgttctctttagttgtccgctgctgtcttggatcgtactggagagtgacgtcagttgcagcacttatcaaagtatgcatgtacttggagaacgagttgctaatactgcgaccaatccagcttcatgtgtgctgtatgcttctctaccaactcgaacaataaaatcgggttgttgagatgcgatttatgtcttccagcttctaaatgatcgctgaggttctgcatcgcaataaccaaaatcaatcaacgtgtcagcaatctgtcctgcttcggtgcaggaactcgtcgaagcttctgcaatagcgcatgaataaacaactccagtctactatatagtgtctccaacgtagcgagaatatgtggaacacttgacggcaatagcagtcggctctgcacggattcaagagcatgacctttcgggcacctctgcaaccttgccagattttccgcgtctgtaaagtcgcacacttgggcagagttgaagtaagcgcttatgaatagcggccaatcctcaggattaccagtgaaaattggcagctccttacgtgcctggcagctaagagttgtggtgttggtccgcggtacgccgttagacgcctgtctaaatcgattatagtttctacttaagctaaaccttaggggagccacagaaagacccgtgtggctcatactacttgtcggtgcaatggtgctttctatccgaccagttattcctcgatggcttcatgccagttgcccaaacgaaatacctgataccgccgagggcgtagcctcttccagaaatccctggttgctagttgattgcttgctgcccagccggcaactgatcgttgtcctagtttcgtaggtgcaattttcggagcctttcccgtcgagaacaccattgtcgaattaaaagctcgccattgtcgaaccttgccggatgagctttgcacggattcaacactctcgttgtcgtcctccttctcctcctcttctgcggcgataatctcccgaaggcggaatgattcgttcatcaccgtttactccaattgtagctccagctgttggagtgatgcctcttcctgcaccttctttctgttggaatagtaactccgcttccttatgcttgcgctcttgttcccgtcgctaaagttctaaacccttcatggtcaaagctttttgggccttgagtttcgctagctctaatcgtgccttcgctgctctgctagaactcgatgaatttacgcttagtgccacctttcccactgtacctgtacgcatggtttctagcgctttgaacaattgaacacccggtctggctctgcgatgctatcgttgacgcccacgtattcaaaatgcagccaggaatcgcattgacagcaactgattttccgattttcacactctaggtgcttcacactgcttggtgctgtcggtaagacttgaacaatcttttagatttgttgggcggtggagtttccaaggtccttcaagcaagttttacgttccttgcgtgagctaaaacctattaactttttattatttacatgaggaattccctacttaccgttttgattcatattacggacacttaaggactcagggaaatataacccagcatagagcatacaaaataaatcattctgtatgattcttcagcgctatcgaacgtcggaagccctttactttcgaacggtgggtgaagaatacgcttccgcaacttcaataattttaaataaatcaaaattgtgtcgctttttcatgattcttattccggacgcttcctcacttttgcctcatattccggacactttgaatcgaattccggacagctcatgataatcattaatggtacaatcaaatcatcaatcgaaatcgttaaaccaccaaaaagtcatctaaggtagttgggcattataaattttcaaagatatttatggaaaaagtttactaaaacgagccttgaaattgagaacttttgaacagcaaaaattgaaacatttcgcgtgaaatgtttcccatacaaagtagagtgtccggaatttgaagctgtccgtaatatgaatcaaaacggtacatcggtctcttgctactctcctagttgctcccaattgaccttgaaagatttaattattgttttggatttcaatgtgactcgtggatgcgccggatttatttttttatggggaatatggatttgaatatgaaatgcatttggatttcaatccagatatggatacggatccagatttgtttcagagtttaaatgtatatgaatccaaattcagatctagatttagatttgcaaactggaatctataaaactgaatttggattggatttcaattcgatttcgatttgagttcaattcaggtgcgtcccactcgggttcagatttggtaccacttctagtactgcatttggtcccttggtactgcaaaaggtacccaagtttgacagatcgcagtacacttttcacggcattctagattttgctctattaccttatgagccataaattagacagctgcaagggaatggaggtctttattgcgtctttgattcaaccttggtcctgtttcgtttacgatccaaagctaattcaaatgtaatccaaatccaatccaaatttttgagttgacagcttattaaaatggaagagctagggagaacttggattgaaagagaatgttcttgatggaaataaatgacagaacgatcttagttgaaaaatcaacaaccttgtatatcaatactccactgcactgtgacgtcacgcatcaattttgataggtactggtcctgttgtttacagtttggacttagtacttttttcgaatcattcttaatttcttgaaagattgctgcgaggagaggtcaaatccgctgcagatacccacggatcgtattattctatcttcctaccgtggaccagcatgctgatcgtcaccatcagcatgctggtcatagaaatgcgaagatgaaaaaatgatggaaaaaacgactaagtccgaaacgtaaacaacaggaccagcagctgtcaaataagtgaggttaggctcgtcatatgcagcgctctatgggtcactgcacaaaaatcttcctctctctttcactcttatttgtaaacaacaaggccagtaaacgtcaaaatcccgtactaaatcaaaacagtgcagagccccatagtttgcaaagctggttgtttgattgttaacgttcaacgctccgtcatcgtaatcatcgaaacttcaaaagcagttttgctgtccaaaactgtaaattattcgataaaaatgtgttcactgtgttttggttggagaacagaatacagtgaacacattttcctttgattattattgattttgaataaaaaaaactgcttttgaaaattccgagatcaatgacggatcctgcccccttaaggcggtttttgttctgctaatagatgaagtgcgccacatcgctgaggctgataaactagggactgttcatttaagaaagtggacacgtgttttttaccgtaaactgtttattttcgaacaaattcatgagtttacctaaaatacatggaaatcaacgtaatttcgatcaaattcacataaatttgaacatttattgagcattgctggagaatgttcttacatttcttttgatacctcccataaaattctgcacaacttttttcggaacttttcgaactgctttttgaactgctgaccacattttcttgaaaaaatcgttggagctggcttctctttcatccttcttaagatgccgtttgattattgcccaatatgtttcaatgaggcgtagttctgagcaatttgatggattcgatcatttttctacaaattcgacttattccttcttgagcatctccaaagtagctgaagcatagtgagccgatgctaggtctggcaaaaacaatggaggcatggtattctttcagtagatgggcagaagccattttttaatgcattcagttctgtaattttcgccgttgattgaacccgtcgtgaaatatgtagtactttcataccgcaggagcaaattccttgcaataccaaatcatttttcccaaatttttctgttggcatgtatcgtacgtcgtcaggaatatctgttttggccacagcgttgaaaaaattcaatttggacacttcgcgatttaagccaaatctcggaacggcagtttttctgtacaccatttgtgcagacaaaaaattgagagtcgccatgtcaattcgacccatcgtttagaatttataatttttttatgtcaacttttgtctgctgtcaaaataaacacttgagatcacactgaaacaaaattttatttgtttttatggaatgtttacaccaaaatgctaatatttaggtgtccactttcttaaatgaacagtccatagatgcctatttgattaaaaatctaagattctaatcaaaattataaatctagattcaaatccagaattacactgaaaatatatattgttttatattacgaaatcgttcgtttgaactacgaaattattcgttgttttctgcaacgaaacagtttcgtaaaatgtaatgaggggcggtttgagatttcttacgcgccaatgtatctttaattttcatacaaaaatcttatcatgaagggaatggggagtttattatcatattaaaatccaaattcaggttcaatccagaagtactcctcctcctgcataataattcagtacggtgtcaaattttatagggtgtccgcaaattatccgaacagcaaaatatttaaaagatgatctcgcattgaaaacaatgaagaattaatgtccatgtactttttttaatacatctatatgttaacacaaaatgtaactaaaaacaaatcgaaataattgcttgttactgagataggcgaatttaaatttttcgaagacgtttttcctgagggccgctagtcatactggagatgtgttatctctaaaatctaaaagagatgaatccaaatgtcatactattatttgatgtaacctatagcttagtggcttcaatttagactggaaatagaaaattatacggttcaaatccagtgagttctatggacatttttcttccgtcatgaagctcaaaaaacagctccctataaaacacctcaataaattttgcttagttttgcaaatatttgaaatcggaaatgtgtcaaacttgcttcttaagaatataataagccaatgtttaaaaccatgcacaaatattgaatttattatgcttgattgtatagagcagtgattcccaaagtgggcgaattcgccccctggggggcgatttttgggacgaagggggcgaaaattttcaaaacagaatttggggggcgaaaaatccagtaaagggggtgaaaagtctagtatgggagaaattgaaaaatgactcataacgttcggaggacacacgattcgatagaaattaatgctaatgcttcaatttcattctaaactatttctagtttcaccttagatcgaatatacctctgatctaagcatggccattttaattcattctagataacacttgatgattgtcaaaagaaaatatttgtattatgcattcagattttttccatatcatatgagttttaagaattttaggttttctcaagatcagaatgattcaagatacggagagcattgataacacacattgacaccgtctccagacatttagctgcacagactgtaacttaacactagacaacggacaagcatgctccagtggcacagtcgcgaaacatttttggcgaatagtgtcaatggctgaagcgggaatcgaacccacatcccatgacacgatgcgatcactgcttgatgatgctatccactggacacaaagcccacaatactcaatctgtataaaaaagtgaaaaaagttttatatgccatgagttggcttgagaacggatcaatggattcgaaacactttcactgttgcatttgttctggactttaaagtaatcgtccgaagaaaaagtttaataaaatctctagaatagtcggaaaacgtaagaaaactaatctgtaaatttgtttaggaaattttatgacttgatggcaagatgaagtttaccaggatctctagtatttaacatgaagatttttttaatatttctattgtaagcatccagtttttcacagagaaaaatatgttgtacccgttttttggtatttaggttgcactttttattaccattcttacttcttatggtacaaatattttaattaacaaatctctgaaaatttggctgacaaaatcaggttccaatgatgaattaaagccattttgtggagtgtatattttttccaaagcaaacacttttgtagtaatatacgagtaaacttgataattttctttttttttagtacagtttatagattaattcaaatatatgaatttgtatatgaaccattcatcaggggggcgattcctaaaaatattggcctcgagggggcgaaagtcgaaaaagtttgggaaacactggtatagagccatgtcttcaaagtttgtacggataatttgcggacaccctgtaaatgtactatcttctcccttccagaatcgttcgcaacaaagcggcggagaaggccaagtacagctcccgcatcgattccagcatgcaggacagcgccccccgtggcgtttcccggcaaagcggaggaagtcaacagcaacagcagcagcaacaaccgagccaaggtccaccaccgccccaatcgcaatcggcccaggaatgcatgaaccaatccatgtccgacacggagggaatgatgaaaagctcccagtcgcagtcggccgatagtgtgggggcttcggcttcatactctatcaacgggttgcttggattgtcgcagaaatcactgtctgggactagttccaaacggcgcaaaattaaggaagagccaggttacttcgatgatttaggttaatcataagatcatgattttaacatttgatcatttctcgacagatttacgaagcggtctcttgggcagtattaaacgtgataaggtactaaatccgcacggatggcatcaatcagtaattttgaccaattttccccgttattccgggaaattccatgactaatgcgtcgatttttgaacttttaggacaccaaagatatttcggactatgaacacatgaaaccaattgaccaggacaagagcaacgatctttataccggcgtggactttgttagttcgatggcaatgtccagcgaggacaactccgacaatcaatcgagcttttccattagaggttcttctgcgatttcgagttcaaatcaaaaggattttttttaaccttccccattgtttttaggtgagaaaccgcacaaataccatcgagcggaggacgccctctcggtgggggtgatcatagaagacgacacgtccgcccgcaagcaacagcaacatcaaccgcatccatccgaactcaccaaagtcccggaaggttacgagaagattcttaccagcgaaatgattgccgcctcttcggctgccgcagcagcagcggcagcggccgccgcttccataggtggcagtagtggcggccttaagcgatccgaagcctcccaaatgacgcagtccatcgaattcctcagcgacatgaacaacaacatttcgcaaaatcagaaccagagcttccccacgacgagctacgaggcggccaccgggtacagtaccggcgaaccgtccgaagcagccgtcctcaatccgcacattgcctgctcgtccaactattcggcgttcctgcagaataccgatcagtttgcaggtaaacctagaatgagcctttaacgtttgaaacgttgaactcaacatctctcaaccatctattctagcggccaatccggaactgatcttccccacagcttacactcaatacgccccaggttacggctcgttcaactacaacacggcattcacgaacaacaacctttgtcgagacttgggacagatccactacccggaggagcagtagccctaatggagcaacggccgaccctgcatacgacgaatacatggcaatgaaacgattctacaaaacaacaagagtaaaacgaatttcacaaccgctacaaagaaatttggcatttaatagcacacacacaaacatccaaaacacaactttagaatgatttgagagatgatgagtaactaatatttgagaaacatgacaaattatataagtgacattacagaactgtgcgagtttggcaaccgatttagaagttaaagaaagtcaaaaatcctatatcagaaaattcaattctaagcttccttctgccgaatggttagaagcgaacatccttttaacaaggttgttgtccggcgctcttacaacatgcctccaacacgttctccggacacatcgtcacaaaagatagtctagacgatgttcaaaaacttcaagagcgtgtatagtgctcgagcatagtccacgtttcatgccatggactccagctttggggactggatattgggctcactatcgagttgctcaagctcgctatcaatcggcacatacaacctgtccgggttaattttaccaagttcctctccaataccaccactctcagatactttgttaagtgtagaactagccctcgtgcgttaaaatacactctaataaagatttaaaaaaaaaaaaaaaaaaaagatactttgttgcttctggtttgattttgtttactagatcgtttatttgaggctcaatcgcgtttaacgcattacggagccaaaattcattttttgtattatttacaatttattcacttttccagtgccaaagttagtatt

SEQ ID NO: 126 - DNA, 170410 bp, Aedes aegypti
  misc_feature (38010)..(38539): n is a, c, g, or t
  misc_feature (44080)..(44179): n is a, c, g, or t
  misc_feature (74023)..(74122): n is a, c, g, or t
  misc_feature (89910)..(90009): n is a, c, g, or t
  misc_feature (112565)..(112664): n is a, c, g, or t
  misc_feature (138969)..(140530): n is a, c, g, or t
  misc_feature (142824)..(143185): n is a, c, g, or t
tagtgcgtatgcttgtatggtcgagtgaaagcagtttgtattcaattttccggttctaattccttttcgttacctcaccaatgctgctaccgatactgatatttccacatgatgaaatttccttttgatttccggttttgtgttttgtctttttctcccctacgcatggatgatatgcacttggtgaatagttctgttgttttctttttcattagcataacgtttgaattatgtattttgaccaatcagtttgtcatctcatttcatttccacctcttatctcgtggctgtgttgagaaatacgtttattttaatgtatacaatactgtaatcgaacagattttgctttcagcatacatttaagacttatcgattgccagagaaacatttcattgcaagagtgtgtgtacattcaaacatttaaccgtgtacaacatatacgtagacgatatagcgatcgattatgagcgcatgcgcttgattggtcaaagtgtcgtgatagagagatggcaacgcccacttataaatattgcagcaatgcaatgtaagagaggggtgagatagaacagccctctttcattgttgtattatttctgacgagtttttctattgtttgaaagctacctggacgtatttttagcatgttattttctgttttgttgccttatggaaaattgtgatcagttgcatcattcgtgttaccgcgattagacatttattaaaaagttttgcaatcagtgcgtatatgtacatgtgcattagatgacattttcgcttcggtaatttgaaatcgtatacggatatcgaatgcgttgaaaattcttcgccatggatttaatatagagcttcgaaacttattgttactttttgagtgataatgcatgaaggattaaccaagtgttttctatctgtttaaagatagtgtgactacagtttatacttgaacaggtacgacaaaattagtttcaacatcactagactgttttcaaagtgcgtgtatagagctggtaacaaactgcatattaaaattgatagcaataccaacatatgcgaaattcaaacttcatcctaaaataagtctttaattcaaatttcatttgattaacttgataatttatttataattaagaggtgcaccaaatcaactttgtgtcattgtgttatttccaagattgaaaaattcaaaccaactgggccgaattggcagatttaagagtcaggtccaaatctctggctctttggaatcggacggaaaagaggcaactctcatacaattgtcttagacggtagcacctacgaatttgttcaaatcgtttaatgctaatgcaaaaaatatctcaatttggaaggtttctcgaatgttttattttttatatttttaagtttgaaatcgtcataaatcaaaaaagtcagattgaaattaacattttctatttctttgaagaacttgctttggcatattaatatatatgtaaaccaaattagctttactttttcttgacgagcggctttgaaagttcatccacgaattttattttattttattttttttttattgtgtaaacgtctttggtaatactaccgtacagactaattaattaaactatattcttaatcctagctctaaaacaatcttttgacacattaaaatcaaacatttcacaaacagagttaaaattcctcaaacaagtggtaaaagggtcatgatatccgtaactcgttctttgtaaagggatggcgatgagggttgtatgccgcagtctacgattgggaacgcttagttgcacttcggaaagaagatcagggcagtcgatgttattcgtcaggatatcgtgtacaagtagtctttgaagctttagccttctgtttgaaagtagctccagatccactagctgacaacgtgcgggatagtccggtaggttgattggatcgttccaaggtaggcggcgaagagcaaaacggataaatgatttttgaactcgttctatccgaatcattagggatgtgtggtatggagcccatacaggagcagcatactctaaaacactgcgcacaagggcacagaacaaagcttttaaagcgtacacatcggtgaactgcgatgcatttcttcggataaacccaaggactgaaaaggctttggcggtgataactgtaatatgctcgttaaagcgcaattttgagtctattaccactcctagatcgcgaattgacccaacacgctccagagttgttccatttatagcgtatgtgtagttgatcgaagacaagctgcggcaaaatgttatgactttacactttccaatattgagcgtcattccgttttcgatacaccattgaagaagcgagtcaatgtcgtcttgtaaagcaacgcagtcgagagtagagttgatcactcggacaattttgaggtcgtcagcaaagcatagtctcccagatgaaaatcgatgacacaggtcgttaatgtagagtacaaaaatcagtggtcccaatacactgccttgtggcacaccggaaggaatgctgaaggtactggatcgcgaagactttactttaacgaaagcttttctatcagtgagataggacaaaatccagtcagatatccaatcgggaaaacccatatgtctcagcttttcaacagcgtacaaatgcggaacagtgtcaaacgccttggagaagtccacgtatattgagtctacttgcttccgccgttcgatctcacgaaacagtacattagtgtaacataagaggttggaagttgtcgagcggtggggaatgaatccatgttggtactgagaaataatcgatattgatgcagacattacaactttatgtaccatagattccagcatttttccgaggcagcagagaattgagattcctcggtagttttccacaagacgaatgctgccagatttgtaaaccggaaccattgtagcaattttccataattgaggaaacgtgttctcattgagtgatcgattgaaaagtaaggtcaacggtgcaaccaaagacgaagcacagcttttcaacagatggggagtcaagccatctaccccagcaccttttgttgtatctaagctaagtagggcattcaatacttcttgatgagaaaactggaaaggcgggatatgaatgttgtgagttcgtacgttttggaagcatcccgggtagacacgaggcgatgtggcactgtacacgctttggaaaaatttcgcaaatagttcagcggcttcaacatgtgtggtggcattaatgtccccgtaagtaacgttgttcgggataccatggcttgctttttgtgccttcatatgcttccagaacttcgaggggttgtttttggcggtaagctgcaaattctcaagatacctgcgatagctcatatcgataagctcattataagaggattccactaggcaaagcagattcctgttttcaaccgttttgctagcaaaatatcatttacgaacttttctcagtctgttgcgcatgtttctcaattctggattccaccacggttttctatcaacaccaagattaacgcatcggcgacgagggatgactgagcggagtatttcgtacattttgtcgtaaaacaagccgacactttcatcaacggagtgtccaagtagttgattatcccaatcaaccgaatccagtaagttattgagcgaggaaaagttacatcgtcggaaatcgaggcccaagatattcgggtctgggtcaagctgactgggtgcggaaaagcaaacatcaatttgtaaaacaagcggcggatgatggtcatcaattggcagcagcggtattacgcgattttcgattatctcggcacgtttttagcatacaacgttaaacgatgaaggacacccatcctctttattcattcacagttagaaaagtggagttaaaacacgtcttggttcgatttcttttttctaagtaacatgagcattaaggccgcacgggacgtcatcataatcaccctatccatttgaagaagcaaatcccaagaaccactccatatatcgatgcgaaaaatgtatcactatgtttctatatatgtagtgcacaacccaattaattttcagcttcatcagttcactaaaactcgagatttgctccacaaagttttgatgataattgttagagtgagacaaaagatagagaaaataacactgtctctcgtgtcaccttaacggtttgggaaattcaattttggaaaatttccaatgataggttccaccagcttttcttccaaagctaactccgtttttgggtaagcaccatttttcgaagtatttctctaagcaatacgtcagatatttgacaagaaaatgtttctggactcctaaagattttttttcaggatttgatttcagtttttttctctgattatattgtctattaaatgttaaactttgaaaacacaagttcttgatatttatacgtatattaattgcggagattgcttcgtaaactgtttcagagatttatcaagtagttttttggatatctctaagtatttttctaagagttccacaagcaatacattcaatgtcttttcatattactctagggacttgtttaggaatactgtcaaaaatcaaaactattttgaaaatttattttttttcgtttttttggatattgttaagatatttcttaagacattactccaagtattttattggaatcctgctatacatgtcccacaattatatcaaggattcttatatcaaattctctggtagattgtttttttttggtattttttatgagaaaccaatcagaattttgccaaaagttcattcagggatttctttgcaaaaaacctgtaaattttttggtgattttttaaataaattctctcttgatttttttttttcagaatcaacgcttataactatcccatgaatcaaaaattactcctagaacaccaaaattcctacaaagaatcatataaaagctactcaatggatatttcttaggaactcctaacagttaatttttggaagcatttcttaacatattttgcgcataatttaaaagattcgtctagcattttacacgtagatttaaacataattttcttcaaggattcccgaaaaatctaccctaaagtctggaatttttgcatgaaacggcacggtatataatgattacatacagttactccaagaacagcccaaaaaagattccatcggcatttcttcccttgaagaaataagaactctcaaaatttctcctgacatcccgaagtatacctctgagcaatccggaaggactaaatattcgggattctagttaaattattccaggatttgactttttttatccaggtattttacattcttcaataagctcttccaaaaactccttaatgtattttatcaaatgtattgcattaacacacatagcaattcattagtctaatagatttcccccactacatcatatctagttttaccattattatattgcagtgaaaccaatatgtaatgtgcacttttaactgagcaacgagagttactcagagtgcacgcagaagaatttctttatgctgagattactatcaacaaatcaactatatttatagttatctctaatttaaacttaaaatatagttaacttgaccggaaaaaatattacgaacacattattttgttctctgtgcgtattaatatatgagattcaatatcatatcaataactagggttaccatccgtcctgatttagcaggacatgtcctgaattgagcttcttcgaaggtgtcctgatttatttttcgttttttaaattttgtcctgctttttcctgcttggtgaacattgtgagatgtcagagatatttcgagtcaagaaaagttaccctaacacaaaaaaaaaaaaaaacagttagaatgtacaaatggcataaaaaaatgttgcgttttggcgtcagaaaccgacttcagctgcataaaaagagtaggatgcgttccatactgtatcacaacaccttcaagttcagtcaaagtttgacgattctgatgttgttgatagaatcctttgagctcgtgcaaaacacaagctatcatttttggcgtattttcacagagctctatcgctatcagaataaaagaaatcttcaaaacaccgattattagtttctgcacagatggtagcattcatgggagcataaaactgtttcctatctttgttcaatactttgatgcatagatttctagcacgatctttggcgaattatcacgagatctcaatgaaaacttaacttctaaaaactaaaaaaaaactatcattttaagggattaacttaaggttccatttagaatcggtcttttgccaaaactagaatagcagtttctttcaaacggactacaactgtacaaaataagaacatccgtttcttcattttgttagttatgataaccagatgttctcattttccgtgatctgttggctaatgctctttcagttttggcaaatgatcgattctaaatcgaattctactgatagcttaatcttcttttgatcagacacttttgttaaaatcatcgataaattgcaggcgagactgttacaggatatcctggactggatgttttaagaccctcgatagattctcaaaggattcctgttgttaaattcctgacgagatgcttgatataattttaagcgacagtctaaccaagaggatcccttttgtaatttttgacagacttcaaacaataaacttgagacaatatttgtcagatacctagcaaaacaaaagtcaaaacgccttagtgtcttctaaaaatctatagattgttgtcttagcaaaggttagttctatttaaaaattcatacttatgctcatacgcgctaataattagattccggaaatcgtacattgcaagtcctcaacgtcagaaattaaaagaaaaatctttgttatcgctgctgttaggaatatgagtcatgttcagaatttgaggcaaaatggaatttgcacaggaaaattgtgaaaattgcaaaatgtcctgattttgaatctccacgatatggtcaccctatcaataacaaaacatgctaacatagtcaaatttgatgttgttatgttatggtttaaaatcgtcgattaaataattaataacaagtatattatcatggtgaaatttgtgatttaagcaataatactaaataagatgcattatttatgatatgaataagaaactttgccatcacagtgaaatatattgagctttaaacaagcttatgaaaatacagtatttgaacagccgaatatcaaatttcgccatcatgactaatttgaagcagtactaaataagccattaccaagaaagtgaagaattgaatattctattactgaacaaaaatgtgtgattgttcaaactcgttattggtttaaaataagagtttaaggtgacacgggagaccgtgttattttccctatcttttgtctcactcgaacaattatcatcaaaactttgtggaagcaaatctggagttttagtgaaccgaatagtgaatttattgggttgtgcactacatatatagaatcatagtgatatatttttcgcatcgatatatggagtggttcttgagatttgcttcttcaaatggatagggtgattatgatgacgtcccgtgcggccttaaattacataaaaaaacttagcactatacacaaaaaacatagaaatattttattacgccattgaaataacaaagtcatacaaaaaattataattacaatcataaattgatgaataacaattataaaaacaaaatttatccttatccgtgaagagctcatttagttatttttttttgtaatcaatatcacaaaaataacttattttgttatttcgtcttgttgaaattttcgccattggtttccctgataaaaaatacaatataaaaacaatataacgtattgtaacagtaccattttgaacattggaaatacaatacagcatattgtaaaataacaatacgataacagtacaatatattgtttataacaattcactgtatggtacatgagttttttacaataaaacgtatgggttgtaagtatcgtaagttagtatcgtaacaatacaaatattgacattttctcatacatcactttgcacaaaacaatcagatatagagggacatcccccagtatcggacacttaagccactaaattcacaatttcaaaaatattggttttatgtgatcctgtaacccatttatgaaaaatactaccatttttgtatcgtacaaaaataaatttgatagtaaaaatatgaatttacattacatttcgttgatatattctagtaccaaattgaccaatcttaaaaggtggcacccaataccggacacaatctgaaaatggctcgatttctgtatatttgtacatcatcgaatgttttactccatgaatagtatttcatagctaatttaatgcatttgcaacatttgcaagaataatttgaattatacttggtcttagcctctttcacacacgatgaaaaataacacattttacgatgatgttctgaatgttcattcttcttatttttattgcatgtttgataccatggtcgatgaaatctacgaaaaatgaatctattttgagacaccgatgcaaaaattacaaagatatcatatattgtgtatttctttcactactggactgcgaagtgcggcctcataagtgcgaaagtgtgaataaaaatgcgggattgcattgaatcctgttggtgtcctcagagcatttattctttgatttacgaagaataagtcccgcaaagacacctacccgatttgatgaaactgcgcacttttattagcgtttccgcacttgtaaaaatttctgcaatagtccagtggtgaaagaaatgcgcaataaaaaatcaagctgtccgaaactgggggaaatgaggtatttgacaaaaaatgttgtttgtccacatttagtttaaacatggtacaaaatacagtcatacttctatattatgattatgttcgattatgcttccgtgatacatactattttgccttactcaaaataaatactaataagactcaaacttaaggcgatacgtcaactttttaacaattttcaaacatcactactttttcaaatagacggatttcacgccaactcagcaccccttcagaattcaatgaaactttctgggtgtaaagactatgtgaaactaagatactttacatactttgttttttcaaaatcgatctagactaacatttggaaagggtcaaagtttatttttacttctttttataaacccgtataactcgaaaacggtaagacctacaaaaaagtgttgtatgggggactgtcgtgaaatttccttacgttttagaaaatacaacagttttttgtaggtcttaccgttgtcgagttatacgggtttataaaaagagtaaaaaaaaactttgggacttgaaaaattcggtgttagaaaaacttttttccctaaaatatgcccaatttgcaatgtatggacgacttttagtaaatttaattacgaaactttttgcttaaggatgatcaaaatctgaagtggccgttttttctaaatcgactttaaagttttgaataattttttttcagtgtagaaaaagtgtttttattttttcaatatttttctctaaaacgtcgggaaatttcacgacagtcccccatacaacacttttttgtaggtcttaccgttttcgagctatacgggtttataaaaaaaagtaaaaaaaactttaaccctttccaaatgttactctagatcgattttgaaaaaaatacatatgcaaagtatcttagttttacatacttttgacatccagaaagtttcattgaattctgaaggggtgctgccaatcgcgtgtcgagttggcgtgaaatccgtcaataggcatgcataattctaggatgcgtcattctacgcaaatattactctccataaaagcttttcttctaatacaccgtcttgattggaccatgatttctcaatgtttcgactttgtccggtattgggtgctgtccggcactgggggatctccccctattgttttaaatggtaccaaaatttagaggattactgtaaaatatattgtttttatatgcttctgattggaaatttgtgtattgttttacaatacacaaacaattcaacgaaaagcatttcaattggaggtgaaaagaaaagaatttgtatgtttaatggattgtttctgacttactggatatttgtgctaacagtaacaaaaacgtttcaactcctatatagaggtatagttcttcaacattattgcattaatcctttgaaaaatcacaagtaaaatcacttatttctacaaaattaaatatttttaccttctaaacaagttttacttaatgtttcttgctttttgaactttctttgtttacttctgacagtcaagctacacagaaaaaaaaaacaaaaattgttttacacgttgttgtaaaaaaaataaaaattgttttacaatgttgttccaacattcaattgcaatacgctgtattgtatccaatacggtatattgtacaataatggtttattccattcagtgaatggtacgtttttattacaattgaagaacgagataaattttagcttttatgccgtacaaactgagttattacattctattttaatggtttaatctgatattcatttgtaattctcctctactcagtttttccaggaatacacttagagtaaggtggggcaaaagttcgaccttagtggtataatcaatatttccaaaagaacaatagcagttgagaagaagaaataaattccacacaatgaaacttcaacacattggctatgattttgctgaacaaacttgtgtcaacatttttacccatttttagttataacagtttcaaaatcgattgtcttaaacgaacttttgccccaccggtgggcaagatttcgaatctagtgtggggtaaaagcccgctggcagaagcacaaaatatcgacacttttacgacaaacatactttataccagccatcaacttatatcaacttatgtttacagataaaaacacattaaattttcatcaaaaaattgccaaaaataggattagttaataataatacccaaaaatagcagtttttcgtaaaactaagtgaaaatgtaaaattttggtgacttttttcgctcgatcaggcaaattttgctaaatttgaagttaatatgtagatttagattcctctcgattcccgaagatcgaacagtctcataaatagctgggataatccaacattcaagtggatatacaatacttttacctactcacaaatagttgtttcaaagtaaaattaacttacgccaacactaaatgaacgtcaaatcaaatacacacacttaattgattcagctatccacttgtacctagtgatcctttatatgagagatgagcggaagtaaaatggaatgatttggcaacagaccagcagtgctgagtttgctcggcgtcgagaataatattgtaatacggacatgacttcctcattgctaaaaaatgtattctgattcgtaaaagatctttgagctacatttccaaattaataaacatcagaaaaaatcaacaatcaaatattgcattgacaaaaaaatcaaaaaaggaaaatattttatattttttgctttatgccgaacaacttttaccgaaataatttcaagcagattacattacttttaaagaaaagttcaaaacaaacataacgcatgttcgtttggctcacactttgacagctctcactgctcgattggctcacactttgacagaaatgtcagcttccgcgtatctctcttataaaggatcactacttgtacctatatcaattataatttggataattatttaacactatccgaaaacattcacatccctagacttcaagtcatgctcacaaatctacttacttttaatttgcaagaccttgcacacaggagaccacatatgaagcttaccgacgcgcactttgatttttgtaatggtttttatttatatagataaagcagcaacgaatcatttcagatatgatgataaagcagaacaaaatgttgagtaaacatagcaaaatattgtaagctcaattaaatttactttaagtcaactaaattatagttgaatttagacgtttgacgtatgtaaattcaataaaaaatataggttgacaactatacggtatagttatttttaacaatatactaaacaactttatttataggtatctctaaattaaacttaaaatatagttaaattgccggaaaaatgattacgaacactatattttgttctccgtggagggtttatcttcaatgaaactttgaccaaaaattccaattttttcgtcataaaacaacaaacagccataacttttccaaatcacaatcgattcttacgatatttggagtgaaagtctcttacttgaatggcattcgaaccaccgggcatttataagttttgttttgaattgagctagaaattatttaaaagatcttgtcccactcgaactattaacccactttactctattatttttcgaaatagacaactaatgatacaaccaatttctcaacagatgcactcaaatattcttaaccttttagtcgtcgcgcggttcgccaccgtcagaaccaccacgctgatgttgtgagcgtaaagcgagcttttttcacctgtgttgtacaaaatacaacagcgtgacgactggtgttaaactttttcagttattacaattggaactcatttaaggtttgtttaagggatactgtcattgcatttttcatgaatcaattaacgattttctaaagtattcttcttaatctattttttcttgaggtttcctcaatttactttattagacacaacttattgttctttttctgagtcattcatttcgttagaagcatctcttaacaatgaatatctcaggaagaagagattcttggaattctattgagaataattcaaaaaagtcttccagaatctctaccacagatttcttctaaagttttcaaaaaaaaaagtctagaaaattcattcaggagtttcatatgatttttgtttctaggaatactcaaaaaaaatgtttttctatggatttgtccagccttttttctaagaatttcccatgcagaaatccaagaagtaattaaaaacttgatgcgctgctaaggactcactggagaaattcgaagtatttcaaaaactgatttgtggaatatagtctggaattattatcaaaagacttttttagaaatcttaacaataatatccagaggaatataaccaagaattccaggatgaatgtctaagaaatacgtggaactatcccttatcgaaatccttgacgtatatttgaaaagaaagatgatgaattcgattcaatataattagaaaacccttggcataaaccttctgagttcaataacagatatctggccgattcctcataagatacattgtggactgatgtttacacctttaaatgatttctggttagatctttggtagtagcctgattgtaaggtggactccaaaaattcttcagtcaatcatgacgcaatagtttatatatatatatatatatatatatatatatatatatatatatatatatatatatatatatatatatatatatatatatatatatatatatatatatatatatacagccattccatgaaaaaccgatctagtgggtcaccgaattccgtgaaaattggctattttgttccttatccgaaataagaatacacgtatttttggattttttgattagggtgaccatttacaaaaaagggtgaccagaaaaatcgcgattttgcaaaattttcactttaaaaaaatttataacttttgaaccgtttgaccgattttcaatctttttggacgattttaacttttcaggaaaaatatgaaacttcacaaaaattattttttacatgaaaaaaatcaataatttccgttttttcgtgttttgaaggactcgggaccaaaggggctattgctgttctcatttgagattgagatatatttttttgaaaataaaaaatcagtcattttttatcgtgcccggtgaagtacataagtcacacagaggggcgggaagaaatatgtatcgtaataggcctattcaaatgacgtctcaaatcagctgatcgggaagcactttgacatttcttctatgaaaatgacaggcccgtgttagcaccggtcctccaccgatgtaaacaaatgcatagacggatctgtcacatgaaaaggcctatgtggcgttgctcagtcgatcgctaatcagatttcgctcggtacgttttcgttcatgcgaattcggtgaaaaagtgcaaagtggataattgaactgaagttatttctggaaataccgtagttcaaatgcatttttggtgtgcaaatgagcgaatcgtaacagctttcacaaaataatcctgggacaataaatctatattgtaggtaagttcgaatatccgccgtacattttaagtttgatacgacgaatattagcgattgtgatgaagtagatcgaaaccaacgcgcactttgttatgatttttgcaatggctcatttaaagtaactttatcggcactcatcgcatgggttcaaatcccagcgatctaggttattgtcgttaacggaaattttctcgacttccctgggcactgagcatatttgtgtttgccacaaatgtaaataaatcgtcatgctctcagttaacaactttggaagggctcataagaacactaagctaagaagcaggctcaataggggttccacgatgaaatctttcaatacatgttcagcaggaaaaatacaaaaactgatcagaaattttgtttttgtattgaatattgtagtggcgaatactggaacacttgcaccactattcgtcacgtttttaatcttctgagccaattttgaggtttctaagaatgtttccgtatcatgctgctgcttctgggcattaacatcctcactgggacagagcatgcttctcagcttagtgttcttatgagcacgtccacagtcattaactgaagctttctttgccaaagttgccatttttgcattcgtatatcgtgtggcaggcacgatgatactttatgttcagagaagtcaaggaaatttccattacgaaaagatcctggaccgaccgggaatcgaacccagaccccttcagcatggctttgctttgtagccgcggactctaaccactcggctaaggaaggcccctaaagtttccgtatcatctcaacgcatttaacaacgactaaacaattgggaaccatttgtgtcgtaaaaccagtatacaatccggcgtggcactatgggccagaaaacaaaattttgcaacaaaagccctaacttatttttaataagattaattatgaagatgagagtgcttcaaaagtgtccaggctaacgagtcggttttgtgctccattttttcccctcgatttgcgctcgatttgccgggagtgcctcggaaacgagtcggtttgtgcttcgttttttttcctcttttgcgcgcgttttgctgggagtgtggtacgaaggaccgagcccttgagttcgcaactaaaaaacttgaatttcataaggaaattttatgtgtaggtgaaaatgacaagaaaactattgtttgtacatttttggtaagcaagcttagtgttttttacgtgtctgagtatcattttgagttggttttaagaagttgaatgaatttttcatcatcttatcacatcacatcatcaggtttttttcattcatatctctttgtattacacagaatcgcataaatgaagtttacatgacgtataatctttattatttttaactgtgtacatgtaaattaattctagatttgcaacatctttccagttgataactgtgcaatgacttggttccaatgtagaagtaatgctacacagaaagaaaaatccatgtaaatttcagcgtaaaatcatgcacatgaagggaatgctagatttgtcgcaaatttacacgtcacgtcgtgtaaaattacaataacatcatgaaagttgatgatcttgatgtaattttacacgatatgtcatgttaatttgcgacaaatctggcattccctttatgtgcatgattttacgctgaaattcacatggatttttctttctgtgtagcattacttctacattggaaccaagtcattgcacagttatcaactggaaagatgttgcaaatctagaattaatttacatgtacacagttaaaaataataaagattacacgtcatgtaaacttcatttatgcgatgtaaacatgacgtcatgtaaatttcagtttgaaatcatgtaaaaatgtgttatatgtcatgtaatcatcctgctagattacatgacatataattgaagtttacatgacatatcatgtaaatatcaatgatattccacgctccaattatgtgcattatatgtctcagaaatttacacgtttcgttcaaactgtgtaacatcaaaccaaaccgaaacacctttaccttataataacagactttaccacaaaactaagaatgagcccaacatcaagttccaatccgtgaaacatggaaaaaaataatgtgctctcgtttttcagtgcatgattttattattttttccaattttgaagtaattatgaactgtatgctgaaatctaaaaaaaatgttcatttttgaaacaaaataaaaccctacataacatttgaagttctattatatttgcacaaaaatctctcacaagatgatcctgtcttccagaattttgatcttcttctttctggcgttacgtcccaactgggacaaagcctgcttctcagattagtgttcttatgaacacttccacagttattaactaagagctttccgattgaccatttttgcatgtgtatatcgtgtggcaggtacgaagacactctatgccctgggaatcgaaaaaatttcctttacgaaaagatcctcgatcagcgggattcgaacccacgaccctcaagcatggtcacgctgaatagctgcgcgtttaccactacggctatctgggcccctacgaattttgattttgtctttctcaatttttgttcctaaatttgttgctgatgttatgaaatcttcaacaacatacatcgttgaattcttctttgtgtgaatgttttttgacaatacatgcacgaatctggtagaacgtgcattcagttttttaattactttttctacactgattctcatccacctactgacattcggtggcagcaaattcaatctcgcttgcgaaaaaaatcatttcgatcagaataccccacaaaaacatccgcaaattgcaaaagttatatttttttattaaaagacaatcatgattcatcaactagaggcatcacattgccgttttctaacaccgaaaaacttgttctactacttaagtgggcctcttttaagcattctcaacccaataatggatcctttattgtgttgagaattttcaaaagaggcgaagagagatttgtccaaaatcaagacaattaatttatttaacaaatgggcaaatttatatctctcacaaatcaagttttttcgttataaactgaagcacatttaagactttcttgttttgaacgaaaataaatttggtaggttattttacaggatacatttcttgtgtcttctcactgctattattgtaaatgcaaaagtaggtagtttcacatatctactctgaaacaataaaaaagaaagcgaatgtagctcctccagacaaaactacccctcattctgtgtagaccgaatggaagagtactgaatattttatagggtaagataatattttatccatgcagtggacgcgaatttccttttgtgttattgtagaatgctccaacagtaataaaagaacacatattctgaacatttatacaatttatttacctcgtatcgggcatcaaaaaaaatacagttagctttggcacaacgcatagccattgtaaagctttctgcccagtatctatatgcgcaataaaggtcttcttatgtttgttttatgtttttttttttagattctttgatcagtatttttggtagcaaatgttatctacgtttttggtatatattatagtgtataaagcaaagttgtagcagtgccgattgtatatacagtactggacagaataaagcacgtatgcgtcgttttccatacaaaatattcaagattgatggcttgaatctccgattttttttaacttaaactgagctgaaatgtgcactgtagcttgaaaacaacatttcatttattcagctcaattgaaattcacagaaaaaatatttttttgagttatcacaaaatctccaataccaataaaatgtaagaattgttttaaatgttatgcgaaatttttgaatttgataagacaagtaagtttgcataatagttttttttagtgaaattgattgtgttctaagtatttcaaaatggaagtaaaatttaagttatttttaagcttcggtgaaaatttcaagtcaaccggagctctagtaacggagatcaaagtctacaatattggctgttttgaatggaatgcacatgcagctgcaattatttttgaattcaaattacacattagatcgatgcaaccatgtcaattaaggaccaatgcactagtttatgaatttgacgtttgaagggtgccgaattcactcgtttccacttttgcaagttatctaaaattttgaaaaaaaaaaaaccagaagacgtattttttgtttatgtatcaagaatcggacgtaattgaatttgattacatcagtgttacaacaaaacgtaatgagattcgatctacgaaaatgccaagaaacccatttcgagtagagatacaaaacttgtatcaagttttgttacctatgtggtaggtcacaatctagtgtttgcttttttgtattgttttcttttcgttttgttatatatttttattaaattatttatacattgttacaaaaatgttctgaactaatttgggaatagaaaaatactgatttaggaaagtttggtgcaaaaaagaaagttctcagttaataactgtagaagtgctcataagaacactaagctaagaagctggctctttcccagtgaggacgttaatgccaagaagaagacgaagatgtacaaaactggatactctgaaaattcaagtttatataagaatctttttcctatgataatttattttactaacatgaaatagtaaccacataaatagtaatcaatagtaatactactcttatttgcgttttatgaattatgacgatcaaagtagttttaaaaatctatctatataaataaaaatggaatggtgtttgtatgtcacgaaatggcttacgaacgggtcaacgggtatgaatgattctttctcagtttggttcgtcaagggttccgacgtgtttgtgtgtataaaaatcccaggatattcaccgggaaagttgcaaaaacgagcgcgaacgaaactgtcattttatgtgggatgatcaaaagcgtttttcaacagcctacttgatggcaagacgaagtttgccgggaccactagtatataataaaatatggatcgatgggtttgaattttgtcggcgcggtaaaaagttaaaaacagtttctcaccgaagttggatttttcttaaaatctatgcgagatacctaacttctgaagtggtacattcgattcgcttccggatgcgctctaatgcgccctacttccgaagtagggtatctctcatatattccgaaaaatccaacttcggtggactgcattttttaatgatggaccgaatttacaatatttttttcactgtcgtattcgctcaggtctctaacgtgttcgtgccaaaaaattaataagtagaagctccgtaaaagtaagaaaaaaacggaaaaagcagtttaatctgtcaatttgtatggaagatttcacggcctttttctacagcctacttgatggcaagatgaagtttaccgggccaatagtttataaagaaaaaaaagtatgatggtttactaatttgaaatttttattgtttctcttacagcttcctattatactgaaagaccagtggatattatcagtctgattgctcaatcacagtcaacgggtagcaacagaggtaaacatacatgagaaaacaaaagtttaaaagtaaaagtgcaatataatatatgaagagtgacatttacaatgaggtattgagtgatgtgacaggatacggaagaagtcaattaaagggcgaaagttttgaactaccacataaaagttgaagtgattggtcaagatatacagcgatacgcgattgacatttacgccggattgtagagaatagccagtggttgttttttggcagtataagcattccaaaatttactcacccacgcattttgacgccgctaaggcgttgaagttagaagacgaatttgctggcggttgcatgactatgtctatgtacccgtcagcagataaaatgaaaatgagcaccccaacttgttttccgagtcgatatagtcccacataccggggaccagatcagatgcgacgttgtatgacgaatccgtcggtaagtacaattatatattatttgtgatattacgctaatttaaggggaataatcaaatcaaatattaatacttaatactgtgcattgcgcgattatttatcatgacgatgatcttgaaaatctttacaaatgcttgtatttcgtcgtatctactgtagataacagaaaaaaagtagtcaaccgattatttttttcttaaattgttagttttgatcataagatagaaataaagtatgttcaggggaaatgaatacctaaataggttttgttttatggagtatttaaataaatttgctaaaaattttacaacagagattaggattgattaatttatatgtagagcgaatgattggttttgacaacaataacagtatattttaacaaaacagaagagtgttattgttttcagataataaaatctgtcgaatctcaaggtttgtgaattatcaatacgaattatttatgtgaaaacattacaaaatctattattccaccaactttaatgtgaaaaagttatgctagcttaatctaacaagtttaagcgtggcaacatataagtaaaattttgaatactaagctataagcttgtgacaagccatataattacatataaacaagttgtgtttttctaatttcaatgtaagtcactgaaattaaaaaaaacacaacttaaatgaacttcagagaaagtcttctggcaagaaaaattccctgaagcaaagaaaggtgtcaattttaccccacatgaaattgtcgatcttactccgaatggacaatttttcttcagaggctttttcagttgccgaaaaaccagaaactacattcttcttcaggttgcatctacgaattaattatgaatgatgatttcgacgcacagcaaataacgacatttgaaaaaatttacagacgaaatcattaaagaataatagcgaaatcttgcaatggccgtccctgcaatgttgtccaatatgattttgttgttcattttggcagtttattggtagcgtcagtttaaaagtcatccgaaacacaactttttttttgtttttactttttttattggtaccattctaaacattaaattcatttcttatatctaggtgttctttgttattagacaacactatcatcctaatttggtaaaacatatttaagattttattaacattttgttaacaatatattacatgtcatttgccgtagcagctcagtttttttacaggtgagttgatttcacctgcttataagagaaaaaaaggggcccagatagccgtaacggtaaacgcgcagctattcagcaagaccaagctgagggtcgtgggttcgaatcccaccagtcgaggatcttttcgggttggaaactttctcgactcccagggcatagagtctcaccgtacctgccacacgatatacaaatgcaaaaaatggtcaattggcaaagaaaaaataaataaggaacaaaaaaataaaaatgaaaaaaagttattttttcgaatttttgtttttaacgatagctgttaaactttttccaaccgcatttggatcattattttacctggtttttactctaaaaattaaaacaaaaaacctaactgatgtcaaaaaaaaaacgaagaatcttttttttcctccccttcaaaattttcggatttttgaaggggtggggggggggtgacataaaagaaaattaatatttgtatcagccttattaattattttatttgacatttgttccaatgtttcaacattggatattctatgtaactcattggtactataccagggaggaagcttcagaatcattttcaaaattttattttgaattctcgcagagctttcttcctggtattacaacagctagtccatattggtacagcatacaacatggctagcctgaaaatttgtttgaatatcaaaagcttgttcttaagacaaagttttgattttctcgccctctcatcgtaacaacgtgtctacttgaaggattcatataaagagcctttggtttatgtgggaatattattagttgagttttggaagcattaggagaaatcttctatttttgcaagtatgaagaaaatatatccaaacttgtttgcaatcgactacagatgacacgcagacttcgtcctttggcggagagacctgtgtcatccgcaaacaaggatttctaacatccctgaggtaactcaggtaagtcatatgtgaaaatattgtataatattggtccaaaaatgctgccttggggacaccagctcttacaggaagtctttcagatctggagttctgataattaacctgaagtgtacgatttgacagataaccttgaattattctaacaatgtatgttgtaaaataaaagttttttaattttataatcaaaccttcatgccaaacactgtcgaatgctttttatatgtctagaagagcaagaccagtagactagccttcagatttattggaacgtatcaaatttgttacacgtaaaagttgatgaatggtcgaatgtccatggcggagtccgaactgttcattggcaaaaattgaattttcttttatgtgggccatcattctgttcaaaataaccttttcaaaaagtttactgatggaggaaagcaaactgattggacgatagctagaagcttctgcaggatttttgtctggttttaaaattcgaacaaccttagtatttttccatttgtcaggaaaatatgctaattgaaaacatttgttaaatatatcaactaaaaatgataagctacttcctggaagtttcttgatgaggttgtagaaagtaccacttcttccaaatcaatctcacaggaattttcgaaaacgttctcttgattgagaatattttcgaagtcctgagtaacttgattttcaattggactagtaagttctaaataaaaacacaacattttacaagtagatataaagtgtggtaaacactggtttaaaatagcttataaattgaaagatgagagggtgtcgaatttacccacagtgtcggttttaccctgactacccctacttgtttatttgtgactataaatgacatagcattttaagggggagggggagtctacgatcttgtgaagaatcatgtattaggtatatgaaaataggctgcaatgggggaggggtgtcaaaaatgagcaaataaatgctacgtcatttatggaagttcccttacctgaaaataactactgtgattatttagatctacaaattttgagaagaaataatgattgaataatataagggtatacaaaatgcttaggcgccgttcacaaattacgtaacgtaacatagaggaaaaggggagtaggcacaagtgctacaactcattttaatgttttcatgcaaaaagcgttacggaggaatgagagggtcaaaatcaaatctcgacatacatatccatggtgaaacttttacaaataattagaatcaatgcaatagcaaatacttcttggaaacgcattatatgatcaaaaagtttcaatatttgttaattgttttaataaatctggacaaaatttatgcgaatacacttaaataaaattactaaaactacatattagaacattcagaatggaatttttgttgacttcacgagaaacaaaaagattaagaaagattccaaaacgatttggataaacaagtgcttcaatttctaacgattttctaacgttttccaactgtaacgatagctttcttaatgaagtttatgactaggttcaaatgcaatttatatatcttcagggctggtagtgtttaagtgccttgcatatagaaactttagaggactcttacttgataaaagataccaaaaagagaccaaacagaaaccaacgaaaatgaccaaaaaggaaaaaaaaaacaaacgtaacctaaaatgcaccagaagaaaagcaaatagatgagttagacttcctgcgagtgggtttttcaaaccggaagttcagatctggacatgttttccaaccggaaataagtgttccctaatcactttttattcaactttaacaacgaaaccattgtttaacgttaagttttagccatttttagacattatgtaacgggccaaggctagaatacaccatttggtatattttattgcatgggccgatagccggaacatggttccggaagtactttccaggtaaaagccaaggccaaggaatacatataaatttgacccgaagcaacatatgcggctacttgaacgtcatgaaatcaactcaaaaagctgatgtaagacatcaactctcaatattgttaattttaccatatggccaaggctgggttgtagggtcacttccggtgaaccaggagacaaacatggatgaagttcaaaactagacatgcgactgctcaaacttcatgaaatagcctcagcgttgatgtaaaaacatgcttctttcctatatggagacttcggccagattgtcaaacgttgtccgaattctgaggtcactttcggtgaatctgaaggtacatataaataataggtaaaactggacatgcgaccgctcagacttcatgaaataatcccagtgtagctgtaagaacatacttcttgcctgtacgtacacttcggccagatgatcagacaatgaccggattttaagctcacttccggtgaatcataaacaaacatatataattggtaaaacaaggcatgtgaccgctcaaatttcatgaaataacctcaacgttgctataagaacgtgcttttgattgtattgatacttcggcctgatgaacagacaatggtcggtttctgaggtcacttccggtgattcagggaacaaacatgaataaaaggtaaagctagaaatgcgactattgaaactttatgaaataagctcaacgttgttgtcagaacatacttctaacattaatcgatacttcggcctgataaccagaatataagtgaattttgaggtcacttccggtgaaccaggagataaacatatataacatgtaggaccagactgctcaaactttatgaaataatttatacgtagctgctggaatatgcttcatgtctttattgacttttcgtcaagttggacaggcaaaaccctgaagccacttctggtgaatcaggaaacaaacatggatggctcaaaactaggcttgcgactgctcaaactttacgaaataatttcagaattgctgtaagaacttgcctgtaggtacactttggccagatgaacggataatgaccagattctgaggtcactttcgttgaatctgaagacacacatgattaaagtataaaaagaggtgcgcggctattcaaacttcatgtaatcgtctaagctctgctttgctgtttgtaattgttaaatacacaagtttgtaagaactttgtacagtcaaccctccatgagtcgatgttccattactcgatatcggctcatggaaccatactaaaaacataaaatcatggttactatgatagtcccttcaaacagctcacactatgtctaaacctgggagggaggcaccgatactacacacgaaatataacagcaagttttttcaaactgcaagaaaacttcagcttgccaacgacaatcaaggcagacttgatgaaaatcgctagttttgttttgttgtgtactttcgatctttttggacaaacttggaaaaggggccaaagttttctaggcatttcaatttgaaaaaaagtaaaattatgcgtattttgaactttatattcaatcagaataaaaggtgctatcgtgacattacttttgaataggcatgaatagcttatcaatcgattttttgtcacatttgatgaaatgccaaaacatgttttgatcaattacgcgctttttccatgtttgtccattgtttgagatccgggctcacagtgacagtttgtgacagcagaatctcggctcactatgacgtacagaaatttcgtatcggtttctccctcccaggtctaaaccagcagattatgcaaatccaatgtacctcggatttttttcgctagagttcagtatttggtctacaatttcataatcggaaggtcacaaaatattctatcggtgaaatttttcccatatattttgtatgggttgaaatgtgtaggaaaacgtgattttcattgatttacatagtctgtatatgaataaatagctaaaaagtgaaaaaatcaaaatttcaccgatggaatattttaaaaccttccgattatgaaaatataacccagctactgaactctagcgaaaaatagccgaagtacattcgattttagacatagcgtgcagcttactaaagaataagctgttccatgactcgatatttccatgagtcgactcatggaggtttcactgtacaacattttttgataaaaaataatcgcttattttccataattgtttcctgatgcagcagaacggatctcaaaatccggacatttggctgtagtgtcgatacatgcaagaaacatattcttacagaaacgataaggttaattcatgacgtttgagtaattacatgtccaactttactttatgtgtgtttgtctcttggttcaccggaagtttactcagaatattgttattgtctggttatatggccgaagtatcaatacatgtaaaaggcttgttcgtacagcaacgccgaggttgtttagggaagtttgagttgcatttataattttaccttttattcatgtttgttccttgaatcactggaagtaacctcataaatcggtcattgtctgttcatctgaccgaagcatgaatacgtaaaatagcatgctcttacaccaacgctcaggttatttaatgatgtttgaacggtgcatagtttttcaattataaatgtttgttcctgattcaacggaagtgacctcaaaatccggtcattgtcaggtcatctggccgaagtgtccatacaggaaagaagcatggtcttacaggaatgctgaggttctttcaggaaatttgagcggtcgcatgtctagttttacctgttatttatgtttatctccagattcaccggaagtgacctcagaatccgatcaatgtttggcaatatggacgaagtgtccatgtcctgaatcatattcttacagcaacgcttagactatttcatgaagtttgagcagtagcatgcgtagttttgaacttcatccatatttgtctcctggttcaccggaagtgaccatacaacctagccttggccatatggtaaaattaacaatattgtgagctgatgtcgtgcattggctttctgagatgatttcatgacgtttcatgggataaaatttggacaaactacaattttacatactaagtaaagtgaattctcgatattccgtatctcgacatcaattattactcttgtaaatgttgcaaatgcattgaattgacaatgaaatacttttcctggggtgaaacattcaataatgtacaaatttatagaattcgagacatttaaacattctgtccggtattggcgccaccttttaaaatttgtaaatttggcgctaaaatattttatcaaaataattcgtattcatattttggattttgttacgctgcagaaatgataaaatttattatatatgggtaacaaaatcgcataacaccgatcgtttttgaaaaatctatgataaaaagtcgaaagacaaaaggccgaaagaacaaaaaagaagggataaaaggtcgaaaatcttttttcaaggaaggaaaaatttcccacctagcaaatcactttcgaccttttatcctttcgattttttgtctttcgactttttgtccataaaccatttttgaattataaatatagcggtttatgtgtccggtacttggggatctccccctactttatttcggtaacataatactgctatagggagccagatcctattcttggcacttttgattcacttcggcagtggggttttttgaaagctacaaagctcatattcggccacaatatacgtcatactaaagtgcttcttattgcaaagtttcagacgattcggccgagagaaaccctccatgccaaagtgaatcatggcagtgcccaagtggttctgtaccctaccaggttaatctgaactaagttttaacaactgccatacattcatgttcatttttctagattaaatgtagtaggcacttttttttctgtctgtactttacgaaaaatcgttttggtgtcttctgcgcgattaggggaagtggtggcaaaatgaacaggggtggtaaaatgaacaccgtgccttgtaccggaaaaaaaaataaacaaatttcaaggatttttttatcacgcatggacgatttagagcataaatcggagtgttcgggttgatacggaggtcaattgaagttaaaatgtcaacgaaaactaagattttagaaaaccacgtttgaaaattagaactgacgtaacttttagctcggaggtcttgaggtttttcagtgaggtgaacatcgttatgatatgaagtcaaatctgatacttttacatttctatttgaatggattacaaacatcaatggatatactatattcgataatgcaatgaaaatttcctaaaatatttgtttggctcacgttttctgcatgatgttcatttttatcatcaacagcaattcaacaggtagaatcacatagtgctggtaaaatgaacatttgtaacgtttcttgctagcgataaaaagatgtgaatatctagctatttcagtatgaattcgtgtagctgctatagataacatccctatttttgatgttgtgcgatagaactatacaaattcctcgtttttctatcagaaacaagatgatatcctaaggtgttcattttaccaccccttcccctattcctgttcgtcgcacagaagacaccaaaacgattttaagtaactgcgatgatctacaagcatttttaacttccttagtccctattggcgcggtaaatggctgggcatggcgtaccattggtacctcgcgtacctgcaggaataaaatagacccctttgtgcggtccttagcctcttgcccagcaactcctatccctacctcctcgtggtactggccggggtacgagtaaccttggggaagatcgggtaaccaacccccggtgggaactttggtcgtatgctgacagggaaaggggggtttgcttttgcaaacctggagcgtctgtactccacgttaggagcggctcacaacagcgtctgttccccatgtcaggggcggctgatcatcgtccgagtgccagagaaggactctaagctaaactgcgcactatggccctccgaacatttagggggaatggtcctccggaaatctagggggttggtgtcaggccctgcaagccaaccgtgaaaacacatcagcacaggaacgtcaacgagagaatacggaccggaacaatcggcacagaccacagcgacgaaaatggactagcgattggaaactcggtacgtggaactgcaaatctctcaacttcattggaagtactcgcatactctccgatgtactgaagacccgcggtttcgacatcgtagcgctgcaggaggtgtgctggacaggagcattggtgcgaacgtttagaggtaatcataccatctaccagagctgcggcaacacacgcgagctgggaacagctttcatagtgatgggtgatatgcaaaggcgcgtgatcgggtggtggccgatcaatgaacgaatgtgcaagttaagaatcaaaggccgattctttaacttcagcataatcaacgtgcatagcccacactccggaagcactgatgatgacaaggacgcattttacgcgtagctcgaacgcgagtacgaccgctgcccaaaccacgacgtcaagatcatcataggagacttaaacgctcaggttggccaggaggaggagttcagaccgacgattggaaagttcagcgcccaccggctgacgaacgagaacggcctacgactgatagattttgccgccaccaagaacatggccattcgtagcacctatttccagcacagcctcccgtatcggtacacctggagatcacctcagcagacagaatcgcaaatcgaccacgttttgatcgatggacggcacttctccgacataaccgacgtcagaacctatcgtggcgccaacattgactccgaccactacctggtgatggtgaaactgcgcccaaaactatccgtcatcaacaatgtacggtaccgacgcccgccccggtacaatctcgagcggctgaaacaaccggatgtcgccaaagtgtacgtgcagcatcttgaggcagcgttgccgggtgagggcgagctcgatagggcccctcttgaggactgctggaggacagtcaaagcagccattaacgacgctgccgaaagcgttgtcggatatgtggaacggagctcaagaaacgattggttcgacgaggagtgccaggaggttttagaggagaagaatgcagcgcgggctgcaatgctgcagcatggtacgcggcaaaacgtggaacgatacagactgaagcggaaacagcaaacccgcctattccgggacaaaaagcgccgcctggaagaggtggaatgccaagagatggagttgctgtaccgttctcaagaaacgcggaagttctatcagaagctcaacacatcccgcaaaggcttcgtgccacgagctgagatgtgccgggataaggatgggagcatcttgacggacggacgcgaggtgatcgaaaggtggaagcagcactacgatgaacacctgaatggcgcagagaacacaggcacagaaggtcaggacagcgaaggcgatggctacgtcagcacagcggaaatcaaccagctcccacgatgggggaagttaaggatgccattcaacagctcaagaacaacaaagccgctggcaaggatggtatcggagccgaactcatcaagatgggcccggacaggttggccgcttgtctgcatcggctgatagtcagaatctgggaaacggaacagctaccggaggagtggaagcaaggcgttatatgccctatctacaaaaagggcgacaaactggagtgtgaaaattatcgtgcaatcaccatcctaaacgccgcctataaagtgctatcccagattctcttccgtcgtctatcacctatagcaaacgagttcgtgggaagttatcaagcaggtttcatcgacggccgctcgacaacggaccagatcttttccgtgcggcaaatcctccagaaatgccgtgagtaccaggtccctacgcaccatttgttcatcgatttcaaggcggcatacgatagtatcgaccgcatagagctatggaaaatcatggacgagaacagctttcccgggaagctcacaagattgatcagagcaacgatggacggtgtgcaaaactgcgtgaagatctcgggcgaacactccagttcgttcgagtctcggcggggactacgacagggcgacggactttcatgcctgttgttcaatattgcgcttgaaggtgtcatgcggagagccggacttaacagtcgaggtacgattttcacgagatccggacaatttgtttgcttcgcggacgacatggatattattgggagaaaatttgaaacggtggcagatttgttcacccgcctgaaacgcgaagcaacaagagtcgggctaatggtgaatgcgtcgaaaacaaagtacatgctggttggcggaactgagcgcgacagggcccgcctaggaagcagtgttacgatagacggggataccttcgaggtggtggacgagttcgtctacctcggatctttgttgacggctgacaacaatgttagtcgggaaatacgaaggcgcatcatcagcggaagtcgtgcctactatgggctccagaagaaactgcggtcaagaaagattcacccccgtaccaaatgcacgatgtacaaaacgctcataagaccggtagtcctctatgggcatgaggcgtggactatgctcgaggaggacttgcaagctcttgggattttcgaacgccgagtgctaaggacgatcttcggcggcgtgcaggagaacggcgtgtggcggcgaaggatgaaccacgagctcgctcaactctacggtgaacccagtatcgtgaaggtagctaaagctggaaggatacgctgggcagggcatgttgcaagaatgccggacaacaaccctgtaaagatggtgttcgccacgaatccggtcggaacaagaaggcgtggggcgcagcgagctaggtggattgaccaggtacaccaggacctggagagcgtgggtcacagtcgatgatggagagaagcggccatgaaccgagggaattggcgaaatattgttggcgaggctttatcaagataattgatgtaaagccaaataagtaagtaagtaagtccctatcaaaaagctacaaattgttacttagggttgttttcgactctaaaattcaaacagctagcaaaaatcagtgtgttgagcgaattcatttctgttgggcttaaggtgaaacagttttgcaatcggcttctaagattgcactaaaacttcaaaggcactaatctcgcgaaaaaaagcatccaacagtgcactttttattttggccttgtgcactggcagaaagctttatataagaagatcagaaacgtttgccaacaaattcttcagataagtgcctatgaaaacgtgagtaggggcacaagtcggctattgtgccggctttttttggatttcgagatgtttcaccttaaatgaaaggcaaacatgtctagattcagaaaccctcccggagatctgaatttggtcactgtggccaccggaaacctgctacatctgaaaaaaaagcagttttagaaaaaatcgtttaagagagccttactttgataacctgtagtttcgtaacaaaacaagtaatctgaaccgtcctcatattgttgaatagggtatacacgtggactgtgaaaagaaattctcaaatcatttatttattcataccctgttccggtaagtttccatagtagttttgtatatgtaattcacatcggtactattcggttgatggatattttggcataaaatttccggcgcacatttcctgaaaaattcggtccatgcagaaccgattcctggagtcccagaaggtggccaatctggacaatttgattaaattactcggatttaggccccaaaatcaaatgaattgttttcaattctctacaatttttcatgtttggatgtattttgccaagaggatgaatggaaggtttttctggttcttttggcgcaccgaaatggccaccgggaaacccgtaatatgggaccactcagcttaagcaccaaagctaggcatgcgacggttcaatcttcatgatttttaatccctgtgactattctagttcaattatagatgaataaccattttggctcttctggaccaccgaaataacccaggcatggccaccggagatacccgtattgtccgacattttagtaccattgtaccaaaactaggcatgcgacggttcaatcttcatgatactgaatccctgcgactcttctaattcaattaaagatgaatgactactttggttgggagcccagattgccgtagcggtaaacgcgcagctattcagcatgaccatgctgagggtcgtgggttcgaatccagctggtcgaggatcttttcgtaaaggaaattttctcgattcccagggcatagagtatcttcgtacctgccacacgatatacacatgcaaaaatggtcaatcggcaaggaatgctctcagttaataactgtggaagtgctcataagaacactaatctgagaagcaggctttgtcccagtggggacgtaatgctagaaagaagaagaagaagaagaagactactttggttcttcttcactaccaaaataatccaggaatggccaccggagatacgcgtattgtggaatatctaagttattgtaccaaaactagacatgcgccggctcaatgattatgaatacctgtgactcttttagttcaattatagctgaatgagcaataaataaatggtatattttattttccatgaaatttttattcaacgtaagcatttttacgcaataatttcatttcgaggttacacactacgttacactttccgcagttttccatgcatcttgaaaatggcactgaagtgacgggggtgtatcatttcgcataaagacgttttgcataaggacgtttcgcacacggaaaaacaacgaaaagtgatgaaatcaaaagttttatgtttcatgatatcatgactagaagtcatgaaaacttgaatatttttcaagaatttgagtgctccgggagttacacaaatctaacggtcatttttttcatcacagttaaagcgtcttttgtattcggtggtgttttcgagtgaaatgaaaaaaatgcgtgtgtgtgagaaggaacaactggagatcatgctcttcggaactttgctataatttcgatggaaatcttggtggcttgtcgagagtttccgaattgttttacgaccacaattgatttttgaaagaacattttgcatacaaacctaagcactggatgttcgtgttcctgctagtgatgtgacattcttggaggcactcattacggtttgaaatgtacgtttattcttcttctgtgacgcggttaacaatctgtctcccctgagtaaggggctggtggcccaaagaataatccgtcacgttttcttccaaaactactgacgcaaaaaccggaacgattacaatctatatgtttacctatcacaaatataaactggaaccttgattgacgtataatgtttgttttcatgaactgaattcatgattccatggtcttgcttcatgacttcgtgactctacttgccacttttcagcaacaaaatcggaatcataaatgacaggtatataattcatgaatagtgcttatattttcatgattttagatcctacttcatgattttgcgacttttgcacccatttagacacaccccaaatttcttattatcacagtcgaatctcgcatacaatttcacagtgaaaatatatacaagcaaggtctgtcataagagcggttgtttcagctttttgacaattgtccagttagcctacctacacactccgaaaaaatcatgtgattttaagtcttttggatgcacataaaagaagcgagccaaatgacgtaaatttgcgtcacgttttaaatacgatggtgtctgattcgggaaatgtcaatcatagtggcatcgttttcatgtccttcatcatgtaaaattacattttccgttcaatacatctttcagaacacatttctacgccatttcatcacttacataatgtttcattcagtcattatgtgaattacgttcgcaataattttcattatttttaagagtgtagttaaacagatcttgctttgcgcagttgtgtgatttgtgcgcaataaatcgtactgtgataatcgttgagtctaatcgggggaaagtgtcgcagcgaaattatgcttggaggaatgtcaaatttatcacagaaatctaaacattcgtgaaagacccaatatcatgaccaaaatttccacttttcatatcaaataaaagaatcataaggacatgtaacaaaatccatgaattgtgcttatgttttcatgaattttgttcatggttccaacatacatacatgcttcatggtttaaattaattgatttaaattaacaattttcttcgctactaactaaaatttatatatctaattatttgaaattagcgtgaattgaagcgtatacatatctagtacctcaaaatttgcaatttaaaaattttaattttcatttttgatgcgttattgaggaatctgtccgaacatcatgcgtaatttttcctttcagtagcgtatttaattcgtagccatatggaatcaaagtacaatcataaagcattccaatagtttcacagccgcagcactgacattaggatcttcgtaccaggttctaacaaatgcaacgttttttatgccactaaagcgagctgtttttgcataggtacacatgcgctttttctccattgaatgtagcatgcagcacgcgtttatatgaagcttatatgcgatcaaatcctgtaataaattattcaacatgctcatgctagtatctttttccgatactttgttccctcagaaccttggctgtcgagccggaatgcgaactagaacgtataggtactagcaatttccaaacgtcagccacaacgagcaaaggacatttccatactggtcccctagagagaaaaaaaagtatctcagcatttcgcatttttttcctagagattccatacatccaccgtacacgatggaatatttaaactctaaaataggttttgaaagtacaaatttaagtaaattacagtgatcccacgcagtggaatcacccacaatttatgaatcagctgatttcaaaagacaaaattattatcaaacttgtcacaaaacatggcagaattatttttacacatagtttcttatcagtgaaaataattctgtgatgttttgtgacaagtttgataataattttgtcttttgaagtcagctgattcataaattgtgggtgatttaactgcgtggggtcactgtatatgtttttttttcaaacatttattaagaaactcttactaaaggcctacgttatttcctgctttgatatttctgcggattacttcaaaatttgaaccaggttttttatcagtaaatcgaaaaatctcttaatattattagttcattcattttttttggtttactctgtttcttcaaaataacttcaaggatcttttctcaattacaacatccacgggaatttctccagaaattcactgatagatttcttagtgatgatctggagtttcccaaaaaccatctcataacggcgtgtctgcagctatctatttctctttatgactaataattggcccaatgctttcgtttgttatcattgtttcagaaggaagttccggtcgtccttttttgaactgcattttgaaattagtcgaaaatcgattgtattttgtgtaacaatttaaagataaatttgataaagagaagtcgattactataatactaaacgcaaaataaaagttttcaaatgagttcataacagaatttaggagttatttatgaagaaatgttctatgtaacaaaactcgataaattctgggaaacaatagttgttttaatgatttctagaaaaaaaatctatgaaagagaagaatctctaaaagaattggtgggtgtcacctcagaatgaattgaatacgaaataacatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagatttaacccaaacatatcttataaaaaaaaagagagtttttttaaaaacggttttttttgatttaacatgccagaaagggtttgcccattcttttattaaaggaatggtaatttatttaaatgaatttttttttattttttcctttttttttttgtttaatttttttttttttattgtttttttatttatatttttttatttatatttccgcgggggataaaaaaaaaataaaaaaaaaaaaaaaatttttttaaaaaaaaaaaaaaaaaaaaaaaaaaatatatatatatatatatatatatatatatatatatatatatatatatattatatatatatatatatatatatactgttccttgatcagtaattacacaattattgaatccataatcagtacgattattctacacgggcgtttgcttctggatcccccttatttcactgtttaagccgggataatcacactatttgaatatgaacagaagcaattacctgtttgttatgttattctatataaagatgtcactttcaactttgttttcaaacgtcttagagttttaagaaaaacttgttaaaatcatcttagtattcaccattatggtttaccgatgatggggagattatgtggactaaaagttttggttcaaattaccatggaacatgctgtcagacgatggtacgataaacgaaatcatagtatacactactccatgcgttactgaaaccatatgactgcatggttgaaatgaacagaccctaacaattcatatcagtacatattttcatcagtgtatgtgtaaaaagtgccgtcggggtaaaacgcaccaccgcaatatctcttagatgaaaggtatcttagtcaaattggaccattttacacgataaaaaagaacaaaaatgaattcttgacgcctttcacggaaaacatttcccaatttccacattaaaaaaatataaaaattaaaaaccattttggcaggctagggagtaaatgacgagacaagaattgcatagtaggtatctgctgcatacattagaatttggaaaaataagtgagatactcgcggcttttcttgctatctcaacttgtcgatggttcaaaaatgtaggcgctatcaagtttcttgaatatatgtattttatgaatttagtagaatatgctgattaaatcgccaacagcgctctacagtagcacgtactatgtatataactgcttgcaagcaatatcttccaagcgcattgataagctgaaattatgcttttgaaattttaacttttccgcattaagccttaaaactggttctggacttagattttcgactttcctatttgactcccatttgacaaccctggcacccttgtagaaaatagctggattttgccacgaaaaattcgttttgaactgcggttagctagcatgagccctagatacttaacttcatctgaccaatttattggaatccctctcatcgtgacaacatgtctacttgaaggtttcaaataaagagcttttggtttatgtgggaatattattagttgagttttggaagcattaggagaaatcttctatttttgcaagcatgaagaaaaatatccaaacttttttgcaatcggccacagatgacacgcaggcttcgtcatttggcggagaggcctgtgtcatccgcaaacaaagatttttgacatccctgaggtaactcaggtaagtcagatgtgaaaatattgtataagattggtcccaaaatgctgccttggggaacaccagctctcacaggaagtctttcagatctggagttctgataattaacctgaagtgtacgatttgacagataaccttgaattattctaacaaagtatgttggaaaactaaagttttttaattttacgatcaaaccttcatgccaaacactgtcgaatgctttttctatgtctagaagagcaaaaccagtagaatagccttcagatttgttggaacggatcaaatttgttacacgtgaaagttgatgagtggtcgaatgtccatggcggaatccgaactgttcattggcattttcgtttatgtggaccataattctgttcaaaatgatcaaactgcatagcttctgaggttttttcaaaattttagataatttccgaaagggcttagagccagggtccaattgagaaattttattttaaaaatttttgtttaataattgtgcaaaacgtttcttgatttctttctgcaaatcctgccatataatttttatagcaggatcgcgagtgcgttgaaattgtcttctcctcacgttttaaaggcggatcaagagtttaagatcatcgtctataatcacggattcaaattttatttcacattttggaattgcaatgctcctggcttcaacaatggaatttgttaaagtttcaagagcattgtcaatatcaagttttgtttgtaaagaaatgttagcatcaagattagagtcaatatatgtttcatatatattccaatctgctcgaaaataattgaaagtggagctgataggattgataatcgcttcatgggatatttgaaatgtaacagggtgacaaagatgactagagtcggttaagaccactatgggcaatcaggtggccaataatcgaaaaattgacttgttctgataggtttttgttgtacatcattacatagtaaacatttctattaagttattcctggaatatcagggcaagatcttttatattttaattgatacagtatgtcaaagttagagttttcaagaaaaatgaagaattcagtacaaatacaaggtacacgttgaatacaatatactgcataatcacaatatgttatacagatctttatacactatccgaaagcttattcaaaaagctatctaagaaaaataaaatgaaataaaaattcgtactttaggtcgaaaaaatggggggaatgcactgaaaaaaatatatttgattttatatataaactttacacatcccatacttttttgtcccaagttgtcccaggctaaaatttatttccaaggatactttgagatgttaactaaaggatagtgaagaatttagctgcacaaatttgcacttttttattatatggctttttgaatttttttcaatatttttaaccatttcctaataaaaacagacaaaaaacaattcagagaataaatgaacatcgctaaatcattcatataatcatttctatgtaagttctaacattcataatggtttgcacaacgttaatcgcataaatggcttatatgcatcattagtaacaaaacttattatttcgctataggccctattcaaaagttagtctcgaaaacttgtttttgaaaataaaacatcaaatttgtagcacaaaactcattaatacgacatgagatggaaaaaatatttttggccgccagtctgtatggaaaccgcccatagtgaagaccaagtcaatcgtagatggataatttcttggatatgattgcctcaatctaatggcaatgaacgagctcattcttgtgacttctctgtgaacacaattagaaaaacgttttcggttaaataggggccgtcttctcttactatgttttactgcatatatccagtgatgactgcagagcagcttaacaattacagccgaagatttgcaatttatacaaaaatcaataactaatttctgagacgtctgatttgaaaatggtctttgacaaagttgtagctgatgaatgtatcaaacctgcacaatactaaccttcaagagcacatgggcaaacaatacgactgattgaatgaaaattcttaactgctacggtaaatgaaatgtaatatgttgttaacaaaatgttactaaaagctttatttagttttaccaaatttggattatagtgttgtctaacaaaaaacacctagatataagaaatgaatgtgatgtttaaaatgataataataaagaaataaaaaataattaaatgcattcattgcttttctcatattaatccccatacaaattttgaagggtggtgcatagagtgtccatttcccggccattttgctcgtcccgggattcgggacaaaaatctttgattgtcccgggaaatcccgggatcccgggattaataaaattttcaataaaatactagttttcgttagaaatggaagtacaaatccaacaatacaatatttttaaatgaaataaagagataatgtagctttccaataattataacaaatcatatttcatatatggttttcgtattctgttgaagtaccttaacaaaaataaaaaacttagcttgactaattatgggtttgctaggatttttttcaaattctctataacacttatgtatggaaatatggtaaaaaaataagtcataatattaaagcaatttgcttcagacatttgaaaacttattgttactttaaaacaaaagccacaattaaagataattgaagatattgtagaatatcatgcttaaagttaaaaactgaaaattattgactgaagtttagatgtactttgaaatttgctttctcagaattggcttataaaaatggctaatgttgatttgaaaagcaataaggctacgtagcccgtccttcgttttggcagccatgttgattttgaagctcgcaatttctaagtgataaaactcagtcaacataagtaatattgaccataatcactacttgcgcttacattcagaaagcatgttaatactttttcagttatgtcagtgctaaaccaagcgattttctttaattcgcaatcatgagattaattagtcacaatcatcaatgcccagcacaaatttcaatgacggtctacttcgccttaaaactttgcaacaagacaaataaaaatatgtgttccttacatagtacattggtcttatcttgaaaataattactcttctcaatgatgcacttctattttatcaaataagaaaaatgtaattgtttttcattggaatttagtagttttcatcaaattctactacatttcgggaatcccgggattcccgggatgtcagaagtaaaatcccggcaaacgagaaatcccgaaatttgtcaaatcccgggatgtcccgggatggacactctagtggtgcagttcaagttttcatcaaaataagctcatattttgagaggactctcaaaaatttgacctacaaacgaatgagcggtgtgacgctaagacggttttttgaaccattctaatacataagtacaagttaaatcagattgaaacattgatttaatagctagaacacaatttgaaagttgttcatgttgataaaaacaatttacagatcgatcccatgaaaaatataacgtgattattgttcaaaacattttgatttgacgaatacttgccgtagaaatattgttttatctgaattcctaacaccaatcaaacgacccaccaccaaagccccctccatgacacatttgatctttttgtgtcgcatatttgtgtttaaagtacagtcaccccacgcagtcggaatcacccatgattatgaatcagctgactcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagtcacacaaatttgcagaagacaccaactttccacgacttaccgttttcgaattaaattaaaaagtctcttggttactaacttttgtctttgaacaaccctctgaaactctatgcaaaatgactgcagtgtaataattccctaacaagcaaaatttcaagttatttgtagttcgtcatccaaatttcagccaattcggactaccagaagctgagatacagcaccccaaatatgagcattttgtatggaaaaacagcatttggttactaacttatgtcactgactgtatatatatacatatatataaatatatttatatatatatatatatatatatatatatatatatatatatatatatatatatatatatataaatatatataaaaattactaaaaaatcagttaaattgattagcattccattactttaagaatgtacagagtcattcatgcatggtaaatccaggaatacagtgttttaaaaaaaatctcacatatattttgatatatgttatggtttaatctaccatctttgttgtaaaaataagagaaaattattgttttcaaaaatgagttgtcacttcttcaacatttagaatgtaaaatttactaattacgcaataaattatttctatcgtgtttgtttactgtccacaattttatctttcatttgtatttctaaagttaacatgcgggaaaccaataacaagtcgagcactcgacagtctgtaagtcgcagacgaaataggcctatctgtcagaataagcaacatattagagtttaaaggtatttgctcgccttactagtgattttagtattttatgttttgcaaaaagtgaagcgttaaagctcaattagtagttttttaacagaaaaatcggcctgtccgaaatttcgatactataaagcccaaattttactctttcatttgcaccaaaacgaaaaaaatcggtcgggagttagaatattttttttaatttttttacggattttgagatgtaccttcatatttaaaatgaaaaataaaatactctagcgtagccgtggggccttccttagccgagtggtcagagtccgcggctacaaagcaaagccatgctgaaggtatctgggttcggttctcagtcggtgcaggatcttttcgcaatggaaatttccttgacttccctgggcatagagtatcatcgtatctgccacacgatatacgaaggaatttctttacttttcttgagcggaacagcatacttagcttaagtagacaatttgtagcttaacatctatgtcaagcttatgggaacgcattttagtgaactattatgtttgatctctacttttagagaactgaaacggtatagtttccaacaaatctatagccggttcttcagggcatcaaatcggattggccacatctggtacattttaaacggcccaaaaatcatcatttatgatgttttatatcaggtattaatgatttatgccaattaaaatgattgcgagtgggtacatttgatgattttccgttagggaaattccggaaacgaccgttatcgtaacggatattatctttcatctgcctggcacgagcctcaacgactctcttgcaatcccaaaaatttgacttatgcttggccccgcaattagagcatataaacttggtggcatcttccttcactggacaggcgtccttagaacctccgcaaaacatgcatttagcatccatgtggcaattttttgtaccatgaccccacttttggcaccgacggcactgagtaatttcctccaggtttctggaaatgttcccatgtcacacgtacatcgaacaaaagttttgctttttctaaagctttaatattatttagttattgtttgttaaagtgaactaaataatattcttgagaaagccctttccgaacaatgccagattgggttctctttttcataatgattacttggactgggaaaaatccaagtaaatcacttattccatttttgatctcttcaggtgacttatagtcacttgagagacctttaagacaactttgaacaaacgttcagttttgtcgtcataagtaaataagaaaatgtgcttcttctcttcaagatatttgagaataagttcgcgatctttaagagtttccagcaaaacgcgacagtctcctttctttgcgatttggaaggaaaccttgattcccttaatggagttcaagatctcctgcctaaatcccccaaattcggaacaactgaccacgataggccgcactctttgcttcctcacttgaatcaaagagcatgggctagaggctgcttcgatttggtgttcggaaaatttgtctagagcatcgaactgattgctcatttcgatacatttatcaacattattcatttcacgcttggaagaaacttcgcattccggttaaaacgtcctttcttccattcttgtcacgtttagtaacagttttaaatcccaattttttggaaggaacttgtgaattcagagattcacccttccctttgtttgttgttgcaaccatgtttagtggataaacgaaagaagacgtgaccttcgagaggttttgtcccaagtcggtgtccaagaaggattaccaccgctagctttcgccaacgggtccaacgaaaaatcgaaggcacgggtccaaacaaggatcgtaaagggatcaatagtagaaaaactagtactgaaaagttctgtttttgtagtactgaaaagtactgttttattgctttagatagtttttaagaaaacttccaagagcagagagaattcgtgtacgcacagcacgaaggtacgatgcgcacgtggccgcatctggggatttttttttattttcgtacgggtttgggccgaagggtctcagattttcatgaaactttttccacaggcagggctcatcaatatatgaattaaaaaaatttgagagaaattcagggtcgcttattttcccggaaaactcagttggaattttttgttttcctctgacactacttactttgaaaaatcataactcaagaacgaagcatcgtagaaacaaagttttttatgaaaatgaaagcaaattttctcaggaataaaaaaaaatattaactggaaaaattttccaccgttgagaaaactcgtaaagaaaagccggaaaaactatgctccaactcgtggaaaattttcaaaaaaatatttttgagaagataatttcataagctttaatcgttgaaatttttgaaatgtactttttttttcgtttttgagttatggccaattttgtaaaatatgtgcaaatatgtcattttgagctttttctttgaaaaatcacaactcaagaaagaaacatcgtagaaacaaagtttttttctaagaaaataaaagcaaattttctcaggaataaaaaaaatattaactggaaacagttttccacaaaattttccaccgttgagaaaattcgtaaagaaaagccggaaaaactatgttccaacaagtggaaaactttcaaaaatatatttttgagaaggtaatttcataagctttaatcgctgaaatttttaagatgtactactttttaattcctgcgtttggtcatagttttgtgaaaaatgcccagatttcccgtacaagtcttttcgttcgaaaatcataactgaagataaaagcgtcacagaaacattttttttgccaaatcagaatcaaattttctcaaaactttgagattttttgaaatggaataagttttcgaggacattttttaccgttaaggaaaatgaataatgataacccgattagctattccagcttacaaacaaagtatatttgagaagagcgatcaatcctaaacattttttaaatacgctcatttttcgttcctaaaacatgatcaaatattgccaagatgagctgtttacaaatttatacatttataagtttataatgcttattttcaaatttataagtttataaacaaaactacttaagaacgaaacagcatagaaacaaaaatttcttcaatcataatgtaggcattttttccagctacctgttaggtaactacaaaattgacagttaaatcaatgggtagacaatatggcaattaggtatttaccaattctggtttaaagcgttgaaatggcttgagaatcataagtttaccaaaaaactaacaaagggcagtgagaaagtgcaagtgttgtcagctgtatattactagttattaccgaaactgttgaaatggacaaagttcaatactacgaatactattcgctatgctgtaaccccttcggactggacggccacaaatcagtaaggacaaatttacgatcgattagccctggtctcatgaccaagtttcattcgaatggagttcggtggattacggaaaagatgaaaatctgcatgaagtgcatgattatgattaaccaaaccagaacgaccaataaacgtatgatttaaaaaaaaaaaaaaaaaaaaaaattaaccagaaacgaaaatcttctggtgttagcaaccaaaaacaatcttctcggttgaaaaaatagatagtattaagatgaaatgtaagttatatactgaataaatgaataaataaaattaaaaaaaaaaataatcttatttgttccatagaaaagaaagaatcccttttcagtgtaatgaaaaattgaggcagaaacagttttttttttagtttttcttagcggtgtaatatttcatgagaaatatcatctattccgacttatacttcattaaaaccaatcccatatctttttttcagatgttttagaaaatttgcaattgctttgataaaaaaatctttgtttttccgattgaaatatgggttttcaatgaaaaggcttatatggtcattttccacaaaattggccataactcaaaaacgaaaaaaaagtacatttcaaaaatttcagcgattaaagcatatgaaattatcttctcaaaaatatttttttgaaaattttccacttgttggagcatagtttttccggcttttctttaaaaattttctcaatggtagaattttgtggaaaactttttccagttaatatttttttttattcctgagaaaatttgctttcattttcataaaaaactttgtttctacgatggttctttcttgagttatgatttttcaaagtaagtagtgtcaaaggaaaacaagaaaaatccaactgagttttccgggaaaataagcgaccctgaatttttctcattttttttattcatatattgatgagccctgcctgtggaaaaagtttcatgaaaatctgagacccttcagcccactttgtacggaaataaaaaaaatccccatctctcaattctcagctttgaacatgttctagatactgggtttgccgtagagttgggcgagctcgtgattcatccttcgccgccacacaccgttttcttgcatatcgccaaagatcgttctaagcactcggcgtttgaatgttccaagtgcttgcaagtcctcctcgagcatcgtccacgtttcatgcccatagagttttaccggccttatgggcgttttgtacatggtacatttggtgcgggtgtgaatcttttctgaccgcagtttcttgtggagccattgtaggcccgacatccactgatgatgcgccttcgtatttcacggctaacgttattgtcagccgtcagcaaggatccaaggtagacgagctcgtctaccacttcgaacgtatccccgtctatcgtaacaggtacaggtctgccaccttttcaaatgttcggccgacaatgtccatatcattcgcaaagcaaacaaattgactggatatcgtaaagatagtacgccggctgttcagcctggctctccgcataacagcttctagcgcaatattgaacaacaggcacgaaagtacatcaccttgtcgtagtcctcgatgggatccaaacgaactggagtgttcgcctcaaattttcacacaattttgcacacctcgtcgctcttacagctcttacgctcttgagcttcttgggaaagctgttatcatccatagttttccatagctctacgcggtcgatactatcgtatgtcgccttgaaatcgatgaaacgtgatgcgttgaggatttgccttacagtaatgatctggtccgttgtcgatcagcattggcaacttcccacaaactcgtttactacaggtgacaaacgacggaaaatgatctaggataatactttgtaggccgatcgaaagttcttacaatctaacttgccgcctttcttatagatgggacatattaccccttccttccactcctccggtagctgttctgtatcccagattgtggttatcagccggtgcagacaaatgaccatctccgataccatccttaccagcagctttattgtttttgagctggtgaatggcatttttaacctccctcaaagttctctcagcgccattcaggtgttcgtcgaagtgctgcatccaccttccgatcacctcacgctcctctgtcaaaattctcccattcttttccctgcacatcatgcctcgcagcacgaagccgttgcgggatgcgtttagattcttatataactttcgtgtttcttgagatcggcacagctgttctatctgccgtttccgtctataacgtcccacgttctatcgggtcccttgctgcagcttgaccgcccgcgctgcattcttcttttccagaatctgcctacatacctcgtcgaaagaatcgttccgtcgactctgtcccacgtacccgacgttgctctcaactgcattgttgatggctgctttcgctgttctccagcagtcctcaaggggagcttcatccaactcaccctcttccggtaatgcagcctcgaggtgctgcgtgtatgcagtatacgttgttaacgacggagagttttgagcgcagcgtaaccatcaccagatagtggtcagagtcgatgttagcgccacgataggtcctgtcggagaagtgccgtccatcaatcagaacgtagtcgatttgtgattctgtctgctgtggtgatctccaggtgtatcggtatgaaaggctgtgctggaagcaggtgctacgaatggccatatacttggaggcggcgaaattaattagtcgtaagccgttttcgttcgtcagccggtgggcgctgaactttccaatagtcggtctgaattcctcctactggccaacctgagcgtttagatctcctatgatgattttaacgtcgtggcttgggcagctgtcgtactcgcgtccgtgatgtgcgtaaaaagcgtctttatcatatacgtctataatttttcatataattgaatgtcgtttttcagttttggggtaactttgataatgagtatgttaacgcatggaaatccgcaaccaaactattgtttgatatcttttcaattggaactggattggagaatgttaattaacaacatggattggattgattgcattaaaatacataattctctaaccgagctgttttgaggcgaaaaaaacatgacaaacaccatcactagtgtattagaatttatataaaattatatttttaaatagatatcgattgagttttctttttcgaggatgaattcgtcataaatcaatcgttttcgaaatataaattagtatattcctaacaaaatcgaattctcgttttcatctaaaatagctctgacatgaagcggcatactaattctctttactcttgcatttgttttgtttaactgatttacagaaattatgttatttcgttaagtatgttgcgggtcccgctttatcaaaatcacccacattgtcaaaatcttacggtacaaaatacgctagtagctgaactgaattttattcatttttaatcagaataaaaagtgtagtattttctcaaggtttatgattcatttcgtcaatgtggtatatctacctttatttatttagtccgatcgcaatgaataaatgggtcgctcttaattaacgtttcaattatgcatgtgcttaaacgaatgttatttaatttaatcgttgcattgagcctgattatgttagatcattggcgttcaattataaaccaatatattcaatacaatctactttcgaatacgatctgcttgtatttctacataaacgatgtatttactgttaggctggtgattaattttaaataattttaattaaatttgcgggttaatcacgaaaggtaaagttgaccacacaaatagtcatcacatccttccactcaccagaacgaagtaaggccacatatttcccccatatctgtgtgtcgataaatttaccactgttctgaatgatagaaaaataattgaatgcatacacgtggtaatttcaaatgattggtggaaagtatttatccacagatctgcacaggcgcactatttataatagtgaaacttgcaacctgtttacagtcaaaacgttcttgcgtttggtgtatatacatttcaaattgtgcaaacgttgctgattatttatttgactgcaacgttcacttgcaagcaatctctcacgctttcatgtagacatatggatgaagatagaacaattgagatcaactatggaaagttgtcgtaagggtaatgacgcccacgcaatattgtgcaaggatgagacttgaatatttaatttttaattaattgcatctatggacgccgaaaatgcggatagtccgtcattgaattaattacatttagaagttgtcatatgatgtaaggtttctaaaattgaggttgacagagtttgtcctttaaaattgagtatgtagctgttttacatatattcgtttttttattgtaaatttttatgattatacgtcaatacgtatttgaaaaagaaaaaattgccatttctggatataaatccaggtagcatgagtgggagttctctttagattgtctaatactcgtatatatcgccaacaatgttttgtcacgctgctgcagctactttttttttttagcgccgactactacattaccagtatgccatcgactttcaagtttccatgccgtttttatttataatgtttcaagcgaaggaggacatacattttcaaaccacaacactcatatttgaagttgcttttactattgatactgccgtgaatcgcaagtcagtgccatttacattttcgtcaaaattggcttgagttcactttccaacatatcgtctaaagttctttcagctgcactagtgagataatatgatttgttcggaaaaataggaaaaaaccagcatgtcaaatcgtcccataatgaaaagtaatcgcatatcagtcccactacagatttccgcgtgcttttaacacaaaaattgacctttatcttggagggattatttttggagagacttttgctggagagatatcgtagtgacaagcaaatggcgaaagtttcattaagattttaacatgttacattcgtatagaaaacgattttggaacttcacagcccattttctcaatgcctactttatacagatgggactgacttgcaattcacaacagtatactgcccataaaagcataactgtcacatatggaaaaagtaggcattccaaaaatagcgccaaaagtttaaagtttctcctctcatacaaatgtttataactttctagtacatttctgcacactttaattgtttagcatcaccgctagctaactcattttgcttccatttatcagcaaaaatataaacatgaacataattcgcgtttcgcagttgatgtcgaggtcgagttcgcagttcatgtggaaactgttaccaggataaaaaaacgtaccatggaaaaaaacaattaatgtacaatataccgtattttggtacaatacagcgtataaaacattatttttccagtaatctgctatttttgttgtcaataaaaataaaaaaaaaaacattatgagggaatttacgtattctcggcagtctaagccgatgccgctttttttagttatttttttcggacataagcagacaaaaaacgtgtttgtctgtttacatttatgcgctgctcaatcctctatagattcccaccgacagaattggtcaatactttttggaaatgtttttacaacgcttcgaacatatcatgtcagaatgattaatgtcggctgcctcgtttctttcggcagcctctcccataagaactgctggcaaatctatttggaaactacaaatcagccgcgttttgagacgcatacatttgaattgatcatatctctggagaaattttttattcggtctcgaaaatttcgtcaagagaaagataaaagaacaaagaatcttctgaatgttttcattgttgtgtattgatagaaaaatactgtgaatttgaagtttctcatcgttataggttatttttcatcacgctaatctgtcatgaaaagacctactttcttgcaataaattatgcagtatcgtaagatacataaggcaagtgctttcatttgcgtaatgaccattacacaacgctttttcattacgcaactgttttgagttgcgttatgagagaccatcagtgcactagtatccactcatgccgctatttccgctcactagtgtaaaagtagatttttcgtgtcaaaaaccaacatttttcgcacagatatattctagcaatattaacaactttcaaatgaagtcgtctgacattattttcatttgcaaaaataattctttatattaaaaaaacaagacctcgtgagcggatgttggaccactaggtatttttgtgtgttccaataaccgctcatgcaaaaaaataataaacaaaattttaaagaaatgtcgattttagtatacagccttctttattgcattagtagctatggtttgaccataaaaatatcaggatgaataacgaaatttgaaataatgcattttttagtaagttcgtcacgaaatctgtttaccgtgagcggaaataggaacactcagatgcagtaacaaatgcaaataaatatttttttatgaaagtttctttttatttttccgccgattacctatgcttggagctacattgtgaaataaaaatagtattgatcgacacaatagttattttataataaacatttgaacacataacttaccttagatgagcggaatctggtgcactgatggtattgaacaatttttctgaacttgctagaaaatggtgaacgcatctggatatgatatggtatacccttgagtggccattttcgaaattgcaaaaaatgttgtacgcaactcgttgcagaactggatttttacagcactcgccgtaattatccaactcggcaagcctcgtttgatgaatgttcggcccgtgtattgaactagtatcactgtttcacataataccatgtattcagtgtgtctttttttttgcagtgtataaccttcgatcaataaattaaatacgcagtttgtaatcggtcgggtcgcgtttttattccgtcggattcctagttattccggattgtttaatactctgcgaattgtcctcccacaggttatgggcccagagtaagcgccgcgagtgatgttttggccgaagtgtgatttcttcgagaaatagaaccaaaagttaatctcgtcatcgatcgcagtagtgtgcttgtagccaaaacaagatagctgatcaggcatggtttcaatttccaaaattgaataaccacaacttccagacgtggaaattcaagatggagatgatgctgattcgcgacgaactgtggtatgtcatcgatgagaattggccggaggcagcatcggcacaatggataaaagacgatagaaaggctcgcgcaacaatttggttgtgccttgatgacggtcaactgagtttggtacgaggtgcagctacggccaacgaagtgtggactgcacttaaaaagtaccacgataaggcgtccaatgtgtacttgctcaagaagttgacgcgactcgaattgaacgacgaccaatgcaaacctttagcgatagtgcaacgaatcgcggaagtaggagatgaacttccggcgagtttgtaagttgcgatgttgctgtgttcgctgccggactcctatgatccgctgacgtgaagaattgacgttgggtttggtaaaatcgaaattgttggcggaagcggagaagctcaaggaacggtacttcaagtagcggaaaagcgctgaaagtaggcaatcgtcgtttccatgttggaggatgtactagcattaagaaggatgttcgtgtttgttttcattgtgaacaacctggacatctaaaacgcaactgccgccaatttgcgaaggaagccaacaaggaggaaaattcgaaccaattgaaaaaggaggataaggcgaagacaagtcaagctcaaagcatgtcggatggaacgatggcgtggatggtcggccatggtgagccggcagattggtttgttgacggcggagcatcacgacacataacgggaaaccgaagcatcttctctacgctgcacgaagcaaaaatagccagcgtaatcctagctgatggagaaaaatcttatgttcgtggcgtcggtgaagaaagttttgatgtgatcgacggtaacggagaacccagtgaagttttgctgagcgatgacctttccgtaccccggattaacctgatctccgttagtgcacttatcaagaaaggatttggtgttgtcttcaatagcagcgggtgcgagattcgaaggccaaacggtgaagttgtagcagtagcgggttgttatgacaacatgtattaattgtgtacaattggaaaggtgatggcaacagcgacgtcaagccgtcgcacactcccaattgtttgcatatatggcataggcggttggggcaccgcgatccggaagtactgcgatctatttccaagaatggcctagctcatggaatgaaggtggtcgattgtaacgggcgtacggtatgccagtgttgcattcaaggaaagatggcacgcaagccgtttccgaagcagtgcgacagaggatccaaggcgatattagatgtggttcacatggatctttgtgtccctatggcaagtacccccagtagaaatagatatttttgtcaatccagctttctacgcttgcttgctataaactttgattcacccccttctgacattacttgccaacactatattttttatggctgagtcgtagtaagggatggtgcacaaattatgtcacgctaaatttctactttttcgatctttttgtatgagtccttcgaaaattttgtaaggcttgtcacgcttggctcgaccccctccccctcccctccccccttagagcgtgacgtaatttgtgcatgacccctaagctttgcgagtaatcattaattttatgttgacaaggtaacatcaatttttttcatgttgttgtttacgagaaaatcgaacattatttttattttcttattacctccatactaatggtttttatattttaggttttgtggaaacatgtgagaggaattggcttcaattgtgtctgtacaatgaatgctgttgatataaatgttgcgaatgagttaccgatggaactaagaaaatggtaccagaacggttttgttactaaacatttagctattgaacgaatttagtgcctgtgtagtgtacaacagagaatgcgaaatatgtttactaaattatacagcttttgatgaatccgtgactattcctgccagttttttatagaactcttgtgctctaaatgttacgatgattcgttcattgagacgttccatgagccaataaaagacccctctatcccttcttgcatcctcctgtcatgaacagttcttcggtatgttccaaatcatacaacgttggttatacattgcgtagttgataaccaaaaaaaatttcgttgtacgtaaccaaaaaagaaaaattttcgaacatcaaagatctttttttcttgcatacatttgatatctcattctgacgatctttcaccaaaatttcactaaaacggttctatgctctcaactaagactcaccatgtagagataatcagcgatacgattagatcgtttttctagaattgaaaacacattagagcacactgttcattggatcattagttagatttaattttttccaaaaagtttacgtgatttatgaacggtttttaaagaaccataactcgagcggaactaggtatctaaattttgttccgaagaattaagccaaaaatggagtgcaaaatattatgtgccgtaattgaagcttcaattcattttattagtaaaagtaaatttttcctcttgtagattgaaaggtccttccgtgccggttgcctaaaatggtatgaaaagactaaagttactgtaaatcattgttgaatgtttgatttagtttcttcgatatacaagaagttgaactccgaaacaaattccgtgaaaattattgacatctcgatcaacaatttgaaacattgcctactgagatcatgctataaaatatgtgagcaagacatgtcaaagtcgaatcacccctcgcagttttatagccagcgtgaaaagctggatagttgataattctcgaatgtcgttcacatatatggctatcgaatagcagagatgttctggacgctttaggcgaaggaaaacccggagaagataagagattcgcagtagacaaacaaaacgattacgagcgggtactcggactcttgtggttgacgcaggaagacgccttcagtttctcaactgcgatgaagcaggaaatcagtgatctgatcagggctgacgaacatcctaccaaaaggcagatgctgaaatgtgtaatgtcgctgttggacccgctgggcctattgagtctgtttgtagtacacgggaagattcttctacaataagtctggagagaagggatacagtggaatgaaaaggtgaacgaagaactgcatcaaaggtggaagaattggataaggctattcgaagaggttcgcagcctcaaaattcctcggtgttatttctcatgtgccaccaaacagcgataccaagatctccaactccacatatttgatgccaacgaatctgcgtattgtgcgattgggtattttcgtacgtcgaacgctgatggaatctccgaatgcgcgctcgtcgcagtgaaaactaaggttgcccctctgaaaacgctatcaatcccccgcctggaactgctgactgcagtactaggcgctcgtttgtcgcagtttattgtagaaaattataccgtacgcattacaagaaaagtgttttggagcgattcagcaaccgtcctctgctggctgcgggctgatcatcaacggtagaagcaattcgtcgcatgtagagtgggagaattgctgacgatcaccgatgtggaaaattggcgttgggttcccaccaagcataaccctgctgatttcgctacaaaatggggaaacgggcctgacctaaatgcgaactccatttggttcaaaggtcctgcgtttcttggatcatcggaaccggcatggccggaacagaaagtgaacaagccatcaacagaagaagagctacgtccctgttacactcacaaggcagcacgtattccagaacgtctcgaggaacttgagccgttttcccgattaactaaagcaatccgggctaccgcttacgtttaccgtttcgtggaaaacctaaagcggaagatcgcacgatgtgaaagattcgttggtccactatcatcggaagaactccaaagtgccaaaaacctacttattcgagagacacagtggcagtgcttcccagatgagatgacggtaatgaagcacaatcaatcgaagtcgataacgaaaatacccttagataaaagcagtgctcttcatcaattatgtccaattctagatgagcaagccattattcgcgtcgatggtagaattggagcggctccaaatgttgacaaggaaacgaagttccctgtgatcctcccaagcaaacacaaatttacgatgttgttgctggacaactaccatcgtagattcctgcacggaaacactgaaactgtggtgaacgaggtgcggcagtcatactacatcccacggctcaggatggcggtcaataatgcagccaaaacttgtcaatggtgtcgtatctacaagagcttgccgaaaattccccgcatggcacctttaccattagtacgaatggcgtcctttgtaagaccgttcacctataccggcttagatttctttggtccgctaatggtgaagatagagaggagttgcgcaaaacgctggatagcctttttacgtgcttgacaatacgagcggtgcacgtagaagttgctcatagcctgactactgattcgtgtgtcaaatgcattcgccgtttcatctgccgcagaggagcaccagccgaaatctattcggaaaacggcactaattttgtgggagccgctagattgctgaaggagcaagaggaacagttggccgttacctttacaggaacggcaaccaaatgggtgtttaacccacctggcactccgcacatgggccatagtgatttttgtttcgttgcctttgttttcctttgttttcgaacggtcactgcgtcacacgatcgcgaaatgtcaaaagctcatggtaaacaaaaaaccagctgatcgcagccaatgtcctatataacaggtttgcttgtattagtcacgaaaaagatgtaaacaaaacgaacagctgatggtgacgacaagtatgccaaaaaaattgttcgcagcttgccaatatgacgtcattttcgtgtaacttcgtgaactttcggcttctcgaagttggcattgcacaactaccacttcaaaactgatgttatcacaaatactaatttgatcttcgaccgcacttctcaacaccccacatcggatcgcagctgtctcatggattgctttatatgagactgcaccattgtcatgtttttccacaatatttttaattaaagtgttttaatttttctatgcatagtaaagtatatattaaaacacaaatattgcggcaaaaatagatgttggttcgaaaatttcctctgattttctttaataaatctaattttaaaatgtgcaaacctcaaaatgtgattgcttcagttttatctagatgccacgtggcaacagttgattaattgcaattgtattttacggaacgagccccacttcttgactcttcagataaaaaaacaaacacagtaaagtaggatagaagtacgagtacgggcataagtttttttttttaatttctagtcaattcaaaacaaatgttagaaatgtcatggtggttcgaacactatccacgaaagagactttgactccaagtattacagaaatcaattcagattttgaaaagttttactatttgttagttttagacattaaaattgtaattttcagtcgaacttccattgcaggaaaaatatgaaaaacaaatctttttcgatttttttttgtaagaacattgttacacaccattttttcgctgaaatcagcagtatttagctggaatttgccgagctgacattttcagcaaatcaaattgctgagtttcagaagaaacctgcagaattttcagaattctgcactgaatatcagcaatttagttgactgaaaatgtaagctcggtaaatttcagcaaacatataatttggtatgaaggttactttttgtctaaatatttggaaaccagttttggtccatagtgagacaaaatttcaaatcagcagggcagaagttctagccatatattatttatttatttatttgacaccggtatacagtcgactctccacatctcgataccgaagataccatcgagatagggagagatcgagatagatcgagatatggaaccatttttttcaatgaatcttcttcttcttggcattaacgtccccactgggacagagcctgcttctcagcttagtgttcttatgagcacttccacagttattaactgagagctttctatgtcaaagttaccattttcgcattcgtatatcgtgtggcaggtacgatgatcggaagtcaaggaaatttccattacgaaaagatcctggaccgaccgggaatcgaacccagacaccttcagcatggctttgctttgtaaccgcggaatctaaccactcggctaaggaaggcccctttttttcaatgactagattgaaaataactccattaccaggaaaattagaaacaaacagacgtcatattgtctttgcaacttgttttgaatacttaaattccagtctagtaacctttgataatgggctcggggatggaattcgatcccaggtcctcggcatgagaggcgtgagttctaatcactacaccatgcccgtcccccatcgctgaaaattaataatttcacacctctaattctatgaaaaaaataaaaatttcactaaggagttcaagcactcgacactgaaaaagtctgaaagtcgcagacgaaacgatgaaggataccccttaaaaggttagagctttaagataatcactgtgtttaaggtggagatgcatcgaagccaaacctcaaatttcaagagcacaaatctagataaccagacagcgggttgagctgaaaacttaatcgattggtcacacgctggtggtgaccaaacgatgaagttttcagcttgaacggctgtttagttctctagatttgtgcttttgaaaattttaggtttggcttcgatgcatcttcaccttaatttgacccgatattgaaaattgaatcagttttattatgttaacagatacaaataacatagaatttttcataccatacagcaaaaagatttttttttgtatacgttgatcttaaccacagatgtgtgtaagtgattatgaatttccaacaacatccaatactatgtcaagatttcatactccgctatatgattttaaaacttttgacgcaaacctcaatgtaattagtatgatagaaataactattattatcgcattaaaaacagtcaatatctggcgaaatttcttttttgataccagtacgatgttttttgtaaaatctttgaactttcggaggttctattgataaaatatgttatgggaaacattattcacgaaagattagacaatattcaaagaagctttacatatccaagtgaaaatgtggaatatcttctaaaacactactttttaaaatgaattaatttagtattgtcccataaaattgaacaaaaattaaaattatttagaatatttgtaaattcagctttatcatgaaattttcaaaataatttgtttaataataggaatcctagagaagggaaacagaatcgttctgttaaacactgatattaacattatttaactactagtttttgtaaagctgtaccgcgttcacaaaatccaccttttcgttctatgtttttttcagagtcgattcttggaagatgcatcaataatgtgtaactcgtggtcacctaggcataatgtaagtatgcatttatttattgttatttattgttgtcaattccaatgtgaattgtattcattagagtaacggaaataataaacttttgtaggcgtgccaactctgttgcttactctcgcattcggctgagaatgttgcgtaccctggttccaaataattaatttcatagcgtaaccaagaaaaatgaacatgaccaatggcagagaaaaactttatctgttggttaaaaatgttaataatacgaaattgagatgtggacagtacctggacaactgagcgttactcagtttaggaataaggcagcatctattcattacgtaacactaaaattactaatttttgaaacaaaaatgttgctgtaggggatttgtgaatctcacacaaaaatggttagaaggagttgatgagtctacatcttttgaacatagatagattggtcacagtaatatcaggcgtccgtgtataagatcttacgatagtgaagtgcagttcaaatagctattacaccccccttaaaggctgcaacctaggaatgttcacccgcctccgtttctattgaaagacctgaaatattcatccactttaggacctcttatcttttcaataaaacggtctacacatggaggctcggaagtcaagagggttttcgaacctaatagcaaaccctcgttcgaacccggatgaatccctcaggaattcagccttaaccatcaaggaggctcctttctcggtatggtaattccggtatcgtcctaggccgtgtcgatttcgtcagagaagggagatgccttttcacaagatctacgtcagctacgcccgctgaatgccgccaattcatcatctcactaacccagagtggtttgtgaagcaataacaataaactttttaaagcagagattcgagataatggcactagcgtttacaagtgtttatttttgggttacaaaaggcatagtggcagtgtttcgagatggcggtacaaaccatcaaatttggttttgccgctccgattttcgaattgttgatcgaaattttattgaaagaagagtgactatttgcagacgaattttgaaaatggaattttgtgagtttgttcagctctgtagctaattgacaaatatacaagtctcggtaagccaatcgggatcgccttagagaccccccactcaactgcctcagggtcggcacgctcacttaagtctactgcggacagggaatcttcgcactagatatttagggaaaccaacaagaacttcactttgcaaaactcctactttattgcttatactatcacagctttatatgggctacaaactcctcatcactacccacttttcccactttattattcgttaatctgacctgttcactacttggggcctcttcttcttcttgctaccacctgttcactcctttctcttaacctggtaacgatcatcggcgttctcctagcgctgcttcctgctccggccacgctcgtattggcttggtgaacttcggcagcagccttctgggaccctcctacgtgttttaggctacggatgtagtgacgtattggtcttcggctaataacgatgccggaatgtacccagaatagggctctagggcggcgtagggcagtaatagaaatttatggttgtataccaaaaatggcggggtcctgattttcacttctatacactttttctcacccttcttcacttctaactctttaccatttaaattaaagtaggagcatctggggtaatgtccactcccggggcaaaatggctttttagggtttatatgaatattttgaaaaaaaatggacatttaccgcggttttttttctgataaatcgtattttggggtgccttactatcagcccctgatgaaaaattgttcaaaattacttcgcaaatagcctaaaagagcaccgtgagtcgttttgcctcaagggtgcatattaccccaaattccctaaatcgttttttaaacttgcttcttcagcagactccgggtacgttaacgatctgagttttagcttttgccttccaggttcttgacctgcctggccggttattatcattcaatggcccccaacaatggtcttatcaacaatggcccccatttctccactcctcatggccgcccgaaagttctgcttccagacatctggtggtgggttttagaagcgcgttgggtggcagcctgtgtggttaaggttatttgacatactactgccctacttgtatgtctagtgggtctgctagggaaacctgcactactaatacaaacataacctgtcatacatttttacggaacaacaaaaatacaaaatcttctcaacactatcaatcaactaaccagacacatacaaatattatttaagttttggaactcgttttccatacgaatattcaaaaaattccagaaggttgttacatgttccaatcttaatgaaattttcacaacttgcttttgttagaaagcagatacatcacacaccctgtagcggaggtgtctggatattaacatattgtaagatagaggtaagagaagatttgtaataccagacaatgaataaaagagaggtgctgacgtggtagcaatatcagacagtagcctgcggtatggagcggaaaagccttgttgttttgtagtcgttttatttcaacagcttttcactacacagctaaaagtatgttgtaaatttcagtttattttcatgcacatatttggagcatcaaaataaactgaaatgccaacgacaaattgcttattttttaatcgaatacactttaaatagggtcctaaaattttaaatgaaatcttcgctttggtttggcatccagtctcataatagtcgataaatcaagctaactccaagatggccacgaatccacattaaatgaaatcttgtttttgtttaatgatacgaaagagcatgttaatgcaactacttaagcagttttccccgctcaaacagcggctgtatcatatttaaacttttatttgaaaaatgggttcaaatttcaaccttcacacttttgatcatgtttgacattcgctttttcgacaaaaatgccacagggattttggtcttaacactggggttgttcctatctgacatttcgaaagggacacggaaaacaaaacacacccaaaaatatgagtttaagccaaggggtgtgacaaaatctcacaatccataaaaaatgttttttggacttaaacaagcgaaaaacgttcaaaaattgagtaaacatatgtttctagcctaaacttaagctattgatactaaaatttggacaggacttcaggaccctatttacacgttcatgtaccattcaagcaactttagttgaaaattaaacgtgatgctgtaacaatagatgaatttggtttacttttactatcttctactgtttacgctacattgaaatttatatatttttatctgggtacgatatcttcccgagaaaaatataaagatgatcaaaaccaacatttttgtgttgcacgttgcgaaagtctgtagtgggactgatatgcaataacttctcattaggggacaaattgacttgctgttttttcgtatttaaagcagctaaaagagcataggaagggatgttgaaaactgaactaaactcaattttgatgaaaatgcagatggaactaacttgcgattcacggcagtgaatgtctatcaaatgaattaaatgaaaattggtgcaaatctgctaagttagtgtattagtatcaatactaaactagataaatcagtagccacaaagttatgtttttttgagattttccatcttccttcccccacaaactggttaaacaatatatgaacgtattcataatatagtaaagtgtttgttcataaacctcgctattcaaaaaaaaaaaaaacacggatgtcttttttggccattcagttgtacatactgtagttttacacaacaactgtaacttaacggacaaacatgcttccaatggcacagcctcgaaaaatgtttcaagaactgaagcgggaaacgagcccacactccctgccacaaagcattaactgcctgatgacattaaactcgtggccacgaaacccaaaaaccacgatgtttctgaaaagaaaggatggtgaatttggttatcactgacgttaggggaaggggtggtagaatgaacaccttaaggatatcatcttgtttctgctagaaaaacgaggaatttgtgtagttctatcgcacaacatcaaaaatagggatgttggcgatagtagctaaattttcacatgttgttatcgctagcaaaaacgatgaaaatgttcattttacctgcactatgtgggaaaaatgaacaactgttggtggtaaaataaacatcatgcaaaaaacgtgagcaaaacgaacatttttgaaagttttcattgcatttccgaaaatatattcattattgattgtaacccattcaaaaagaaatccaaaggtgtcagatttaacatcatatcataacgataatcacctcgctgaaaacctaaaagttacgttaattctaattttcaaacgtgatattctaaaaccttagttatcgttcatattttcacttcatttgacctccgtatcaacccgaatattccgatttatgctctaaattatccgtgcgtcataaaaattcaacgtaatttgtttattctcggtaaaagtcacggtgttcattttaccaccgctgttcatttaaccaccccttcctctatccgtctttatatgaaatctatttcgtcatctacttcaaaatgggagagcgaaaagggtaagaagaaaaatggatggtttatacaaaacttagcacaactcttcacgttgaaatttaactccctaacacccgatttgtttattcgatctaaatatcattttatttttccttatctaaaatcgtcctaaacacgttttgcacaatgattcattcctaatcgtgaacttatttatttttatattttttttatctttgaacatccctatcctttttcattttttcttgaggcctcctctggttactgatttttggcaataataaaaaactgagtttttacggtacgtttgaaaatatcatatattttccgtgtaattaacggaaaaaacaggtatgaaattattttaataccaccaggcacattttctgtgataggttgattgtagaaaaatataaaaggtacgatttttgtattatacattagatgagccccaggcatttgtaagttgtaaacaatacaatttttcaaaaatacataaatgcttcaaatgccataaaaaacttttcttacaatttaaacgaaaagctacacaaagttccaaagtgtataccgtctaaaggcagggttgtcacgtgaattcagctctcctgaaaactaaaattcctagtcgggttgctaattaaatgatgtattcaaccatcactaaaaaaatctgaggcagacaaaaacacacaggaaacgccattatttttcgtactatgcctaaagtgacgcttttctgatcattcagatcgaccttttcatcgaactgtctgattaatattataagtgcaataagtgtattgataagtttggacttcgtagccgtgacaagtgtcaccatgcatttaaacgcattgtgttaaggagtgtgggatcaattcttgcatcagaccggaaaacttttcttaaggaatgtttttcggctgtgtcactaagcgttgtctgctcgttcgctgttgatgtggtgcttcattcaaagggaaaatcttccactgaaagaattaaggcacaagtgaaattggaactggaaaatcagttttctcaaatcgaaaaatgtaaaacacacagctgttttatttcgcaaatgaaacagctgcgtgcttttacttgtttagatttgtctatttttttcgaaaaaatgcagttttgacattttcttcaattttacttgtgccttaacgtgactgtgtccttagaagacacatacagacatagtaatccaatggcgcagcaaaaaaaaatcctcacgaaaagctcgaaggctgaagcggggatcgacttcaaactttaagacaattccagatccattcttggcacttttgattagccgagcaaaatcccccatgccaaagtgaatcatgttagtgcccaagtagctctgcacactatgaacttttccatcggacgacactagccgcatggccacgaattccaccaacgcacacaagagttatttaaggaaatcgaggctaaaattattgtctgccttcaacggtcttcttatgccctagtattgatggatcaacggtttttgtctatcagcgagtaatcattttttatggccttgcgttagaattttgttacaacagatgaacattatttcatttgaaacgcattgatgagctttggccaatggactaaatgattgttgaaatattaaattgttcaatagtttttggatattttttgttaaccttccagtcgtcgcgcggtttgttaccgtcagaaccaccacgctgctgttgtgaacgaaaagcgaggttttttcaacagtgttgtacaaaatacaacagcgcgacgactgaagtgttaagcaaagttaactttccatttggggtgaacaaatgtttttttctgaatcttcaataaaaaagtgatgtatctacatatgcatgtattgtattattttaacaatatacatactaccatttctaaaactgtgagatctataaatttcaaaatatgaacatcagattctcctattcacttgaaactattatgcgtttatagacagaatagtgcaaacgtttttcaaaaaagtgttaatcatagtatgctatacagtcaacttttccttactctatattccatatctcaatatcgagctagagaaccatagtaaaacttggtcccttggatcggagttgcactggttttgtgttctgtaacttcaacctccctaacttgatggccacttcaatatcgagttatggagagttgactgtactgttaaattgatgagttttggtcacatataacaatataatcagaacatttttttattatcaacacatgttagtagatttgaaaataatagaaactgccacttaggacgatgaagcagaacagatgtataaaaaaactatcaacttaaaattatttttaaaacctatcagtgtggggttactcttaacattttacataatttattatcatgctctaatagccattggtaactaaatgtgtaacacgttatttctgagcaactgataactggctttacaagctattcaactacgtttcaaagaaaatcttcatctatctcccagttagtctatcctcagtctatctgaaagttagttcattcatttacccagaaacagcgagtcacacatttggttacttatagtttctatggcgttatcccaacacagttcgaacgaaacgtgtaaatttctgagacatataatgcacataattggagcgtggtaaggcaaacgctcccttagtggaggtagctccaatagtggaggtagtgtgttttggcatgtttcacgctaataaatgattatgtgatatttttctattatgtacgatgcgaaaatgatacaagttattgaataatatcatgaaatttaaccgtaaaactatttaaaacaattattttgcttaattttttgcttctttgcacctatagtggtgcatccgtacccatagtggagggtcccataagaaatcaatggattgcgccactaaaggaaccattcttaaaacatacctccactaaaggaacagcgttcctattattggtgcaaggctttttgcagggaaatttcgaatgaatcttgatttttatacatttgaatgatagaaggatttaagatctatcgaatgatacgttaaaatcatatatttcatgattttaacaccatgttttagcagttttcccttaggtgtaccactaatggtacacttgccctatataatggatatttacatgatatgtcatgtatacttcaattatatgtcatgtaatccagcaggatcctgagtggttacgtgacatgtaacacaaatttacacgattccagacttaaatttacatgacgtcatgtttacatcgcatacatgtcatgtaaacttcaattatatgtcatgtaatccagcaggatcctgagtggttacgtgacatgtaacacaaatttatacgattccagacttaaatttacatgacgtcatgtttacgtcgcataaatgaagtttacatgacgtgtaatcttcattatttttaactgtgaagttatgcaagacataaagattatttcaaaatataactaaacttaatttttcgataccatgtgcaaaaactgtatacgccatttattaaattattgcttttacaaagggcagtaactgttatacaaacaatggaaatattatactatatttttttcctgaacatttcatcgaataagatcaatgcaagctttatttgattagggactctaagttattaaaatgcacactaaaaaaatgctaaacgttaataaaaattaatatcttcaaatagtttgaagtttcaaatgcggaagagttctaaactgtgactagcagataacatatcagattttcacactgctaggctttttagcttgaaattcgaaaatatgcgaccatttattcataaaatttactgcatgactccaaaggatccttagacaatatcaacttgccatttttttactttgatagagcaatgtttttgtggtatttaacaaaataaacaaaaaagaagatcattctgctaattcacataagtatgcaacttcacttgggaaacattccctgtgcaacaactaactgtatcataaaccttatgttagattgctatgatttttaacatccgtaatgacagtttcgaataatcatcacaagtgcacttatgatgaatggtagcagaaataaaaacggggtgaataattacggccaacccttcatagcctcttctgatattgacggagtacttgaaatgtattgcgtgtaaataaatgaaggtttaccatccttccgattcctatcatgtttgtgctctcgaaaaaatcacccctcttagtccaaatacacctgttactgtaacaaaactttcctctgttcttgtcccctcgttacatggtacggaaagattgagccaacataaatatgtgcctaccgtttggaaattctctagagccaccctcctaatgtagcccaagatcgacatacaaaacgcaatatctacaagtgaaggccgcatacgtaccatatatttttatgttctttttcgtgctggcgtctgtcgtgtcgacggtcgcaaaagcatgcctggaataacaataattctactttcctataaaagtggttacagttgttatatttctgaatgtaacaatgctatttggtggtggacaattgttaaagtgattgaaaaccattgaattatctaattgaatctgatggtttcagatgatacgtacattcataaacaatataagtaacaggtaaatttcaagccgttgtatcttcgtagggaccgtattcggataagacaaactaatgaaacaataacttttacccactgatattagcgaatctaattcgttcgaatccatggctcatttgattttgctggcgtaaacgggaatgcaaaacggttttcgatcgtaagagtaccgttttgactcatattccgaacactcgatttttgtatgacaagttggttgaaatgtttcgctgaaatatgttatcaaattactaggaaatagcagtcaattgcaattcaatttaaacgtctttaaatctattttatacctcggaagtagtgatgattctctagttcgagaccagtagagctagctcagatgagtttatttgcgaaattatccatttgaatattatttatttgtgctgttcggaatttgaatcaaggtgctcggaatatgagacagaatgaacacagtgttcggcatttgaatcaaaatgatgttttatacttttacgtaaaaacaatattaaacaagtttaaatatacaattttatcagcaaacccagcagctaacagttagactttgtgaagaaatgaaaatcagatgcatttgaagtcactgttggccttaactgactggaatataaaaaaaacgtgtgttgaaaccaatcttgatgtttacatttctttagaaactggcttgatactggcaatgctcttcacactttcattttttcgcctgttgacgcccggaccattggcctttcaatatgtgaaccaaatttttggtccccgaacaaattaggaatcgaaactcctgagattgtttaatatcgtctggagaacgcaatgtttttccacccacgatcgtgttatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaacacttaaggccaacagtgacttcaaatgtatctagcaggcataaattagctggtataatttcttcacaaagcctaactgttagctgtatggtgtgctaataaaaatgtttgtttaaacttgtttagtattgctttttccgtaaaagtatagaacaacattttgattcaaatgccgaacactgttctcattctgtctcatattccaaacacattgattcaatttccgaacagtacgaataaattgtattcaaacgaataacttcgcaaataattttatctgagctagtattactgacctcgaactatcatcactactccggaggtgtaaaacagatctttcttcttcttcttcttcttcttcttcttcttcttcttcttcttcttcttcttcttcttcttcttagcattacgtcctcactaggacagagcctgcttctcagcttagtgttcttatgagcacttccacagttattaacttagacctttctttgccaaacttgccattttcgcatttttgtatatcgtgtgtcaagtacgattaaactctatgcccagggaagtcaaggaaatttccattacgaaaagatcctgggatcgggaatcgaacccagacaccttcagaaaagctgttctttgtagccgcggactttaaccactcggctaaggaaggcctccgtaaaacggatctgaagatgttaaaattgaatttcaaacgactgccatttcctggtgatttgatgacatatttcagcgaaacatttcaaccaaatcgtcatgcaaaaactgagtgttcggggtatgagtctgttaggaacttgagacaaaacggtaaacaacaatagggatgataagcacaagatgtgtaacaaaacttatgttcggtgaaaacgtttctcaaaaatgcataatatttttgcatttatcacatgaaaatgaatttcaattctcgattaatttatgatcagtaaacgccattggtaaccaagtgtgtagctttttgttattgagcaaacgaatcaatttccatggtaatcaacaatgctacgaagaaaagaagatcctcctctatctgccagtggtgatagtttacccctctaccggtagcttatttttttaccgcaagaaaaaaaatcacatcgcgcaaattttctctttcttggtatttttgtacaaatttttcgcaagttctcaaaacactcttctattttaagaaaaggtgtgaacattaatcattggtcatctggattcagagatattccgaaattccttgggggaccgacgcgtaaccataactcacgtatatatctcaggctacagattttttatcgtatgggatggtacacaaattatgtcacgctaaattttgtctttttcgaccccctaccccccccccccccctttgtcacgtttattgtatgagtctttcgaaaattttataaggcttgtcacgtttggcttgaccccctccccccccttggagcgtgacgtaatttgtgcatgacccctactcggatattcactctttggaacaaaacatcaatgagagtatgttgtgtaaaaatgaagcaatttggtgcagccgtctttgagtaataagcatttatgttgctggtaccatgctggccaaaaaaagatcttgaaaacttcaaaagacctcatatcgtaattttcaggcatctcaaagaatacttgaccaatttgtatgattttttcagagtagctcctcattacatggaattgtatagcccacatttcattttctcgataagttgacgtaaaacaaaatggccgccttagacatattttatggaaaatttcggtcccccaaagaacattggaatatctttaaaaccatgtcaacaatcatcattatcgacacggattcttaaactagaagagttttttgagaacttgtgaaaaaataccgagaaacaaaaaagttatattttggtccattcatttgctcaaaaacagcgaactacacactcggtcgccaatggcttttagggcgagttcataacttatgcgagaattttcctttttttcttagaaagcatgcactacttaatacttgaaataccgtgacaaggaaaagtgttaacacaactgattctcagcgtcctgtgtaccgattttcgattttttttttcaatgatcttcgaccggttacttcattctttgtggatttcatgtttttagtggtgttcaatcttcccccagagtagcgtgagtcggagagtcgcacgaataataaactcttcagctcaaacggtaatgtcttaagtacttataaataatgagaaccaactgctttgctcattgaataggaattgtagtggctttcgatagccttgtgtgacagaacatgaatgtcgtgagatttaaagaatgaatttggtaatggagctcctgctccccaaaacaaggattcgaggcacctctacaaacaagagagccagtaataatcgagacgcagcaaatccatattccattttatttgaagcgtattccgttttattcgaagttgaaaacaaggaaaatctgtgaatggaatacgatttgtctcctaaacacctaaaccatacactacacacttagaccaaatcatcgacttcggtaatctcattaccgaaatctcaacagctgaacgatcggtaatcgattcggtaaacgaatagattactgacctttcggtaatttgcgtttcgcacctgagctgttaaaactaccgagttttcggtgaacgttaaccgtagatctgtaaataattataaaaaataacctttgcatggttcgacgctaaaacttttagcctaaaagtgtcgacttaccatatgttcacgttgtctccatactactgataagtgattttttgacctgaggtttcatgaatcgcatcacttaccaagatgaatcctgatcatgcatctatgatttctccccactaacaaaacttcttcccatgacaaccatggagatacagagataacctcggcctctagtaacaatggatgtcacacttacttcacgattttcgttggaatattaagttcgatttatgcgtttcaaaaatctctgatttcaagtcaaccttgataacgatctggtgcttcgtgtgacgaattgattttaaaaagtgctccgcgaccaaaaattctgaatacccctgaaacagactacaaaaataacacagcgtaacaaaaatgacacttttgcgtgtctcaagaaccaaattatgtgtctagtagatttagggttgcttaatctaatgccgttttcagggtggtaggtcatttggcataaagtcgtttggcataaagccgtttggcataaagtcgtttggcataatggtcatttggcataaagtcgtttggcataacggtcgattggcataatggtcgtttggcataatagtcttttggcataatgagtctgaaattaagaatttcttaagatgacattcgtttttacgtttctattgaatctttctgatgacaccaggcttgttttggaatcaattgacataaaattacactttgttcaacaatctcatgctctccaataaactaaagcatattaggaaagttattgccaatagtattttattatttatccagatattgcccttctttcaaatattaattctttttttttaccttcgctattggaataactttttgcactgaagattttgatatatttagcacaaatttatccttctttcaaacgttctataatttttttttctaaatatgatgtaatcataattataggtatagaaactgttgatttaaaatttaaatcaattttaccttcttttatacataggctgttctttggagccatattttttaaatattttattgttcccaactgacaaaagggcgtcattcgattacattgatctgctcaagttatcagcgaagagagacaccgatttctgcagttacttcgatgagttgttctacttttcaccgaatgtcggtttcccgaatgttgttttcccgaatgttgttttcccgaacgctagttccccgaatgccagttccccgaatatctcttttcccggattagcccatttttccgaaaagtttttagaattcataactgtcgtaacatttcagggtggtgaacgaactggccatctaatatgcacccttctttatttaatttgcggttcttttgagttttaacgtcctcaacatttttgccagcctttgtatagccaagaatgacagaataactcattcttttgattagttatcgttctttctcgttcactatccagccactgaagattattatagcacctatttaaactgcactacttttcagggaaaccagtcattcaaggactggcattcggggaaccgacattctgagaaacgacattcggggaaaagtatcacaatcacttcgatgattctgaacgcaattgttaatgtcttttcgttttattatggcgcaataatttttggcgtccaatcttctattagtttaatcataaattttgccttcttttaaaaataggctgttctttatatttatactgttttaaattttattacttagtagagctaaatgttaacaattttttatatattgctgttttatcaattcctacaagacgtgctgttataatgataattactttagagcttgccaatattctacttttttttgctggaaaaatatcatctcaatcacaaattttcccttctttcgataatgtgtttttgatgtacacttccaaaattaaaatttatgttgaatcattgaaaagttttgccacaaaaatgtgttgttcatttgagttatgctgtgagaagattttttgcgttagagccttaaacattttaaacgaaaaataatctgctatcgtatataggctatgtttgcattatgctgcagtaatagatctttggattagagcttttaatattttgcaattaaatttcccttcttttatcgagtaattttcatcaagtgttaagtccaaactgggacagagcttgatcagcagcgaaatattctatgagcgttcactttattaataactgcgaagtttctttgccaatttactattctcaaatatcgcaacaagctcaaagatactctatgttcttggatgtagagaaaattattattccgaaaagatcttccaccagacccgcctcgagttttatttagtaatgctctctaatgtcacaataatttttgacattcatagcttggaaaatctctgaacaaacaccacgcttattgagaacccaccaaaaatgtttgccttgggctcggttgtgttgatctcggtaaaagcttcataaatgccgatattcattctaagccaatcattatgccaaacggccattatgacaaatgaccattatgccaaacggtcattatgccaaacgaccattatgccaaacgactttatgccaaacgaccttatgccaaacggggtacaatcgttttcagaaatgttccagcacgtcacaatttttagctacaggacgccaaagttgtataaaacactggtttcattgatttttacgtaatatttaaacaatgatttatcaaaaaaaattatgatctaatctaccaagcatgcaaaatgggacttcaactttcatttcagatataatttgattgaaattgcacgattaaattgaggttaaatcggttttttcaacatgcttgcagtctccatacgaaattcttcgtttctgttatatggcaaaatacaatacttttctaaaccaacaaaaaataatttttgagcatcggaagtattatgaactttatttataagtattgttatacacatgaagtttaagttcagaggcgaattaagcaaaataaattgccactcaagctggaaaacttgcatgcaagttggctgaaatagtaaaatttagcattttcaacagccaacatcgtgctacgatatttctgtaaatggcaatagattcagcaaccctcaattaagtaaatagcggaattttggtgcttgagacaaaatcgtgttccgcctggctgacggtaatctacatatatccagtggtgctggaagcgggtagaacaggtaggacatgtactacgtacaagaacacctagataggacagtcaaaggattgtcctacccacgattcaacagaaaataaactaagatctgcagaaaacctgaaatacaaaataaacgattcatcatctgttcaacatactaacaaactcgatcaacgtcgtacttattcttatgcaggatggaagacacaataaggtttttcatggtattctaaaacgtgacattgtttgtgcgttaccccaaaaatgtttggctcgtgagaagaacaaatgagaatatctgtagtgaaaatcttgagaaactaactgtaataattgctaccgtaatccaggggaaaattgatcacaggggctaattggatccggtcggtaccaaaaaacatttccttccaaggatgccgaaggtttcattggcaccacagacattccatattttctagttaatagacaacaatattaaaaatgttatgtatgcttaagtatgaactactgaacttatttttgataccatacagcatatcaaatatagttttttgctcataaaaccatttaatctcgaaaaatgtccttattacaaagggaaattgcttacatttaggcgtattaggcaggttttcaaagtttaatttcgatcagatcgaatactcgagttataattattttgacataattttcagattcaggagacccaaatttagtagatagggaaatttttaattcttaaatctgctttgtgatatggagatcaatttcgccccaatgtgttattttaattttttgatattaaaactatttttatgatatgttaaatattattttattgaaaagcgatttcataaactgataaatatcaatggagtactggttttgtcgaaattttttttgacgatatttgaattccgaaggaaattcgttatgaaatagtgatcaatttgcccccggattacggtacaagaatcaaatagagtaatcctttctggcatttctgaatgaatcaactgatggtttcatataaatgtgtatctatggcaaaacctaattgccgtggacattcctgggagtatttcttaagaactttcaggaacatgcatatagagtcatcagaagattattgaagaatatttggataaaataatacatttatttgatgccagttgcatcgtgttatacacagcacgacggtaatggtgctaatgatttctgaacgtgtgatcaatcttgatataatctgccaaagcattgctgaagctctttagaagttttcggctgatttacacttgccgtaacaattttcgcaagtagtttctagttaattcctgaaaaatgattcaatcaaattcccactgatatttttttggcatcattcagaaaaatatttgtagcaggttataatgattttctgaaagattttttttattgataatttcagaggtaattccagcgatattttttagggaatttatgcgcaatgaaacgaaagtctaccccattaccccgagtggtattaccccgaatgccattacaccgaaaccacatcccgaacggcccatgaccccgaaagacatgaccccgaattccaacactctttagaagtttttggctgatttacacttgctgtagaaattttcacaagtagttcccagtcaattccagaaaaatatttgatcaaattcctactgatattgttttggcatcattcataaaaatatttagaacaggttataacgattttccgattgtttttttttttgagaattttagaagaaatcccagcgatatttttgatggaatttatgcgcgttcaaacgattttatcccattaccccggatgccattaccccgagtgtcattactccgaatgccattacaccgagtgtcattatcccgaatgccatttccccgagtgttattaccccgaatgccattacaccgaatccacatcccgaacggcccatgaccccgaatgacattaccccgaattacaatatcatgaggaaatatcatcaatgttatcatgttaagataattgtaaattcgggcaaataacattaggggtgatggaatttcggctaatggtgcattctgaatcatgtcatttggggtgatgtcattcggggaaatggatttcggggtaatggggtagaatcctctaatgtgccaattttgcacttattctgctttcattgaattctgatgcaacagtgtaccggctccaaagaagtctccaaaacctatagcgggttcaatccctagttgaaatcttataaaaatcttggatagcaaatcaaaggaaatctctagaaatttctagaaaagtttgtgattgaattttagaagacgttttggacgggaatcttggaggatgtcccagggaaatcgatgaatatatcagtggattcaatcttggagaagttaggacattcttgaaaaactactcataaatgttttgatgaattttgaaataatctttgaagatattgaatgtctgtggttctatttgggaaaatccaggttgaatttttgagtatcctaaactaaattcgtggagaaattccttggaaaacagacacaaaatgaactcttttagaaatttccgaagtaatatctgaatatttcggtaaataccagaatctgattctgttgaaattcttagagaaaattattgaataaacttatacagtaatacttgtcgtaatgtagcgagggactttcaaaaacagttttagatcataaaaaatgtctgcacaaaaacttcaaaatcacaactcacaaaatctactttggcttttttttcagcattttttcattctatacaaattgtataggagtcaagaaaacaaaccagtcttctaagaattatgctatattttttgttgcgcttaaaaatcacctaataaggacgtttggaaaaatagaattttctcaacttaactcaactcaaaaccgaccaaaatatcactcatccttttttgcgtttgagctcctcaaaaatatagaaactgttaatatgcagcctccttagggttaaaacttgttaaacagtaaagtgcactaactatttccaaaggtttgtcctacccaaggtttcaaacgtggacgcgcctctgtctaaatcaaactagtttgaaatcaaaatcaactagtttgctacgaaggttaacacagtgtaacattttcaaggtaatcgaatgtaaacaacattctgtcttcaaatcctaaaagaacaaacccatactagcaaacccatatttggattttgaaagattagttggaaaattgtggttacacccttctgatttttctgattatgatgtatctaacaaactgttaagtattgctcaatagagcttagtgacatttgaacacacaaacagtcgcatacactcatcatacacagtttgtttttgttttcctcaacgaaacttacacacgcttcccagactcatcaaaatgcgtatggaaatagtacccaactagactgctcataactgcatatttgtaacattcgacaaaagtaggcattgagtaaatagaataccaaaatttctaaaaattaccaggaactcaaaagtgcgtatttgtggatgatattttgtacaactcatatcgcatactagaggaatagtcagaaaataattctgataaaaatatcattgctattacattacgaggctcatttataatctcaatgtgactgttatgcggttataattaccaatgtgacaaaacaacttggtatttttttcgaattttctagaacaatctcaaagattttattaagttgatcgaaagtatttatcattcgatgactctccatggtattaactccaatttgtcaatgtcaatgtcaatgtcgaatgtgactgttatgcagttatgggcagtagaggtcccggcaaacttcgtctcaccatcaagcaggctattaaaaaacgtcaaatcaatcccccatacaaaatgacacattagtcttctcccgatttcccgattattccggagactatcccgaactatatcctcgcacgaacacgtcgcatcacttgtcgagtgcaacagtgaaaaacttacgtcaatctgttaatctgtacgtgataaccactatgcaaccttcggacaaactattttttccacaaaaaaagtaaacatatcgtggcactattcttattttgagcatttttttttttagtttttttttgtcatagttcatacactgttcatgttttagcatgagtgtcttccacaaaaatatcaacatttatttcgatagcctttcaaattatgaggcggccaacacgtacaaatatttttgacaaacaaatattcatgtaaactaaataataatacgtaataaatcaacgctgccaaatctttttaaagcagatgtgttgctttgaaatgcattaacccgtataggcctgcgtgaaagcaaaaatactaaaaccctcactgctcagcgaattctaaatggattcaaatattttttgtcaatatgctggcacacatatctagtttctagaagtggccacaggaacgcggaaatattcctgtggccggagttattccggtgggtcatgtaggcaaatttcaagttacagaaaatttccggaatcggccataatctggcctctcaatgaattttaagaaaattgcatcagtgtaaaccttttgagaaacgattgaattggataactatgtgtcctgcattcattgattctacaaatgaccattttcgggaccccaggacgcctcaagtttacgataaagtggccaatttgtatctgaacatctgtcccaaccttatgggaacgcattttagtaaacaatgatgtttgatttctactttccgagaattgaaaaggtttagtattcaacagatctgtatccggttcttccgggcattaagaccgagtggtcacattcggtatattttaaacggtgcaaaattctttacttaatatggagtatatctgatcttaatgatttatgcaaattaagatgactgttattgcaaataactaaagttaacttggcatgtccttaaaaatagcctttttttttactcgacttgacccagtgaccgaccagaactactccggccacaggaatattttcgagtttctctggccacttctagaaactagtatacatgacatgacatgacaaataatcatttggatccgtagagagttcgctgagcggtgagggttttagtagatttgctttcattcaggcctatacgggttaatccgcatataccgtatgacaatgaaatttatgtttaaagtaaaaaggttattcaacaataaggggtcatgcacaaattacgtcacgctccgagaggggggagggggtcgagccaagtgtaacaagccttacaaaaatttcggaggactcatacaaaaaacgtgacaaaggggggaagggggtcaaaaaagattaaatttagcgtgacatactttgtgtaccatctctaagttgcaattgaaaacatagaaaaaaaacaagaacttggttcactataacacattgtacggtaaagaacatttggaagggaaaactaaaataatggtctgtcaacaatatgatattagtggtttatcctattgcccaaccatgcctttgcgtgtccagtgtgtggttgaatttccgcaatagcatctgttatgtgttcacatcaacccttcgacaaaacgttccactccaacctgccgtgctattttcataattggcttcttctgccaactttcaaaagacatgtgaagtattatgatttgttcgtattgatttttttttctaaggacaatgcaaagtggggaaatttcgattcaacgggtgaaatagaaatgtaaggggacctgtgttaaagttaacattttaagaaaaatgtgccgaaatcaggtctggatttgctattttcccaacgagacctaaccgacgtaagtaactttcacacggtttgagataaaataattaacagagctacttcggcacttacatgattcacatgggggaggtgtttctggtttctctgccgattcgtatgaaactttgcaataataagcatttcaatacgacgcatattgtggccaaatatgaactcagtagctttgataaatcacactgccgaagtgaatcaaaagtgccaaatataggatccggctccctaggtaccccgtggcaagtgagaattcggggtaagtgggaccttccgtaatagctcatttaagaaaactttttcaaggggatctgcttctagaaagttaaagatacaatgatacggaaggtatttattacatcaaatacctattgttttttttttaattctgtattagtattattccaaatattacattcatttcttatgtgttctgtgttagacaacactatcatcctattttggtgaaacaaattaaagcttttataaaccttttgttaacaacatattacatgtcatttgccgtagcagttcagattttttacaagtgagttgattctaccccattaccccgaatgccatttccccgaatgccaccaccccgaattccattaccccgaatgtaccattaccccgaattccatcaccccgaatgctatttccccgaatttacaattatcttcacatgatggttttgatgacatttcaacacgatataggaattcggggtaatgtcattcggggtgataggtcgttcggggttttggaattcggggtaatggcgttcgggttaatgtcattcggggtaatgggattcggggtaatggggtagaatcttcaacattggatattctatgtaactcatcagtactataccagggagcaagtttcagaatgatttccaaaattttattttgaattctctgcagagctttctttctggtattacaacagctagtccatattggtacagcatacaacatggctggcctgaaaatttgtttgaatatcaaaagcttgttctcacgacaaagttttgattttctattaataaggggataaaaacattttatatatttgttacatttggcttgcatgcccttaatgtgatttttggaagcaaaattcttatctagcatgagccctagatacttaacttcatcagaaccaatttattggaacccctctcaacgtgacaacatgtagaaatggtttgctcaatctcaagttttatttgtaaagaaatgttaacatcaagattaatatcgatatatgcttcatatacattccagtcggctcgaaaaaagttgaaagtggagctgataggattgagtatcgcttcatgtgatattggaaatgaaaaagggaaatgatcagaatcaaaatggtagttggctacaaaggtgactatagtcggttaagaccaaatcaccggtttctagaagagaaaagacatgaagggctatcagggtattgaattgagaaatatcctgaagagcactcatcaaataaaattctgccgttggaattactttgcgaattattccatgaccgatgtttggttttgaagacatcaatcacaaattttttttgacttattgcgagtcaattttcgcaagtcagtttggagcaaattaacttgctgtccagatcattgaaaaggcaaatagccagctataaaagtatattttccaagctgtgttgcaacagaaacacctaaagtttgaaaaactttagtttcaaatgacgaaaacagttgatgttttatatgcctatgaatgatgattacaactcccccatatgcaccatcaagtcgatcattacgataaacaaaaaagttaggatctcttttgagtttggatccaggtttcaaatacgtttcagctgtaactgctatatgcacgttattagctattagtaaattaatcagctcgttctctttaccgttcaaagaacgagcattccaatttaaaatatttaaattattatttggatccattagaaaaacgtaatccaataacaatttgagtagtaaattttacaccaacttggactgcttctgtcatagtggtggttttgaacattgcatcaatcatttgattcaattgttcagttagaaaattaaaatcagagtaagacattttacttgaagtaggcacaatatctgatgattttccgttaggtttttcgctacacgaagaggcggaatagaagtttcctgtggcggcaaggttttttccatttgatttgaaacagttataacagttactcgtagtatgcacaggtgaggagtttagattatctgctacgatttcggtttaggattttccttgggtacattcattcgaacggctacccgacggaataaaattagtttgtgaatgagcatgattatgatcttcctagtgggtatgatttttaatcaagcgatcgttaactgaaaaatgagcaatgttcgactctaaaaaatccacccaagtaacaccaacattatatcattgcattaatttgatcgaaagacaacattttttgcattaataatgttatcatgcatttattcaataactgtccagcaatgatccatttgattaacattgtaaatgctttgtagcattattttaatttagcattatgctaagcgttcagagttcatacacgattacaaaaccacataaaacgcactcgaatctgtaataaataagacgatcgagcacattcgcactagctcattacgttttgtgggatatggaggaagaataatttttataataaaatgactttctttcatctcaagcccccatttcatgatctaaggatgtaggtatttatttagaatagttgtattttatctatgagactcttttattcataaggagcgaagaaatgtcgatcaatatctctcccctgaaatcatttcagtgtggtagggttttgattgggggttaagttctgttatttcccctatgagaaataatatgatcaaattctttctattggtgtttcatttggtgaggaaaggaaatcactgttgttcaatcgccgaagagaattcttcctattcgtaataactggatgaatagtaatggttaacacacacagtagcttcgttttgcagcattagcacaggacaccaacgcgccaggcatccagcactccatcatcctagttgtgggttcgaatcctgattaaaaaaaatcattgagatggtaaagaaaaccattggaaggtagccaatggattcattgttttgtttacttttcacgcaaaccctaaatatacattattttaagctaatatacaccatgaaccctaaaatacaaacataaatgcttcagtacggcttgtgcattaaaactgctttaccaaatattgcattaatttggttattgtggtaccctttcccactttaattatgctaaaaattattaaagattatttcacttcaaaacaaaatctgatagcacactatagagcaaacataaagtatttatatatagcttcgtggttacttgggcaagtaaatcatttattccatttttgatctcttcaggtaacttatagtcacttgagagacctttcaagataatggagttggagacctttcccctaatggagttcaaaatctcctgcctaaatcccccaaattcggaacaactgaccacgataggcggcgctctttgcttcctcacttaaatcaaagagcctgggctagaggctgcttcgatttggtgttcggatagtttgtctagagcattgaactgattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgctttcttttattcttgccatgtttagtaacagttttaaacctcacttgtttggaaggaagtttcagagattaacccttccttttgtttgtagttgtttttgttgaactttatatctcatatctactaaatttatcagttgcgaaaaataattccatcacatcaattagttttcggtcatgtgtaacaataataacagaacatatttactatttcatcaattgttgaaattttatgttctactttttaaaaataatttaggaatgatatattttgaacatgttttattctagtgaggaattttcagttaatattaattggaggcggatctggtatagtagttggaacttacgactctcgcgccaaggatctgggatcgaatcccaaccccaaaattgtcacttatgacacaaaggtcatagtgacgacttccttcggaaaagaagtaaagccgttgctcccgagatgaactagcccagggctaaaaatctctttaataaagatagaaaaaaaagttgatattaagtgcgaagtaacatactattacatgtaggttttctttctaaagtgttacgtattttatggttgatcccttatgtacatcaaatatgtactcaaaataaaaaaatatatgatgcatcaatcgtattattgcaatggctgacttactgatgtggattaacgcataaaactggatgggtcccacttgccccgtttagcaaggtaactgcgtctaatggctcattttacaacttattttttaaggttttcacaatttcgaaattattcgataaaattcatgcatacaccacaaaatatgttgccaaaatgtgaccgtgttatattggattttcaatttgaaaattatgatgaccaattcatttgaactttcgttttttaggtcccacttgtcccggggtacctaagatctaaatttgctgcaaacctggtatatcaaaagctttactgcccataactgcatagttgtcacattcgacattttgtagttaatacccggaaaagctatcaaataataaatactttcatcagttcactgaaatctgtgagtttgctctagaaaatccgaaaaaaataccaagttgttttgtcacattggtaattgtaaccgcataaaagtcacattgagattatacatgagtcccgtaatgaagtagcaatgaaatttctatcaaaactattttctgacttttcgcacagtatgcgatatgagttgtacaaaatttcagcctcaaataagcactttcgaattcttggtaatttttagaaattttagtttcgtcccatactgccatgaaatttacacttgatattccatttattcaatgcctacttttgtcgaatgttacaaatatgcagttatgggcagttttatccatacttgtacagcatacaacggggggtgacccatttcgcataatgaagtttcgcataagggcgtttggcatgatagacgtttcgcataaagcaatttcatatatagacaagtagcattttaaagaaggcatataattatatttatgccaaacgtccattatgcgaaacgtccactcatagaaatatgcgaaacgtcccactcccatacaacatgaccaacttgaaaatttgtttgaaaatcaaaagtttgttcttaaggctaagatgaatagaccaatgcacaagctcactaatttgacgtttgagcggtgccacattcactcgttaccatggccacatagataacacggcaccgctcaaacgtcaaatagtgaacttgtgcatggatcaattgaagccataccttaaatcatcaagggagagaaccaaacagccgttcaagctggttatgacctgtggtgacaacccaagtatccaaaagcattaaattattaacgtattttaactgtaattcagcgagtgcattgcttctattttgcaatatgcgtgcattaatgctctgattccatttaaaaaaaaaaaaaaaaaaataacaatattttccaatgatttttctatctatttaaggttaaaattaagcaagcataaatgcctgataggtgatactaataccaactacggactaaactggatttagatgaaaaaaataagtaatcgattttagttgatgatgccgttcggcagtagaccgctcagcaattcaatacaaaaaagctagttacattattgagccaacactgatggatgtgattcaatctacaaatcaaaataataaagaaatataaagatttattaaattacagtttctttcaagttcaagtcccgaacttagcgatagccgcttcattatatagccgggacaagcctgcaaacgtttttgaatcgcgggacaaatttcagaatttttcggatgggtcgaaaatttgagtacataagcaattctgttttctcaacatatttgtaaaactacataatatggggttatataaaagttcagtgcaatattttgtgagatcttgttagaaattgtgtctaatgcttctttgaactttattgctaccaaaatttctgcccaatattgttatagaattctgtctatttttgcgtaagacccaagacactgcaaaacttctcaaggattttagtatcgcggtagattaatgctccggattatctgaattctatactcttgttactaactgtgagaatttgtatagccaatatgcccttttcagaacaatttctctaaagctagaatataagctcatttttgaagcctgatgaagatgatccgatagtgaattaataatccgttggatttgttcaatattgataggtacgtattgcaagtttcgttgctgtgtcaaacatatgttatattattatgcatagtgctgatgaggaagcactatgattaatgctccggattatctgaattctatactcttggtactaactgtgagaatttgtatagccaatatgaccttttcagaacaatttctctaaagctagaatataagctcatttttgaagcctgatgaagatgatccgatagtgaattattaatccgttggatttgttcaatattgataggtacataatgcaagtttcgttgctgtgtcaaacatatgttatatgcatgcatagtgctcatgaggaagcagattatctgaaataatggccaaaaatgagataaaaacaattttaaacaaatatatatgataagtataaaaaatcaatttcgaaaaacacatcataacaatggagtgaaaattcttgacagttcaatcaacaaaggcaaaagaaaaacctatgggcaagaaatgtcaaatccgaatcaccccttgttgttttatagctagcgtaaaaagctggatacatcgtattgtaattgaatgtcgaagcaatattgtttttgatcgaatatacaattcaataacaattttatatattgtaaatagaacactatattggtttccaatggttttatgccttacaatttgggtcaaactcttattttcgtgtaaaacaactgttacttttttctgtgtagtttgactgacagaagtaaacaagttcaaaaaataagaaatattggatgaaaatatttaaaaagtaatatttttttcgttttgtagaaataaataattttaactgtgatttttgaaggacgaatgcaataatgttggagatctacacctatatataggagtttaaactctttcgttaaggttagcaaaaatatccaatgagttaagaataattgataacaacacaaaaccttttcttttaaccaccaatttaaatgtgtctcgttgaattgtatgtgtgatgtgaaacaatacacaaatttccattcaaaacaatacataatcatatcgtattgttttttttttcaaatgctatgtatgagaaaatagcaacaccgtgaggattcgcttatagtggttatcacgcccaatggtatgggtgccttagtgtagatgtagttgtgaaccttagaggtcatatatagaacaaacgtacatgtacatgtagtctggagcattttcaccagttgtcagtcgtcccaactaatgggtcggattcgctagttggaagaattgtttttttttaatcatttaattttgagatagtttcacgctctattggtagaaatatacctaaatatatttcaaccacccataccagctatatcagtaaatgaagctgttcaaataaaccttattttaaagaataacctaataagtactatcaatatacatgcttaataagcattgacttttgttttcaatcatactcctgtttgaagggccaacaacgaatgacggacccgtaaacgcgaaacgcgcaagggaaaaagaatctccttccaggactaagttcacacaaacagtcgtacaacgagcccttgcttgtcagaaagattaaattcgggactacgaagctgctgatgttttcttcggttttctgtgagaaaaacaaggagagatatattttttgctttttttttccacgcacacgatgacagttccttacgaggttttccgtaaatgcgagtgctttgtaaatctctttttgtttcgtagtcgcgaatagatgggaagaagagaccgacaaatcgtcgccagcaaacgaatcaaaagagatgatttgccgttgtgttggtaagactggtgcaacgtccaattcgaaactgctggttggcttgcgatgattttggcgacggtttcaccggtgacgattacaaaacgtcgccttttataaggtgcaaaatttacaacactacgaaactaattcacgcgacctaaactgtcactgtggtaataatatgaatttcatcaaaaacatttttttttcgaatcaccactctgggcttctcgaagcgcactgcctgaaaaccgaaaaaaacaacttccacttaggcgatgtgaaaaccgaacccgcttgctaagcttctcgagactagacctgtgcgccgaaatatatttggtcggcggcggcgtcagagcatttttgtaccggcggcggcggcgtcatcggcgtcacgccgttgactattttcggcggcggcggcggcggcggcggcggcggcggcgtacatcggcgtagacaaaaattgaacattaaaaaaatcgaacatataacttttgaaaccgtatgcgtacaaatgcaatcgaaaccgaacttgaaattccatttcccatatctatcttacaatcttatgattgaaatagagtgcaggaacactttcagtcattttggtaagaattcaatgtttggaagtttatataaaaaatcctagtttcaacacttgtaaaactatcatataatatactatatcaccgttgttgctactaagatatattatctgacctgattattcgaactttttatttaagaaaattgaagaaaagtgatttaattttgtgcaaaactatgtttgtatttttgtagaagtttactggacttttcgcgttactttttgaattaacttatctgatatccatatctataaaatcgttcataaaattccacaataaataatcacagctttggaaattgtcggtattttattttctcggaacagaaaaaacgtacaaatttctatcatagtttcttgcgtgctgtttagattactcgagcaaagttcaacatcatgaacgaagcatgttgaaaacatatcttgttttcagcagtaagatgatatctttgtttggtatcaatttattattatcttaagttcgatatcatattttgttcttctaccatttttttattattgtaacaattttacataactataactcaaaagtgctacatactaataaaaaataaagtctttattttgatgacttcatttcaatgccagtcaaaaatatgtgtaacctcaatgagttctcaatgtccttaatgcggaagaagttttcaaatttttaaattgctttcactgagagctgttaaatgtcgaaattttggaaacattgaagtgcttatagcgtttttctaagccaatatatgaccaactgaaagtagttcagatatgataaccagagaaaaacattttccaatgactttttccgcggggattgaagatattcgcattattcaattgtcagagtcacgtgaagttcatgacatttaacatcactgtcacttatggcaaacatcgtttttaatttgatttcttaggaacaggtttctgctttcagttttgatattttaactgttaaaatgatcaatatgataagaagctgagtaatcaaaatctgcggcatcacagtatcaacattagtttccaatataactaatgtttattctggtatcatttcacgtagttaaaatgttgtttacattagatgcccagattttgtcagcctctttttcaaaactttgtgaagctctccttcaaaatgtaaacaattgatcaatattctatatttgccttgttatgaatattaatagtagctttaacataactaaaaaatacttggttgaaattcattaatcaaatagtgagaactacaagatttctgaaaaagggattaacaaaatcgggttagtactgtattccaaaattatatgatgaataattctgtacttcatcaaacattgatccaaagcggcgggacgaccgtactcaagcgtctgaaattgttatcccgtatttgctcctgtcatactaacgaaagataccaaagattcgaagaaaaatccatgtccattaggccgtcccttatttttcgaaaacgcaaaatgttatgagttcgtcattgtgaagtgctcgttttggtaagataaaaatcaggtaaaaatttgaagtccgtacctaagtcattcaaatccagtaaaacactcaccaatatcaggtatattgatagtattaaggttattcttcaaaacaagactaatttaaccggttgaaatatatttgagtcgtgaaactgaacggggttccaccaatcgttttagcacatcgtttcaaaacgtttcccaaaaaataacatatttataataaaacaaaattggataacaatattaaaatattactatgtgacgcccaatagttacttaattttgatacacttattttgaaaacaaattgttacgccattgtgaaaatcaaaatattgttcaaaaataaacaatttttttgctttataccatgaagattatgtggtaaatataaagtacaataattttgtcggaagaatttctcgttttgacatacgattttattcaaaaaatagtgtaagaattttccaaatccatcgaccagttattgagctacatcgtaacgaacaaacaccaaaattttaatttcaacagaaagtatccttgatgtagctttatgtgcctgatatttcttggtgagtacaaatgttaaattgaaacaaactttttcaaaaggctcaaaattctggttctaacattttgtattccagctgataattgtggctattttaattccgttcacatcatttcaggagaggtacaacgaataagaataataaaaaggccagacaactcataaatatttcatcaaatcgttctttatgagcgcccttaactgtatgcataaatgatggatgtgatacatttttaacgcttgcaataaagtgaaccgagtgaaactggataactggaaaagcactttcaaccttcgtttttccacatccatctggtaagtttgttgacaattttgatcttcctatgatagcttacgtcacggacgtactacgtattttttgtcttgaatttaccacaacaccaaccaaaaacgtgtgcaatagctagtgactggaagtttctacgttgtgctgaatgattgataatgtttacaagatacgttttcacgtgaatgctatacagattgaagatgtggtataaagttcgtcggaggcggaaccggtaaaaattgctattacatttaacctggcatcaaggtcttgtactacgtatgaaaacacatttgaagtgtatgtgttgaaggaactggtcctcggttcagttggatttaaattgactggaaaaacggcataaaatggacggtgtctaactttcaggttattattttgcaattcaaattattcaaatatcgacacaaattgccaaatgaaaatatttatgtttaggaagtgctggcttcgaatggaccgtcgagttaggaaggtataggtgtacaaaacacgaaatcagtgtaactgcagttcaacaaaccattgtaattatttattttttgtgtaacatcccactagatcagagcatgcttctcagattagtgttttgtgagcattttcacaattaataatttagagctttgtattgccgattaaatgatcacaaaaagacaccaacacgttaaatacttccagtcgacgatttgtcctctaaaggaagcaccatactagacaacgggtcagcattagcaatgagcgattttgaatcgatggtcgaacatcaatttttggtttcgattaatcgattttttgagtcgatgttaggatcacttaaaatcgaataaatcgattttcttcattcgattttttgtttcggatcaaaaagatgaaattgattagaatttgttcatgagttgatgaatcataaacctagttttgaatcatccttaaagcacctaatagacaattttaatttataactttatttaattgaaggaatttaataatcaaatgcaattgcatttggtctaattttgagagcttgttttgtaaattttcatatgagcttaaaaattgaatcgattcaaaaacattgatgcatatgcttcaattaaatcggcgaatcgattcgacaagtcgaatttgaatcgattaagtaacatcgatgtttttgtcaaatttgtccatcgttggctaacatgcaacacccagtgacataatcacaacaacgttactcacgaaaagttttccgaaaaatcctcgactggcgtgatttgaccctcagcttgatcttgccgattagctgctatggttatttgtgcttcatgtgaaacgcggttgttttgcagtagaacataaatagcagcctggaaaactatgatcaattcttcttctcaggagctctctttttgcctgccgaacagttggtgaagcatgcaacatggaaatctacctcataccgtggtgcatcaatacccggacgcttaaggtgccactaattttcttacttcaatattagcgtgttgttttagaaaatcctcgatgtaatattacttgatagattgtttcaagccagatcttcatgaaagtgatgaaatttttgataaaaatcatgattttaacacaaaaattaatcaaatattgaagcatgtcttgtctttaaatccggacaccttagacaaatgatgtctttaattccggacacttttggatcgaaatccggacaaaggtgttatagcatgcaatatccgttaaatttcaatgaaaataatgtcaacacgcaattaaataacaatctttaataaacttgatgtccacgattgtcccacaatggcaaaacaaataacacgtttgtaattaaactggtttgattacctgagctgaagcacgcgtagcttgaactgcattcgacgcggctcgaacaactattattgaaaataaatacaatatatccaataatcaattgcactccgaatactcactacactatccactattttcacttatttcttctttcgggaatctcacttacactagtaaaacgttggtccattacacgatgcccgggatctgaaaacactggctcataatcccggacagtctttttgcacaccgataaatgtatatttccaatttatttaatgatagtggagccaccgaatttccaaaatatcttcttttgaagagttttggataaaaattctataaagatatattttactaacttttacttcaaacaaacgtcgttcgcgtgtgcatcgatcgttcaactcgagatgaagttaaatcgcgacgaaatgacgtccaacatgaacaaataatttgtttttatttttattaattatttagcagtggtaactagatcagaaataaatgtaaaatgatcagcattgtttatttaaaaggggatgaatgaaaaccagacatataatcacttaattttaactgtaattaattaatataattaaagtgtccggatattggtaccgtccggattttgattcaccacggtaatgatgaataactatttacgtttttaaggggtcttgtatggaccgtggtcattggtcagacccccctctccccccataaatggccatgtggttgatgggcagcccctaatatgtaccgttaagtcaccagtcacccagtaaacacaccatcgtatatgatgggatataagagtactaatgtggaggcgatatacgcacatcttgcacgcagccttatggcgcatgtacgtatatcgcctctacatttgtactcttatgcgccatcgtatacgagtttgtgtttactgggcaccgtgcggcctccattaaccgtgcacatatacaaattcccacagaatatccttacaattttcacaaattattggtttgtcagttaaataagataaaactgatgaaatgaagtagttcttgtcacaaggcattttgaaaaacctagtttatttagtcaaaatcatgtgaattctgttttataatgggatttttcaacactcttagtagaaacgccaaaaattcacatttttcatttaaacgttagagtatattttttgttataatttcaacaagttttcgctgtagatactactagtaacacgtatttcattgtataagccatgaaattttatgtaaattatattttttattgattttctgtcgaaacacaatgcacggtggatggaccctttcaaatatgtatgtatggttcctattaccgtgccttagtgtaaaatatatgaaattattagataatattggatttattgatatgtcgtgatttaattacttcatattaagattttgagcgaatatgaaatggtttggacaatacagtcaaacctcctaaaactatttcaatgaaaaaaataatattttagccactttttcagctttttatggttttacattaagatgtgaatacccttaaaaatgaacactactagcaacataatggctctaccaacaacgttttttcaacaaacaaaatttaatcatgttggaaactatacgcacggtacatggagcaataacgtgcacggtaaatggtgacatagaacggtacgaggtgaccttaacatgacatttgtaaacataatgtttgagtaattttttgttatgcataactaattttagttttttttcctgaaatattgtataatttcacgcttcgtagtggtattctagtttgctttatattatttggaaaaaatatatgattttctgaagtgtagatttttcttaaatgcacggtgaatagtagcttgacggtaatatttgattattcgctgcattaattacgttattaacctcaccattgaactgtatgcaataagtagtaggggatattgttcttactgaaattttttctgtgttgttgctggtttcaaaaacactgaacatcttccaatgtgtgagcccgagtttggtcggagaaagttgctttaacttgtggatagaccaacaagaagtacatttcagtgtcagtcttggcgttggtacatagcagaaggtaccaattgctcaaggcttctagaaatagaaaacgctgtcttttccaacagctcaaaagctgtcgtgggtggcttctagcgcaacacgcattcattggtaataacagtgggatccacaatccagaagtttaaaaacaccagacgttggtatactatgtactgaaatttggtgagatcgtttgtaataggtactcaatattttaatttctgatcaaattgcacacaaatttcacacatatgaatcatatggtattcatattctgatattcctaagctattttgtatcaacattatatacaattaaataaaagcggtcatgcgactcaaaggtaaaggaagtagggtcgatgcaccaatagccgcatagctaagaacaaatattcgtataaaatcaaaaaataattattatcttggttttgtggaaaaaataggaaaactacgaaaactcatatgtttgtattaattatcgcttgtgccactataggaacacatgtgccttgcctatagtagcactatttataatttctgttcctatagtagcactagcttcacggcgtaagcaaaatacgaatcaaaatatgtagtagttttacgaaacttttatatttttcttttaaagtgtggatcaaaagcattcgattgatgtaaaaaagttcttaattcatcaattattttgtttaatttcaaatatattctgttagtagtgatactataggaacaataggtttactataggtacaagggagctaaaattgtaagcgaaactttttatttagatcattttttttttgaacaaaatcatgctgtgtatcaatggtacttatataaataggtcctgaccttcatgtcaagaaatattttgcttcgatttatagcaaaacggccgtaaaaagccactagggcgactataggggactgtctactaaaggaacactgaccctatatagaagatttttacaaatgattgaaattaacaggtggataggcgtcgcaagggagcgccaagattgaaattttattaggtggtgaaaattgagcaaaccattttaatgtcagtaagcatcaaagcgtactgtattctacctctccccccaacaaaacctctctaacataaataatttaacctttcggtcgtcgtgcgaatttttgttacccgagtagtcgcgcgttgtactttgtacaacacccttaattttgcgaatatcccaggagtctgaccacttagaaagatgacgtcttcggcaaaactattcacaagggctatcattactttagccaagaaattcgggattttgccactaggcggcgctagtgagcatgaaacattggtttcgcaaatatctcagtatcctgacctcttagaatgatggcgaagacgctatctttaaaagtggtcaggctcctgagatatctgcaaataaaagtttcatactccctagcgccgcctagttgcaaaattttgaatcaactagcgcgaagaatgatggacctaaacttactaaacaactttgccgaagacgccgtacttctaaatggtcaggatcctgaaatatctgcaaaacaaaagtaaaacttctatgcccactagtgccacctagcggtcaaatcccaaattaaatgaggtaccacctccagaacaactttactaaaggccccaagcttctatattatctggattttgagatataccgatttcaaactgtggtttactcgaaccgtatatagtgcgttcattattatacgaattccatatacgtttgttgattttaccgtattataaagggccgtaccgtaaataaaaactatcgagtattgtgcttaagaaaattcttgaggaatacattttggtttggtgtcgacagatatctttgttgcacaacgatagcacataaaccacaactgttgtaccgtcaagctaccattcaccgtgcattaaaaaaaatctgcacatcaaaaatttatatattttttccgaacttgaataccactacgaagcgtgcagttacaccataattcagtgaatcataacaaaaaattactcaaaaattgtgtttactaatttcatgttaaggtcgcctcgtaccgttctatgtgcaccatttaccgtgcgtatagttttcgtcatgatttaattttgtatcttgaagaaacgttgttggtggagcaaatatgttgctggtagtctgtgcactcatttttaagggtattcaaatcttattttacaataaaagccatagaaagttaaaaaatcattatttttcatcaaaatcgttataggaggtttgactgtattgtacaaattatttcatattcgctcaaaaactaaatatgaagtaggttattcacgatataacaataaatccaatactacccaataatttcaagccttttatactaatgcacggtaataggaactatatatatttataagggtccattcaccgtgcatttgtgtttcgactgataggttcacaagaaaaaaaatttgcataaaatcttaaggttcatacgatgaaatacatcttactagcagtatctacagcgaaaacttgttgaaattatgaaaaatttaatactctaacgtcaaaatgaaaaatgttaatttttggcgtttctaattagagtattgaaaaattaaacagaattcacatgattttgactacataatctaggtttttcaaaatattttgtgacaagaactactttatttaatcagttttatcttattttgctgacaaaagaataatttgtgaacattgtatgaatattctgtaaattattttatttatatgtgcacggtgaatggaggccgcacggtgactggtgacttaacggtacaaagtccaacagcgcgacagcccgaagcttaaaacaatcacggtcgacgccttttcctatattatatactattatttttgaaatcatgtttatcattttgcacaaatgtttttaaatatggataacagttttgtttcctgtataacggaaaaggagtaaaataagttttcatctcgtttaagatagcggataaaggcgcctaaaccaaggttctcgagccaggacatgaggaagaaatgcctatctctcaaccaaagaaaaaaaaccaatgtggtgtgcattaactttcttaacttcttctttctggcgttacgtctctgtcaattgaccatttttgcattcgtatgtatatcgtgtggcaagcacgaaaatactctatgcttagggaagtcgagaaaatttccttttacgaaatgttcgttggtcgatagtatttgaacaattcgaacccacgagcttcagcttggtcttgctgaattcacctcaggtgcgtgttgctcaggtttgcgtgctgcttagctaacttttgcaaaatatttttgaatgcctacgaagtaaaaatatttcattgcctttcgaatgcgccatagggagtttcaatcggacgggtaccgtaatccggggtaacattgatcagcggggtaacattgatcggtatgacccttctcgtaaaaagttcgattcatcctttattgatggagtattctcaaagcatgaatggtgcctctctttcttacattcataagctaataaaaactaaggtttttgcgaaaatcgcatttcgttcatgcgtaaatttgtcaacttttttaatcaatgatttttattattatggatgacactactgaagattcatgtctcacatgagttctgcaaatggtatgagcatagaaaatgtggttgttacaaaaaatgacatcgccaataacgattccgttgtcaaatctcttataagtttattcaattaagctacattaacgaactactattaagaatgcagaatttccttagtaaattgcctacctttaggcatattccgcggttcaaagtgtttttatttttgaaataactcaaaaagtaaatgacttctaagagtttggtcttcatgttcggcttcaggggccatgatttaagtaagcaacggcatttccaatatcaccgaatgttgtttacatgggtaatcaatgttaccccagatcagctaaatcaaaaaatcacttaaaacatttatttaaacttagttaaatctttcgaaaaccgaaatacagtgtacagtcacgtgcggtgggtgccagtacttgttttaaaaatataaaacttgccacatttgcattctcaaacaaacagtttaagaaatatcccaaaacctgatcaatgttaccccggattacggtaatcatgaatgaaaatttgaacttggaaatcttaagctttaattccataaaaaaaagattggaaatcggttgagctgttcgtcgaaagttatgattttttttttaaataaaaatctaatgccctgagacctacagtagtgtgtgccgatgaaaaatgacagattttttattttcaaaaaaatgtatctcaaaaactaaaaaacatacatcgctgaaaatttgacagtaaacgaaaaattttctgaactttcaagaaaaaatgagaacagcaatagcccctttggtcccgaggccttcaaaacacaaaaaacggaaattattgtttcttttttcatgtaaaaacattttttgtgaaattttatatttttcctgaaaagtcaaagtttttagctattcatattcatatatatatatatatatatatatatatatatatatatatatatatatatatatatatatatatatatatatatatacatagcaattgaaaatttttttagggatacgaaattatgctgatattaatgttgttaagcaattcttatttacagtcaactctcccttactcgatattctgtatctcgatagtacatagtaaaagtaggttatcatggctaattcgatagtcccttggatcgcagttttgttttcactcgatacctccctaactcgatggtctcttcaatatcgagttatggatagttgactgtattagtttaaacttgcttgatagcctttaagaaatattttatttgttttgtaaaatattatgttaatataagttaatataagtcaacattttcttcgtagatcatttttttatgtttaaaaatttagaggagtatatgcttttacattacagggtgatatcttctccggattaaacgatggtattctaagtagagccgaagctctggctgcagtagatattggaaagcaccagagcagtcacccacactcgcaaatgacatcgcaactgaagcatgacgttatgtaccaccacagcatgagtgctccaccacaaagaccgctacaggtgagtggttattagtaagtacatagagtaaaacgatctaaaggggttggaaaacttcccctagtcgatacatgtcgtctctctcgcagactgacagcaggctgaatacaaaacactgctatccaattagtcgcaacattcgtctcaaatcataaaattacccggaaaacacttatcgcttcgcaaatagcaaatgctcttccctgtaaatcgtacggtaacaggcctttagtttttcaccctcttgcaaagtgtcgattttttctatcaaaatgtatagggacagaagttgtattattttgagacgatgacaattataaaaaaaagaaaaaaatgtaaataactcaagcttgctttttcataaacacgaaaattgtccgtgaaaccggtaacatttcccctacattgtcgtactaggtgaacaaatagagttctcaccaagaagaaaatctctggaaggagcacacgttcacttcaataataaagcagcgattctcaaactcgacatttatgaaccctgcaaattcgaacaaccattataggtactgtgaatcattaatggttcaacaagtggtaaatacacatgttttcaacatggatcacaagcaatcgttttatacacacatcttactattttcttataaaaatagcattgggcattcttatacatttaagatcatttgaattatccgacgcttccattagtgaatgcattttttattgtttaaagatactttggtccaactgtatttatttgtttcagttggcacccgatccaagtagtctttgcataattcaccgccggttttgtaaaacagtagacttgttgtggtcacaaactgctcgccatgacttgaacaaattgccgagccgattagaaatctttcttgacaagttctgcaaaaaaactttgatttgttaaattcatcttcagcagagaatgtttcacacaaacctacttctactataaatatcaatattatcttgaaaaaaaaaatcaaacggtaaatcaccatgtaaaatgtattgcatttctcacattacctaataaaatgttgtatctctcaaaataagaaaagttaattataggagttttttcggctttcataactattgtcaatttctggaataatgtacgattgtagccattgggcaccactgatcagcataaagcgcagcgaacaattttgatgtttcattttactatcataacacttgttcttgcagcattgacaagcaacctgcaagtattagcatacgatgaatctccagagtgttgccacgtgatcaacacgcgactcctcacgactggtagattgaattgaggtgatattcggtttcaattgatatttattgttatatcctactacgtttcccggagcctgaaaggaacgcggcgtcaattaaagtaattactaaaaccgacctttgatgagataatatcataagctgttgcgaaaatttcacggtaaattttctctgtcgaccaccaatcaattttcgaatgagccgatccacgtgcacagagtgtgtcacgtagaagtattttccatccacacactctatctataaagtcggacaatatttctatatatttctttttatcttattgaaaatcacaatcttgaatgacatatgtatgtatttgaaaaaaatgtgttttttttaacggatatcatatgtgtaaaaaagcgcactaagatgtaaataaggtctttataatcttcttcttattcttagagttacgtctttaatgggcaaggtctactttccagaataagttctacaaacacatttattaactgagagcagacttctttttattgcatttgtatccattcagacaggtattttttggtgtttttgataaattaaatatacctctctgaaattttgaaataaatgtcttttatctaatattgttctatgttgccgaaaaatctgagcttgcgattgattttttgcgcttagagttgttagagctcaaaaattgaactatgaaacatagttttccgttatatcctaattctcgggcatcgtattataaaaatatctctactagagtatgtgtttgttatatttttatcagcaaaaaaattttacccaacatgatgcttaagaaaaatgtcaaactcgttaagaaaacttttttttcactaattgtgttttagttctccaataactcgaaaacagttttctgtggaattttgacgttctcgaaagaggtgtatattttatcaaaatgaacaactttgcaaaacatgccaagtctctagaacgtcacagtaacaagttagattgttgctccacctatgcagacaatttggagtggatggtcctcgttgttacaacaaattttgccaaagacgccatataccggaaatacttcctttccgagttatcaattttgtcccaccagattgcgtccctggcccatagtgccatggttttgaatgtagccgagcctctgggaaacactcattatgcgatacaacaaataacactgtgaaacgaaacttttataggtcaagttgggacattctggacgtataagatccattttgggtttcgttcagtaaccccgatatttggttctgaaatctaaatccatacttaaaaaaaagtaaaatcggttaggttttcttttttatgtgatgtttgactttctctttgggttattttacatacaatcattgggttgtgtcttatgaaatcatatttattcgataaaaaacatagaaagcctttctgatcatttgaatataggtgaccatttaaaatctagttttagaaccccgtttttgatgccaaaaaaatgatttttatcattagaaaacacccattacatgcatgcaacaactaatactgttttagcaaaatgaaacttgtcccaccagattgcgtccctggcccatagtgccatggttttgaatgtagccgagcctctgggaaacactcattatgcgatacaacaaataacactgtgaaacgaaacttttataggtaaaattgggacattctggacatataagagccattttgtgtttcgtgtagtaatatcggggtacggaatttgaattcatattttccataaaatatgtatgaagtcttgaagaaaattctcatcacgagaaatataaaatccaattgattcgtgaaggtaaatctatcggaagcaatttttttattattttaatgtaatcgatcattgttctaaaactcagatttagtaacaatgttctttttatttttgagattctccacagtatgcatctaggattctccaccagaatgcttcaaggattctccacagattcctgacagaattctcaacagagtccttccaggatactcaatagagtccattcaaaaatcaaaacagaatccttacaagattcttatcagaattcacccaggatttcgatgagatccttcacatattggcaacagagaatccttccagaaatcttatcataagatactttgcggttttcactttcatgatcgaaagcaactacctgtgaaagaaaatctgaggttcatgaaagttgcatgaaaaccccttttaaagcggaaataatgaagcgatataaaatcgaacagtgacaaaaacgagagctattatttattactacgtcaacattaagtatatatgagtaaacccgcattactatgagtaccaatttaggatgtgttggactatttcaattggacacaatgctcatgctatatttcccttggcaatgtttccgtgcagcattttaatacgttctgccttaaaactaaaatctttaatttgaacggggttggtggtctaacgtttctcaacaggggatccgtggacccccgaccatgtaaaaagcacgctgaaacgaacacctcacagcgagccatacgctatgtctgaaccagaagattataaaaatcgaatgtacatcggattttttctcgctagaaattagtatttggtctaggttttcataatcagaaggtttcaaaatattctatcggtgaaattttgatttttttccacttttaagctatttttcatactaaaatctatacaaaacccgttttgtaacctaaatctgcccatacaaaatgtatggaaaaaaatttcaccgatagaatatctttcgattatgaaaatatggacggaatactgatctttagcgagaaaaaatccgatgtactttcgatttttataatccgctggctcagtcaaagcgtgtgccgttttttcgccgttgccaaggttgagcaacggtggtcgaatcgctatcatttctgcttcccaagattcaatcccaggcccgtccttttctcatatttgtaacattcttcctaatagctatttttctttatcccgctgcgtaattatgaagtaagcatagtcaattctatctatcgctagaattgaataaatcgacttaccacagtgacattcatacggtcgaatacctcatctatcttccaaggtgggaaatcaacaggatattgaacgcggggaatgcattccttcctctccccgatgggcataaggacgtggccggcgttgttattaatctggaaatatcaatggtagtgtattgtacattgaagatggtaaaaaagcgagaagtgagtgattctctgtgaaatattactatcctgatttctcacggagtagcaactaggagtgtatgttccatcagttgatcgtttttttaaacgtgatcgaaaactaaaatcttcaaattaaaacattaactaatggcttagtttgtttcaaacaagaaattcttgtttggaataaccaatcttaggattgtcttaaacaaatttattgtttgaattaaataaattaaatcgaaaattaaataaggcatatgtatagtacaattcattattgttgttgtattgttgagtattgttcattaatattgttagtacttgtcgtttaacatggccaccagactcataaggaaggatttcgctttgagcgctttaactgaagtgcacctgaaactaaattttagaatagacagcagggataagattatggaaaatgtttttttttaatacctgttcttgttctgaatgaaatacaagaataattgttaatttagtgatgtcctacaggtttgtggccggtcagataggatatatatttctacaacgttctgaaaaaactgctgcagggatcctggaatcaattctgaagaagtaaactcctacattgaggcgttgtgaaaatcctatatctattgaatatcacggaaaaatcactggaggaaattatggaaagtccaggagcgatcctctgaacgattttctttgtaaaagtccttcgataaatactccagtggcattgaagaaggaatcattggtggaatttctagcggaatctctcgatgaatactaaaacagctctttgtaggatttctctggagaaagtcctggaagaagctattgaaaatttaataaatttattatcctaggaatctctggaattttttaatgaattatttaaagatattcgagtacagagaaattccttttgtgataactcgttgcaaacagaggttctgtgtatataacttctctatatttcactacttttatttactactgtaactaaactactaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtttttgctccacaataactttagactaattttaatgtaatgttccaccgatgggaggaaatcataagattctgtgcacaaaccaacaaattaacaacttatttcttttcaattttacgataaacactttcaaacaataacgataactaatagatcacgtgtcattcgtggtcactttgtgttaattcggagaaaactaactaatagatatattttgttgatgaagaaaaatatcaactcatttttttaaagtaatcaagtagcgtcttatttcaaaacaaacaaaacttcgtttaaaacaacatcaatttttagattgatgcttactattaatcaagtttgttttaataaaaatgttgactttcatcagcaaaaacatagcttggaacgaccaaactttggctttgaatttcatttagtttgtaatggttggcatttttctcgtatacgatttagtaggatgtccatcaacaatttagaaaataaaaacaactgaattagactgttgagggcagttgaaaattttcgtttggttttttgtgaaatttgaaacacttgggacgacccgtaataagatttttattacaaaaaaaaaatttacaacatatttaaagtgcacaatctcgaaagaaaaataaacacgaaaagaacttttattcttccaacacacttctaaactagggtgaacagacggtacattgtatgcatattcgactttgatacactccacttcaagggtgtaaatagaattaatgcaataaattcatccctgtagaataagaagcacgttatctccgtatattcaatgagtttctggctaatagagtgtgttcaacttttcggaacttgggtatcagtgttatttttttttcccaacgtgtaggtttatgtttacacaaaataactcgtagggactttcattacctgcgtttttgtgtgtcttttactctgcttggtttgccttgctatcgaatctcgtagcaaagatgtatatttctattatttaggcatttatttctatttggcgtttgtcctgcttacggtcggtgtaattgtgatttatagaacaaattatcgccctactctaaggacatatttgtttcaataaagagtcgtagcagaagaattaataaccatcctgatgcaaggaaagatacttctaaacacccctctcaaggatgtgaaattgtgaatcaagaaaatcaaatgaccgttgacaaatttatccaatttgtgtgtcaccatttttcatcgatagatggaagaataggaattcaataccatcaacaaatccaaagaacatagtgacaacgtcctatatctagtggccattaatgtattgtgatccgataatatctttctttgataagggatacgccttcaaagacgatcatgtaccagagaacaactctcattcagctgatgtttctagcttagggagtgaaaattcggtaaatcccattacttctttccattcaatttgtattaccacatcgaaaagcagatttatgtaaatcatacacaaaatatcgaccatcaaatcctttttgcatgatggacgtatggtccagcttaccttagagctacttacttacctgatgataatgctaatggaaacgacaaaccaactaggggaccggacgtattctattgtaatttgataagactaatattattgaatgctcacttcgaaacctacatcaagtatcgttcaagaaattaggaaggaaagtgatgcagcaagaaaatattttcactctttgaccttacgttttccgatctgaattgaatcgttcttcttctttctggcgttacgtcccaactgggacaaagcctgcttctcagattagtgttcttatgagcacttccacagttattaactgagagctttctttgccgattgaccatttttgcatgtatatatcgtgtggcaggtacgaagatactctatgccctgggaatcgagaaaatttcctttacgaaaagtccctcgaccagcgggattcgaacccacgaccctcagcatggaattgaatcgtatgattactttgataacgattgtaggccgaaagtacgaaaattaacgagaaagtgtgtgtgtgttttgtgctttagtaacttctgctacgttttctttaaaacgtgtattgagagtccgttttgtttgtcctatgttaattttgttacagtggtcgcatgtaatttggtaaacgcctaatatatataaactgtcaattgggtcttttgttgaacctaggagagtttggagttggttgtttctactggtaaaaactaactcagaaccaacccttcgtaggattgggcgtagctttaaagaaagttttaatcattagcgtaacttgaactcaaatctagagggggcttgacccttctgatcgaaaaaatcccttaagtaaggtatatacttagcatgagagttaaaattttctagggggggcttgacctttttctaggttcgtctaaagacccaattgacagtttatatatattaggcgtttaccaaattacatgcgaccactgtaacaaaattaacataggacaaacaaaacggactctcaatacacgttttaaagataacgtagcagaagttactatatgtttgcccttaccaatgcccatattcattcaacacaaccgcacagatattgcatctattgattagcgaaaaatattaacttgaacataattcacgctttgcagttgctatgtatttgggtttaaagttcatttgcttaagttagggaaaatatagtttctcttggtagcactacttaggaactctaggtctactatctttgcaaggaagcaaaatggtcgccccataacgcgagtagatcacctttgcgtggtgcgttatggggtaaagagctaccagtgaaccctagtcctgactgcttcaaacgaagagaacaggatattatagtaatcaaaggaacaaatttagtccttgttacatttttaatccttgttgaaagtgacaagcctcggtttttccaagttccgagaatgatcttgagacaaggaaaaaaatgagtcgaatacaacaatttgttttccactagtgcgactaaggatacatcgattctacacaagttgtaagaattttgacataatttacagcttcagggagtccaaatttagtggatagggattttcttttattcctaaacttgttttgttatcagcatttcaccccaatgtgtcattctggattttcttgaatgttattgctgaataatttcctgaaatgttaaatgttatttaataacaaaaaatcaataacataagctgatcagtgaagtactcattttgttgaaatttagttaactatatatgaattcctaaggataatgtaacaaaaagttgtaaaatagggattaatttgtcacaggtttatggtacaacttagtttttcatatattttatatacaacattaatttttacacaggcaaatatatagagaaaataattctttaatttaaatttcagatgttcaaactcgaggttttctcgttttccctgttttttctacaaaacataatcccaggattttatgagaaattcgtcaaagtttcaccactaattactcaaaacattgccaaaaaagtatgaatattacgttttggattcgtctaaaatcttgaaaggaaattgtctgttcgtatttcctgttcacatctacattcgcatagtcgcccatggtataacaatacttaccagcaaaattcgttttactttcgatgctcaaaagttattttattgtgatttagaaaagtattgtattttgccataacgggtgtccactaaaaaatgagaatgatttcaatacttttctatcagaacaaaaacggctgcatagaaatgtcactttagatgaatgaatcgttgcactctccagaaaattttcatacactctattccactctaacatgttcagtcgtgttcagcatgccgtcaaaacaggaagaactgcgcgcgcgttgtacaattctttcaagcgaacgaagatcgtggaaaaaaatacacggtggaccatttttgtcgtgaaattgttccggtatccaccgtataccgtatcctggcatgcatgagagtaacccggaagaaaggttgcggccgtccagcgaaaataatgaatgagaagacgctccgctcgctgcgcaacatgttcaacaacaaggattcggtgagtcaacggaaagcagcccgaaagttccattgttcgaagacactcatctgcaagacgctaaagaaagaaggaatagtgtgtagaaagaaaaccagatccccagagtacacagatgagcagattcaaaccgtgaaatcccaatgccgctggatgactcggtattacggcggaaaatctttcgttctggacgacgaaagctactttcctatttcgaagtcccagataccggaaaatgaccgattctacactaaggacaaatctactactcctccaaaagtaatgtataagttcaagcacaaatttgaatcgaaggtcatgttatacatcgtaatatccgataagggaatttcgaagccgtggttcaaatcaagcggtttggccatcaaccaggaggtgtaccaaacagagtgtttgcagaaaatactcatcccatttcttaaacaacatcacttggatggcaaatacgtgttttggccggacaaggcatcatcgcactacgcaaaaaaacgctaacgtttttggagagccaaagtataccatatgtcccaaaagaccggaatccgacaaatttgccacagtgccgtcatatcgaggatttcttcggtcttttgagccaagaacaccaagcaacttaccaacaggatcaaaagctgcatccgaaaaatcgacgtggctgccgtccaacggtcatatttcagcataacgactaagctgcgccgcacggcggaccacggaccatatgccaatattcactaaacttagtttgaagatttaagttgacccttttaataaaataaatcagttttaacaaaacttcactggtatttttttcctgacccattctttccgttctcattatttagtggacatccgttataagagaaacgaagagttttgtatgaagactgcaaaaaagttaaaaaaaatcgattgaatctaaattgtatcgtgcaatttcaaccaaattatatctgaattgaaagtgaatgtcctattttgcatgcttgcttaattaggctacaaaaaagtttgataaatcatacttcaaattgcatgtaaacatcaattaaactagtgttttatacaactctggcgacctgtagctaaacattttgacgtgcaggaacatttctgagaacggcatcagattcagcgatcccaaatctactagaggcacataatttaatccttgaggcacgcaaaaatgtcttttttgtgtaattgattgacctaatgttgaattgattacttgaagttcgtttatatttgtctgtttccacttggacatttcatttaccctcaccccgtatccgtggactagcgtatacacatggtatatggccggcctcataatgtaaaaaaaacgattagtctgtttccagttacttgatcataaacatttactagttgacccggcaaacgttgaactgtcctgttggctttgcacacaaaacattaaatttgtattactcttttattcaacctgaacctgaacctcttcacaaacacgtcgcagcccttgtacaatgcaaaagtggaaaaattgtggaaatccgttgacctgttcttaagccattttgtgacatacaaacactattcccttttattcatatatagaagatagatagattacttacttgtcttaatcaagaaacatcacacattattgcaatgattccgcgttttttttatgagagcgagtaaagacgcttaatgggtagtatccacttcgtaagtactgtgcaaaaggataggacaagtaatggccaagaaatacttcagctgtccaaattacttgagctgtatccagttgacaagtagagctgattccgtaacattggtaacgcctgccgtacaaatcaaatggagctgtcactattccgtacggaaaaatgtgccgctcaattattccgcaagtaaaagtgacacttcgctcattctggatcagctatcaaaattactttggtaattagcaacaaattgtacttgaccgctctacttaggatgtggataccaggcttaagcctaggctttagatccgtgtgaaataaataaattttgcaaaagcgttaattttgccccgacaacttttgaccagccttattttcgacctaatttcctatctcgtcttttttatatatgatatgatttatattattttgaataaatacagcacataatcacggtgtgtgtttccgtcctttaaaaatttcgtagctatgtaggtctccacgagatatgagagagtgccccacggtgtgctgaaacacacatattatcgaacttgcataaacctccaattttttttcactaaaagttagtcaaaaaaagctttcggcatattaaaaaatctttcatcggcaaaaatttgaaaaaggttgatttttgtatttttgccttctccctatataaaggtttttagaagaatattagagttacactaattttgatgaacttttaacggttaaagaccattctgacatatcctgaacacgaatgaaatatcagatgtttcaaattgagcatcaattctacctgtactcacacaatatgtaaaaaaaatagtccgaccagagaaattattacctctaatgaaaatactaaaaaatcactagtaaaacgagcaactacctttaagctctaatatgttgcttgtcttgacagatatgcctatttcgtctgcgacttacagacttcttcagtgttgattgctcggctttgggcaggcctgatctaatccatgttcccaattctactggaaaattggaatcattggcaaatatgtttaaacataaagttttcttaagatcaactaccttatattatattatcaacgtcaataaatagaacaattacatacagccataaaaataaacagatatacacatgtatagggcactgctctgtttcgattttgtacggcatttttccttctagtcttgtttttcacaataattttgaaagagtgaaagatagagaagctaagctctatacggtatgtctacatgaaaaactagagcttattcaaatattgtaaatattgtaagggtttcatgcataaaaatagaatttcaaaacaaaaaaaaaactctagaaaccttactttttatgtaaatgtaacaatataatgcaatatgtgtaaagtttttatgcagaattgtattgaaatattgcagccgcccgttgtatacacactcaatatgttcggtaaaaataactgggtttttgaactacagcggggattcgctggttggaacaccactgccttccatctaacgaatgcgacccgttagttggaacgactgacagctggtgaaaatgctccagactaaggcatccggaacgcaaatcgtcacgaaacgcacatatacatacgcatttgttctatatatggagatttcaatgcgatggtagtcagacgtcaaagttagtttgacatcttctcctgacattcgagtgctttttagttggaatttttttcaaccagcgaacatccaacgatcgagtcattccatgtagcggacccccaactagcgaatccccactgtaccgaaaaagtcagtaaactaaaaaaaagtcaaaaatcgaaaaacagagtttttttattgaaatttttcagagagctgtttttttatatcatatatcgataaaaaataaaacatggggaaatttgcttttcaattacgcgtggcgacagttttcattttactgactttttcggtagttccacaacccagtaaaattttaccgaccccagtaatttaatctaagtgtgtacactcttaaaaataatgaaaattactgtggacgtgattctggttatgactgcatgacacatgatgtaagtgatgtaacgacacaaaaacgtgtacttgaagatgtattgaacaaaaaatgtaattttacatgttaaaggatacgttaacggtggaactgtgatcgacatttcccgaatcagacactaacgtattcaaaattcgacataaatttacgtcattcggctcgcttcttttatgtgcatcccaaaagacgtaaatcacattattttttggtagtgtgtaggtttatagaggttagtagtgtttgatcctttggtcgcgttgcttgctcctgaggggacgggtgatgcgggcaggatcaatcgtgttgcgcgtcgctcgcgcggcacgatagtatataagagtcgcggatcgcgtgattagtgttagtattgtcaattcaagtgacaattagaaattcggcagtcaaaacttcggcgaagttcggcgtcggcattctaatttggtgcttcgccgacgcataaggattgcctttgtcggtgtagcgcttcgctagaatgccgacgctgaacttcggtgaactttcggtgatgtttcatgtttcatgaacttcggtctaaagttaatctgaatgcacaatagtatttgatcctttgatcgggtgatgcgggcaggatcaatcgtgttgcgcgtcgctcgcgcggcacgatagtatataagattcgcggatcgcgtgattagtgttagtagtatttgatcctttggtcgcgttgcttgctcctgtggaggcgggtgatgcaggcaggatcaatcgtgttgcgcgtcgctcgcgcggcacgatagtatataagattcgcggatcgcgtgattagtgttagtagtgtttgatcctttggtcgcgttgcttgctcttgcgagggcgaacgattaacacttgttcggcatacaattcatttatcgaataatatcgcgaatccggtcaggcgtgaatatatcaaggatcgcatcatcaactagagttgactcccagatccttaccttatcccactaacccaatatcctttccatgacaactatggagatgcagaagattcttcggtctctaaaaccaatggttgtctaactaacattccggcgccgttattgacttctaaagtttgagctctcgatttgtgcacattgaaaaatggtaagctaatcccaagccacattcactaaatccctgtgcaacttcgattgctctggtcaatcatggagtagcaactacgaattgtacggtcatttatgctcatgctcatgctcagtgtgtaggttaatagaaccacacatcattaacgtatccttagttcaattcacttatctaaaactaaatacttaaatttgggtctttctaagttccgttactaagtgaggccaattcgccagtcggctcgcagacctcatggacatataccagttaagggctggtcccgtaaagagatgaaaggcggagtcgaacaattcaggttctgatactttttagatagagccaattgagagactaaatgcaaaaactcattgagcttaagcccttatgcagcttccacttagagaccggtaaagatttacggccatacggtttctggaatggatcaataacaggctgagatgaaccgtctacctactcctctggaggggatagggaaaggagcctgaccaagggtactaatcgaaaccggttagtttgaagtttctctgacttctggagtcgcgtattgcgaaacacctggtcttcgttctgccacaggatcccatgcggagtagggaagttgtgctaagggtatggattgaaagtatgctcccttgaaacgtacggagttacattccaactgtcgtcgggaaggtcagataagaatggtatctgtccgacggaggtttggcttctgaaaatgtacaagatgatattggataactcgccccagggaccgatgggaaatcgtatcttgtggtcgggcggattgacgatgtcattctcggcaccgcgttcgataaagttggattcgttaacgtattcatggcaggatagcctccagatcttaggccgggaagctctgataagcccgcgtttgatattctacttgaaccaggccacggagaacttcctcaagagctagtgcacgccggggttgtccaactacctgattgcgtcatggctgtcattggatcagtctcggtaaaccgcacctgcttggctaatcctggaatttctgaccccgattgtttcggaatggttcctgtataggtggtttgaaaagaaacactaagattagttgcatccatgatgttttccgattgacggtttgaatgaacatctttgaacttttttaagctgtacagttcttgttctaacttcaacaaacctgctgaaacttcatcatcggatgaaatattccctgttcccaacaaccgaaccgaaaacatcttcatcaactcctggctagtcacctgactagctgctggcatttccgactctttgaacaaattgtccaatcaaaaatctttatattaacgcttgctgtagaaaaatttagccagatatgccaaaaccttttcgagaatttggtcgagttgtaactgctctgtgggttctacgactttctttaacaaactcagcctatttcccagatgtagtagtatggactgacatctgggtggtaaatctcttcctgaacttccaatagtactttcaattttttgtaatttgttctcacactctatgatttcatttttcggatcccttttcaacgaatagtctaccattgacttctccgtctatcctgctttaatctttctctcaaagcccgtcgttttctgcacatggattcttctttcccgaaaacaatatctcgtacttccaatttaaaatcgagctcctcttcatttaaatgatctacgcgaatatagtaaaagagaatccttagatcctcctctctgccttctaaattctttccaccttcggccatttctagatcacattcaaatcaaatcaatagtaaatataaaaattcaacaatcaatcctaaacctagcttatatatagacttcaagttcaattcagttcatggcaattcaacattcaaatatagtgcatatgatagcgaaaaatagtaagaaatctgcaatggtgtttgcaatactaatactaatcaacaaatcacggagcaattcaaaatgtttcatttatcgcagggtgtgactcggactagtaagagaagcaagagattcaaacaaacctaagccaaaatccacccagtcctccctgatgcgttactaagaaattcttccgataagccattacgtgtgtctctccaagcaggtgaagaaaaatattcgtaattatattacgaatattttttatttgactttacgtggatcgccaattgcgacaagtggctagctcagagtcagccttctcagggtcggcactatacctgctgttggcgcgataaccgtggccaaccccggtcgggtcggggtggactgtattttcggatgaagggaatcaacaccactgattctactattcactgcactttatttacactatactacactattgttcactatactttctctttaggtcactttcggtcgatagtatactcgcggtggttaaaacaagactgactcgactacgcgaagggatcgcgtatttatagcaccgcgccacgtgttctaggagcacgcggaagcttctagaagcacgtggaatagtcgcgaagcgcgtagctcggtcactcactcgtggaaaaagggaactcacgagatcattcgctcactgtgggaactctcgaccacagaggcgtcggcagggagggtcgaataaggggctgcactcggatgtattttaaatcgcacatgtttacggcacgttccgtacggaacacctgcttgaagctactcacaacccagttcaaggcagaaccggacaaagggtacaaggaaccaacggacgtgcatgcagacctttcccttttatcattcaaaagagctagagatacattttcttaatttttacttaagattttaattcattttgttgtgtgggttagtgttagggttagttcgttgcggccgattgtggtgttggagctcatgctgacgtgtgtaggagggagaaagcttatcatggacataccttgcacggggtctagaagtgtttcccgatgctgctgtggcttggcggggttcagaggcccccgaagagatgggtggtcaatcctcaatggtgggtgtatagttctgctgcctagttggagccagggttccggccacgtggttgccaaacttcggcttggtggacgaattagtggtggtcagctgaagctgtcgacttggccggccttcttaagagaccacatgggggtccacgtccaacctgggcgtcgggttcgtagggaatacaggtgcagttgaccagaattgcttggtcaccgaaatcgaggatgataccgttagggccctccgaagcagtataaaaatggagctagatggccggttcgggaagggacctccgcaatgcagtctggggaagccttccttataaggccacgtgcgggtaccgtaaattcgggtcaaattgatccgtagggtgaaattgatcaccgtgtcacacgattttatttcttcctaatggagcacaaatatcaatgcaacctgcagtgaatgaacgttgtttcacagacaaacagacgtaacacttagaacaaatcttaatcaaaatcatagtcacgaagacatgtacgcccaatgctataatcggtgcgtttggccgacgggccaacagatggcggtagtgtgtaaacgtcaaacacgaacaaaaacgatacgagcgctgcgggtggcggatcggccacctaccatatttttgaatcgaccgttaaaaaggtggtcgatggacaacgatgagagtgtgacgtctgtttgtctgtggttgtttgtcggtgagcaattctcgctgaaaccaggccgccatcggcacccatcgttagaattccaattttatgtcactgatcgctagttttcgataacacttaagggtggtcctttctgttttctcaaactggtggacccctcgtacgccagctagctaaacagtttgcgaaaaagcccatttttgataaatcttgggtatttcttcacgtgatatgtctcatatttcgcttggaacacatagcaatcttagtggcatcgcatagagaaagaatatagctttcaattaaaccttaaaaaattttggcggccattttgaatttggacgccattttgaattttgttagaaaaatcgttttatcaccattagcgcaccgctaggtttgaattctgagatcaccatcagaaagctgaggaaaaattgcgtaatataggctacaaaaactaggtgagcaatggtatttaccctatcaaatgaactattttctaaatcatattatacgattttgacgtatatggcgagtgcaatcgatccaaacatcattttttgtacaacaaagaaacaagttttcaatcgttggtgtattatttgagacagatgaagaaaaagtgttttttttatttaaaaaattatggcggccatcttggattttggcgccatcttggttttaagtagtagaatgagttttcaccttgttagcactcaacatgttgactttagttctaccattgcactcattcttcttctttttcttctttttcctgacgttacgtccctactgaaacagagccagcccctcagcctagctttgaaaacaaattatcaaataggatttttaacgcttatttgctacctgaattattcttttgaatatcttcgagttgaaaaatagcattatttctttcatttatctggtctaaaaccattattagaaatgaacaatcagttaaatagctcagataagacaagaaagatagaatctgattgttttttttttaacggaggcgtcataattcaacatgatgagcactaagatggtaaagaatcattcaactgctaaaaaccaggatggagtcgaaatccaagatgaccgcctgattttccaacctcgaaatgatacacctgtgtttcggtattacgtccacattagaacaatacctgcttctcatctttcaatttcgctatgtttcacatgcatgttgggcggtattaaaaacaatactttatggctcagaaaatcaagaatgttttttgtttcaaaatttaagatttccattttaatttaatgtacttctgtcaatgttctacgttaaaactacagatattaccacaagacttactaatgtcccgacgcgcaatctataaactttattcattgaacaacaatgcatatagtaaaaaaaaattgtttaatacaatcaatgtttttggatggttttcatttattgaatttatttattcattattactgaattcaaagatatgtcgaagaattattctgttgtcagaaatagcattataaaagaaaattcctgtttaataacctggattataactactagagctgagtatcaggcttggttccagtagggacgtaaaatcaggaaaatgaagaataataataagaagagtatacgtaatctttttttattggtagcctctacattcgacatgttgtctggtgaatcctcctactggggaagtcgggcaacgccgccggagccgaaacgaaaggatgaacttgatctttggtcgacgccaacgagtggcgctactcggatgatcgggcttgtaatttctcgggacttcaatttgcgaaggcggctgatggtcggctcaggtgatcggatgcttaacaccttttttttcaatacttggcacgtgcacttatcggtataaggatccaaattccacgacctagccgttgtgacggtccgcactctactatctctctagacgctttctcctctcctgttttcctccttctcctggtcctctccttttcgccccgtatatggggttaccctcgttgaattcgcctgcataggcgttatgtgtttgtgagatatcattgtcgaggggcattacatgcatagtttcatgcatggggggggggggttgggtttgtcttaattgggtcatttgtacatgcatacatttttagaaggcaatcttctcgggcatctcagtatactgaaagattttccaataaatccattggtagtaatgaacgaagactggatggaaaataggatgagcttagatataccatattacatggttgaaacaaaccgccaagtatgggaatcagggggtccgaatatctcaccaggatcgataattttctacactgatggctcaaaaatgaatgagaacattacaggcgggaattacaggcccagatattgatatttcaataccaatgggaagatgaaccactgttttccttgcagaaatttttgccattctagaatgagcatctttgtgtctgagaagaaaaggcatgcacggatttgcatattttcagattgccaagcggcgctgaaagctttaaaaccattcacaagccaatcaaaactggtatgggaatgcataacactgttaaagcaatcatccattaggaaccaggttaatttatactgggtaccaggccattgtggaattgaaggtaatgaaaaagctgatttacttgctaggaaagggttaagtgtccagttcataggaccagaacccttccggtgtatccaaatctatcttctatataaataaaaatggaatggtgtttgtatgtcacgaaatggctcacgaacgggtcaacggatttgaatgattctttttcagttttgttcgtcaagggttccgacgtgtttgtatgtaaaaaaatcccaggatattcaccgggaaagttggaaaaacgagcgcgaacgaaactgtcattttatatgggacgatcaaaagcgtttttcaacagcctgtagcgtagcgaataaaacagttctgatacggatttatactttcacaagagtgacgtttattctactcaatcttagcttggcctacttggtgaattatcttaatgacagcctactacatctttccctttttccaatatgacaagattttcttctacatgtgtcaagaatataatgaagatgatatttataaacctgtctctactattcatatgtttaaactggtggtaaccctatatttccaagtcatctgtatctgtttaattaagccattttttccgaggtgatttcttgatgttttggttcttcaaaactggttgataatcctgcgtgtacttccgaggcacccatacttcttgtttttcaagttctgttcctcagccacgatcacctgcataattaaagagcaaacataattattcgatccatttctatattttattttattcaacttagtcttcaatcagagatttcctttccttgtcatcattaaattgatatacttacctttcctttttattcgaagtgtacaaaaataaaaatagtgtaatttaaaactcctttattgtatacttctgttaaaaccatttctttgttacttgattgtttaaattgttcttcctcttcacatttttaatttttcaatattgattgtctcaaattaaatgtaatattattattttactaagcttgcatttggtaaaaggttatgtaaatatccttatgtccctttaccgtcgacatttttgtcatggtagactggacttttagattgcaacaaccatacatatccctttaccattaagctagatggtctgaaggtgtacttcctacatcatcctagactggattgtcaaatgaactaatataattcttcttaatttgggttttttttctgtcggctgaaacaatgagtcccgtttgcttatccctttaccattaactaagatgggccgaaactttctaagcttccttcatctcttggtagactggacattatgccaaatggactaagattacactccttcatttggtctttcaacggactggtatctcgcagataccctacgtttctttattgtcttcgtttcatatggatgagtttccaacactttttttttttcaagaaacggactggatgatatgtgttattccttatgctctctttttaacatgaccgaacttccacaatctcccttcgttctttttccagaaatggaccaggattgtttcatcctcttcatttcttattgagaagtagaccagaatcattcatgatgttctctttactctctattctttgactaagagcgggccggacgatttgtgttattccttcatttcttcttagaaatgggccgaattttcacaatctccctacgttctttctacagaaacggaccaggttttctaacctcttcgtttcttatggagaagtagaccggaattacttaatgtatcccctttactctctgctgatcataaatgaactagaattcctacacttcactttagaagtggaccgaattttatatcttcctgccttccgtttgttaaaacgggccaggatcccagtatcttcgtagactgatgtaacttgatgattgcttttcactctgcatattttattccagcgacggttttgcatttctgtcgcttaattctttaaataaatcgaactttctcgatctctgaacttacttctacagaatcggaccaggatactcaatcctcttcgtttcttattaagatgtaaaccggaattattcgacgtattctctttactataaatcagtcttaccaaacatccgcagatatagtaaccattattgaatattagctaaatgcttcaattaatatttgtaagaatcatacactgttaaagataatcttcatcacgtcatgtaaacttaattaatgtgatgtaaacatgaagtcgtgaaaatttaaatctgaaattatgtaaaaatgtattatatgttacgtaatctcacagaatcctgctagataacatgagatataattgaagtttgcatgacatatcatgtaaatatacattatatgccaccttcaaattatatgcattaaatgtcacagaaatttacatgtttttttttcgacacggttcgatgacatgacattaaaatcttatatcgatttcaaattttataattgaagtaatcaaatttgtacaaatctgacagatcaagtattggctaactaacaaaaggaaaattgagctaaacatgtaatataccttgaaacgattgattgatcttttccttttatttgtttaatttgagttccttacttgattttgtattcagcatttgaaataaattctcacagtcgtacctattttatagtttaaattcaatatttcaacaagctccagttttgttatgacaaattattgcattaaatacttgtttttaactcacacttgctggattctgtatagaacttctggcacgaatgccacgctagtggtaaaatgtcagaaacaaactaataataagaataataatgtataggctttatgaactttaatattctactctaatggaataacatgcaagcggttaaaatccacgagaaataataaataataaaattgaataaacattatttagctgtaagttcaatcatttgtaataagtataattgaacaggtcaaagttgttcgtatagccaactcttccttgctcgatatttccctaactcgattgaatgcgtggtatcttcaatctagcatgcttagaactccctatgaatcgatatctctcaaacccaacgtgatctgttttagttaacctctctcactcgatgatcccttcaatatcgggtagaagagttattaactgagagctttctttgccaaacttaccatttacgcatttgtatatcgtatgatagacagacgatactctatgcccagggaagtcaaggaaatttccattatgaaatgatcctggaccacccggaaatcgttcccaaacaccttcagcatggctttgctttgtagccgtggactctaaccactcgggtaagcaaggctccctataaaacaaaatttaatgtgccatcgttatattgagcgctgtcgcattttcagttccaataatgcacactattttcgttgaggttctttgcaagccatctctgatgcttttttttcatatgggcagattattcatttttacagcacaatcagttgtatataatcatagaaaatgcatcatttagaataccacctgacttccataaatgaaatttcttcaatagatttgcaaattttacttctttccatttccttttcttgacatttttctagcactaaattgtccactggcaaccgtccatttagggttcattcaaatattacgtaacgcaaaatttgccaattttagaccccctccctcccccacgtaacagcttttgtatggaaaattttaagtttttgtatgagccgtaacactatgtaagaccccctccctccccctgttgcgttacgtaatatttgaacggtcccttagccgatttctcacttgatccaaacacaacacaagtctctactcctcctttacacttaaacagcagcgggttcatttcaaaactcgtcgccaatgtagcgtagcgaataaaacagttctgataccgatttatactttcacaagagtgacgtttattctactcaatcttagcttggcctacttggtgaattatcttaatgacagcctactacacagcctacttgatggcaagacgaagtttgccgggaccactagtgtttaatacaaatggcactgaaacaatgggaggatcaaatgatacagtcaaactggattgcaacagaaaccttaagacaattaaaactgttcataactccaaataaaaacgttacggaaaaacttttaggtttgatacgaggtttttaggtccattctatacagtatggcccataaaaaagtgcgaaaatcgtcatatcatgttttatggtagtttttacatagaaaatgtgaatgaaacttaaatattattcattacttgtattgtttaatctatttagactcagtttttcgctttggatatgatttttatctgttaatttcaccttaccagagaggaattggaagcataccttcaaattatatcatgcggacgtcgagttcaatatctgcgtgatgaaagcttctaaaacatcaacgatggcgtgagattcttcacaggccttgtcttcagcatacgcccatatcaaatgatagaattggttcatacctgggtaattggagacttaaacatattttcgaaaaaacggctcattttggagagctttgattgaaccttcatataagtgtgataagcggctccgtttggctcaaaatttatgagctagtattgatataagttgtctccaaccgaaggaacaaatttcatcctcaaaaatctgttataggcctccgtatatattttttattcaaccttaacaaaaaataaaggcatatcaaacctataagacgcaaatgccctcaatactatgaccctgggaaaatattttattgtgatcatgaaaaacacgttctctaagaactcctccattctctgataccaaacaaactaaaattttcaacaataaagtgtgatttttgaaggtggaaagtttatcaccagagtatacgacaatcagacgctgtttctagcttttggcggacaaaacctttgaacttatttgcttcattacattatttaggacagtaagaaaaaaaaggacaaaaattgtcctggatagcgaagttgtgtcagaatatactacaataatcagaaattacattcacatgcaaaaacaatgaaaataacgcttgtggatgctatattcatgttcaaacaattttcgcatttttttatgggccatactgtatatgcgaggtcccagaaggggacttgccaaagccccaagctgctggtctagagccgacggcaacttccggggtgggcgctcaaggcctcttttgtttaacctggatctcagggttgtgggagaatttccgaattgagtggtgaagaggcggacaatacaacaatgggaggacatggaaaacatggttttattttcctaaataaccttaaattagctgaggttcagacgggccatacagaataatgaaactggtattcctgaaagaaactttaaacgtatttttgataatgccccttgaaatattccagaaagggtagaatcctcaagcaactcaagtgagagtgcaaaaaaaatgcgaggattttttgagtgtcgcgcccgaacaagacagactttggggagttgtgatggcactcttttttgacggagttttactctgctgtgttttgtgctctatcttcctcgctcatttttcgttgcctttcttcttatcatttttccgcccactcgcaaagaggcaaaggcagcatgctgctcaagagtaggtcaccgaactctgatggtgttgagtattatcaatcctgcatcaaagaatcaaagtattgttttgaaaagcaaatagccgaacatgatataatatctgtagcctgagatatttacgtgagttatgcatacgcggccttccttagccgagtcgatagagtccgcgtccagaaagcaaagcctgctgggttcgattcccggacggtccaggatcttttcgtaatgtaagtttccttgacttccctgggcatagaggatcatcgttactgccacacgatatacgaatgcgaaaaaggcaactttggcaaagaaagcttacagttaataactgtgtaagtgcttattgaacactaagctgagtagcaggctctgtcccattgaggacgtaatgccaagaagaagaagaatgcatatgcgtcaaagttcaatccaatggacgcagtggcttaaccttaattcaaaatttcatgctttactttgtttacgccatttaaaaagggtatcgccagtaacataattaacataatagggactattatgtacaatcagatgatagttttattttgaaggccgaagctgaaaaagggaagcacctctgagaggtaagaaaccttgttatgtaaaggatgtaatttttataactggttgaacgggtcaaaaatctagaagcaaaacaaaatctatttcgcaaatttatcaaacttgcattataccattataaataactcaaacaccatctgtcattatttataaacctcctgtcctgtattgtatgttgtcaaaatttgctagaacttttaaataggtgagagtcgcgatataagtgaaggcatgacctccttaatgaacatcgttctttgcacagacaataaatcgcaccctttttagagagcattaatgacgatccagatcatcaactggtactgtgactatatttttgcattatccgtaaccaacttgtagcagctcatgaataaatttttcgaccctactcttttcttttgcaccatcaacgaagataattcatagggtgtgcttgtgctacaattctgtctatccctccagaagattcagtgatgctcaaacaatcccaccacttttccatcgatactgatgagattaaaaataaactgaagggtggttccacttgttctcaccctcgttttattgttattacgtagatttgaagcgaatttgatacatattatatacaaattactgctataatacacaacgtatggctctttttatgccatttctggtagatttttgagataacagcaggggttaagcacattttaataatgcagaaacaaatgctactgtgaatttggtcataaatcacacatcgaaactttgataatttcatagactcgccatggggatttgccggaaattactaaaaaggataaggagtataagctgcacttcaaggaacacacagtccattatcctacacttgtcattaaaatagatagacagaaaaagggaatcgcttaaataggattaggggccgccacgacctttgatgcgtttttggtgaacttcagatcagatacttatcagaagacccttttcgttatgctactcagattgaccgtaaaacgggacagctttgatgatttttagatacatttctgaatatttttattttgggatggcccataaaaatcgaacttcaaaaattttaagttacaaatttgttcatttgacccccagaagctactttgcacatttgagcgcaattacagtctcttgcttataggttggagaaccttcaaatcaataatgaaagagatttattgacattttagaattgacggattcccttcaaatttgcacagcagcttctgagggtataaattggggtttttacggttttatttttcacatataaaaatgggccaccttaagcaatatcttcactctgccgttttatatgttttaacaatacaacttaatatgccatttactattggcagttgaaaaattaataaaataatcataatttaaggtttaagtaccgtaaaacggggtaactttgatagttttttcgaagaaaacttgaatatttatgcatgctgcttcaaagaattatagtttatatttttaaaacaagtactggcatcctagctatcgattgcagttgatagatagccaaaagatttatttttaatggatatataatttttcatataatcgaaagtcggttttctgttttggggtaactttgataatggagcatcaatcaaacaagattgaatgaattacgaacatttatagggcattgaatacctctatacgtttatcgttatatggaaatttctgacttagattacaaaaatggtcctagtttgtgaaaatgctattcgctgagggatttgagaccatattcaagttctatgataactaggttgtcaaagataagtgaccaactatttaaaactacatcaaatagtgatcgtagaacagattgtttgtgcgcgctttgaaaatgctaaaatcgtatcaatttttcatattcgtatataaagcctcaaatgttctcagttaaaataaaaacagctctagtatggagtgtcatactaatattctttagttttgcattcgttttgcttaaccgattaacagaacttatgatatttggttcagtatgtggtgggtaacggactatcaaagttacccgcattatcaaagatgccccgttttacggtaattaataatcaaaataaatatggaaaattcacgaaaatccagaatcaaaataccagttgacatctgttaagaaaatgtgtgtacagctacgtgtagtctacgctttggaatacaaaatatgaaaggaagcagatctaacacaatttttaaatcatttcgctatatatatatatatttttttttttctgaaaagttgaaatcttaagctttcaatccataaaaaaagattggaaatcggttgagctgttcaaaagttatgatttattttaaacattaaaaatttaatgcgctgtgatgtacagtgtgtgccgatgaaaaatgactgattttttattttcaaaaaaatacatcttaaaaactaaaaaacatacatcgctgaaaatttgacagcagacgtaaaattttctgaactttgaagaaaaaatgagaacagcaatagcccctttggtcccgaggccttcaaaacactaaaaaacggaaactattgagtttttttatgtagaaaacacacttattgtaaaattttatatttttcctgaaaagtcaaaatctttagccttcatttcgtccaaaaagattgaaaatcggtcaaacggttcaaaagttataatttttttttaaataaaaattttgcaaaatcgcgatttttctggtcatcctatttcggaaatggtcaccctaatcaaaaaatccaaaaatacgtgtatcctcatttcggataaggaacaaaatagcacattttcatggaattcggtgacctactagatcagctcaaccgatttccaatctttttttatggaatgaaagcttaaggtctcaacttttcagaaaaaatagaaaaaaatagaaaactttgaaaaaatattttttttacattaaataatatgaaaatttctaaaaaaaactagaaatttttatattttttcacgtttaaacatatttttatcagatttttcaattttgtctgaatagttgaaattttaagctttcattccatacaaaaagattggaattcggttaagctgttcaaaagttataattttttttaaacattacaaatctaatgcgctgagacctacagtgtgtgccgataaaaaatgactgattttttattttcaaaaaaatatatctcaaaaactaaaaaacatacatcgctgaaaatttgacagtagacgtaaaattttctgaactttcaagaaaaaattagaacagcgatagcccctttggtcccgaggccttcaaaacacgaaaaaacggaaactattgagttttttcatgtaaaaaacacaatttttgtgaaattttatattttatctgaaaagtcttcatttcgtccaaaaagattgaaaatcggtcgaacggttcaaaagttataatttttttttaaataaaaattttgcaaaatcgcgatttttctggtcactctatttcggaaatggtcaccctaatcaaaaaatccaaaaatacgtgtatccttatttcggataaggaacaaaatagcaaattttcacggaattcggagacccactagatcggtttttcatggaatggctgtatatatatatatatatatatatatatatatatatatatatatatatatatatatatatatatatatatatatatatatatatatatatatatagacattacccgaagatttgtgcacttgaaatctaggataaattattacttcctgtgaaaaattgcaaaataaatgtattcatcaaccaccataattactttcagtactgcttcttctttttcttccatcgaataaacacaaaaatattttgctgaatttcggtaataactgccgagattttcggcaacggattaccgatctctacgtaaaattttgacagctgagctggtcttctcattttgcagttaagtcgacacttcgaacttttaccgaaatttttgccgagatctcagctgttgggttttcggcaaattatatatatatatatatatatatatatatatatatatatatagagatatatatatatagtgtgtgatatagtgtgtgtgtgtgtgtgtgaggaagaagaacgtgagagtacgggacacacagagacacacacacacacacacacacacacacactcatatacacttatatatatatgtatgtatatatatgtatatatatgtgtgtgtgtgtgtctctctgtctctctctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtttgtttgtttgtgagggtacttgtcataatttcaaagttacgtgccttatccggtagcagggccatatccgtaacatatctggagcaagcactttgaaccggatgctgtatttaacgattagtacggtatcaaaatgattgtttttcattcttgctgatatttcagtttctaaaatgccgagattctcagttgaagttaaagttaagtttaaaggcgttcggttcgttgccgaatgagggcgacctcgataaggcccctcttgaagagagctggagaacagtcaaagctgcaattaacgacgctgtcgaatacgtgtcggatacgtggaacggaattcaagaaacgattggtttgtttctgctgcagaaacgtggcagaacgtggaacgaaacagactggagcgtaaacagcaagcccgtctatccgggacaaaaagcgccacctgaagaaatggaatgtcaaaagatggagttgctgtaccgttctcaagaaacgcggaagttctatcagaagatcaacgcatcccgcataggcttcatgccgcgagctgaaatgtgcaggaataaggctatcctgagatgcttctataagcatcttgatggacggacagatgcgaggtgatcgatgacgcagaggacacagtcatataaggtcaggacagctgaactcatcaatatgtgcccggtcagaatctgggagacggaacagctaccggaataatgggagcaaggcattatattccccatttaaaaaagggtagaatgtaaaatcaatattgtaatcactatcctaaacgccgcctacaaagtgctatcccagaatatcttccgtcgcctatcatctaaagcaaacgagttcgtggaagttagaaatcatgtttcatcgatggctgctcgacaacggaccagatcttttccgtgcggcaaatcattcagaaataccgtaagtaccagttctagcacctgttcaacgatttcaaagcggcatacgacagtattaacctgtagagctatggaagatcatggacgagaacagctttcccgggaagctcacaagattgattaaaacaacgaaaggcggtgtgtaaaactgcgtgaagatctcgggcgaacactccagttcgttcgaatcccgccgggcactacgacaaggtggtagctttcgtgcctgctgttctataatgcgcttaaaggtgtcatgcggagagccggtcttaacagtcgggaaaaaaaatggaacgatggcagatttgttcactcgcctggaatgcgaagcaacaagagtcggactgatggtaaaagcgtcgaatgcaaagtacattctggtaggcggaactgagcgtgacaaggcccgccttttaagcagtgtcacgttagacggggattgtttcgaggtggttgatgagttcgtctaccttggacccttgctgacggccgacaacaacgttggtcgtgaaataactggtgttcagtatgtttctttctctccaagataattactaactccctaaaaatgggtggcatgtttcttttccctcgggcgctgtcagttcaatcgaagatggcgtcgaaacagcaagcactacgcgagcgtgttgttcggtttttcggttctaacgtacgtgccgaaaaaaaggaacccgaccaacttgcctcagtaccgtcccattgaggattttttcggctccctcagtgccctagtgtgcaataataattggcggccaaggatacgatggaatcccttctccaatattcattgacatttttagaagaattaaaattatgtttttaaggtgaagatgaatcgaagccaaacctcaaattttcaaaagcacggatctggagaaccaaacatccgtttaagctgaaaacttaaacgattggtcaccaccagcgagtgaccaatcgattaagttttcagcctaaacggatgtttggttctccagatccgtgcttttgaaaaattgaggtttgggcttcgattcatcttcaccttaaataaaatatactgaactcatcgaataaagcaatatatgattggagaagggactacaacgactcattgtcgttgatcacactctcagaataggcatcctaatgtagaaatcaaggctccctatgggggaccggtacgaaactttgttccatgggagatttatcttcgtaccaaaatgcccattatacgtgagacgggcccccatccgtggcccttttgaattactcttcggcaagtgatttttacgagcgtgagagcacctccccattttgggcgagaaaatgaggtttgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctgcaaactcttggggttaagaacgccgggtgtttaggacaatcttcggcggcgtgcaggacaggtgtgtggcggcgcaggatgaaccacgagctcgcccaactctacggcgaacccagcatccacaaggtggccaaagcttggaggaaacgcaggacagggcatgttgcaaatgccgggcaacaggcgcagtgagttaggtggattgaccaggtgcaccaggacctggaaagcgtgggtcgaagttgaggatggagagaggcggccataaaccgagtgaattggcgatatatttttggcgaggttttatcaagttgatttatgtagaacgaaataaataaataataatattaaaaataatacaaaagacaatttacactgttttcagccaaaggctggacagactgaacgatagtggcaaccagtgccggatttgggcttcggggggcccgggtcagatctcataaagggtgcccttttatacaaaattcagcacgttttgggatttcataaaccaaagtgttgaattgagttttgcgagtagaggatggattaccaactggtgagttcgtttcatgcttatgataacacattttttcttgaaagcgtaacttttatgtaatattaaaacaaactttgtatggttcgtcactataagtgtcggcattattcctgtttcacataatttaaaatatatacatgtaattttcagttttcgtcattaataaaaaagtcttttgaattgttcgacattacagatgttgacgtattttttaaagcttctaccaaaaacttctcgagacaaaaatacaaaactagctttaaatataagtcgtatatttcccccttgtccatggatcgcatcaccgaccagaggtgactcccagatcttttcctccctcactaataaacacccttcccgtggtgattgtggagatgcagaggtattctcggtctctagaagcaacaataattacaccctaacattccttccccatcccaactgactgtaaggacttggccggcgccgttattgatcaataatattagatctgctaaaattgcacttcgagagtaagcggaaactcccatcccttattcatttggatcccagtgcaattctttccagttccgatcaatcacggagtagcaaccattgacatgtacagtcagtctatgctatgctattctatgctatgcaaagtgttgaattgagttttgcatgagatggtcggtccaaagatatgaggggcaaagtgttgtaaataacattctcaattgtgagctatacacattgaaaaatttaactgttttcaaactttccaatagtatttttaggtgatttttccgtccaatgggaaaaataaaacatttcgtaacatattggcttctatatggtctttgggctccagaagaaactgcggtcaagaaagattcgcccccgcaccaaatgcacgatgtacaaaacgctcataagaccggtagtcctctatgggcatgaggcgtaaactatgctcgaggaagacttgcaagctcttggggttttcgaacgccgagtgataaaaacgatcttcagcggcgtgcaggagaacggcgtgtggcggcgaaggatgaaccacgagctcgctcaactctacggcgaacccagtaccgtgaaggtagctaaagctggaaggatacgctgggcagggcatgttgtaagaatgccggacaacaactctgtaaagatggtgttcgccacgaatccggtcggaacaagaaggcgtggggcgcagcgagctaggtggattgaccaggtacaccagggcctggagagcgtgggtcacagtcgaggatggagacaagcggccatgaaccgagggaattggcgaaatattgttggcgaggctttatcaagataattgatataaagccaaataagtaagtaatatggtcggtgttcagacggattggactaagtgttttgtttttaatggctccaagaaaatgtacctctgccattcggaatatcaaaatatttgcattatttgctatgattattcaacttatctatttgatgacaaattcggattataacagcatcggaaaaatcacaattgatgttgtcctcaaagtatatttagcacgctaaaatatcgtctagtcctgtctgtctgaacaacgtgcatataatttgtatggagtgaaaaattgttgaaagtgtttaaagccgtttttttccaaactccttttggttctacttactacatgtttccagtttatctctggtaaaaaaaaggatttacagtactgacaagacaaagttcacaaaggatgattttcatataaaatggtcaagtttggagatctgcatctatgcttctaacaaaccggttgacctgaaatttgaaccgcatgttgaaaaaaacttcaaattagatctgtgaattcatcaaattctatacaaaggtgtctaagttcttaaaattccccattttgacaaaattattcaaatttggatactaagatattttgaaagcaaacaatttacgataagaataatcttttacaaagtttggtatttcatcgaagtgaacaaattttcagaaacatgcctacttctaaatatacacattgaaaaataatccaatttaaaatttttggcatattttttttttgaacagtgttgtttaattgccttccaatttatgattatattattataattataataatttgattaatctcccgtaattcaaattttaggttatttattggatgtaattcaaatttcaggtcaatcggtacgtcagaagctgttataaagttcccttaacttgaacattttgtttttgtatggaaatcggcctttatgtactgttttcctaccagaattgtatattcaatggattatattcaaagctgaacgttttctaaagcaaaactaagcctatactgatttcaaagaaaacttcatcaactctggcatacaaaatagcaaggtatttaaaaatactaatcaacgcgtcacaaaaaaatttcccatacacttcaggtctccgatagaattgcaaatatgtttaaattttgaagttctgataggaacccaattaactctttgaaattagctgtgctttacaggtttagccgtatttttttagatcctgcaaaaacgttaagtgcatttttaattctaatattttctttaaattaattggagtagaatgttgaaggatttggcttgacgttcatgttttcttgtaatatactgtgcgattcagatattaggtaaataaaaacaattaactcaaatattgaaaagttgtcttaaacgtttgaattatatgttcaatgtctgaagagaaattatggaaaggtatgttatagagttgtttgttcttaattttggttcctcggggggccccttcaaccggggggcccggggcatttgcccccttggcacccccccaaatccgggcctggtggcaacggacaacatgaaatacccaatagccgagtcatttgtttcggcagccatgttggctttgcagctcgcaatttgaaagtaatacaactcactccttatgataaaacatcagtatatgggcttatatgcggaaatttttcagctttgtcagtacaaaacaaactggtcacactgcggaacatgtttttatctcaagcacccaaataaccctatttgcttagataagggttgctgaatccattgccgttttcaaaaatatcatagcacgtctagtttttttatatctttattaacgagatttttagccctgggctagttcatctcgggaccaacggctttacttcccttccgaaggaagtcgtcactgaaatttttagtgactatctcggggatggaattcgatcccaggtcctcggcgtgagaggcatgtgttctaaccactacaccaggtccgtcctccacgtctagtttttgagatgcaatatttgactatttcatccaacttgtatgcatgtttgccatgaaaagttcattgtactttcgatgttcaaaagttatttttttgagagctctaaactcttctaaagagtattgtttattgccatataagagagatacgaagaattttatctaaatttattggtttaatttcaatcgaattatggctgaaataaaatattaagtcatattttgcatgattaacaaaacagaccacacaaagtttgagaaatcatacttaaaatttcatttaaacatcatagaaaacagtgttttatacaactttggcgaattgtgacatgctggaacatttctgagaactccaaatctactagagacacataattcaatccttgagacacgcaaaaatgtcatttttgttacgctgtgttaccattactttgaaattgcgaattaaattagcaccaatcatcgattacgcggattccaactcaccatcatcagcttggtcttacataatagttgcgcatttaccactacggttaaatgggtccctttattgtaaacctattttcttcaaattgaaacagatgttccatattgtatttgaattgaaagaggttttaacatatatcattcccatgttcttcagtaagtgattaaaaactgtccatttaaccataaaaaagctgtggagattgttacactatgtaacattaaatatgtatgtgttgaattcaaatacatttgtattgtacttgatatgttgtgaatctaacacatctcctttgcgaaatatccaacagacactttgttaaaccacccactaatgtatctatttattcccactatctgtacgctcataattacctcatttgccaaataaactgtttatttctgttcaaaacatccttatagaagtttagcgttcgcctgttgtggttatggtacatattgcagtgcgcggaccatgactaagattaatgcgaagctggtttgctctttccattgtgatggatttgatgcgtaaatcatttcgtccaccccgtactttccggcgattgttcaagcagcagttgattgcaaataaatatgaacccctcccaaaatactgcggcctgtacgcagattggaaacaagagaagaaatgttttcacaaaagtcgctaaaggccatgattttagtgtttgcctaatgaaattacatttgaatttgctggttttaaagcagcctttgttaagatacaatgtttggcaagagtttttacgtctagtgagtgattgtaagcacaccacgttgagttatgctcccgggtaggataacgttgagttgggtagcgttgtgtttgtacaagacggtggttaccaccaattacgttatttatcatactcataggatgactgaatgcaaaggtcgatctgttttcttcctcgaggcagtagagaagaataattattaattttttgttgatgtgacatgataaattgattgattaataaatttgtaattaatgttgctccaagagcgtatccttttaattacggtagaaattagattatggtcgtctgtcctgacaaaatacagtcagtaacgttaacattattggcttttgcttttgtagataatcacaaatggtaataaacagcgtcctaaccagaagagaacaatgtatgatgaactaaactttttggttcatttggtttcacatcaaatggtttttccatcacattattataataaaggttcttccggagatttgtttatataagcataacttgagctcaatactgacacgttagatcacaaaatcttcagcaaagtacacaattagccctaaaacttgtaagcttcaagtaagtaagcttgatccgttaagaaacttgatcccacccttgaaatcccaaacagtttcattataagtataagtaatactttttagtagcaaatgccttttgcaaaatttaagatggaaagcaagcagacaatttttatcgactagttttttatttcgttcttgtgattattagatcattcagagtcaacaaacattttaaggcgaagtaggccgttgaaatttgtcgttgatgattgttgccaaatcatgtcacaatttcgaattgaagaaaatcagttggtattgcactgatgttactgataaagtacatatcagcggactgagtttaatactttgaaattgcgagctgcaatgtctacatggctgccaaaacgaatgacagactacttagccttcaaatggtctagtaaatctttgttttagttacctgaatcatataaaatatgaacttgcaaaacacacttgcttcatagtgcgtctaaaaccgttataaacgaaaaaaaatctgtcatttcggcgcccagtactcgaaagatgctggtagtattcgaccatctcctccataaattagaaaatatttcaacaaggaaaataattgttcaccatcgttgagggtaagaaatgcataaatatgtcctagttgattgttgaataattctcttactccgtttgctcccagcaaattaaaaaaaaattgaaatgcagccattttggacatttttgcaggatttctttcgttatagttccaacggaattgtcaggatatcttattatttggggaccattgaaagttttggaaatgtccaccggtccagagattcaaaatgaccccatcttcatttgtcgtcaaaatttacccaactaactggtatcatggcacttgcagatgttaggtccagtgaatttgttatgaacatggtttttcacaaaatggatgatatgtactataaatgacaaaatcactggtcagtttactggatagaaatacaacccagctaggtttatggcttcgcacatcgcattgtgatctgcaagaaaaatctacggattacggttatttgaaaatctcgatataccgtcgcagtgataataaaaatcaccaaatgtttcagatttagcaaatttggtaatcaggataaaaccgacactgtgggtaggatcgaccgacaccctttaatttttcatgttttaaacagatttccatgcagtttccaccaaattctatctttacttgtgaaatgttgtgtttcgaatgaatgactgacgtcatttgacgtattgtcaaaatcacaaaacaaaaaaacatagaagaaacggtagttgcaatatttcgctgtcttcattactatttcgcatgttaaaatttaaaaatgtcatattttgttctgctagtacaccattatttactattgttccgttgatacaacttgaaggaggatgtaattttttgtttttttttggcagctgaaacgctttgagaaaaaaatgtccactcggggtaagatcgacactttcatttgaggtaaaaccgacacctttctttgcttcataatccaacttcagggaatctttcttgtcagaagactttctctgtaatttattttagtctttcttcgaattccagtgaagttcacggatggtgaacttgttaacatgtgaaatatgacactatatgactttccacaagctatcaatatgtattcaattttttttgtattttgttatgtttaaacttagcttgaataactttttctcattaataattgagaaactaatagaatttgaaatgtttgtgtcacataaattaatcttattgttcatttataaatcatgaggttccccgaccagaacaacaaaacaagattataacacatttctataagcagcagttaaaaataatagtagttgataaatttttgttatcaaaatggctttgttctcaacctgttatgtttttagtaacacatttataacaacttttctcgaaaacttattcaaacagactgaagtcaaaaaagtataaaaattactttgtttattctacgtgtttcgcagacgaaattctacacgtttcgctctgaaacaactcgatttttcacttttagaacgtttaatttccggatttgcaaaacgacgaaagtaagattttcaactttggcaacctaacttctactttcgctgctccgctgcatggagagacaaagtgacttaaccacgaatcaaaacaaaacactacttgagtcgattttacactggtacaaaaacgtcgcaagtaactaaataaaatggcttatcattttgtcagaaaatttttgtggaaaataatagaaactccctagtttttttaacgtgagctcattgtatgcaaaatttaagcaatgtacacgacgaaaaaatgttaaaaacgtgattcattttaaaacagttttagaagacaggttgtttattaattatttattcacaacctatggaagttacttatgtcgatttgaaaaagtaatcgagatttgttatatttttgacatcgcatttataagtttgttgcaaataacacccgatgtcataaacagtaacatagtttgcaataattttgttattttgtaacatccatgcaacacattctgtaataattatgatataattttaacagggtttgttatatattagtttaatttggtgcaaattttgggccctattttatgagtcgagtcgatcaaaaaatactcgactggagtcactgtcaaccaaaaacttcgctcgactaagttctgtcactcgagtttatcgacagttatcactctatgtgactgaattactatgggagtcgacgggtgacatctgaaatatgcatgcttactttgatcgacaatgacttcagacgagtcacatgaatcttctcgatttacaaaatagacccctttgttagaatttttgttattttaactactaacggtacatgttttataacaactggtgatacagtcaaacctccatgagtcgatatctcaagggaccatcgactcatggaaatatcgagtcgtggaaacaaatgacttggaaagccgtttgacggaaccatcatagtaaccatgaaattttgttttcaatatggttccatgagtcgatatcgagtcatggaacatcgactaatggaggtatcactgtataaaaaaaatatatcaggggaacacattctgttataatcttgtttcttccgtctggtcgggtcgacagttttatctgaaaataatcactctcttctgttttgttgcaataaaactgtatctattttccaaatcattcatcacaacgttatcttcgtaaacattccatgaatacaaattaatcatatccatgtgtattcaccacaactttataatcttagcatggtacatttgaaatttaaacatatattaagtggatctttctcctctcctaatttacgtaatatatgtataatcctttcgaggaaggatcatagaaatcgaaagtcttgcagggtgtctactacctggaaaacctggaattatcagggaatttgattcaacctggaaaaaaccttgaattctcaggcaatttcggctacactcagggaaattattttgtagcagtatggtaccacaactatacaatcttagcatggtacatttgaaatttaaatacatatttagtggattttttccctctcctcatttacgtaatatatgtataatcctttcgaggaaggggtcatataaatcgaaagtcatgtttagagcattctgtaagtttcggtcagccaatcgggagcgtcttggagactccccgactcaactgcctcagggtcggcacgcttaccgtaatttaccgcggacagggaatcttcgcactcgaaatttaggaaaacccacagcacttcactggtcaaaaactcctactttattgccttcactccagtttcacaggtttatttgggctacaccttctcctctctgtctacttctttgctaacactttcttcccactttcttacagactaacctgacctttgtcttccttgttaggggccccttcttctcgcagctaccaccaaactccttcctcacgacctggtatcggccttcggcgctctcctgcgtcgaccacgtctggccacgctcttctcgggttggcttggggaacttcggctgcggcctgctgggaccctcctacgcgtcctaggctaccgatttggtgacggatcggtcttcggcttataacgaggccggaaagtacccggaataggtctctaggacgtcgtagggcggtaatagaaatgtggttctataccaaaaacggcggggtcctggaggaatggaaaagggtttataccacggtaatagaaattgtggtctttttggtggttacctggtgtccacttttcgctatcttcttcctcaactctttgtctgcttttcacttaactttttgaattctagcttaacgactagcttcttcagctgtatccgggcaagtgaacgaccagtaatttattttcgaccgtagaggttcttgacctaggtcgtcggtcattcccctttcccattcgggttttcaacgatggcccccatttcgccacccctcatggcgcccgaacgttatgctaccagacatctggtggtgggttttgggagctcggtgggtggtagcctgcatggttacggtcatttgacatactactgccctagttgtatgcctagtgctactggggaaaaacctagacacctactacgaatatttcctgtcgtttctacgtacaaacaaaatacaaaatcaccttaacactagcaactgacaaaccaaacacttacaattctttcaatatgccatgtgctagtgatgaacaacgtataaattctactcaaagtgcatgtgtcggttttaccccaatagggtgtcgatcttatccgtactctcaattgtttcacctaaaatgacgaaatttgatttaaatcactatataaccttaatatattatccagcgatctcaatgattgatagatttataatcaatatgtgattctacaacaattttagattagtttaacaagcgaaagaacacaaattatatcaataagcttagtgtgtcggttttatcccgatttcccctacattcgcgtccttgatgaccgcatgaatccaagcctacatgcgcattaccgccgccactggatgtggatttaaaatgagcgccgcaatatcattcaggtatcagaaaatgtggctcaggcggcacgttcccctacaaatgggagatttgtgcctcgcacgtcatagccatctcatcacttacccgaaggacagatgggacaggagcgagggaaaggaaggggaaaggagaatggaagaattgttgcaagcaccccagatgtgatgctagtacaatttaaatttgtatatataacgcacaaataaaagaagaccagcattgagagattttcttttacattgtcataaaaaaatagacaaataaatggaatccagttcagcaccccctaagggatacttaaactcattcaaacagttcaacatccgtaacaacaacaattctcatactagccatagtataagtccgttgttgaagacgttgaaaaaaaaagccgttcggagcttatttcttcgttagtagacaagcagaaattttatggaaaccatagttcaccataaagttttgcttcttaagaagatcaacagaatcatcgccagaccatatcagatactgcaaaagaacaggcgatgcccgttctgcaatggcttgatattattaatcttccaaaagtttgccaaaatcgaaggattttgaaaaactaggcgatttaattcatccgtttgattcagattttctttcgcattccaaggaacgcgcaaacaaatattgtttgtatgaagactgaatggttcgaatacaaactgaaatccgtcaaccgccttttcattgatcatcatcaacttttgttttaaccagtcatggctttcctgattttcaggcgaaaaccacatccggccatacctgattccacaaccaaagaaagacgggatcaatgagccaggcgacgtttggtatagaaagatgttaagatcgcaaagtaactcatccttcaatgcatctgtgaaaaagccattttcaagctttatctgaaaacgcaacgaagatcgtgagttagtagctctttcttcaggaagaagcgctatagctgaagaagcagctttgcgttttaacttctttcgttgattcttcgcataatttttccctctagaggaagaactagcttcaacatcaccagctggtgtacaagagtttgcggtcggtaattctttaccagtatcctgagttctctcaaaagtatgtccagtagatacttctgaagaagacccagaatgcagatttgaaccaccgatagtattacccagagagtcagccatgataacgctgcggtttccaaaagctctaatgaagcgatcagcaatcaaaggcgtccaaaagggaaaagaaagatattctgaaatcagatcatctctacacccgatggaagttgctagttcaccaacacgatcatttgtgatgagagtttagaagacataaaagacctccaaatctaacacagaccgacgataattcgtagtacaaacgatatctcagttgcacatacatacctaggatagcatccaaagagtgttcatggatcgcttgcaaatattcatacatcactgttatggttgatctccagtcgtagataaaacagagatcctcacaacgacacataggattcgcgaggcgacacgatgcttttcgtatactacaccaagcattgcaatgcaaatgttgaatatcttcctacactaccattatattcacaaaacgagtttgatttgaatacttttcgtatacgtagtggggggtttataccagggggggtatacgcaacgaggtgcgcctaccgttcatgtttcgtgggtgtgttcgtttggctcacaacgctgctagggatcccgctgtttgagtgttgaaatgcatcagcatttgctgcctggcatggcccgcgttttcgacctgtgctatttgggccttcccgcgtgagagatgatgctgtttgggtcggcccgcgtgagagatgattgttaggcgagctttgtttgtagttgacagccgtacacccaccctggtttatacaaacagtattaacgtattcactctctgaaaaaaactacatgcgctgtaagcacacgcgtttgtagatcagagaagagattcccgtttatgatgagacgagtatacatagacaaccgagtctgatctagtacctcatcattaactctcctaaagagaatttattccccacaattcgtttgtttccaatacgcacatgagaacaacgttgatgtgagaatgcatccaccacgagcgaaaactaaatgaatacatgcacaagctaacaaaccttcttgtatactataaatgaaaacacgatgtttaacctaaaatgggctataacatgtcatgctaatttaaggaatatttttcacaatatttcaaaatacacagtcacaattactgaaattcactacatttgtactgtgattgcacagtacatcacgtattagaatgctagacacgcattattagacgataacaccgataaattattcaatcagatgggccatcgcaaaaaggcgtccactacccatgaacactactactatctactattaccgccgccactggatgtggatttaaaatgagcgccgcaatatcattagggcaaacgctcccttagtggaggtagctccaatagtggaggtagtgtgttttggcatgtttcgcgctaattaatgattatctgatatttttgtattatgtacgatgccaaaatgatacaagtaatcgaataatactcatgaaatttaaccgtaaaactatttaaaacaattattttgcttaatttttttgctcctttgcacctatagtggtgcatcagtacccatagtggagggtcccataagaaatcaatggtttgcgccactaaaggaaccatccttaaaatatacctccactaaaggaacagtgttcctattattggtgcaaggctttttgcagggaaattttaaatgaatcgtgatttttatacatttgaatgatagaaggatttgagatctatcgaatgatacgttaaaatcatatatttcatgatcttaacaccgtgttttagcagttttcccttaggtgcaccactaatggtacacttgccctactactattgctcgcatttatgattatttacaaatgcacggaacagccgaaggctatggtcacttactcttgacctaaagtgaccagacatgttggacttcaatgcgggacgtaattcgcgaacttttgaaaatgagtgtaagtaatattaaatatgacacgtttttttaataggatttgttgtcgtttaaaattattaagattttttttaggaatcgattaattttaaactatttatttctatgaagttttaatttatttaagttactgttttgcacttttgctgaaaatttcacaggtgttttcaaatattatagtaggatttccataaaccgtttaaaagttttcaatattgaacaaataaaaagtttaataagtataaattgagatctgaaacatgttttattttcaattatttgaaggggttccgatcagaattttgtacgcttttcaaaccagtttcagaggcaaaaaatatgatatttaaagtgcatcctcgtaagattttggaatataattcaaaaaagaatctaaatctagaagggtttagagtttgatccggtgagttagtatgcttgacagaatccttggaattcagacttgcaggattaaaaaaaatatcttgggaacagaaccaatattggaaggtttttaacagagcccagagaaatttcttgtcggtaccatgagaagattctgaactaaatcatgaactgaaatagtgtggacaatttgtaccagttgatacctacagcgaaaattttgatttctataagaattttgtaaggacttcgtccataagtgtattccataaatttcgatcataaatcaaatagttacagaaattttgagtgcgcataaaataaagttaggtctcaacaatatttgcgaagacttgaacagaaattttgtaataataaaaataaagtcctgtttagaaattgactaaaatcctgtggaatctggtaagatttcgataagaattctgttggtccatgaagaaagccgaccagtaaatttttatttaacaatatattacatttcattattcaaatttgaagtacaaattctattttttgattatttctacaattcggaacgttttccgggacgtttgataatgtgggacacgttgcacacttaacacttaaccttaagaagatattacaatgaagagattccgaactcaggaagtattgttgattattattcgatttctgagtggccacctctactgctacttcttgaagaaatttgagacatagtgtatgtcttcttgaagaaatcttacatataccaagtattacttgagcttcatcatggcaatcaaggttccgaattctcgctcattcttacgataatggatttctcccgcacaacaaatttcagcgaaaaactgcttcgttcgaatgtgagaagtttattttctctttctcctattcatggagaagtttttttttgtatccatcgctacgagcagtagttgcttttatgtacataggtaccgaatttaccactgctttcgttgatgtggtaacatcacgtaaaccattgcacgcatcgcgattgtttttaacaatgttctaggttcgaatcccctcgccggcaccagtttttgtttatccacatggtgataattatcaggagaagtttgtgagcgaacatatgatggaatcaaaaagaaattattcccagagtggaatgattttcggttacgctcctcagtaactctaaggaaaataagtatgagcataaaaagatattcccgtgaggatgcgtaaaatcttagatttgtgtcattgatacgaaaactcagaacccttatgacaacttttaaaaagttttattgacaactctgtcaaaaaacgacctagattttcacaaagaatcattgatatcttgtctgaaatgttgcatgtaaaccagtatgattgaaaaattttaagggctactcaaatgcaggttttccaagggcgccgagaggccacgctatggctctgaacagcagagtttttattttctacgatttgacggtttgaaaggagggcacagggcagcgtgtgctagaaagaagtgaattcaccgcagaacgaaaaggcagcacgaaacacgcgtggtactttaagcttaagatagcatacaacggaatgatatgcgtaaattttatgcaatggtcaacggcgcgtggcactttcagcagttgtagaaatgtagtgtgaaacagggtgaatattgatgaagacggtcaagcccaccgaccatacgagaggttaaaagggcagtcagcgatctgaagaactgtaaatctgttgcgaaggacgagttcccagttaggcttctcaagcacgaaagtgagtagctttaccaaacgatccaccgagtacttctgaaggtatgggaggtcgaataaataccaaccgatggatgggaagacctcatacatccaatctacagttgcagaggaattattctgcggcgtacaaaatactgtcacgcatctaatttaagagactgagaccactcgaggagtccttcgtcgtcgattttcaggctggtttttgtgagagccgctcgacagcagaccagatgtttaccttaagaatgaccttagttacattccaggataataatttgcagaccctgacgacgataggagcaggtggaaaacacagcagatcagcgaagccgcagattctgatttgtacgggaaataaaacacgcgagctaactttgaacggtttaattaatcgagaaaattattattattattatttattaaggaggttttaactacaaagtcattcgcctcgaaatatcgagaaaatgaaaaacaactgtacgcgggaaatgtgctttttggaatgagcaagaatgtcaaacgtacttggggtacaccaatgctctagtattcatactcacggtaacgcgccccaactagagatcggggagtcgtgagttcgattctcactgagaagacgtgtaactttttcgcaaatcttcacatcaatttgtccatctaatccaattgcaaattatatgtaatgtttagctttccggtagttgttaaacttccactcggctgattggccgtaaaccatgattcataattaaaaacaagtatttattgagcaacggactcatgttcggtaaccggtcgtttgagaacgtcgcgacccattggaagcccacacaatagaaacctcagccagcgcagttgctggctagtgtagtgtgctattcctatacctaaaaaaacaatgcgctctcgggctgggcattggatatatatagaaagcgttgtgtttggatgggcatctaattcttccgaaagaggtgcactttgcgaaataggaccacgtgattattgagctgaaatcaaattcaggttaacttctgcgttcatgagtcctctcatggcgtagtggtaacgcgccccaactagagatcggggagtcgtgagttcgattctcattgagaagacgtgtaactttttcgcaaatcttcatatcaatttgtccatctaatccaattgcaaattatatgtaatgtttagcttttcggtagttgttaaacttccactcggttggttggccgtaaaccacgattcataattaaaaacaagtactattacatggtcaaggacacatgacatacaatttatgttctgttaagatgcgaaatgcacacatttggcatttcatcttttttggcaacttctttatacgatttaatatgaccgacggcagacggttgataactacgtagtttttccatcacgaaacgattcaatataagttcgtttgcaaacagtatactatttatttcgtttgttttttcattgcaagagaaacgtattaaaattggcccattctcacctcatcgaggggttgacattgggcctaacaaattgaaattgattcgcaataagaacaaattaacaaaatcgttttccgtaatataatggacataattgtgatattttaaaatagtaatcaaccacctagaagtatgattttttataatacactgtcaattaaaaaagaccttaactccaatctttttttaatgttttattaaaaaaatcactgactcccgagatcctattgtgtttggtagtatagctgtggataatggattatctgggatattttagataatttagatagatgtcaaccccgatgacggtcaacttaacacaacgacaacggcgatgaacaaaaaattccttctttgcttgcaccgcaactctctatcaccataatatagaattcctgtaataaatgaggacagtatcaacaccatattgtttcaattcgtttatatttttatgttacgactaaaagccctaaactgtaaagtaagtcctaaaattaaacgtgcaaccactgccggcttaaacagtctgcccaacgtttcaccagaacaaaccgttttccttccagatgcaccatacaatggacagtatcgacatgctggatccatcaggttcgatgacaacattgactcctatgtctgatgcaccaataacttccactcatcaccaactacatggatcgtaccacagtatgaaccatatgatggggcatcatcacagtggtccactcggaggtcacactcctggtttgtgcgaatacatttttatgttggcgtttggataacaactaatttcttattgttatgaacatctcatttcagatggtttcctcggagctcatcatcccgctatggcagtggctgttgcaaccgctggcttacatccagatacagatactgatccacgagaactagaagcattcgcagagcgatttaaacagagaaggataaaattaggtaagaggagaatttagtaaaaaatgctctcgaagataaatgtcctgatctcggacggaaatgagagccaaatatttattcattatcgcagtttttcctagaagaaaccgacgctgttgtcaggaaaaaaaaaactgtgttcaagttgtactatcagcaaagtacgctatggaccaatgcacgcgttcattctctgacgttttagcggtgccatgttacagtctggaccattgcaacaagtgaattcggcaccgctcaaacgtcaaatttggctgcgaaccgcttcaccagttcgtttaactattagttaaaatttgacgttttgatagttattttcccctcaaatggttaaattgaacatcgcagtcgatccatttgagctttgacagtcgagtagttatttcagaacaaagttgacagatggttagttattctcaaatttacgggagcagaaaataactttcgaactgtcaagattaaccatgctccagagcagggttatttctaaccggagggggaataactatcgagctttcaaattttaactaaaagttaaacgaactggcgaaacggttctcagccttagtgaactcgtgcattggtccataggtccatgcacgagttcactaatttgacgtttgagcggtgccgaattcactcgttgccatggtcacgtaaataacacgccaccgctcaaacgccaaataaagaactcgtgcatcggtccattcttagctgtcattgttatcacttgactcatgataggccttttcatatgacaggtccgtctatgcatttgtttacatcggtggaggaccggtgctaatacgggcctgtcattttcatagaagaactgtcaaagagcttccggatcagctgacacttgtgaaaaccagatttatgttagacactctttgcgcactttgtctatgactattgcgcgtcccaaaatgtatgaattattgctttatgatataagaattaattacctattcaaaatattggtttttcttcagttatgtttcaatttagtattctctttatcaactggtagttttttagttaaataataaataatcagctgtctaggctggtagtgtagacagaaatatcttttttgtatttgttttccttcttttgaaggtgtaacacaagctgatgtggggaaagcacttgcgaacctgaagctgcctggcgttggagcattgtcacaaagcacgatatgtcgatttgaaagcttaaccttgtcccacaataatatgattgctctcaaacctattctacaagcgtggcttgaggaagcagaggctcaagcaaaaaacaaacgaagagatccagatgcgccaagtgtcttgccagcaggagagaagaaaaggtagctgaggtttcaattcaatatttttaattcacaattatttgattattgcaatgctatttttaattttgttatctatttcttgtagctcaagtttcaacaacaatgcacatttttatcatttgcgccggtttatttgtatataatgtgagttttatttttttccgaattcatttgtacttagtatcgtgaagtgtcgtaatagtgggaattatgcaactgaaaagagccaggtacatgttttgcgactgagaccaagcaatttccttataaagttaatgaattttttgcacaatgtcgaatttggtcgattgataatagatgagctttatgtataacagtaagaatgtattttgttacaggtaaaaggtcgttcataaattacgtcacgcttttgggatgacggtccatacaaaatatccatatctccccgcaacaaaaagaaaaggacgtaggagggagggagttgaacattttggatgacgcaatttatgggcgatctcgcatatacattaagaggcataataaaactacgacaatactaaaataatgttttcaatgtgtttgtttcttttcatttctagtggtatatgaattgtatgctcttctaaaaaaaactgcataccgtgatgctatcatatttcgcgcacgctcctgattgcgctcactgccattttattcatatttgttgatacatattggactacatgtgatgaagccatggtgaagtagaattattcaaaatactagccaacaaatatttctttcaaagcgcaatgggttacatgcatgccctgattcgctactcgccacaccgtaacgcacatgcgctagtgtctatgcacgaaaaatcgctaaaaggtaactcggaaaatatttgcatggcgaaatgcatctaacgaattatttctcaaaattgggaagtattttcgaaaaaatatttggtaccggttgtacgcgatgataatgactatcaagccaaccaaatatttttttgattaatgctttcattcacgagaaatttgaagttagatgcctttccccatacaaaattaaacgagaaaacttctgctgatcaactgtgaacaagagcaaagcaggtaatccattagaagcggtacaagtacatgacctcgattaacataatcagagggatgacgacctattttttcactatggaatttgacagcttgagttgttgtctccttatcgggagcataatttatactccagaatcaaattccactctcacacgtatatttttgggatgtttaccttctcctacgagagaaaacagtacaaagcgcatggagcgcaacgaaatctgctaaagctgtttgatggtaatgagctgcagaaaagcaaatgtttcttcgaaaaattaaaccatagataacagacacaaaacggaggtgtgaatcaatttcttcagaatgaaacgctagtaatgcgtcgaatttgtgttccgtggctcatttccccacatttgcaccagctgctttgttgatgtgcacattcgtatgggtgagctctgctatcgttttataagaggcaacagaaaaagatcatcgtagcaatcccttgaacataatagaaaagaagaacactaattggactttaacacttcacacgcaaaacaaatgtttcatgctcactaacgccgcctgatggccttgagctaatgagcaactttgccgaagacgccatctttctatgtggtcaggatcctgagataaccgctaaacaaaatttagatgctcactagcgccgcctggtggaaaaattttgaatctcataacttatacaatgatagtccttgggctaatgaacaactttgcccaagacgccatctttctaagtggtcaggatcctaagctatccgcaaaacgaaagtactatgctcactagcgccgcctggtggcaaaatctggaatctcttggctagaataatgatagtccttgagctaataaacaactttgccggaggcgccatctttctaagtggtcaggatcctgaattatccgcaaaacaaaagttctatgctcactagcgccgcctggtggcaaaattttgaatctcatagcttttataatgatagcgcttgaaatactggacaactttgcccaagacaccatctttctaagtggtcaggatcctgagatatccgcaaaacaaatgtttcatgctcactaacgccgcctggtggcaaaatttcgaatcttatagctttttcacgaaaaaaaatctaataataatgcggttcgtgtaaattttccaatattttgtaccaaacgtataatttattggttgaggtacaacaatttcaacgtaactgtacaaataaatgtacaattttgatttttcaagtgtttttgatgacaagcagcaagaaatatcgagcatttgagatagcaattactgttgcaagttacgcaacaagggtagtcaaaaacgtttttgatttttttagtgttaaattaataaaacttttatttggttcttttttacactgtcaaatactgtaactgatagcaaatacctcgaataacatatttcgaccgttgttgtggtactaggaacgattgtcaagcatgtttttatacgatcaaacgtgtgataagattttcacctccatcaaaccaaccaaactagaaaaaatactcgaatacccgaatgctcgctcaaatcttctgtcttacacctaaagtcgataaccggagcgacaaattaaaataattttatcgttttctatagaaacgtcaattcgatatacactcccgtgcaaaagtttgggttcaccccctcaaaaacatactgaagtgttctgtccattcaagtcactgtgattacacgtccaattgaaactctttaagccgcattcgaaacgcaaaggttattgttacttcgtatgaatttttccaaaatcatttttgaattttatatactaaatttttacttaaagttgtgacatttaaaaaaaaaaaacacactgaaaaaacatagctaatttccccagcattggagagaccaaaatattaaaacgaggtgtcattagaatcgtaatcttatattctttgaagtgcactcacaaaatttctgcggaaaaatctaaaaactactcaaaatcaaagaaacagtcattcaagtcatcatgcaaaagtttattactgtattactcgaatttatacaaatatttgtttccatacttgatcggttactagcacatttatcctatgtaaaatatgttttttggaaaaattgatgagatcaaaaatgaataaaaattaatattgtgtctttcgtcataagtgtctacagtcgactctccacatctcgattttctacatctcgatatctctccctatgtggatgattgcttcggtcccttcattctgcatacgatttctctctccatatctcgatatcctccttatctcgatatctccatatctcgatgtgttcctgttgattgtttgttcccaatttcctctccatatgtcgatatgaacattatcaaaggttactagaccaaatttaagcgattcagaacaatttggaaactcgaaatgaagtttgtttgtttattattttcctagtaacggcgtgattttcaatctagtgttcattaaattaatgttctttgtctcgatctctccctatctcgatggtcccttcgatatcgagatgtggaggggcgactgtattttattgttttttttttttaaagcactccgtgctcgtggccactactgtgccggaatcagttcatctgtatctactataccgatacagatctatttttaactaatctatatttacatctgctttcactctcctctactcttttactctcacaccgagcaggtaggagagagctctgctgttcagtccaatcgatttccataagccatagtcctttgttcttgcggtggttcattttgccgtgttcctaagtcgtttgaggctagctgcctacgaagagggtcagtttgtctcagtcaccatctgatactgacggaggatggatgtgctcccccaaagcacggtcctccgtgcggcgtcttctggtggctggacggttttttttttgtggaggggcttggaattgaatccatgaccttccgcttatgaagcgaaagcgtaacctcaaggctacggaccccccatattttattgttttctcattcttaatttgtttttaaccttcaaatattttttaccgtcgatggtgggtcaaaacgaaaaaaaaataatttatgaaatattcgctaaatgcactattttgtacattttggtcgctaaagtcaccattattttgctgtctggccgctaccagacttggatgttggatctcgaaaatattgggatcatgacgtcggcactattgctgctattgaacgcggaatgccgcaccgaaatttaaattttaactgttggcgaatctcaaggtctaaaacaatcacgatttcactaccgtacatatcaccacgggaaacaggctaggctatgatgataagactttctagacaatttgaaggtaaaaatgcatttaactagatgaaaaatgctgcttttacatactttgtacacatggctcttcaattatttggtataattgaacttttaaatgggtttgccatccttttgaaacatcttagttgtcttttcatcttgtttgcatcgtaattcatcaatctttttcagctgtgaatggtttcgcaatcatattctcaaaacaagttattccaattacaatgacccaatatcaccccatctatggatggagattgggttttttttttattcacttgtagtgccgtggtgaacaggaccatacacgctcaattaaaagtttattagagttaaattgcgaaagttattcaataaataaatcatacatatccttttttgactcattcccacccacaacgacggtacatacataatacatataagctgattttcccatatatacctacctaaatttttacacaaatttcaatagaaattttgctcagttgtttggaatcccactacaaatcaaataaaatgtgatctgattcgatacattctaatctgcatttttctttagaactgttttccaagttaacacttcggtcgtcgcgctgttgtattttgtacaacactgtcgttcacaaccggacggttctgacggtggcaaaccgtgcgacgactggaaggttaatatagttgttttctttgtttgagcgcattcaaatcattgttttattacttgtttgatttgttgtatgcacgatttcaatagccaaccatattttaataataagtaatctatatcgagtcttttttcaagaaaaaggacttccatcgctgcaccagaaaagcgttcccttgaggcctactttgccgtccaaccgcgtccatcaggcgaaaaaatagctgcaatagcggagaagctcgacctcaagaagaatgtcgtccgtgtttggttctgcaatcaacgacaaaagcaaaaacgcatgaagtttgcagcccaacactgaccaccgcaccaaagctctcagtttagtggcttagtgaatagtgtagcatctttaggaagcaatggaggcgttacggggtttggttattaatagacgcaaaacatttcactcatatgatgatagcaagggaaccaataaatttaaaaataggcgcctaatcttaccatttgtacattgaactataaatacaaaatgaaggtttagtattaagtagatgctagtgatactataaaagcaaatgaaatgcgaaattgtgatttcggacgtagaagcttgagtaataacgaaaagtgagagaaccgtgtacagtttgataattctatactccgaactcttaaccaatggtccgacaaaaagaactgatcaattctaatatgtgcaatttatcattaagttttccgaaaaaaaacatcagaaaaaatattttggtgtcaaaatatttctatttctatataggaggacagaaaatttagtttattgtaaataggcaaatacaattaggcaaggcaggaacacacaagaacattagtagagcatcaaagtgttttagatgcttaaggcaggctataatattctcatactgccaatggaaagctctcgagaattgcagatttttgtctttatttttcagttgagaattgttcggtcaataaaaatgccttatgttaagaccaatgcaatcgggaaaacccgaagctatttttgcataaggaagtaacaaaattatttcgatgggccaaataacatcaattatttccctttttgtatttttgttttgttctgatctactgaactgtttcaatgtaatgaaagaatagggtaaccaataatgttggaccccctgtgccattttcctgcaaatttcccagtttaaatcgaaagaccaactcaattcgcatgctgtttggaaagataggactattcctcacttgcatcaaccgtttgtacaaagaaaatctgtttatttaatctgaaattacagtcgaatctccacatctcgatgttctgtatctcgatatttctctctatgtcgatgatttcgtcggtcccttcattctgcatacattttcactctccgtatctcgatatctccctatctcggtgtgtttctggtagattttcgtttccaatttcctctccgtagggtgatgtgctagtatccatccccaagtaactactaagccgtaaaaactggcaccaactcggttctatagtcgaataaaaggcatagccaacaggactaacaggaactatatcataattaagggcttttaaaaagccacttttggcgaattattcggctgataaatagcctattcgtaccgagtcactgaaatgagagatgtcaaaatgttatagcatgcagcaaaaaagaaaaaaaaggtttgtttatcgtttattggtttttttccttttctcatgctctcttctgtgatgttgtttttt

SEQ ID NO: 127 - DNA, 90918 bp, Aedes aegypti
tgaagagaaatcgatcatgcgacttacgcccttattctagcacacgcttgatatgtaaaatgagaacattatcttgagtgtactcattcgagaaaattacaatatttatgtgcaactgtacattttttccagagaccgttttgttttttttgagtatttatgcgagattttagattaatttttctgctaaattttttggaacatctcaaatttgtgtgcgtttgcggttccgtgtacgcttatcatgcggtttgttgctcataatgccaaccttttaaagttgaagcgaaaaatagtgacagaacgacgggagtaatctcaggagtaatttaatgatggcctcttcggtagtagataaaatacaatcttgttgtatcagttaaggtgtgttcgctagaaaagaatattctgccagcgtttgtattctgtatgcaaggattaaaaagggtacattttgaacagtcatgtgataaaacctatgtaattttcgttacagtcaacaaaacaagatatgttacatgacgtttcgtggagtgcgacctgtgttgtattataaatattgctgttaatccgagtgttacttgataaaataacacaaaaatgtggaacatgatgtgtgatgttatgcccacgatctccgaggacagtatctcgcagagatcgtcccaattcagcggcgaggatccaaattttgaacagctaatggtatcgatgctggatgaacgagataaactgatggaaagtctgagagaagcgcaggagaggcttgccgaatcggagaataaactgcaagatatcgaaaaagaacgtgacagccttcataggcaaatagctgctaatttacctcaggttagactctagtcaaattcacaaatcaataactcctttcgcatttctctagctacggtatagacgtttttgaaatatgttttcttttgcataagttatgtcaatgatcgcaatggccaaacggccacacaatgatgtttgtcgaccagatgcattacacaaaagatggaatgactactgaacagttcagggaccacaatgccgctcaatgccatttctatttacataacattacagatcgaaaatcatgtagctggataattcgcccacaaaattagatagggtgggtgtactcttaaaggacattcccctataatcgcgctcgtggctttttacggccggtataaaccgcagcaaaacatttttgaattgaatgaagctcagaagctatttatctgagtaccattgatttataacgcgatttcatccaaaagatgattgaaataatgagtttcgatttaaatcttaactcccttgcactgcccataaatgcatgtcagtcccatgtttgctggatttcctattcacatgggacaattatgcgtttatgggcagtgcacctataatacctctattagcactactaaaacattttatttttattgaactacataaagagagaattaaggacttttttacatcaatcgaacatttttgatctactatttattggaaaatataataggtttgtaaagatacgattatgatttaagttttgtctgcgtcgtgaagctagtgcaattatagaagcagaaattagtgctactaaagtaaggtgaccagacgtcgcgtttcgcgggacaacgcaattttcaacattatattactgcgtcaaatctaattgtttgactaaactgagaagttagatcatgatttagacctaaaatatttgtagaatacacatccaatacgaataatgcttaattgggaacgagatctgacagggtgtccgcgggacatggtcgcttcaaactaaaggcatatgtggtcctctagtgcagggtatcttacagtgccgtagcgtggcctcacggcgcccttggcaaacctccattttggcgccctcaagttaattctgttttcatacaagtttgtatgtgattggagttttcgtaaaatatcccaagtaatcatgctacccaatctgtaagtaatgcattcaaacagtgcacataaaactacactccaaaaattcatcaggtatgattcataacaaaaagcatatagcttttttccataatgcttttcatataactcttattaagaagtcctacagatagagtacattatgaaaatcagataccttttaaacaaaaatacgatgtatatggaatccatttgaagttggtattataaacaaaaacatatacatttcgtcagaaactaatatggattataattgattcattaataaaactgaaatggctttcaaaatggtatttactacatgattatttgaagtaaaattttaaaaataaaaaaaatcgttcaagtagtacatttcaaaattatttgtttcaaatttcaatgtatggatattagaatccatgaaaaaagctttcttcgttgacatcaagtattgctgtgtgcatttgcaatgcaaatatcaaatgcgggaacaccaaacacggtaagatttttattgctgtgtgcatttgaggtgcaaagcttcactaaatgtccttcaaatgcggtaagacaaaacaatcaaaggacacctagcaacgattatctaaatcgccgccgacctagcaagaaaaatctatctttgacatcgcattacttgaggaaaatcttaccgcgtttggtgttcccgcatttgatatttgcgtttcaaacgcacacagcaataaaaaggaaggcgaagtcaaagattgattttctttgctacactccaaaaattgttcatatccgaatcattacaaaaaacatatagcttttttccataatggttttcatataactgctatatacaaatactatagatagagttcattatgaatatcacataactctcaaatacaaaaaatatatagatattgaattcggaggaatctgaaatcatataccaaatcatatagattgtatttgttgtatatgacataacccaatgggttatctaatgaaaaataatgggttgtcattcagcgcttgctgcataccagaaatacaatttcaaaaataatacaggcgctcaaacaatcacaatatatatcaagttttactaattgacgcattttttaaacatgtcgatgtcaatagtataaacccgatatctattgtgacagcttgagcgtatgcgcaattcgcattccaatgcaattaaataaatggcttttcatactttcgaataaattgttttaaaattttaaaatatttttttttaaataaatttgttttgaataaataaataaataagttatgatatacgtatacgagttggttcagtgtaggttggcggtgatatggatcatggttgctaagtatcctttggttactttgtgttactgcatttgaagctcagttagcctggatttgcacgtcaaacgcaaacagcaatacttctccagcattgaaatcttttatcatccgggtattcggatccactatagtcatctgatagttacaactggaactagaacacaggggatttttgttgtagcatggtcagtacagaaatctaaaacaataaaaccgtgttgacggaatttaggtccaaaactaactaccgaataaattaatttactcagataatgtcaagtaaaacttcaggaacagctgtatggaattcgaagcgaaatttttcaacgagcatggtaaaagcttgtaaataatggttccacattctgaaatataaacaaaaaaaatacgaatatcgaatagctgacatttacagtttaaccttcaaaaattagcaacgtcgtaaatccaaaatccgctagcaaattgaatgcagtggccgccatcgtgtcactaaatataaacacaatttttttcacaatacaaaataatataccatgtatctgattttgtaatgaccgaatgggcaaacgatgtttaataagttttatgtgaaatgcaaacagcttccatatggttattatttcaacctcatcggagcttcatatagtcttcattgggtgttaataaaattatcaaatatgaattctgatgcgtgtatatgattttccagataaatataatcggattaattcgctcagtatagcattactgtaaatccacagacaaacagacgtcacactctcacccttgtccatcgaccacctttttaacggtcgatacaaaaatatggtaggggccttccttagccgagtgcttagagtccgcggctacaaagcaaagccatgctgaaggtgtctgggttcgattcccggtcggtccaggatcttttcgtaatagaaatttccttgacttccctgggcataaagtatcatcgtacctgccacacgatatacgattgcaaaaatggcaactatggcaaagaaagctcttagttaataactgtgaaagagctcataagagcactaagctgagaagcaggctttgtcccagtgagaacgttaatgccaagaagaagaagaacaaaaatatggtaggtggccaatccagggtgtccatccatccgggaaaaccgggaaaaacccgggaattacaaatgaccgggaaaaatacgggaaatacccgggaatttgttgaacaccccgggaaaacatgtttttcaaacataagactaccagtttatttaaattttaagtactaactagaatttttaacaagggatgcaacaccgtctgtaattcgtactttgcattatgattattttttggtgaggtgatagagggatacttaacgattgggatctttgtaacatttcaagaggggtacttaaagatttctgacaatgttcttggcgagatgattgttagatttccatttgaaatcatggcaaattttatatgaaatctttgctagaatcctaacgaaaatcgaaccgacattcgaccaatatttaaaaattctttctgagagatcactgaaatggttattagtagattgctaataagattttcagtagattctagaaaaaatccttggctgattttgctttaaattcatagaagttaatgtccctctgacatttggataagaatatatttttttaaatattatccgttcaatttttttctcacaggagctctttttactcagaattttaatcacaaaaacatagtaaatgttcattcaaatagcataaatgttgatacatattttttaaatagcagtttcctgagaaaaatcatattaattcaatgtgaatttaagaaaaaaacaaacgaattaatatgatttaaaattgttttattaaaaatttccactaagatatttttttgaggaatgcgcagaaaattactgagaccctgtcaaggatatctattgataaatgtataatttttcgaaggatttccctaaaccgctaatcagtttccttgccaagatggaaatcacgaagcatcttacgcgtgtaaaccaacgcaaaacaaacacgacagactcgcgaacaaacttgatgagagtaggtttgcacctgcctgcacgggagaacataccagaacaaatattaaaatgttcgtgaacatttactcgcgtgcaaccaaataaggtgtgatttattatggttttgacagacaaatcaagtgtacatccatcaaatcgacagtaaactacaagtttgtaataaaaatcccatgaagtctagaaaactcagaggcctttttttaccaaaagcccaattgacttcgaacagctccgattacgtacacgaaaagatttatcatcaacagattacaacacttatactcgcgagtattttacttgtttttgttctggttcagcagacatgttcaccaccttcatcgctggttcattgacagtcttttttttcaatgtcattgatcatagacaaatcctttgtgagatctatttagatatgcttggaaaaacgagaaagaatatgtttttgtaattgtagttaattgaatctgttcctttttctgatctgcatttaattcaccatatactaaaaaccaatcaaatctttttcatttatttaacaaaaaaagatttctacaatttttgtttgcaggggtagaacttgaaagggaccacagctccaaaaaggttgggaaccactggcctagatggttcttatgaggcctctgacgagattttgtatagatttctgcagattgacagcgaattctttcaataattcaaaacaaatgtcatggctagttttttgatgaataaatatatattttttttttttttaaatctttatttgagtgtattttaacgcacgagggctagttctacacttgatgaataaataaataaagaggtcctttaggtattcttggtaagatttttgtaaagtatttctcgattactttttcaaatcgacgtaagtaattttcatatggttttgagaaaattaattaggaagaatcacaacctgtcttctaaaactgttttaaaatgaatcacttttttaacatttttttttaccgtgtacatcgcttaaattttgcctacaatcagttcgcgttcaaaaactaggtagtttccattatttcctacaaaaaagttataacaaaatgttaagccgtttcattcagttactttcgacgtttttataccagtgtaaaatcggctcaagtagtgttttattttgattcgtggttaagtcactttgtctccccatacaacggagcggtgaaagtagcggttgggttgcgaaagttgaaattcttactttcgccgttttgtaattccggtattaaacgttctaaaagtgaaaaatcaagttgagtgtgagcggaacgtgtggaatttcgtctgcgaaacacgtaggatcgataaagtaagtttgttcacttttttgacttgagactatttgaataagttttcgagatttgactaaattattgatatgttgattaaatcttttgaagattacttggaagattcaatcttggattcatgtcaaatgttttagccagcttcataggagaacaataacatgtatttggaaatattgtttctgttaaaataacttttcttggatccaaaatgagattcatcacagatcaatcatttctccataaatcagtctaagacataacatggcttagtctaacgcataattcttaaggcattcttagaaagtaataggttggctattaaactttgcccttttgtggaagtttagatgcacaaagcaggcatttatattattccataatttctctgaacttcctacgaattccagggggtaacggtgttttagatatttcagcaaatcagcattgttttttcataagggcctatctgcgttcatcgatttctcttcatcgttgttctctttgcgttattgcagaaaactgattctgttgtcgtaggatgaagaatcactatatcttcttcattaacacttcagtcgtcgcgaagttgtattttgaacaacagtagtgaaaaaacctcgcctatcgtacacagcatcagcgtggtggttctgacggtgacaaacagcgcgacgactgaagggttaataagaaatattgcagatttatctaatttagcaaagttattagcggaagagaggatcgttgaagatgtgcagaaatattttaaatctcttagtccaaaacccttttaaaatgtaaaccattttttaattgtattaaaaataattcataaataaattcgatcatgtcctccaaatttggcaatatcgtataaaaaagaaaaaacactaaaatataaaaacgcaggatttttttgctatctgtttttcaatttcttggacaccccttaaaaatccgggaattggaaaactgattttgaatggaaaccctgccaatccgccacccgcagcgctcgcatcgtttctgttcgcgtttgacgtttacacactactgccatctgttggtccgtcggccaaacacactaattttagcattaggcgtacatgtcctcgtgactataattttgattgagatttgttacgtctgtttgtctgtggtataactatagaagagtggaaaagagtgagaatatgccagtaatgctagtacattaaaaaaaatggtaaatgtgaatacaaggtttaaaagtattattttttgagtactgttgaaggttagctcaaagatgtattgaagaaattcataggaaaattattgttcatgaaaggcagctgtaaaacaactgagcataatatattcaaaaaattcttcttgaaatcactggacagtttatttgaatctttttcctcatctgttgagccttttaaccattgcttccattatttaggaatattgtggtatgacccatattttatttggtgctcctcaaatatcctttcacaattgagatgcgatagacattgattgatgtgtcacacggtcccaactgcgcacaactcgttttataaagtctttttggactacattgccaaatttcgaagggctctaataatccttttacaaatgttaacattctttgattaactagtgctcctcagttgcagagtaaatgctcagcagtttcgttttcagcttgacaaaaacgacattcagaggattggatttttcctatctttttaagatgatacctacttggacagtgaccggtcatcaggccagttattaccttaagatttcctttattaggattcaatatagcccgggcttttgttagactgggttttatgaatcttttcgcttacttgaatgtatccggggcgttccaattggattctaccatggacatttcccaattattcagtttaatcctgagagtgcactcaggaacaccacagaacggttcagggccaacaaagctcgaagctgctagattgtcggcgaattcattcgcctcaattccacaatggccgggcacccagtacaacgtaacttcgttcctattggccaattgcttcagagaaagaatgcaatcccacactaactttgatctacatgtgaatgcctttagagcattcaaagctgtccgagaaaatacagatctttgcaaacctatagtttttttttttttgaggcaatcatttgtacagtcaataatggcttgtatttcagcttggaacacagtgggactgcgccccatagcgattaccttgctgataccatgaccgaaaactccagctccggtattgtcgcccatctttgacccgtcggtataaaatacaatagaacctgggcgtaaacttggcccaccagaatcccaaatatagaggcttggtttaaccacattaaatcaccacctagaaagctgaaaatttcacagaacactatttttatggtaaggatggtaaggagcaaaggggcccagatagccgtagcggtaaacgcgcagctattcagcatgaccatgctgagggtcgtaggttcgaatcccactggtcgaggatcttttcgtaaaggaaattttctcgattcccagggtataagagtatcatcgtacctgccacatgatatacacatgcaaaaatggtcattggcaaagaaagctctcagttaataactgtgtaagtgctcataagaacactaatctgagaagcaggctttgtcccagttgggacgtaacgccagaaagaagaagaagatggtaaggagcatatgggaggttgaattttcaaacatttttaaaatttgaatcgccctactgaatatacttatgaaagtattaacaggggaatcgttttcggcgatgccatttttagtaacaatcgcacttttcttgctcgccatcgtttgcagaactcgtttcagacatgcatctttggtagtgtcattcataattaaacctaaatttgtactagctcatgaatagaaggaaaagaagcaccattcatgcattgaaaaaaatcccatcagtaaatgttgattcgtactttttacggggagggccattccgaacaacgttatcggattacggtattcataaaattaggccgttatatagtcgtgcctcatcttttggtaccgtcaaacggaataacttgcaatacattgacatgtaacagaatcagtgttgttaaatgtcatgaatatcacgtgaatattcgaacaaccccagtgttaaaactcaaacccctgtggtgtttttatcgactaagccaacgtcaaacatcataaaaagtgtcaaggttcattgatggacccaatttttaaattaaagtttgaatatgatattcgcgatcatgaaggtaattaccatagttgaccatatgcgagaagctttgatttctttacatggcaaagcataggaagtcaattttcaaatgctcctaaaaatatccaaacgcaatttaattaaattttgttaagtgtacgggattagtcttataaaaagctatagaatccgcagaatattgaggaaaatatataaaatacaaaataatgtgtataatgtcaaaagtttatcaacatatactgaaaagattttaaatagctattgtagttatttttatatacgcatattaaatttcactttctatgccttggggatggtacacaaattatgtcacgctaaatttcaactttttgacccccctttgtcacgttttttgtataagtcatctgaaatgtttgtaaggcttgtcacgcttggcttgaccccctccccccctcgaagtgtgacgtaatttgtgcatgatcccttgccgggtaaaattttcggcgcttcacgcatcgagtaaactttttgcagatggcagcaccgtactttcgttgactcgaatagccattatttgagcgggaaaaatagctaaagtagttgcagtaacatgctctttcgtgtcattaaataaaaacaagatttcattaaggccgcacgggacgtcatcataatcaccctatccatttcaagaagcaaatctcaagaaccactccatatatcgatgcgaaaaatgtatcactatgattctatatatgtagtgcacaaaccgatacattttcagcttcatcggtttactaaaactcgagatttgcttccagaaagttttgatgataattgttagagtgagacgaaagatagggaaaataacacggtctcccgtgtccccttaatcatgttgtttagtcattttattaaattatttaactgtgtttaatttgttttcgtatgatagtaaacatgttaaagaaactttatttgaaatcaaaaataatgattacattcatgaaaaaattgatctatacataaggtgctcattttgcccaaataatgcgagaagtatagaattacagggctggttcatcagtgacgaattttacggatttgttaaacctaccaacgcaatcgatttatgtttcatatctaatgcttctataaatttattaaaaatatttgcttatttttaggagttttcaactttaactaaagaattgacacaagcacgtgaggcactattagaaagggatgaagaaattggagaacttaaagctgaaaggaataatacacgggtaagtaacaataaaaacaatctctactttatttcaaaattttgtttgcttttaaaaatttcaccagtcacttcgctgttgtttccataaagcaaatgtacactacggtttttctacgccggtcgacgttctgcgtaaaatcacacattatttaaaaaaaaagacgttaaaatcgcgtcgccattaaaaatttaaaccatgtttttgggcgttcgagtcaaaatgtagttcaatttggaaacataaattaaccttccaatcgtcgcgcggtttgccgccttcagaaccaccacgttgctgttgtggacgaaaagcgaggttttttcaacagtgttgtacaaaatacaacagcgcgacgactgaagtgttaaagatttttgataatacggcttcttaagtcttttttatactgcttcgcgactaaaaatgaatgaaccaacgtgctaagttcgatttttgataaacttcaccgcgtcgcaagtcactccgctatagtgcgcatctatgccctctgccgtgtgcattatgcgcactattgagaatcgagttgcgacgcggcgaagttggtcaaaaatcaaatttcgcacgttggttaacccattttctaacgcgaagcagtatataattacgcgggttttatttcactgttatctactatttatttcctatggtagctctaaagccccattcatttttgacgatctcaaaacaaaccgaatcagatgaatattttacaatagttactcgaaaatgattacatactcagattaattaaattaactgtgtaactattgacaaacaatcgatctactattgaaaaacaactagaattgtttcaactgatttgaattgtttcatagtaaatacgcaagaattatatgctcactgcactgcccctactcgcataacagtctcatgttctatgggaattcctatataggggaaagtggggcagtttggccaccttaagaaaaagtcgataaaaatgcttaaaattttatagaaactttggattttgcgtgaaagagccattcggggtaatatgggcagtttttttaacttcattttttctttttctttgagtttagaacactgacttgtagcatgtctattgcttcgtttccttttcagttttgggattgcatgttatttcagatgaaagttcaagtatttacgcagttttcaaagggtgctcattccaccccattggccaaaccgccccgactacccctaaatggtataatggtatactcgcataaccgagtatgggcagtgcatacgttatttaaaatgaggcacaacaataacggtgcgccaaagctaagtacatatttatcacgatgccagatagcttgctttgggctgaaatgagatgcagtagaacaatcgatgattggtagtagcttttgctgtataatgtagcgctgccacgggagatgtcgagtgcgatgcaaactttaacggcactgcacaaaaccaaggctggttcattgtactctgtagccagagtaggctaggaggccatctttaacttgctggccgttttgtttacaaacattactgcctggcctgtataacgctcaaactgaaactaaccgtgctgccaatagtgcgaacgaaatagttaaaaaaagagataaaagtagagtacgctacgcgcagatgcggctgcattagaataatttctgacacctttttttctcaaaccaatcagaagtcattactgcctggcccgcaagatgctgaaactaaaactaaccgtgctgccatatttccgattttttttatttttaagggttgagacatatttttgtatgaaaattttgtgcgtcaagttaggcacaccatgtttcttattatttgctgaacaaaatattggatcgaaaatagaaacaaatatggtgcttgcattcaaaaaatccatctgcaggacaacccaatgctttatgtaatcagatgtaaagggtcatccataaattatgtaacgtttttaggaggaggcggggtccgaaaaactcaacgattcatatttgttttcgcattttccatacaaaaaatgtggcggttaagagcggttgaaaatgctaaaatttagcgcaatttatggacgtcccctaatgtttcaagggagtttcaataaatcacgtcagaaggctgtaggttaaatgattggtttagtacaatttgtacaataggggggtgtccattaagtgcgtgacgtcacattttttacatggaaccttcaaaaaaaattgtatgaatcgtcaaatcttgcagaacacttccttccccctaatagcatgacgttctcgatcgttctctaggcccatacaaaaagcagtatacagagagaaggagggttgaaacgtttcatcttacgtgttgtaattaatgaaatttcttaaacgaccatttttggaactggttgttttcgttctagttttcaaccaatagggtcctaaagccctgttctaattttaataccaacggttaagtttaggccagaaacatatgtttatacaatttttgaatgcttttcattggtttacggccaaaaaactttttttttctgattcttgagattttgtcacaccccttggtttaaactcaaattttgggtgtgttttgtttcccgtgtcccttccgaaatgtcaaataggaacaaccccagtgttaaaaagatgagcccctgtggcatttttgccgactcagtgaatgtcatgatctaaagtgtcaaggttcaaatttgaacctatttttaaaattaaatttgctttggaaaaattgcttaagtggttgcaagatcatggtctttcgtcttatgaaattgaaacaagatttcattaaaaattttaggaccctatttttcgtaatttttgcgatttccctcctcgttccagcgcaacgtagtttttaaacgtttccaatgttgactgtggattgaactcaatcaccggtttcattttctacactttaacaggacgcacagcaaaaggtgcttccagatgacgtcattcaaaacttttctcgaaagttctaacttttatgtttactctgaagcgcttttttaagttaattaagctattggatactaaaactcgtgtatattttaaaccttagcattttttagtgcgtcaaatcccgggtagaggagaattgcaaaagaataacaaaatttactattaaaatagaatgtttgaatagcaaaatttgttctttgtttgtttgaaataagagataaaataacaaaaataataactaagtttgtatggcataacaactaaataataacatattttgccattgtaataacaaaataatagcaaaaatgtagtcaaccgtaaataacaaaatatgttattatttagatattgataacaaaataataactaaataagctattcccaagtagatcaaaataatggtaattttagttctttgactttaatatttaaatttagcatgattgaaaaataaactttttgctttcctgcaaaaaacatttgctttttaaatcttcaatgaatatcatacgaattgtaaaatgagctattatggcaaaatttgatgttagttaattggttctcatgaattatttaaataaagttttcaaatatcaaaataatgacatattttactgtgatggcgatgtttgttattctttagatatttaatgttattttagtatttttgcacaaacaacaaattttaccatgatagtatattttgttattgattagttattacatgactttcaagtataacataccaatggcaaattttactatgatagtatgttttgctattgatgagatatttaactgccgttatacgcataaatgtcccatgttccaaaatatgaaaccgagaaaaacgcgattaaagattttcgcacatttatgctctgtattggcgaaggttatgacaaatttgaataatttcttcataataatatgaggcaatgggtgtttttttatagtcaagaattgcgttttgcggaagaatttgaactttgctatgaaattcatagtgggacggttatgcctagaaataccgcgttttgggggaatttctacgcataagagtcccactaattgtagcagaccgattttgaccaatcacattgctcttgatggttggtttggtttggtttggtgaagagtttaataccgaaaatggaagatgtgtattgtaaagcctatattgagggtccaaagaaggctcgtgtggcatgtagcaaagtggagccatacatgggtatgtgaatcaatgtggttatacaggttggtaaatgctggacatggcgtaccattggtaccttgtgtatctgaaggaataaaatagatccctttgagtggttcatagcctccaattataaacgttcctgtgctgaggcttgcagagcctgacacaaagcccctagatttccggaggaccattccccctcatgtttggagggccatagagcacagtttagcttaaagttctactctggcactcggacgatgatcagccgccgcccctgacaatggtacgccatgccagtatttaccacccaaacgaaccataatgtggcattcaattttcaattagttgtagtttctaaaaaaaaaatcgttacaatgattacaacttcacaccgcacaaaaatacaagcaacagaaaaaaatgtgattaagacatgagctcagaaaacaagaaacttcaaaccaatataccgttttgattcatattacggacagcttcaaattccggacactctactttatatgggaaacatttcacacgaaatgtttcaatttttgccgttcaaaagttctcactttcaaggctcattttaataagctttttccatagatatctataaaaatgtgtattgcccaactttcttagtcgtctctctagtggtttaacgatttcatttgataatttgacttttctatttatgatttgtttgacttgtccgcaattcgaatcgaagtgtccagaatatgaggcaaaagtaaggtagcgtccggaatcggaatcatgtaaagtccacacatttctatttatttaaaattattcatgtttcggaatcgaaatcttctctcaccattcgaatgggtttgaaggttcgataacgtggaggaatcatacggagtgatttattttacatgatttttcgtgagttatatttcactaagcccttaagtgtccgtaatatgaatcaaaacggtatatggtcaagtaagttgctgaaactagataaaattttccgtcgaatgcttctgaatgcatccaatttcattcatttttcaaaaagtttctagcatttgtatttaagaaaaaatttgcctaactcaattattcagtctatcccctgtacaacagtcttagaacactattgtgtgaaacaggcaatgttccacatggggtgtaaagccaaagaaaaaagatgatataaaacgatttgacacagctcaatgaatcctataaattgagtaccgtgacctgctctaattccgtgtgttgcctaataccgtgtatttgggaattatgtggatttctagcatattatattatttatttttctaaatgattgtcacaaacgttagcacattaagtagtatttagaaagccatgacaaacttgaactaaagttgcacacaaaaacaagcaaaaataatgttagaatgtaatcgcctggtgccaatacacggtattagggcacggttgcttatgtgttccaaataccgtgtttcagttataattccaaaatggcgaagtgaaatatatattttatttcccgaatcaatcatgcaagcctcaatacgttcttcgatacaaaagttttatttttgatgcgcttcgttcgttcaattgagagatgtttcaaaatgtgactcagcagtcgaggtcagatgcacggtatttggaaaactggtatgtttaacaacatcaactgtaactatggttaaaattttcaaaatggttcacatcatattttttatgcaaagtatataaaacggtctactatataaaacataaaagacttgaaaataatcatacgttatttttatctgatcgattgaaacttgaatttttttaacctcacggtaatagagcatgtcacggtattttatttgcaactgattttggaaaatacatagtgagacagatatgcgtagaaattcagtagcgagacagttatgcgtagaaattcaacagtgggacaaattgacttggtatgcttttcttagagtgttcgaacaaagtatatttttttaaattgttttctaataatataggttaaaataggctttttggctacaaaaactaaaaaatgaaaaaaagtaacatgggacaattatgcgtataacggcagttaatgtcatatattaataacataataatggttaaactagatatgattgcaaaatttgttcttattttaccattattttgttatttacctctacccgggataggcatcatagtgcgtcaaattaggcacattgaagatgcgtcaattaaggaaccaaatgtgttccacaaaaagccattaaacatgaaaaaaaaaaagtttaatatattttcactgatttttgtctaattttgtaatagttgagctaacatagctccaaatttcaacaaaatcggacagattctgacgatttgacaaatgtttaaattcagaatttccttaaccgcgtcaaatatggtacgtccacggtactttgctgctctgaaaactgcacaactatgcgcaaaactgaagaatagttcacatctgcaaatgtgtttagaattgaatatttattcctgctttctattttcagctattattagagcacctagaatgcttagtatcgagacatgaacgatcattaagaatgacggtagtgaaaagacaagcagcatcacaaagtggagtttctagcgaagtagaagtattgaaagcgctcaaaagtttatttgagcatcacaaagcacttgatgaaaaggtaatacgaaaaacataacacacgtcaaacattaaaaaaaaaacattattcacaaaactataaacacgcgtttcaagtttcgaacaatacaatcgatcaacaagaactaaaaatacacttattgcaggttagggaacggttacgcctatcactggaaaagaatactgaactcgaggaagaactagctcaagttaaagaagaggtaagagagcatttatttacaaacaattctataaatgtattgaataattagttgttggtgtttcagttacagcacaagtctggattagttttaaatcagacaagtacttccaaagagaatggagaggattgtaaggtaattgtattttcataagggggggtcctaagatcatttaccattagcattcttaggttgatgcttctactgaaataatccaaataactttaataccgtcgtagggggtgaaaatggatcaaaaaagtatatgtacgaattatttatcaaataactaatgccatttttacttgaataaagttgaaaatttgatgtgtaccgtaaaatgggccgaatagaaacactctccgacatgtttgaaggtatacaacataaaccgcgtgcataaaaaccatttttgctagcgtcaaatatgggtagcgtcttccgttgctgaaaccctgattgttatgtcgtacaaagatttatgaaaatgttgtatgattctattcaatgaggcgaacactgttcagtaactatctttacttttttttttgttctaatggaaaaattaacaatttttcaagtgtatcctgaagaaatagcagaatgttttttttttctcaaatcgttaaaggctcactctccgtacccagcttaacagaggcaatttcaattcagatcagataaggcttttttttttcaccagaagatgaaccgattttcgttagagcagtgtttgggaaacactgataagaacaagttaaggctggttcattgtactctgtagccagagtacaggaggagctggacccgccttggagcaagtctttttggttccactatctttgttcgcccgcctcgatctcgcttgttggtcgtttcattgttctcggtggatgagctcgatgtattgtcatcatcagtccattcgtcgttgttcgttgaaagagctttaaatcgttctccaaaaaatgttgcactttggccacttcagggcgcactgggagaacactgaagtcaactactagtgtgttttttcttgcaccggtcatttgcacagactgcaatagtgaaagaagcaaagaaaaacgtccgatgcgcgcagtgtctggcattttagaaatcgacaaaaatggcgaatgtttcaagctgtcaaaaatggttaagctttcaatattttcttcttgatttgaatttgaaaatagtctagcgatactctgttgctcattcatttatttagttaacatctacacagataacactgaatcaacaatttcacgccacaatactcggttcgtggccgcatctctccatcctctgttctgccccacgctcgccaaatcgatacgcacttggtccgcccacctagctcgctgcgctccacgccttcttgtaccaaccggatccgaagcgaacaccatctttgcagggttgctgtccggcattcttgcaacatgccctgcccatcgtatccttccagctttggccaccttctggatactgggttcgccgtagagttgggcgagctcgtggttcatccttcgccgccacacaccgttctcctgcacaccgccgaagatcgtcctaagcacccgacgttcgaagactccaagtgcttgcaggtcctcctcgagcatcgtccacgtttcatgcccgtagaggactaccggccttatgagcgttttgtacatggtacatttggtgcgggcgtgaatcttttttgaccgcagcttcttctggaggccatagtaggcccgacttccactgatgatgcgcctccgtatttcacggctaacgttattgtcagccgtcagcaaggatccaaggtagacgaactcgtcgaccacctcgaaagtatccccgtctatcgtaacactgctacctaggcgagccctgtcgcgctcggccccaccagctagcatgtactttgtcttggccgcattcaccaccagtccaacttttgctgcctcgcgtttcaggcgggtgtacaggtctgccaccttttcaaatgttcggccgacgatgtccatatcatccgcgaagcaaacaaattgactggatctcgtaaaaatcgtaccccggctgttaagcccggctctccgcataacaccttctagcgcaatattgaacaacagacacgaaagtccatcaccttgtcgtagtccccggtgggatccaaacgaactggagtgttcgcctgaaaccttcacacaattttgcacaccttccatcgtcgctcttatcagtctagtgagcttcccgggaaagctgttctcgtccatgattttccatagctctacgcggtcgatactgtcgtatgccgccttgaaatcgatgaaaaggtgatgcgttgggacctggtattcacgacatttttggaggatttgccgtacagtaaagatctggtccgttgtcgatcggccgtcaacgaagccggcttgataacttcccacgaactcgtttactacaggtgacagacgacggaagatgatctgggataatactttgtaggccgcatttagaatggtgatcgctcgaaagttctcacaatctaacttgtcccctttcttgtagatggggcatattaccccttccttccactcctccggtagctgttctgtttcccagattgtgcctatcagctggtgcagacaaatggccagcctctccggacccatctttatgagttcagctccgataccatccttaccagcagctttattgttcttgagctggtgaatggcatccttaacctccctcaaagtgggggctggttggtttccatcttccgcagtaccgacgaaggcgtttcctccgttgtcccgtcctccattgcctatgctctcagcgccattcaggtgttcgtcgaagtgctgcttccacctttcgatcacctcacgctcgtccgtcaaaatgctcccatccttatccctgcacatctcggctcgcggcacgaagccgttgcgggatgcgttgagcttctgatagaacttacgcgtttcttgagaccggcacagctgttccatctcctcgcactccgtctcctccaggcggcgttttttctcccgaaagaggcgggtctgctgttgccgtttccgtttgtagcgttccacgttctgccgggtcccttgctgcagcatgaccgcccgcgctgcattcttctcctccaaaacctcatggcactgctcgtcgaaccaatcgttccgtcgactccgtcccacgtacccgatgttgctctcagctgcatcgttgatggctgcttttactgttctccagcagtcctcaagaggggcttcgtccagctcaccctcttccggtaatgcagcctcgaggtgctgcgcgtatgccgctgcgacatccggttgattgagccgctctaggtcataccggggcggccgtcggtaccgtacgttgttaacgacggagagttttgggcgtagtttgaccatcaccagatagtggtcagagtcgatgttagcgccacgataagtcctgacgtcgataatgtcggagaagtgccgaccatcaatcagaacgtggtcgatttgagattccgtctgctgtggtgatctccaggtgtatcggtatggaaggctgtgctggaagtaggtgctacgaatggccatattcttggaggcggcaaaatctattagtcgtaggccgttctcgttcgtcagccggtgggcgctgaactttccaatcgtcggtctgaattcctcctcctggccaacctgagcgtttagatctcctatgatgattttgacgtcgtggcttgggcagctgtcgtactcgcgttcgagctgcgcgtaaaaagcgtctttatcatcatcagtgcttccggagtgagggctgtgcacgtttattatgctgaagttgaagaaccggcctttgatcctcaacttgcacattctctcattgatcggccaccacccgatcacgcgcctctgcatatcacccatcactataaaagctgttctcagctcgtgtgtgttgccgcagctctggtagatggtatggttacctctaaacgttcgcaccattgatcccttccaacacacttcctgcaacgctacgatgccgaatccacggtccttcagcacgtcggcgagtatgcgtgtgctcccgatgaagttgagagatttacagttccacgtaccgagcttccaatcgctagtccttttacgtcgctgtggtcttcgccgattgtcccggttcgtattctctcgttgattattcgttgcttgatttttttacggctggcttgcagggcctgacaccaaccccctagatttccggaggaccattccccctaaatgttcggaggaccatagtgcacagtttagcttagagtccttctctggcactcggacgatgatcagccgcccctgacatggggaacagacgctgttgtgagccgctcctaacatggagtacagacgctcaaggtttgcagaagcaaaagcaaaagcaaacccccccttccctgtcagcatacgaccctagttcccaccgggggttggttacccgatcttccctaaggttactcgtaccccggccagtaccgcgaggaggtagggataggagttgctgggcaagaggctaaggaccgcacagaggggtctattttattccttcaggtacgcgaggtaccaatggtacgccatgcccagccatttaccaaaactctgttgctattgaactaattgaaaaaaaaatatatttcagtaggtttttatagtttattattagacaatagtcgcatttctaactgtaggtcgctttctttttatttgccccactttttctattcaccccgttttacggtatgttatttgatggaacattaacaactgtccaaaaaattaaagcaaaatatgtattcgctagccgagggaaatatgtatttacttagccgaatggttagagtccgcggctacaaagcaaagccctgctgaaggtgtctgggttcgatttccggtcagtccaggatcttttcgtagtggaaattttcttgacttccctgagcatagagtatcatcgtacctgccacgcgatatacgaatgcgaaaattgcaactttggcaaagaaagctctcagttaatatctgtggaagtgctcattgaacactaagctgagaagcaggctctgtcccagtgaggacgtaaatgccaagaagaagaagaagtattcactacggcactacaagtgaataagaaaggacccaatctcactccatagatggggtcacattgggtcgttgtaattgatttttttttcttgagaatatgatataaaaaaatatctacagtttggtgaaatacgatgcaaacaagacgaaaagacatctgagatgtttcacaagtatgataaacccgcttaaaagtacgattataccaaaaaaatgctatgtgcaaaagtatgtaaaacctgcatttatcgttaatttaacatgcattttcttgttttttttttctttcaaattatcttcatagtcttaccttattgttataaagcctattcagtttcccaaaggtgtactgaaacagtgattattggaaatctttgcaaatagttccgtgatcaatagaattcaggcagttgttgacgtcataagttctgtatttccgagattcaacaactctcttgtacttctgcgatttgtttctataatataaaatactaataaataattaaatcttaaaaaaaacatttctcgaacatgtattcaaacagactcaagttagaaaagtaaacaagcttactttatcaatcctacgtgtttcgcaaacgaaattctacacgttccgctctaagctaactagattttttagttttagaacgattaaggtgaagatgaatcgaagccaaatctaaaaatttcaagagcacaaatctggataaccgaacatccgtttgagctgtaaactcaatcgattggtcaccaccagctagtgaccaatcgattaggttttcagcttaaatggttatttggttctctagatttgtgctcttgaaaatttgaggtttggtttcgattcatctttaccttaatttcaggatttacaaaacggcgtaagtaagactttgaattttcgcagcctaaccaccaatttcaccacgaatcaaaacaaaacactacttgagtcgattttacactgaaattagagcattattgcacgcatattacccgggcagaggaaaatagcaaaagaataacaaaatttaccattgaaatagaatgtttgaatagcaaaatctgttctttgtttgtttgaaataagagataaaagaacaaaaataataactaagtttatatggcataaaaactaaataatatcatattttgccattgtaataacaaaataatagcaaaaataatggcaattttagttctttgactataatatactaaatttagcatgattgaaaaataaactttttgcattccagcgaaaaacatttgctttttaaatcttcaatgaatatcatacgaattgtaaaatgagctattatggcaaaatttgatgtttttttgttctcatgaattatttaaataaagttttcaaatatcaaaataatgacatattttactgtgatggcgatgtttgttattctttagatatttaatagttttttagtatgtttgcacaaataacaaatttcaccatgatagtatattttgttattgattagttattacatgactttcaaggataacataccaatgacaaattttgctatgattgtatgttttgctattgataagatatttatgtcatatattaataacataataatggataaaccagatatgattgcaaaatttgttcttattttaccattattttgttattcacctctacccgggtatatatagcataaaagcaatgatgcattgcactcactgaattaaagtaaaaacagttgaaacatgaacgagtcaagatttgtaaggcttagatgttgttgaatctagtttttcaagttcgtttttgtttaacagtatacaaaaagttgaggggataacggggttgaacacacatggtagagttttaatactatttcgtttatttgaaggctcacacgccgtacccagtatcacaaagccgattctcagtttctattaccagtggaaaaattcgaaccttttacaagtttattaatgcgtttttattattgcactgatataatcgaaagagaacaagaaaggagagactctctcattgttacataggtcctttaataaagttcagcgtgcattaattgatagtattgattttactgaaccaactaatttctttctttttgatatatacaggacacactagcgaatggtgagacttcggaacagatagattatttagcaaaaactcatgagctacaaacaattattgaaaaacaggtatgtattgtgtttattatttacagcaaatcttctcatattttcaggcaaaattgaaattgcggcaaagttgaatctgacttagtcggcattgatcaaaacactgacatgtaattcaaatcgtttacctttgtcgccaaactatgacttgctctgattcggtgcgacgcgttataggggaagatccttcagtaccggtcatatatcatatcactatgattctaagaagtatgatgttttatttctacattggatgttgaatcgattttttttttcgatcaattgattcttaaaactgagatctacataaggtaccgtttggcaagtgggtaatggatttcgcatagttgggattcttcaaattctagagatcttaaattaaaacaaatgaggtcgtgtatattttttagcttgactcccaccaaatataagcagtaaactgaaattgatttttatgtaaaactaaagaaaaaagtacagaaaaagtgtttgaaaaacgtctccttacttttcacttaccccacctgtgttttagttatttttaggtccatgtcgaattcaaaaactaacagttacatttgcgatttctattaccttaacatttgttaaggcgtcctaataaacaataacataagcaacattttacaaagaaaattttattattttttcttgaattttcttctattcagttatgtttgttgaaatgattcgacaacattataactgcaacatttccaatgttagttcttacatcattggacatcaattgcatttctgctctgtagaatttccaccgctcgttatttgtttttaagaaaatcggatatgacgtcggatatctcttcaggagaaatcaaacggaatccttcctttagaaacttttttgatgtggatacatctacaccccatttttatgttttgaactagctttacaaagacattccacaagatttccgtgcgttctcttatattggaacttttcaatccacgtcttcctttaaatcggctgtccgaagtaaacatataattatcgtaatatttatagggccttccttagccgagtggttagagtccgcggctacaaagcaaagccatgctgacggtgtctgggttcgattcccggtcggtccaggatcttttcgtaatggaaatttccttgattccctgggcatagagtataatcgtatctgccacacgatatacgaatgcgaaaatggcaactttggcatagaaagctctcagttaataactgtggaagtgttcataagaacactaagctgagaagcaggctatgtcccagtgaggacgttaatgccaagtagtagtatcgtaatatttggcaaccttttttagagaagttccatgatttggccatgacgctttgagtatagtgtttcttgaattatcaacacgttctgttgttctatgataattgcgaaccttgtatacttatattcaatttctaatgagaaacttttcccttgccccacgtgattagaaaattgacagtgtttcaatttagttatttttaggtctatgtcgaattaattctaaaactttttttattgcagtttaaaactgtcagaggggacaactttgatgtggtacagaaaattatttttcgcacctatttccactgaaaatattaaaataagattgcacgccgccaacttgttacggagtgatagttgacaggttaacaatatttcgctctattatgcaatattcagtaaaatataccaattattttcacttaccccatttacaaacttgccccgcggtaccttatacttatttttaccttgagacacccatattttggaagcttgcatttttaactaaattgatttcattttacatgcttaacgatgtacaacgtagtgacaacttttaaaaagatttagacattttatttggtataaattggaggtggcggtcttaccccatcaaaagtggtcggttttaccctcttgcatagtgttcacaattagagccttatttcaaagctaaatatgtacaatgaatatttcacttacataatttaaatttctgttaatgcatggacgggcaatgggttgtgttttcacaaaaatttctattacggaatccaaggtgattaagccacacctcaaattttcaagagcacaagacttgagaaccaaacagcgctccgcgttgaaaatctatccaattggtcaccaccagcaagcaagtaatttgattgatctccaacgcgaactgttgtcagagtctccagtcttgtgcaattgaaaattcaaagtttggcttcattttacaatcacgttgagtgcgcatcagatcaagttcaaaattcaagtaaagttctagctttcaagaaactcgccattttcaggacaaactggatgagatccgtcataccggcgagcgctcctgtgttcccctaataattaaaattcctataaatgatgtcttggtgtcaatcgaaagattaaggtgaacatacaaaaaaaaagtatggaaagagtgataaaattcccgcttttgaccattttttccgcagattttttttactttttttgagcggaacagcataccgtgccagtaccatattatagacagcgccatattctaaacggtccgttccttatgttgaacattcattgtttttacatccaaaatagtaaactgtcagttcgaaacatgattcattgtaacatttcaaaactaaaatacatggttaagttgttttttctacaaatattatatgttaagttcgtttgctgtccataataaggaacaatgtgtgttcataattaggaccattgatgtatatggcgtccataattaggaacatgcatgcgtcatactaatatatgattttttaaataattgataattgatggacgttttattttaatctttatgtttatttaaatatttgacaaacgcaacggcatgacaaaccaatatcccagctgttgaaatccttaatcatttaagttatccaaattggattttcttaaccgttcagaatatggtgcttgcacggtacttaactttaaggcgaagtaggtcgcaaactgaattacagcgtggaagtcatggttaccgtcaattgcattatgttttgtttttttttttagactgccgaactgtcgcaatggcaacgtcgtgtatcagacatgaacaacaaaattagtgatttggaagaaaacttaaacaaaacacaaaaagaatttaccaaatcacaagaaacatgtgtcaaacttcaaagagatcttcgggaaaatgtagcacaaaaggaagaccaagaagaacgaatagcaacactagaaaaacgatatctgaatgcacaacgggaatctacatcgttacatgacctaaacgagaaattagagcaagaattgcgacataaggaagctcaactaaaggtgaataatcatatttttgttaccgctataactttttaacgtttatcttctgtacgaacagttgcaagaaggaaaaatttctgccatacaagaaaaactggagttatctgatcaaaaattagctcaactatctaaactgccggacctagaggaacaattgaaagcaagattggaggcatttaaccaggtaggcgttaaggtaggatacaaagtataaaattgatcccagagataaacagtgttttgttttgtcgatttcgtgcgctttttgaatagcgtctaaatcgttggtttcagcgatatagttctatagtactatgaaaaatgttttctaatcttttgctttatttttctgctaggctcaagaacgccacggttcttcagaagatcgcatttcacggcttgaagcaaatgtagaggaaaagaacgccgaaattatgcgtttgaatcaaagactgaaaatgaatgaagagcacaatcaaaggttgtcttcgacggttgataaacttttatcagaatccaatgaccggttacaagttcatctaaaagaaagaatgacagcattagaagaaaaaaatacacttactcaggagttagataaggcaaagaaatacgctgaagaactgaatcatgaaaagtctgaaatattgaaagaaatgtcgaaaagcagactagaaatggacaatttcaaaagacaactgttgcagcaggtaagttgaccaattaattgtcttctactctttttatagttagttatttgatccgtatagactaaaatttgcgcatttaaaaaaaacataagtgactgttagtaattaatttatgtgcgtatatggagcctgtttataatttttaaatctttaatgatatttgcattcggatttatttattttttggatttgtcaatgtttaatctagaagcagtttttaatgatttctaagaatggaacatacttcaagtacctttttttcatctgacgtatctaccaaaaaatagtaaaaaatcatggttatttgttgtcactacgatattctagctacagtcgactctccataattcgatattcaagggaccatcgacttatagaattatcgagttatagaatataccgacacaaaaaaatcaaaaaaattaaggcacagatttctgttttccaaatacatatagggaaagtgtaccagttatggccataaaggttccctatttggccatatgtgaattattgacaattttcacgttttaaatctatttgaatgttttgacatcaagatacatcttaaatctaacttctacaacacacaaacattttcaaaatttaagagatttgaaaaacatcaattcacaaaacgacgtggcttactattttgttgtttagcacttcactgataattacatcgtttgttcttgtgttacaaatattcttcatgtgtctaaattacagcaatttttttttgttcaatagaggttccagatttgcagaactttagggtgtcacttaaacagatttcgagttatcactgaactgataaatacagtcgatattcaataaattccaaataataccctacaggaaaatttccgtatattaaaaaaaactttccaaagcacagtcgcaaagacaaaaaaatagcctcattatttttcttattataacacgcgggccacttcacgtaaatattcaaaatccgttcgccggccgcaatttggtgattactgttctagaacaaacattgctgcaaataaattaatttattcgaaatcagctgtaaaaagttcagttgtttttaaataatttgatttagtttccattgaaacagttggtaggctattggatcaatctgatgagaatggaagcatatattagtaactagtatagtatccatccatccaatggagctccgaagctatcatgggaaagaaaaggtttaataagattgttttgcttagaaattgcgtgacaataatttagttctgtacagtgtaataaactgaactaaaatttacgttacgtttacaacggctcatatgtgtagtttaatatgcttacagtaggtaactatctaaggcatggaattgctccacctaatatgacacatgatcatttgtaatgtaaaacttttctggatgtgctattatggtgatgcgatttcagactctagcaagtagtgtgccgcgttataatatatgtaaattaacatgttattttcattgtaggaaatagcctttaacattcagcaaacagaagctttaaccagaagcttgtctcctacgaatggaacagaggcagacaacttctccaggagcggttcccatgctagttttgatgccctaagtttaagaagaaagaaacaacttttagaagaggagcagtttagtaggtcgcttactgaacaggactggggtaaaatgcaacaaatagctggagcacaaacctttgatggtagtgccgtcgatggtgatgacacggaaagcttatttagtactgccgatattatgtctccaagtggtcacacagacgcccaaacacttgccctgatgttacaagaacagttagatgctataaataatgaaataaggtaagttcaaatattgtcttatgatttttataaacacagcgcactattcacatattagctgcgacgcccggggcccgagaaaacaataattaattattataaataaatgttgatcttgatttctaccggatacataatacatcatcgtcaaacggggtgacttgcaacacttttcaactttaatcaaccaaaaccatgatttaaacttcacatacaaatttaaatttctttttgaactttcaatggtctacagaatgaaattcataaaaagtaacaaatatcctcgttcggaatgacatcccgggtacaggtgaataacaaaataatggtaaaataagaacaaattttgcaatcatatctagtttaaccaatattatgttattaatatatgacattaaatatctcatcaatagcaaaacatactatcatagcaaaatttgtcattgatatgttatacttgaaattcatgcaataaccaatcaataacaaaataaaattagttatttgtgcaaaaatactaaaaacattatatctaaagaataacaaacatcgccatcatagtaaaatatgtcattactttgatattcgaaaacttcaatatcaaattttgccatagtagctcattttactatttgtatcatattcattaaccctctcccgcccatggtgtctgtagagcatcaaaacttctaacctttatatctagaaaaataacgaacaaaattatattgttttcacgttacttcataattacacatctccgctttcacttcaatgccttattttcgggatgccaacacatttaacatgtttctttacgaaaaatatgtatgaaggtatgggttttactggtcgaaaaatagtacatggtttcgaagcctgatattacaaagagaattgattcccatggtagcaataaaaatatttcccaatagatttactctttatttgctctaacatatgttcagaaatgctcaatttagtttcgccatcattgaatttgatggaacttgtatggtgcacatatgcaccactgggcgcacggcacacaaaaaagcgtaatatcgaaattgtttttatcagctcagtttacaaattttactgaaaaatcgtcaagaaataagacaactttacgaaagcggtgcagaaaaagattttatcggatttatggatgaagattctgatgctttgaatggatatgacgaagttactaatgaagcagcgaaaatctataagcgtactacgaaatcgattagatccagaagtaagttcaaaattagaatcgtattgtaagcagaatatatagactctatatattatagagctatattacagattccgatatcgtacactttatcattgtcccgatcccgaaggagatgaaacggaagtggagaatttggatatgagtaatgatgaagctaaagtaatccagtttacggtacttctactgtcagaaaacatcgaagaattggattaagtactctaaattcctggtggtgcatcagagcaccacctcatatttgattttaagttaccttgaacactaattcatagttcaaaaacaaggttttgttctacgattttgcgcaaaaatgtacatttctatttttaatcatgaaaaaaagtcatgggcgggatagggttaaagattcaaaaagcaaaagtttttttagcaggatagttaaaagtttactttttaatcatactaaataaaagtcaaagaactaaaattaccgttattttgatctactcgtgaatagcttatttagttattattttgttatcaatatcaaaataataacatgttttgttatttacgattgcctatatttttgctattattatgttattacaatggcaaaatatgttatgatttagtttttatgccatacaaactcagttattatttttgttaatttatctcttatttcaaacaaacaaagaactaattttgctattcaaacattctattttaacggtaaattttgttattctcctctacccgggtattctttagatatttaatgttttttaagtatatttgcacaaataaccaattttaccatgatagaatattttgttattgattagttattacatgactttcaagtataacataccaaagacaaattttgctatgattgcatgttttgctattgatgagatatttattgtcatatatttataacataataatggttaaactagatatgattgcaaaatttgttcttatattaccattattttgttattcacctctacccgagtatacatagttttttttaattatttttgaaattaggttgattggtttagtagtatgcaatggtaacattaagtggcaaatgtcgttttggtaagtgggcattatacatttaaattcagtgtttttgatatattttgggtatttgttaattcagtagtatgaaagactttcggagaaatgcgcatacaactaaaataccgtaaaatgggatgttaaggacttgtggggttttaagggattgaacttctcgatcaagtttgacaaatcacaaaaacgttgaaagtcgatatatcagtcatttgaaatgctttatttgttcggaagattgtgagctgcattatgtgataggaggtgtgtattgaaataaagtattgtggaatctagatattataaacgttttacaacatttttgttcaaattttataggctaaatacattaaactacaaaactatgaagcaatattaagaaaaatatgtgagtaacttagaagatcagtatatttaattaggatcataacgcaaacaaaaacttctgaatattttatctagatttcgacttttaataatttttatggaaaaagactctttttgaaaacaagtggggtgttaagggattatcttttctactttttccaagttaataaactcattcgatttatgccgcaatatattccaatatacttttggcttattccgtgaagtaaaactggattttaaaagttaaggggtctattttgtttgttacttaatgtcaccaaaaatgtctaatttctaaattcagtaaaactggtaggaaaaccttgataacaacgcattaaagtaaatatggggtttttcttgatactacagtcaactctccctaactcgatattgaagggaccatccaactagggaagtatcgcgttacagaacacaacaccagtaaaactgcgatccaagggaccatcgagttagccatgaaaaccaacttttactatggttctctaacttgatatcgagatacggaatatcgagtaagggagagattacagtattttcaaaactaggtcgatcacactggtaaaacgtttggaaagttgaaatattttttttaattggaattgaattggttttgaagctattgatccctttaattggtaatcctatgaagttataaataaataataatattttgtcatttctgagctctttttaaaaaacttcgcggcctcgtcgggcactaagcgcattgtgttatagagtatgcgttagatttacgctccatactggaacccttttcttcagtattttttcgaccatgccactggatgttacatgcaaatctgatatttagagtagtgtttgatttacaggcaaattggcaatttcccctattaaaactaaaagtttattgaaattatccttatgggataggttattcacaaaattgctctgcatagcttataggattcataaactgcaaatgtataggttattatcctgttacatataagtataaaaatcatttcaatacaattttaggatgtattgatagttcccaaaaatgaataatatttatgaaaaatttagcagttcaaataaaacggtttgtgtttgcaggagttccaagttcaataatattgatgtattatctgtttaaggttgaacataacctatgaaattgaatgaaagcatcaaagttattgaccaaaaggattatgttttgttgttgacaaaatatggttttatttacgaaactcaaattccttaacgccccattttgcatttccgtcaaaaatcacacattttcatgattatctcagaaatttatcaaaggatcctcacaattgtatatggcttttgatatacacgacaaaagaatggtagggctgtcctttgtttaattattgacatactagaagttccttataattcgagttgaatttttttttcatcccttaacaccccattttacggtatattaagtaccgttaaacgggatgacttgcaatacttttcaacttcaatcaaccaaaaccatgatcttaacgtcattgtagcaccgttaacccaaacatgtgtaagggatggtacacaaattatgtcacgctaaatttcaacattttttaccgtcctccaaccttgtcacgcttttcgtatgagtcctccaaaaattttgacttttcacgtgatcaacctcccctgtaacgcgacataaattatgcatgaaccctaaagtgtaattccaaacatgtgtaaagtgacgccggttcatttgtacctcgattgcaaccaatcagtgtttggattttgatccgaataagccgatcgaaccatattcggagagtgtaacagttcgcgaaccataacagttcgtggcacatcacattcggagagccctatgaatgtaaacattcactctctcgtttggtacgtggtacaggagcgttcaagagcagcaactctcacagactgcaacagtatcgagccattcgggtgatttatgttttgcttaaatttggtaataactttcatattttctggtaatgcagcctttaacaacctaattataatctattggttcatcaaacacccctttggttgtaaacatagcacagaaaatggaaaatattcgcctctgtttcttgatcagaatgagagtgtgtcagtgaatgttacaagtggtgacacacactaatcggcgcaaaacagttggtggggtgtgtctgtcttgttttcgttcatggcttgttaccttccacgaatgataaatctcatgcgtgttgtatgaatgcaggcgaataaatgggatgaaattatggctcgtgtgtcaatgatcgttaaaatttccaaagcctgcaaccaatttttgtataaatcttcaattgcatccgaggttcagaacgattgcacaaaacagagagacagaaaatagtttacaggtttactaattttacttatcgtgtcttgttgtatgatatagttaattcctatgtttttttttcataaagttaccgttcaatgttacctaaaatagtaatcttagttgatctgctgttgcacatttttttttttcaattctttatttgtatcgttccaaacacattcatttcttatatctaggtgttctgtgttagacaacactatcatccttatttggtaaaacacaattaagcttttttttacattttgttaacaacatattatatttcatttgccgtttgttccgtttgacatttgtttcgacattggatattctatgtaactcattggtactataccaaaattttatattgaatcctctgcagagctaaacagctagcccatattagtacagcatacaacatggctggcctaaaaatcttttcgaagatcagaagcttgttcttaagacaaagttttgattttctattaataagtggataaagacattttaaatattggttacatttggcttgtatgccctcaatgtgaatttgaaagttatttttttatctagcatgaaccctagatacttaacttcatctgaccaatttattggaacccctctcatcgtgacaacatgtctacttgaaggtttcaaataaagtgcttttggtttatgtgggaatattataagttgagttttggaagcattaggagaaatcttacatttatgcaagtataaagaaaaaatatccaaacttttttgcaatcgactacagattgcatgcaggtttcgtcctttggcggagggagaggtctgtgtcatcggtaaatcaagattttttacatccctgaggtaactcaggtaagtcagatgtaaaaatattggtcccaaaatgcttccttaagaaacagcagctcttacagaaagtctttcagacttgaagctccgacaattaacctgaagtgtacgatttgacagataactttggatgattctaagaatgtatgttggaaaacacaagttttttttttaattttacaatcgtgtcttcatgccatacactgtcgaatgctttttctgtgtctagaagagcaagatcagtagaatagctttcagatttgttggaacggatcaaatttgttacacgtaaaagttgatgagtggttccatggcggaatccgaactattcattggggaaattgattttttgtttatgtgaatcatcattctgttcaaaatgaccttttcaaaaagtttacttctggaggaaagcaaactgattggactttagctaggagcttagcatttttctatttgtcaagaaaatatgccaactgaaaacatttgttaaatatatcaactaagcataataagctactttctggaagtttcttgatgaggatgtaaaaaatgtcatcatcacccaggggctttcaaattttttattatagttctcacttgttccaaatcagtctccaaggaattttagaaagcgttctcttgattcagaatgtacataaaacatttattcaagcttcaagggtcctgaagtttgtaccatgaagttcgataaatgatcgtagaaatttatccgcgtggatttcaacagttctctgtctgtccgctttgtgccattatttgcacccaattttaaacctaagtttgaaccgaagtacaaatgtaccgggtttggcgtggtatactggtacattgacgaagcgcgttcgcggttcaacacaagttgcaaggttcaaaccaaaggggctgtccattaattacgtaagtgttaatggggggaggggatctgagatttcttaggcgccatacaatttatttttaattttcgtacaaaaaatcttaccatgaggagagggggggttgaaaatccctgaaaattatcgtacgtaattaatggaccgccccaaagttgaacttcttttttgttcatgggaagactgctacctagattttgagttggcctgagcatcggctagcagcctaactacaagggatagccagaatgattgagataggtaacattttaccgaaattcaaatgcttacggcttttcgaaaaatggatgaaatttgcattcagaagcattcgacggcagatttggtctagttgcttggtcatgcatattggtcaccgaacaccggagttgttccagattttccaaggccatgtccaaatcacatgttgtctgttgtttgtaattttgtgcggtgtgaagttgtaactagatcaatttgacaatttaatgcagccggacgcattaagtttcgtaggacatcatgcggaatatggtcttttctttaatctggttccagaaaatattatcagtcatgtttgtatttccaatcatgtacatattatccgaaatcaaccaacaatgtaacgatacccggtactatatcccacttagccacacgatcacaaaccaaaagtaggaaggcggcatccacaaattacgtaacgctctaggggaagggggagtaggctcaagcgttacggttcatacaaaaatatgaaaattttcatacaaaaagcattacggagaggatcaaaaatttccaattttagcgttaagtaatcaatgaacgcttccgaatacatttttaaacaaaaaaaatagacgctcaattttatgttattatgttatatttttcactctatttccaggttgattcaagaggaaaaacaatcaaccgaggctcgtgccgaggaactggaatctcgtgttggaagccttgaacatatgaacttactagcgagaggaagatcaatggaaaggcaaagtccaccgttgagcggtagaagcactccaaatagtccaaatcgtgactacctccacaaatatcacacagtaagttttatcatcaatgtatatctataaaaatgaacgacaaacgtttgatagcgcatagcttcagaacggctcatcctatttgtaccgggtctatttggtatggttagttttcacgcaaagattttttaacattagcatggattaccgcttcgtaattgtactccgtgattgaccaaaacaaaaataaacgctcaaaaccagaaaatatattcggcaatcagattttccattgatttttgtgctttttatttgatttgattgacttttttccacatttttttttggttgccaaaaccaaattattgcacacttcgaaaacactcgcatcctgttattgcacacttagagctcaattattgctcacatttttttattttgctttttgcgtggagttgactcgctagtgtagagtgttctggtcagatgacggcgtgatataacattccaatcactaaatttaacgaattacgccgagtttgcatgatgattcgatgaaataatgtttttatcaaagcaaaagccaataggagtacaaaactgcattttgttctgtcagttttgttttgctaaattcaaactgtccgagcatcgaggctgtccggccatagaggacttccccctatattctgtaacaatagacattgtatatctcgcggcccatagccaatacagtcaacttatgttcattgcactaaacctgtagcccacttagtgaaagactctcactaatcgggccaccaattaaaacatagcccacttaatgatagtgcaacgaaataaaatcgactgtaaattacactacagcacagctgctggcggcgcggctttaatatttgcaaagaaaaactaagtttatctaataacttcaccgcattatgaaaccataacataaatctccattttcgttgaaaaaagatttgacttcaatagaagccattttattgcgggaaatatttggctcatggcataacaatttgggtgctacttaaattgcgctgtgcacgatagttcaatatcgctttaagtacatgattttgaactttttaattagaatcaaactgctgctagcaggaatgaagtattcattagtgtttagcattaatattagggtttcaattcattacatcagtgtaatatttccggaatattggcaagtgtgcaataattgggtggtgtgtaataattggcaatttaccctaattgttcttcactatgttctacttaatctcacacattcattttatttcatttggggccaaaaggcggaagcctaaaaggcgataactcattaggcaaactatcagaatgcggaattacaaaaggtcgaagacagaaaaaaaacacattgccaaaattaccagaaggcgtaaataccagaagatagaaagtaccgaaaggcagaaaataaaccaggggaacttgctagattcgagtggcaatttcataataataaggtgggggttatcccgaacggccttggaacgcggttttatccccctaagacccccaactaccctattactcttcctccgaaacatacatggggggcacgtctgaaccacacgattataaaaatagaatgtatatcggatctttctcgctagagatcattatttggtctatatcttcataatcagaaggttttaaaatatgttattggtgattttttccacacattttgtataagctaaaatgcgtcgaaaaacgtgttcttcatgggtttagtataaaaaaataactaaaaagtgcaaaaaatcaaaatttccgatggattattttaaaacttttcaattatgaaaatataacccaaatactgaactctagcgaaaaaaattccgatgtggaccagaaattggagaaacgggggtcaacgaaagctttacactgcttgtatggggtatacaaaaatgcatgactagacatgacatcgtatttttggaatcctcaataataattaatccgatcttttctgtctttcggtactttccgctgttttggttttctgcatgcttgtgttttccgcctttcagcttattctgccttctggtaattctgcctttcgttcttttccgccttatggtattctgggttctgactatctattttctggtcagtgctgttaaaggtcaaaattttggaaaaattaaaatgttcatagcaccctcgcatacaaaatatcgcattagcaaattttggcaaccgatagtaaaaaaacaaaacaaaaaacaaccgggaaaactaggaacgatgatattagcaatattcaaatgtcaaagtcacgtgatattgacatttaacagccctgcttctggtaactccgccttgttgttttcggcctttcaccctatcactgctcactcagccacactacccgtttaaacgttctgtattgtttttaattaaaaaaaatattatattgtatcttataaatggtcaactgacatctgatgttttcatacaattgtacgtttgagaaaaatctggtacttgaggccagtgttgaaaaactcgtgcttgctagtgaaaaaatactcactcttgtactcgtttgcgagtaatacactgtgagttactcggggccttccttagccgagtggaaacagcaaagccatgctgaagatgcctggattcgattcccggtcgctccaggatcttttcgtaatggaaatttccttgtttcctgtcacacgatatacgaatgctaaaatggcaactttggcaaagaaagctctcagttaataactgtggaagtgcgcataataatactacgctgagaagcaggatctgtcccagtgaggacgtaatgccaagaagaagaagtgagttactcatcattcacgcgagggtataacgttttctccagaccaaatagacaaaagagccacaaaactgatttttagaacatttttttgcacatccacacattgcattctctgaccatcactaccctttctttgcctgccctacacgctgtgaactagactatggaaatgcatacagttgtgtttagaattatagtagtgaaaccgattttcatacaaaatgctcaactttggcatgctgtaactttgtttccatatgagctatcggcatgagattttggcagtgaactacaaatatactcaattttattagcacaagatttgaaaattttcatactaccggctaaaaagtaaagcaccaggtaaaatcgctcaaaataatagtagttttaataatttaaatatctgctgtatttgaatttttgaatttttctttattcatcgtttcaaccattcacacccaagctatggatgtataaacaagccaattttttacagaattgttgctgaacaaaaatttacaaaagaaaaactactattaatttgagcgatttcacctggtgcttaactttttagccggtagtgtgaaaattttcaaatcttatgataatgaaattgagtatatttgtagttcactgtcaaaatttcatgccgatagctcatatggaaacaaagttacagcatgccaaagttgagcattttgtatgaaaatcggctttcactactattattctgaacacaactcacattttgccttatgaaaggtggaacaattaatgcaatacgaacgctttatgtatcgttttagcatcaactcacatcaggcgtcgataggcgcgtggtgtacgcacgggcctaacgatcgcaaggtccttggttcgattcaggttgccgcgaaaacctttttttgttttcaaagtttgggtttataaggcaaagcaatgaacttcaacccgatttattgtggcgaattttcataagtggttcctatgtatttcgatagtccatttgcctgagtgcagtctgcctagtcctggctctatgcttcttcttccctcgtctagacagaaagaatctgccgtctcaaccccatcatgcttttgaagctactcacgctcttcctttgataacggtgatacctaccaagggcttccagcccttcgccgtactgaaggtcctttcccagtcggtcgcttggccgcgattgcttcgcactgcttctttcgccagccattctttcggcagagcgaccggtaccgcggtccgctgagggctttgtttagtggcgcgtcttgtcgtccggcgggccgacttgttccttcgtcggatcctacgttgtccccgctccgtagcaatacgatatcggctcgcaccggggtgatccatgtagcccagtgattggctcaccgtgatggcaccaagaaaaggaaattagaaaaaaaaaactgcttttgacagacccgtgtagtttttagcagataccggttttccggatgcttgcgttgcacctagtgcggctgatggcctgtgtcggctgtttttcatgttcgaagaatgctttgcgtctttgattccgtcggcagtctggtggtttttttgattacgataggcttggccaatccttagtagtccttcgcacggaccaagactcacgtgccttgacactccctccgatgcaatggcgtcttttcagctcacgacaatcgtattccgcggaacttccctggatcagcgaagcaggcgcaatggattcaccgtaaccctgttatttgcaccgcggtacaccgctttcctgagctgaaaaggctgggttcttcggtttcttcggaagcacttttgtttttattacagtggcattatttctgacaaaggtcaaatttaccgtaaaggacgtgtgcaatgaatggcttaagtgtgaattgtgcttaaatttactctcgtgtagcttacattcaaaatgaacgttacatataactcactcacgtaaagcgtattactcgcagtgagtatgacggcattactcttggcgggtgattgagcaagctactctttgtgagtatggagagtgaccaattcccgaagcaaaataaaattgtactttagtgtgtagtaattcattgtgttaacagcggccgtctatattgcattttttttttattatgggtgtttaaaaattactgaattcagaattatttttgaaacatggaacaacaatttaaatctgcgatatttcgtttgtgttcaaattcatttatgctcgattggttgctaatttctgacggttcaattggcggctcactccttttcgcatttcccttattcagactcgctatactgcccatactcgcataacagtcccatttgatttttcgccacttttgagttagcttcatgaatagtattcatttttagtgtactttccaaaataaaactccaaattgtatctttgtatggacaaaatgtgaaaaaaataccaaaccatgtgcgtcccatattgaaagtacccgcagaacagtcccattcgatgattatgaagaaattcagctaaacctattcctgtgatgaattctgaaagcttgcattgcgattttccttatagaaacaaataaacaaatcaggaaagcacaaatcaactataatcaagaaaaactcttaactttgtttaaaaaaggttttactataacgacttcttctgtttttcgattaatactaacaccacatcaggctagctgcctgtaaactaaaataaagcaaaatagttttcctgagactattcttctgctccattcacactcttcctgcggccaatcattatcagaatctccggcaggctgaagtccaacagcgagatgcgagaagcttgttttgccgcctcaagattgcgcacatcgtcgctagcatcgtcgccagtgtttacatggtcaaactaagtgttttcagcaccaaatgccgagaaacaggaaagctcctgacacccatcaggattatctatatcttgagaaccaccattcgtcttcatcaagtggaccaaaacgtgttctattcacctttctttgatagttttcaaatccttcacccgtcacgtgctgtgatttcagcaagctttccatatggtcgaccgcaacggttaatttgaattccggaaatcttcaccattttctcaattatatatcatcactgtacagcttaagaacttcaagggacattattactatttaaatatagttgataactgaaagctgaaagaaaagtacattgcaatcgatcgtaaatttgaacaaaaatgtgtcaagatgcacgataacaaagtaagcgaattcccagtaatgggactggtatgcccaagcgtttagcgagagaaatactcggataacgagtcccatctgcaataaccctaatttggatagcaaaaaacaaccagttttactaaatttaaattatttacggtttttgcacattgcaatgatagtatattgagcaataccaccggcatttactacttccagcagcggaagaacgaaaatggagggttttatgtttagaggcgtttttctggacatcgtgattttcctaatgggactgtattgcgagtatgggcagtatatgtattgcgcatttcttccaccactggactatcgcagaaatttttacaagtgcggaaacgctaataaaagtgcgcaattgcatcaaatcgggtaggtgtctttgggggacttattcttcgtaaatcaaagaataagtgctctgaagacaccaacaggattcaatgcaatcccgcacgtttattcacactttcgcacttgtgaggccgcacttcgcagtccagtagtgaaagaaatacacactaacattcgcatttttaagattttaatgtaatctgcaaatttatcctagaaaactcgaaaaaatactaaatgggcttcgtggctgttacgcatggtccatcgaagttaataaagttgaagttattagaaaaatcaacccacgcgttttagtgcaattcaaatccaatccggtgaaaacccaaatcccttgagctaccgtcgaaacattttggtccatccgaaccggattttgtgagtggttttcccggatgttgtgtctggaagttgtttctgtctgttgtgttgctgtgaaaaaaagcaccaagtgcacaaatgcggtccctgaccgaaagacacaagacgattatgtccgtagcatagtgcgtgtttaaaaaaaccaaccaatttcaaagctctaagcatcattctcttcaaaattaaatttatgaaaagtttgtagaacatcaagtttgtcttagttgaaagtagttttctccaaattattcctctttttactaaaccaatttttttttttttgaccgtaacttcatgaacacttaatcgatttcaaacctttttatatgattttgaaccaaatttagttgtttttaaactataggtacaacaaatcaacttaaaaataatttggaattagttattttacaaacactgcccaaaaacatgaattttcaatggaaaacacatttatcagttagacgttaatacataaagcttgctagcgtgtgtgaagaggtgaaagttgattcaagaaaaaaagcagctgaatgaaaggcatgaatgaacaggaaacattccactatatggcttcgcggagtaatgttctcgcgaagaaatcgaatttgaagttattagaaaaaccaacccacgtattttagtgctatttaaatccaatccggagaaaacccaaatcccctgagataccgtcgaaacactgtccaaagcttgcttttatcaattttagcaaaatagaatgttcaaaacaagaacaataacttctcgcgttgagtatcatacaggcgtatttgcagtgatcgatttctcttcgtcgattttctctttggatcagtacacgaaattcaatcgattttcgtaacatttcgtgttgtagtacgattaaggacggtgtatattttctactgaatcgaaaataggagttgaaaatagtcgctcggtgcagtaataagctaagagaaatcgatcactgatctggcgagatttgagttttggaaggttaccaactaaataagttatgatttgaatattgattgtttcttttaaaacctttaaaacgatgctcggaaaacgatttccaagtttgattgaagaactaataataattaatccaacctatttaacttaagagcagatatgcctattgcagttcgaagaaaaagtggtgtgatctaatcagtccatcgattgtgtagcttgtcctacgagagcgagcgatgggaccagacccacattcgtttaacttgcaattcgtaatttcacgattccggttagtcgtgattatatcatgaatcgcatcactaaccaaaggtgattcctagatccttaccttatcccactaaattaatattctttccttgacaactgtggagaagctgaggtataatcgatctctagtaacaatggttgtctaactgacattccttcattttccagatgaccgtattgggccgtattttgaactctagatttatgcactttaagaatggttagataatagcaagtcccattgattaaatctctgtgcaacttcgattgttctgatcaattaagaagtgcaaccacgaagcggtcaccatgctcacacacatacacactctgaaaaacttggtatacaaagatactttcttaacaagggaacaaacgaatagaacccaaccaaactagatattttaataaagagtagtgttcgcgataggtagccactttaacaatcatatatatgatatctcattggatccaatacttcaactctaagatgctggcatgttgtattggctttcagaacgttgtttatttgtttacaccaacagacgttgcttagttgtacaatgtcaacatttttcaacttcacaggctccagcctccatgtcacccgctcatttacatcaatatgctgtttctatgaaccaaggacaactatctgaatcactcccatctagtcaggtatgttctatctctcaatcaataaaaaaatactacaaacatacatcgcaatgcatttttctaatcaaattgtatgagaatcgacaatgacattgctggcagtgtaaatatgtgatcgtcaatacattaaaccattgcatgaactatgtaaacatttttgttttatggataagacgccacttattgagctcattatgctcctaatagccctaacggtggccttccttagccgagtggttagaatccgcggctacaaagcaaagccatgctgatggtgtctgggttcgattcccgatcggtccaggatcttctcttaatggaaacttccttgggctcagagcagtgattcccaaagtgggcgaattcgccccctgaggggcgatttccagcttcaggggggcaataatttgtaattctgaatttggggggcgaaaattttagtattatggaaattggaaattcattacaggcaaaactcggcttgatcaataacaaaatattgatattcattgtttccacttctaaaacacaaaaatggaactaatagttttccctaccgataacggtgatctcaatgatttgtggttacaaatatcattggaagcattgttgaagtaaaaaaagtaaaaaaatatgtaagaattcattacaatcgtcacatttagctttttttcacaagctaatctatgcaattctcgatttttcaatttcaaccggaactcagctaacaaaatgctttcattacgaaggtcacgaagcacgattcactgatactgggcttctattttctgagatctcatgaaacttctttactcgattgtgcatatctcgatttaaattagccgagactgagcatcctatacaaagagcgattgtctttttaatactctataaaaatatctgaatgtcggaaaaattctttcaaaaccacaaaaaaaaatgttttcgtaatttttcaagaaaataaaatagtaaagtgttaccttttattttttttcgttaatggcttttcacgacgagttcaccactcaaataggagtgaaaaccttttctggatatttgcaaatatttttgctctcaaagctctggattggaaaaaaatgtgttctcagaagtatccaatgtttcttaatcttatgtgacatattaagatataacagataagagatcattcacgtttaacgaaccaaatttgattagatttgtaaagcagggagtggaacatcattctatcgataatcgcagtttagtgaaacccctaaatcacatacactgataggcaaaataaagtgcccacctcaccagttttcgaatttctctcattgatttggttgaaattaaagttaacacacttaaatctttattgatattttatttttgatgttctttcaaagttgcacttacgaaattttgataaaaaaaagaatttcactcaaaaaaaaagaaaatcaatttgtattgaaaaaaaagtagtgacaaaaataagtgcccacttccttcttggccccagaaaagatgatttaagaaaaataaaaagcaatttaatagttaatgtgtcctcctttggccttaaggacttgctggaggctcttcggcatgcttttcaccaggttttgtaggtgttgtggatctagttcttcacaaggggcgctctaaggcttcaaaataattatttttgttggtaacaccagttttttcaaccctggcatcgagaatcgcccacaaattctcgatggggttcaggtctgggctttgtggaggccattccagcggtttaaaccgacaagactggaagaaagacttggtcttctttccagtatgcttcgggtcgttgttcaagagaaataagaatttctcttcaaggcccgtctggatcagcgaaacctccagattttcctgctagatgttaatgtaggaatctgccgtcattattccgtcgaatttcacgagacttcttactccactccatgaaaaacacccccagaccatcacatttcctcctccatgcttcaccgttccttggatgtggcgctctgcaccacacacgagcccgccgctttcggttagacagctcgagcttcaggagcgccacacccaaggaacggtgacgcatggaggtgtgatgtgatgaaatgtgatggtctgggggtgtttttcatggagtggagtaagaagcctcgtgaaattcgacggaataatgacggcagattcctacattaacatctagcaggaaaatctggaggtttcgctgatccagacgggccttgaagagaaattcttatttctcttgaacaacgacccgaagcatactggaaagaagaccaagtctttcttccggtcttgtcggtttaaaccgctggaatggcctccacaaagcccagacctgaaccccatcgagaatttgtgggcgattctcgatgccagggttgaaaaaactggtgttaccaacaaaaatagttattttgaagccttggagcgccccttgtgaagaattagatccacaacacctacaaaacctggtgaaaagcatgccgaagagcctccagcaagtccttaaggccaaaggaggacacattaactattaaattgctttttatttttcttaaatcatcttttctggggccaagaaggaagtgggcacttatttttgtcactatttttttttcaatacaaattgattttctttttctttgagtaaaattcttttttttatcaaaatttcgtaagtgcaactttaaaagaacatcaaaaataaaatatcacaaaagatttaggtgtgttaactttaatttgaaccaaatcaatgagagaaattcgaaaactggtgaggtgggcactttattttgcctatcagtgtaggattttcgctaacgtatttcgaatcgatttggttgataagtaaattatcatggaagcttatgaatgtaatagttttgccatgactcttaaatacttaaattaaaccagtcaacttcccattttgaccaatttacgggacacttatgctaagatattgatcaaagcttcaacatagtatagtgtttagttttaaattttcatttggtctcaagggagcgaaagccaaaaaaaaaagtttgagaaacactggcttagagtatcatcgtacttgccacacgatatacgaatgcgaaaatgtcagctttggcaaagaaagctctcagtggaacttaaactgtggaagtgctcattgaacactatgctgaaaagcaggctctgtcccagtgataacgttattcccagaagaagaagaagaaaaatccctagcggtgatattgttaatctttgcgaaataaataaaaattactacaaaacatagaaatgtttgtcgattctgatataatcaaaggaaagaaaatgtaatcataaaaacacatcaacaatgaagccatcactactcggaacaaatgtattattttaataatatcaatgaaataatttaaatcatggaagtttctaatagtataatgtatttaatttgttcttctaggtacagttatcacatctttcatcggaaaaatcacttgaagattttcacagtgggaaagaaatgacaataccatgcgccgatgcagcatctagtggtgcagcatctccgcttaccgcacgctcaatgcggttagaacgctttgcacttgcattagcccatagtcaagaggaacttagaaggtaaatgatgtaacgtctatagtcccaaaaaaatagactcagtatttaccatatttttgtgctgccagacgatcttcaggaaaatcaagattcccgaaaatagatcattatcttttcaatgatcaggaacatgtttataaaaatatgcaattgaatatgaaactcttgcaatctcggattaatatgataagggaagtcacacaacaaatagaccatattgcaacacgccctaagtctatcctgaagttgaaaaaacggcgtgtcatgtatccaaaaccatatttatcgatccaacgatgtatactaccatgtacacaaaatcgtattattaatgacagtttaaaaaaaagtattccaattatttccaacatgccgtggattaattctaatacttcagcgatagttataaacacttctccttttgctttgacagatcgccgttttggaattttacaccatgaacattcgtcaaagtcatatttataacaaaataaattatttttctttttctctattatttatgttacttcgtatgtgcttaacctattccaattactataacaaattttactatagagggttataataatgcacaatttaatataggatacataatctaggttataaataaatgtttttgttatgatgagattttggtatattggtgatttcgattgtactttatttcttgggaagacgtttcctgtgattgtggatagcaggaaacaaaacttcataatgtgaaaaatcgatttggtttagagcgtgtagatttcgtctgcgaaacacgtaggattgataaagtaagtttgctcaattttctgataagactgtttgaataagtttttgagatctctgttaattttttttttacttttcttgatcagaacagcatacttagcttaaccttccagtcgtcgcgcggttcgccaccgtcagaatcaccacgctgctgttgtgagcgaaaagcgagcttttttcaccagtgttgtacaaaatacaacagcgcgacgactgaagtgttaagaaggtaaaaaattaaggaaagacggaaaatgagaccccttaaaaaataagctcgcaattagtaaaaaaaaatcattggattgaggcaacagcgggttataacgcaccagcaaccccctcgccctggttccaaacgtttttttttgtggcaaaatacagcaattttccaaattgtaatgtatagaatttggtaagcgaagcagatactatgtaatttaatgtcccgttccagtttgggttttggcgcaataatcttaatagggcggtattcaaaactgaaaaggcaatagatggctctttttcagtggtagtaaaaacggaatcctaatcactactttttcgttccagttttctattcaagtgtgtttggggatttttgctgaaatttgtaccactgtgcgaccaacgcatcttctaacgttattgctgtatcgggcaacactgtttgcaccgtctacgaagagaagaaaaataattgaaaccacttgtattcgaacagaagagtaataaacacgtgaaaaacaagttttgtccgtattttcaatgcgtgttccgccggtagaaagattccgaccgtccgaatcgtgttctcgggttaccgatagttgtccaagttccgccgcgacctctccgctattcgctttcgttattgatacatagttttggtccttcggtaccgcataatggagccagccgagctggaaagattacgtgccaagcgagaggttatgtttgcgaaaatcaagtgggagttttccgtcgcgaacgcactccacgtccggaatccatcgttcggagaagtgtgtgaacgccgggacaaactcacggaacttgcaacaaactttgatgccgtgcaaactacgattgaggagaatacgacgaatctgatggatgtcacgtcggtgtttaattatcgcacacaattcgaagaagtttacttcaaagtgaaagacatttacactgagttcctggacgcaaatcaggaccgtgtttcgtggcacagtgctggaagcgagacgcagaacgatttacgggatgcaatcaaggcccttttggaaacgcagcaggcgatgcttgatcgtcgggatgtaccaccgcaccagccagcatcgggtggtcaggtgtcgaatcatgagccacaagtcaagcttccgcaactcaacattcccgtcttccgaggtgagcgaaaagcgtggaattcgttcaaagatttgtttgtcagcacgatccacaccagggaggatctgaaggcttccgtcaaaatgcagtatttgttgtcctacttggacggagaagcaaagcgaatggtaagctcgttccccattaccgatgcaaattacaacgaggcatgggaaacacttgtgacacactacgacaaaaagaaatacacagtgtttgccctagtgcgggagttcgttgaccagccaccagtcactaacgcggctggattgaagaaactggtggccacttctgatgacgtcatccgacaactaaaagctttgggcaacgagtacgagacacgggatccttggctcatccatttgctgctcgagaaagtggatcgggagacccgcggactgtgggcgcagaagataatcgacgaggaaaatcccatgttcgcagatttcatcgagttcctgcagaaacgctgcgacgctttggaaacatgttcggcgttttcgaggaagcaaggagaaactgcgaaaaaggagcttccgaagttcagtgcaagcgagaagaagattcaagcgttccattccagcgcgacgcaggtgtcgtgcgcgaagtgcagtaaggaccatccaacgtaccattgcgatcaattcaaggccatggatgtatcgtcacgtagggaattagcactgacgtcaaaactgtgcttcaattgcctgcgttcatcacatacagcgaaaaagtgtcagtcgaaatcggtgtgccgtaccccacagtgcaaccagcggcaccacacactactttgccaaaaggaaatcaagcagcaagacaacaagcaagaagttcatgaacgctcagaaccggaattggatgttccatcaatctctaccaatgtggcgcaggcggttgcggaaaagcaaggaccgtttgcatttgcattgctgcctacggtggtggcgaacattcagggaggtgacgggaaactacatgaggtgagaattttgatcgactgtggttcccaagcatctctcatcacgtcagcgtgtgtcaagcgtcttgggttgaggcgccgtaatgcatctttggaagtcaccggtgtcagcggggaagcagtcggtaccacagccggcattgtcacgctggtgatttcgtcgcgttttgatgaggaaaccaaacttactacagctgcctatgtgctaggaaagctcacggcaaccctgccgtgccagcgtttcgacgtggcaagcatgccgtacttgaagcatctaccactcgcagacccccacttcaaccaaccgggttcagtggacgtaatactgggatcggatgtcttcctgtccatactggaggctggtcaagtcaacgatacgaatggtattcctgtagcacaacgttctatctttgggtggatggttgcaggaagaatctccaagcaatggtgtacgcatacacatcactcggcgattgatcttcgtcaggatttcgatatcgatcgcaccctgcgattgttctgggaggaccaggaggtacgtcaagcgaagcagtggacacgcgaagagcaaagggtcgttgatcatttcaactcgactcacacacgtgcgaatgatggtcgctttatcgtccgattgccgatggacaattccaagcagcaactgggggagtcgctatccgcagcggtcaagcgactacgagccatggaacggaaattcgaaaccgatgagaacttcaagcagagatatattgccttcatgcaggagtaccaagatttgggccacatggatctgattccggaagcagaggttcaagtcgagtgcactaggtcctactacctgccgcatcatggggtcgtgaaagaagacagcagtacgaccaaacttagagtggtattcgacgcttcgtgtgccaccacttctggggcgtcattaaacgatttgctgcttgatgctccgaatatcaactccgatattttcgacattatgatggacttcaggttctacgaggtggtatttactgcggatgcggtaaagatgtatcggcagatactgatgcatcctgccgatcgagactatttacggatagtatggagaagctcgccggacaagccgatgcaacactttcggcttcgtacggtgacatatgggctcaagaattctggattccttgccatggcagcactcaagaaggtaggggatgactacgaaggaatatatcctgaagcagcacagcgaatcaagaaaagtacctacgtggacgaccttacatcaggagcgaggacaaccgaggaagctattcgtttaatcaaggagatcaacgagattgtggagagcgcaggattcacgcttcgcaaatggagctccaattcgacagcagttctcgagtcgctacctcaaaccacgacagcatcacaacaaatacagtttccggacgagcgtgatacggtgaaagctctggggattcactgggttccggataaggatgtcttcacgatcaaggtaaacatgcaaactgatgggcccaacacgaagcatcaactgctttccgacgccgcaagactattcgatcctttcgggtggtttgcgccggttatcattcgtgccaaaatactttttcaacattgctggttatacgacctcaactggcatgatccacttccccctgccgtcgaagaaaaatggatcgaaatgaaggagaacttgcatcagctggagaggatccacattacacgatgggcacccaactacaataatcaaatcgaactgcacggtttctctgacgcttctgaggaagcgtacgcggcagtagtgtacctccgatccgtggacttcgatggaaaaattcacgttacattgttggcagcaaagacgaaagtcgctcctgtgcgacaggtatctctcccacggctcgaactcaatgcggcagaactactagcgaagctgatgaagcaaattgctgagtctctcaagcgcttccagatagaacagtatgcttggacggattcgacaatagtgcttcagtggctctcaggacaccctcgcaaatggaacacttacgtggccaataggacatcatcgatactggagattttgccacgtaaacattgggcccacgttccatcgagagaaaatcccgccgactgtgcttcacgtgggatatctccaacagagctcgtcgatcatcacctgtggtggtcaggtccaccatggttggtggaagattctgctacctgggatcgcaccagcccttcggacgaattggatgaaattacattggaggtacgtaaacgttttcaatcactgaatgtctctattagcaacgcagaaacaacgtacgtgatcgagaagcacatactcgacagccggtcgaccatcggggctgcatgccgacagttggcgtgtgtgaagcgattcatctacaatatgagatcgaagtcatcgtcactctacgaaaaacgttctggtgctatcctgccctccgaattgaatgaagcaagattgcagctcatcagattagctcaacgtgaacactacgaagaagaagcaaaatcgttggcgaagggaaacgaagttcatccgaagtcaaagatcagcagcttgtacccgttcttggacggcagcggaacaattagagtcggtggacgtttgcagcagtcatcgtttcctttcgaggtgaagcatccggcgatactcccgaagaatcatcgcgtatcgagattgctggttgaagaactacacttgcagaactgccatgcgggtccaacactcctgacagcaactatcaaccaaaagtattggattcaaggctgccagcatctcatcaagcaggtcatccaaagttgtgtcaaatgctgccgacagaaagccaagacagcacagcagttaatgggcagcctgccggcggcgcgagtgaccgcatgtcgacccttcagtcatgttggagttgactatgccggtccgattcttgtgcggtgcagtaatactcgcggagaacgttgctcgaagggatatattgttgtatttgtttgcctctcgagcaaggctgttcatctggaggtagctggtgatctttcagcggacacgttcttgggagcgttcaaacgaatgattgctcgccgaggatactgtaacgagttgtggtcagataatgggacgaaccttgtcggtgccaaacggcaactgacggaaatctacgaagctacgcagtcccatagcaagaaaaccgagccctttttcagcaatcttggcattcgctggagattcattccgccatccagtccgcatcagggtggcatttgggaagcagctgtgaagagtgcaaaggagcttttgagaccagtcgttgggaacgaaaagcttacgttcgagaagttgtcaactgtactgtgtcaaatcgaagcatgcctgaattcgaggcctttgtaccccatttccacatcaccggacagctatgaagccctcacgccggggcatttcctggtagggcaaccgttgaacctattgcctgagccagacatcggtcatctaaaagccaaccaactggataactgggagaaggtgcagagacttacatccgagttttggagtcgttggcgcgatgagtatattgccacactgcagccacgtggaaagtggagaaatcgccaagacaacatcaagcctcatcagctcgtattggtcaaaaatgataatacgccgccgtccgcctgggaattggcccgggtagttgaagttcatcctgacaagcaaggcttggtacgcaccgtaacactccgccgaggaaaatcggaataccaacgtccggtacagaaactgtgtccccttccggattaaggcttcgcctcaaggcggggaggatgtttggggatttttgctgaaatttgtaccactgtgcgaccaacgcatcttctaacgttattgctgtatcgggcaacactgtttgcaccgtctacgaagagaagaaaaataattgaaaccacttgtattcgaacagaagagtaataaacacgtgaaaaacaagttttgtccgtattttcaatgcgtgttccgccggtagaaagattccgaccgtccgaatcgtgttctcgggttaccgatagttgtccaagttccgccgcgacctctccgctattcgctttcgttattgatacaagtgtgtgctaaaataaaggcgtaagtaacatgatcaatttctcttcatctatcctctccagcgaataaaggtgacaaggtgcaagtttcttaccagtttatctctttaggcgccgtccacaaattacgtaacgctctaggggcagaggggagtaggctccaacgttacgattcaaacaaaaattttcatacaaaaagcgttacggaggggggaatgggtccaaaaatttcaaatttcagcgcgatgttgccttggaaagcacgatgccaacaaacttgcatcttgtcacctttattcgcagaagagaggttcgattacgagaaatcaatcatgttacttacgcccttatcctagcagacgcttgaatttaagttttgaattattctccacacgttttgacagttcttaactacgattctctcatgtgtttgggttggaagttgagaaatttgagaatcgagtgtagcgcggctggcgctatctatgaacgttgtaaacagtcgttattttactaattttcatagtgaatagcactaaaacattcaaatgattttcaccaaaaaacattaatctcaaactacgtgaatgttcaagagggaaagacctctaaattttgtatatatatacgtatgaaacaggattttaggaaggtaactgcgtctaatggctcattttaaatctttcttgaattttgaaattatttgatcaaatgcatgcacccatcaccaaatatgttgccaaaatgtaaccgtgttgatggttttgcaaaacattgacacttaaaaattatattgaataatttgtttaaactatttttaggtcccttatcttataatttctcatcgtaatagactatttttcatcacgctaatgtgtcatgacacggcctactttcgtgtatgaaatcatttagtatcgtaatagtcattacgtaactgaaatcagctaatactctcaagtggtcttcttcgaaatagcagaaagatttttacgctagaagttgcagaataatgattttcacagcattcgtcgtagttatgtgttatatgggagattgagcagtcgaatgcctagatttgctacataaactagaatgtaactagtaagtaagtaatgtaactagaatgtaaactatacgggtttctccggtggtcattcctgggttaggggtcatgcacaaactacgtcacgctccgaggggggaagggggtcaagccaagcgtgacaagtcttacaaaaaattcggaggactcatacaaaaaacgtgataaaggggggtggggggaggggtttaaaaaaagtcgaaatttagcgtgacataatttgtgtaccatcccttattacggtggtcaaaaagaaccaaagttgtccttcatctatataagtatagaaacaagaaaaatcaaataagctccggtggatattccggtgctccaataggaccagaataatcatcctcctggcaaaagacatccaaacatcaaaaagcataaaggtttagacgccatttatttggttttgtgatataaatccgagaaatttgaactaattgtccagattggccaactttcgggactccaggaaccggtaccgcatggaccatactggaccgaaattactccggtaacttgatctttattgcatagaatttttatgcaaaaatacttatcaaccgaatagtaccgatgttaattacatgtagacaactacgatgaaagaggatctactccgctttgcataatgtggtttggcattgcccattgcacggtgacgtcatcagaaaatcgctctctttccctccttcgggaactttgaaaacaacggtgccagtacctgtcaaagttgacaggtactggcaccattgttttcaagttttgttgaggagcgaaggagagagaatttcgccgtgaaatgcctaatacagtggtttggtataaagtcgtttggcataacagttgttgggtctaccacgagaggccgaatcacaaaaggtcgaatcacaaaaggccgaaacatacaaaaggccgaatcacagaaagccgaatcacggaaggccgaaattttaaaataaattttagtaaaagccacaaatattcagcacatttttctaaaatattataaacatttttacagtagggtagggcgggacaagatgctcaagtaacattactagctgaataacagtttatccagctgaaatataattagtgttttttgggtgtgtcagctggtctattcttagctaacataaccaaaaaaaaatatatataattggagcttaagcattcgcaccgttgtattttgtacaacataagtgtaaaaacctcgcgaaaactggaagggtatacagtgcctgttcgattttggcaacatgccaataaaaatcattttgcttaaattgaaccgttccaaaattcaacggttgtttttattgaaacttttaaaactgtaataatgaccacgaattaaatttacctattttgaatatggtaagccttaagaaggccctcagaaacattgagattgataggatttgtgacccaccatgatccattttttcgagtcaaaatcgaacgggcactgtacgctgaaaagtattcttagtaaacttagtattcttatgatcacttaaacatttgttaagtataccatatctcagcaatcattctcctgcttgttgtgtaaaagactatgttggcattataccgggcaaacgcttgctgtccgaactcgctgtcgctcgtctggcccaaaaattggaaaaacattctctgtttgcattataccggctatacgcctggatttcctgtttgcattacatcggatagatgctatacacacccttcggatatcggagacttcggcggccttctgccgcctcagctcctctctcctcaatgcggcttcgccgcatgtatattttacactgtttactgacatgactgcattaaacaaagcatggacttgttcttttcatatccaagctttattctttaggtttgtaacattacacagttcgaacgaaacgtgtaaatttctgagacatataatgcacataattggagcgtggaatatcatggatatttacatgatatgtcatgtaaacttcaattatatgtcatgtaatctagcaggatcctgagtgattacatgacatataacacatttttacatgatttcaaactgaaatttacatgacgtcatgtttacatcgcataaatgaagtttacatgacgtgtaatcctcattatttttaactgtgcaattcgggcttctgtgattcgcctttttatgattcggcctttcgtgattcggccttttgtgattcggccttctgtgcattcggccttttgtggtaggctaaaatgtattctgccttttgtgattcggcctgctgtgataatccccagttgtttggcataatggtcgttgggtataatttaaaaaggaagatactgcaggggtacagcaatattcagaaccagaagataatataatatcgtcttcttttttttttttaataacatggcatatattaggcgttcgactcatttttgtttaaaatgcgctttaatatcgcgaactgatcctaccaggatcgccctggaaatcatgtatgatgcaattccaaaagatctgtcttgcatattgcgaccatatccggatattccggatggttcctgaaactagaaatgtgtacctttcatataagcccaacacgactaaaattggtcaacaaactgaatttttgggtcgaaaacgacccaacgtcacaatttgtaactttttgttaaggactaaggaacgttggactgaagaaatttttattttcaagaacaactttatagaaacatgtaattattacattaatcataatataacatataatcatattttattattgatcattattaactaaaataggtttgtatcaagtttatcgaacaatgtagttattgtaggaatgatagggttaacagcatttatgtgatactaattgacccgaaaaaccttgttttgtcctgaagtaagctgttggttaatgtgatacaaaattgtatagaataaaagtcagtttcctacccctgttttcctttttttcgtgaagttcttcgactttttgtcgacattaacacgtcggaacacttcaagaatctaactgtgaaagaatcaggtaaatccgttgtctcgttctcaagttatttcgtgacatacaaacaccattccgttttatttatatagatatcgcaatatagaattcatttaattgttcatacattcttcagaaaggcaacattttcaacgtttactgtcatttcgtttcataaggtaattatacaattgtatacaattctactgttgtgttcagcatacttgtctcaggggtttccaattctaaaggaacaactatgctgaaaacggtagattataataacctaacatgccgtcagttggtgtgaaatggactcatgacaaaagaaaaacatattgacaaggggttccatacaaatgtaaacaatttatcaaaaacaaaataaatcatacttaccattgcaagaatgttgaaatatcaattgtcaaaaaataaccttcgatgacacactgaggcgtaaaaaaggtcctcacagagtaactgagcattaagtaaaatcgaaatgagaacaaattttggtattgtcatatagaatacaataatttgttctgataatattgtggttgggtttacaacaatcacgtatcgtttacgcgcccatgttttgccaaacaaatatacatattagtgcaatattatctaagtttgcaatgttaatacataaaaagaacttttttttaaatacgtaagacaaattaaattcttgatattttttatgcacaacgataggatttgtaaaagctttacatgtagctcatatttagctacattttgcgtcatatgaaagtacttcataacaatattttgacaaaaaatcataatgtcagccaatattacaactctttttaataatcttttggcatatgaagaaaaatttgacctattttttttaatccaggctattacgttctacagcaaaaatcagtgttgctctaatagcaattgcatgattatctcagcatgatttggactttgttatcattaataacaaattatccttacgtcccatcaaaatgtcatcttcggcaaagttgtggctaggaaaatttaacatgagcagagtttgttgacttttgcatatattaatgacgagctgttagaggactgaacacaaaaggattgccttttccatcgtaattccatataaccttcaaatggcgtgtgcacaaccaaattttttccgaatagctaaacatttttggcgaatgatttacatcttaattgacaacgtttaagcctagtggagcaaaaacctaggagtaaaaagcctagtggagcaaatctaaatttgcatcagtctaataagcacccttcacaaaaaaagagaatttcttcgaagtacttcaaatttgcttgcaacattctaaaaattgctttaactttattgcatctattgtgctgcgtatttttataaaattgagctgttatctattcgtttctattctcttgcatccgtttcttgtaaattatatttatattgcaggatatgcaatgcgcatcaatgcggaagcattaatagttgaaataatttgatgtaataaagtgctcttcttgtcctgtatgggtgctcaacttgccccgcagcgtattcaagccaaccgaaaaacatatttttgtttgggggtattttgggttcgtgtaacttgaagtaaaaactaatggtcacattcagcaaacatcaatttatccttaatatgttcatcttgtcatgctctaccctatacacaaagcatcctagctatcaattgcagttgatagattaccaaaagatttattatgaatggatatataatgtttcatataatcgaaaatcggttttctgttttggggttactttgataatggagtataaaccgaacaaaattgaatgaattacgtaacatttatagggcgttgcatacctctaggcgtttaacgttatatgggaatttctgacttagattacaaaaatggtcccagtttgtgaatatgcttttcgctaagagatttgagaccatattcaagttctatgatgactaagctgtcaaggataagtgaccaactattcaaaactacatcaaatagtgctcgtagaacagattgtttgtaagcgtttcgaacatgctgaaatcgtatcaatttttaatattcgtatataaagcctcacatgttctcgattcaaatgaaaacagctcttatatgaagagtgtcatactaatattctttagttttgcttaaccgatcaacataaagtatgatatttcgtttagtatgtgatgggtaacgtactatcaaagttacccgcattatcaaagatacaccgttttacggtattctagttgggtgcgcattccagtgaactttgtcttatccaatctgtcccgcataatactgcaatttacacgagatgaaatgatatttcaacattttcaatacctgacgaatttcggtgatttcgtggtcaagctctgaagtataatcccgatcaaccagtgttaaaatttatttataaattctggacaaacatttgaaaagggcccaagaggtcttgagcctttttttagaaacgttgctgttgagccctgtttagcccgccctcgcaaactaataccactatcagaaagattggtgttagctcttcctgatagtgatattggtgagcgtgatcgagttgaattgggctcaacagcgtcttgcaaagccaatgtttaccaatgtcgatgtgcccttttgaaatgtttgtccagaatttttgttcagcgatgctaacgattcaaaacgaatcgatatcgaccgctatcgaaaatcactgactggttgaccgggatgtgtcttttatatttgtaccctaacggttcaaacacgatcttcttgctgggataccacttcacccaactcacggtataaggttagctgctaggatacatgtttttcagttgcaattttatgttattgtaggtacacgcactcccttttaagataaatatacataaatcgtttatttttcaaatattggaatcgtttcactgaaggatgtacaaaaaaatctgaatcgcaagccatcagacaatgattccttttcgggagtattgcaaaattcggtgaagcgattccataacttagtcgaacagtatatgaatatgatttatatcgctaaatgggcatattcgctcgtattatcctcatttcacagaacaattgtagtatgtaggtattagatagttgatacattttcaaatacaccaattaatacttcattgtcaggttggccattttagaatagcgaaaacaaacaatcatacaagtctatttaatttcttcatatactaggggagcttacgtattctcggcggtctaagctgatgccatgcttcttttgtaattttcttggacaaacgcagaccagggtctacgtttcaatcttcgcgcaactcttcatttatagactctggcgcagacaaattacgtgtttgtctgtttacattcatgcgctgctcaatactctatcgattcacatctacagacttggtataaacttgtctgaaacggttatacaatgcttcgaacatctcaattcagtgtgagtactgtcgacagcctcattttcttcggtagcctttcccataagaactgcaatcaatcaatgacatccctggcgaaattgtttgttcagtcacttaaatttcgtcagtaggaagctgacagaacaaataattatctaaatggtgttgttcattggtgtgttttaatagaaaaatactgtgaatttggcgttttaattttgattgccgataatagtcgaataatatcaaagccgtaaattaccctagatacttttttgagcttttaaaaaagtatttttttaaattacggtgatgctaccatatttcgcgccattttattcatatttcttgatacagtcggactacatcattgcatgttatgtaaccattgctgaagaagaattattcaaaataccagctaacataaatttctttctcaaaacatgtttaaaatgtcagtgagcgaaattaggagcgcaatgggtactttacggtaaattatctgcaatatttttatactatttattctgccgtgaatagaaagtcagtcccattttcagcatttttgtcaaaattgagatgatataagttttaaccatatcttcctatgatctttccgctggactaacgagacaacacattttgttcggtaaaattatcggattgtcagtcgtactacagatttccgcaccgtgtagcattaatacgaactgtgttttggtcattactaattttttctcggaaagttatcgaagtgaaaagcaaattttaaaagttttattctgattcaaacatatttcaatgatctgtaatcttttaaatatgtgaatggaatacgagtttataaacttctcagaccattttcttcatgcctactttttacagatgggcctgatttgtgattcacggcagtattctgaacggttaagcaccatattctgaacggttaagaaaatccaatttggataacttaaatgattaaggatttcaacagctgggatattggtttgtcaggccgttgcgtttgtcaaatatttaaataaacgtaaagattaaaataaaacgtccatcaattatcaattatttaaaaaatcatatgttagtatgacgcatgcatattcctaatgatggacgccatatacatcaatggtccttattatgaacacacattgttccttattatggacagcaaacgaacttaacatataatatttgtagaaaaaacaacttaaccatgtattttagttttgaaatgttacaatgaatcatgtttcgaactgacagtttactattttggatgtaaaaacaatgaatgttcaacataaggaacggaccgtttagaatatggcgctgtctataatatggtactggcacggtacatgtatattttgaactacattttgtttgattacttatctaggttgattagatgatcgaaggaataacttgttttcaaaataaggaaactcaccgatgaaaagaaggcaaattaatcaatgaaatgttagtagttacacttcaatccactttttaaaagcaaaataagaaaaattatatgcccattaggcgtgtgtctaaaccgcaaaatgacacaaaccgcgaaatagtttacagcggaatggtttacccaggggggtggcatgagccaatatttaccaacccaacatctattcaacatggcatccagtgttcttgttttgattattttggaagggacaaaacatatgtttttattggtaggagacatcaatgatacctcgctgatgcgtaaaacattaaacaaaatgatgaactaatgaaaagcgtcgtcaaatacgacgattcaatgcgatatgtttaattgccggaatctagcactagcagcgtatgagccgtatactcgaaaatcaggagcaaggttagggcaaactgaccagaaagtgggtaccaaaacgcgaagtaccaaaacgatgtgaggaagagccgaaatgtatgcaggatgacagccgtgtcggtcctctgggtttaccacgaaatgtttaaattctggacaaacatttgaaaagtgcccaagaggtcttgagccttttttagaaacgttgctgttgaaccctttttagcccgcccacgcaaactaacaccactatcagaaagattggtgttagctcttcctgatagtggtattggtgagcgtgatcgagttgagttgggctcaacagcgacttgccaagccaatgtttaccaatgtcgatgtgcccttttgaaatgtctgtccagaattatgttctgatttcgttttactaatgttggcaactgctcctaaagatggcacttcacatgctttatcgtatgccccttcaacatacgttagtaatgattgcaatactcgtcactactcaaaaatgttctgcacgcagagaattaacagctatttaaaacaataaatatttttgttgcgtactatcaacttttacaatttgttgtaaattaaaaaaaatgtgttaaagcggcaattatttttgtcaaaacaaaacaaaaatattgttgaattaactgggaacaatttttattagagattttttgaaacaacaataaaaaagttatttcaaatgaaagtttcatttgttttaacttcatacatttttgatcctaattattacgcggtgaaaaaaaaaagtctgacgcgaagaaaattttcgtttgggaagtgtagattgacgattttttaaaacagttttgaaatattcgagaccataatagaagttatttttggtaagttgtatcttgctgtctagacttttcattccattcaaatatgttccattattgtagccgttcattcgtcggaagtaaatcgagctgatggcatcgacccgtcattttgtcgcgaaacggacaaaattcatgctccgatttaacgtcgggagatggcgcaggtacttactatcatttttttaatgtgcattacaattatgaaaaaaataataaaatagaactttcaaagctattattgttgtttatttcaaaacaagaaagagaaaaataaattgaatgggaatgggagcaacaaaaagtgttgttatttcaaatgaaaacattacaagatcaaaaaacagtgtcattttgttttgacaataaaacgttttattctaatgcaaaaatattgttgtttcaaaagaaaaaaatattaagatcaaaaattaattttgttgaaccgagtcgaacccagctgtcaaattcaacaataaatatttttaaaccaaattatgagtagttattaaaacaatgaaaggcaattataagccggcaaataatacagatatatagttgtaatgatacagaatatatttgacattacaattattttctctgcgtgtgtttgtgttgttcaatgggatccaatgggacagttcgataaggtatttaagcttcacactgttcactactctaattattcactctgcaccactctaattattcaactgcacagtgctttacgaaaggagcccagatagccgtagcggtaaacgcgcagctaatcagcaagaccaagctgagggtcgtgggttcgattcccaccggtcgaggatcttttcgggttggaaattttctcgacttcccagggcatagagtatcttcgtactagagatggtcgggtctcgggttttcaaacccgaaacccgacccgaacccgaacccgacgggttcgggtcgggttcgggttcgaaaatttaaaatttttcgggttcgggttcgggtcgggttcgaaggctacaaaattatcgggtacgggtcgggttcgggcttgaaaacaatcgggttgaatcgggtttgggtcgggtttggtgagaattacaaacagagtagcatcctgaaagcttccctatgcatcagaaacgttgaatttatcatctttccaagctcgggttttattcgggtttttctaacaaaaaaatttcgggtttcgggtcgggttcgggtttgaacaacgaaatattttcgggttcgggtcgggtccgggtttgcctttcgattattgtctcgggttcgggtcgggtccgggtttgaagaaataaaataagtcgggtacgggtcgggttcgggtttgaaaaattagaaacccgaccatctctacttcgtacctgccacacgatatacgcatgcaaaaatggtcattggcacagtaagctctcagttaataactgtggaagtgctcataagaacactaagctgagaagcagactctgtcccagtggggacgtaatgccagaaagaagaagtgctttacgaaggctcgagttgtcgggttcgtttttgcgcacaatcagagtgatttatttggtttgcgtttggttcgctaaacactgctttgcaaaggcccaagctatcgtgttcactttcgcatacagtcaccccacgcagttgaatcacccacaatttatgaatcagctgacttcaaaagacaaatttattatcaaacttgtcacaaaacatcacagaattatttttactgataagaactatgtgtaaaaataattctgtgatgttttgtgacaagtttaataataattttgtcttttgaaatcagctgattcataaattgtgggtgattcaactgcgtggggtcactgtaccatctggatgattttatatctctgtttttgcatgttgatgctgcagttgtgactgctcagtggaggtcagattaccaactggtgagctcgtttcatgtttgtgccaacacacaattttaacgtggcaacgttacgcaaactatggacggttcgtcactacaagtgtcggcataaacccctaatcctgttctatataattttgaaaatatacataacattcattattgaaagtgtggacgtactgacaaataactttttaaactgaagttatatgaatcgcataacttactaaggtgaattcatatcatataggctttggaacctcctactagaaagaagtttttttttttagaattccatctatacagattaaaaactcacctttgaaagcaagttgaactcgatctgatgatttattctgattgattctgatctgaaaatatatttctaaataatcattttgtggcttagcattttgatcaattatttacctttgataagatttcgaatgtatagttctaaatatcacgtatagacgctgttccgtgtacggaaggagtcatgtgatgcgtggacatattttgcaatccttttccttccatttctatcccgcgcgtgtggagacttttcttccacgccccaccttcatgcacgatcacgccacgcatggctctgtgcagaggaaggaactgtgaaaaagtacagtcttcaagaaagtgtccaacgtgttggaagcaaatttaaaactttcttgttaattagtagttaatatacagtagttaagtacaaaaaccagtgttttagatcatttcccagtaacccagtcctagtatcgaagaagtgtcctcccgaaagggccgtaaagtgtatcggctacaagacgaagcgtccagcgagggatccttaccctctagcttcggccgtcctcccggaaaagtgttacagtccactttgctcgttcccccagacggaacattggtccttcgaaccggatacgtgatccggtagtgatttagtgtgtgtgattctccttggactgagttactggtgaaaagagagacagactctaaaggtgaaattgacgaaaccggaagtgaaagtgttccaaaatgtcgctcgtgcatagccctaaaaagacctgttcgggagtgcagcacggcgacacaagtgaagaagaaagagaaaatcagaatcatttggcctgcgcaaaggaatcgctgatccggaagattggtgtcctgagccgtcagcgttccaagacagctgataaaattaagcgaatcggaggaattctgatcgacgacgatgctgacgtgtccgtaccgaagctgaaggtgtatgctagaaacgtggatgccatctacagtgagtttaacgatttccacaaccaacttgctgagatcctgccggatgatgcaatggatgaacatgatcaagcgtacaccagattcgagaaagattaccacgaagtgtcgacgtacatcgaagagatgctgatggatgcaacgaaaagggaagcacctgataccaagccccaagtaatcgttcagcagcagccgctaaaagcaccgataccaacattcgatggccgatacgagaattggccaaaattcaaggcgatgttcatagacattatggacaagtccaatgatactgatgccatcaagttgtatcacttggacaaggaatcctggatgcccgaacaatgaacgagaacaactacgctcaggcgtggaacattcttacagagcgattcgaaaattcccgtgtcatcatcaacacccacatccgcggcctgctatccttgaagaagatgacgaaggagtcctatcgtgagttgcgccagttattagacgattgttccgggcatgtcgaaagccttcgttacctgaagcaggacctcctcggcgtgtcggaactgatcgtggtgcatttacttgcatcagccttggatgcctctaccaggaagcagtgggaagctaccatcgtccgtggaacgcttccgaaatatgacgatatggtgaagttccttaagcagcagtgtaacatcctggagaattgcgaaacatcagctcaagtccctcctcttcgtgccgaaagatcgaacgtgaaagccgcagaccagtcgaagtcaagtccgagattcaatccgaaaatcctaaccgctaatagctgcggcagtgcttcaagtgaagaatgcgacttctgcggcgaatcccacaagaacttccactgtgagcagctgaaaaacatgagcgtacctgagcgagtcgagaaagcacgttccttaggcatgtgcttcaattgcttgaggaagggtcatcgactgaaggattgtccatccgacagaaagtgcttgaagtgccgccaacgtcatcatactcagcttcacgacgatacaagattcaagtcaagccagcctgaaagcaagatgcctgaaccgacagcttcatcggagtcctcaccgagaccagctgtgaaagaagtccaagcaagcacatccagtgcacccactccgcaaggttcacacagcgtgacgtcatcgtgttccatccaagcagctccaaccaagaaaaccgtcctccttttaacagcagtggtgcacgtttacgattcccaaggtaagcctcactgttgtcgagtcctgctagactgtgggtcccaagtgaacctcataacgaaaaagatggccgaagccatcggagcgaagatttcatcagcaagtgtgaagatttccggcgtcaacaatcgaacgacaaccagcatggagaaggccaccgttaagttccgatcccgttatagtgattaccgtgccacggtagaatgtgttatcaccccagcagtgactggcagaattccgagtaccaacatcgatgtgtccgattggtgtattccacccggattccaattggcggatccagacttcaatgtgcctcaagagattgacatgctgattggcaatgagctcttcttcaagattatcaagtccggtcagtaccagttggcagagcatctaccagagctgcgtgatactcatcttggttgggtattcacgggcgagctagaagaagtgttccatcaaggtccatcgtattcccacacgatcaccgtcgaaaacgtgtacgaagctctgcaacgtttttggagcgtagaagaagtagctgatcaagcagcgacgaagggcgattcgttgtgcaactccctttgaaagaaaacgcctcccagctgagtgactgcaggtcggtcgctttgaagagattccacctcctcgaacaacgcctcgttcgaaatccgtgtctccgtgagcagtacgtgcaattcatcagggagtatgaacagctcggccactgcaagcaagtaagtgaatgcaaagatcctcccaacgtccaaaagtgctacctaccgcaccacgctgtcatccgtccagatagttcctcgacgaagtgtcgagtagtgttcgatgcttctgcaaagccatcgcagaacagcctctccctcaacgatgtcctcaaggtaggtggtactgtccaatccgatattctcgatattgtcctgcgattccgcaagcacaaatatgctttcacggctgatataagcaaaatgtatcgccaaatcatggttgctgagatgcatcagccactccaacgaattttttggagagaaagtcccgaacagccgttgaaagtatatcagctaactaccgttacatatggcacagcgagtgcaccctttctcgcaactcgctgcctggttcagttggctgaagatggcaaagagaaatgtcccctgggagcgtcaactgtgagggaagacttttacgttgacgacgtgttgtctggcgacgatacgttgggtgcagcaattgaacgacagcagcacgttaaggatttgctggccagtgctggtttcccgatccataagtggtgttccaattccgagcagttgctggtatgcattccagaaagtgatcgtgaaactcccaaggtcctcgaagagcaaggtatcaacactgtcatcaaagtgcttggtattttgtgggatcctcacagcgatgattttctattctcgatcaaatctccaaatttgaattcggaatccgaagcaaataccaagcgaacgatattgtccgaaattgccaagctgtatgacccacttggattcttgtcgcccataattgttctcgccaagttattaatgcaacagttgtggcgtagcaaggtgggctgggatgagcctgtcgaggacgaaataagccaacaatggatgcagctgaagaagtcccttgaatcaacgaaccaggtgcacattccaaggcgtgtgctgattgatgatgctgaatgctatgagcttcatggttttgctgacgcttcgatgtcggcctatggagcgtatgtgttcattcgaagcgtattcaacgagtcggcgcaactacaattactctgcagcaaatccaaggtggcccctttgaaggtagtgacgattccacggctggaattgtgcgcggcactcctgcttgcgcgtttggtgaataaggttctgcagtcaatccaaatgccgtttcatcgtgtggtgctctggtcagacagtcagattgttctggcttggttgcgcaaatctcctgatcagcttcaagtgttcgtgcgcaatcgtgttactgcaatccgtgaagaaacagaagatttcgagtggatgtacgtccggtcggagtacaatccggctgatatagtgtcgcgtgggcaaatgcccatcgaattagtgaaaaatgagttgtggtggcatggaccagactttttgaaagaagtgaacattgaaaataagccaccagaagagattattgaagacattccggagctacgtgttgctccaacagtgttacctgtaattgaagaagaacagttagaagtgttttcgaagtacagctcgtacagaaagttacaacgtgtaattgcgctgttgttgcgtttcgccagcaactgcaagaagaaggattcagcttcacgtgtgaataagcctatccctaccgtggctgaacttcgtcttgcaatggacgttattgtgaaagtgatacaacgagaagagctcagcgatgagattgctcgagtcgaatcgggtgaacagtgtcgaaagcttggttcgttgggaccgatccttgtgaatggtgtgcttagagtcggaggacgtttagagcattccaagctaccatatggtgaaaagcatccgatcatcctgccgtgtaaaagtacgattgtgcgaatgctgattcgtgccctacatgaggagcatctgcatctgggaccaactggtttggttcatgtgatccgaagagaattctggttaatcaatgctactgcgactgttcgaggagtgaccagatcttgcgtaaagtgtttcaaggtcaagcccgtcgatacaagccagtatatgggaaatttgccgtcctgtcgcgtgacacctgcgccccctttttccgtcactggcgtagattacgctgggccgttccatatcaagcagggcttgcgcaaggtgaccacagttaagggatatgtagcggtttttgtctgtatggttactcgggccgtgcatctagagctggtgtcagacatgaccaccagtgccttcatcactgcgctacagagattcgtgagtcggcgtggaattgtgcatcagctgcattccgacaacggcaccaattttcgtggtgcacatcataagctgaatcaactctaccaggctttcaaacaggagcaagctacccaccaaatcgagtcgttctgcgtgtccaagggaattgaatggcaatttattccggcggatgcccccgaatttggtggtatatgggaagcggcagtcaagagcatgaagagtcatctgaagaggatcgttgggaatgcatccctgaatttcgagcagtatgtgactgtcctgacagaaattgaagcaatcctgaattcccgtccgctattcgtgacatcatcaaggtcggagagtcccgaagtgattacgcctgcccattaccttatcgggcgtcctctcaccgcaataccagagccgtcgtatgaagacatccaagccaaccggttggataagtggcagcacctgcagatgctacgagagcatttctggaaggcttggtcccgcgactacctgagcagcttcttcttctttctggcgttacgtcccaactgggacaaagcctgcttctcagattagtgttcttatgagcacttccacagttattaactgagagctttctatgccgattgaccatttttgcatatgtatatcgtgtggcaggtacgaagatactctatgccctgggaatcgagaaaatttcctcgaccagcgggattcgaacccacgaccctcagcatggtcacctgagcagcttgcagcctagaaaaaagaaccagaaactcaaagcgaatattattcctggaatgattgttctggtgcacaaccggaatttgccccctctacaatggaagctgggtgtcgtaaccaagacctttcctggagtagatggcttggtacgagccgtagacgtctacagcgacaagtcaacgtttcgccgtccgatcaacaaattgtcagtcctgccgatagaagacaacaaggcctacttcggcccatctcaagttttgaaatagacatttcaacgcggcggtgaatgttccgtgtacggaaggagtcatgtgatgcgtgaacatattttgcaatccttttccttccatttctatcccgcgcgtgtggagacttttcttccacgccccaccttcatgcacgatcacgccacgcaaggctctgtgcagaggaaggaactgtgaaaaagtacagtcttcaagaaagtgtccaacgtgttggaagcaaatttaaaactctcttgttaattagtagttaatgtacagtagttaagtacaaaaaccagtgttttagatcatttcccagtaacccagtcctagtatcgaagaagtgtcctcccgaaagagccgtaaagtgtatcggctacaagacgaagcgtccagcgagggatccttaccctctagcttcggccgtcctcccggaaaagtgttacagtccactttgctcgttcccccagacggaacagacgctacatatcccttcttttctactgccatttgaattattcactgtctacttgtctggataaattatatgtttgcagcaaatgacttccctagaaagcctttaatgtttatttgacgcttattaaatccgaatagcgcgaataatgatgactataggaatgcatttggaatgcacgtgtagcacagagagtgaaacgtatatgaaatttctgataatttaaactgtttaattttattatttactatagtaacaatggacgttacactaaaattcttttccttccacgttgaccgttgaccataaacaacctataattaatttttatacatcatatagaatataaattcatatgaatttcattatgatatgatccattttggtatactagcacatgctgatgacttttattgcgaacatttgttgattttttaaaataatttaataagcggtgaatacagcatgagcggtgaatgccgtcttcacggtagtcccgatcaatcatggagtagcagccagtgacatgtacagtcagtctaaaaaaaaaaaatatatatatatatatatatatatatatatatatatatatatatatatatatatatatatatatatatataaaagctaaaatttaaaaggtatttacaaattttcaaaatctgtctatcaatattgatatactgaaagatagatgtgagcaatcttgcacaaacctacagcgcattgtgataatttccaacaaatttccatgaatacaaaaatacctctagttttcgaaactgaagtattttgcaattgaccttaacatattcatgttatggtacaaaataatgtggtcatcccggagacgaaccagtcagccgtgggctgaaagtgtcgtaaataaagtttagaataataataacaatttccgtgtccgcccagcaaatagacaaaaaaatcaaaatgcatttcggaaataatttgctaattgtttttcttttagttccaatagaatcgtaaacatatctaggtttttcataatgaaaattgtagaactggcagcattttgaatttttatctataatctatttacgttcattcatgatgtatgacaacgtaaatataatatttgccccaaagtactggaacaaagatatatttttctaatgggaaactgaatgtctatatttaaattgctacgccaaaacgtggtagcctaatgagtgtagcataatgttgaaaagaattattccaagctgagctaaattgtcttattcgctgtgattttctttttataatatatatcgaagcatataaataattcatattctatcttcacaggtgcggtaccgttgcttcttttggtgtctcaccacccggatctcgacatggtagtcaggagtctttgaaaaaatacaatgcaataaatacgcttagctcattacatacacctacatcagttacaagggaagccgttgtagctgctcaaaaaaagaaaggcatcaaatccagtttaggacggctatttagtaaaaaggaaaaggtaattgttagctgttcatgtttatattctattccttcatttaaaaccagtagtgtcgatgtaccaaaacccgatcaactaagaacaaatattcgtataaaattgaagaaactggctttttttttaatatcgcttgagccactattgaaacacatcaagtatcagaaggcccgctccaaaggcacggtcccgaccatttgggagatttgtgccatcgccatatttgaggcctatttcatcatctacccgattggagagggaagggcagggaaagatggaaggaaataggagtggggtcccttgaaaagggaagattgcataagcgaaatgagagcatgtagctccataccacaatgggtttgaacagcgccctaaaaagggcactaaaaaacgcttgagcgtaaagagagcctatagctcattaccacagcgggttaagcgggttaagaataacagaatgtcctgaagattcagccttctgaattcagttttacttaataagtgtttaccaagtaattggaatcgtatttgcgtaaaaactggacagttacatacttactttacttttgctggcgctacgtccttcaagacatgacctgcgccacaatgttacgccaactaactcggtccatggctgctatcctccaatttctcgatcgccccacacttccaagatcctgctccacttggtcaaaccacctagctcgttgcgctccccttcgtcttgtaccggccggatttgaggtgaacaccatttttgcgggattgttgtccggcattctcacaacgtgtcccgcccatcgtacccttccagctttggcgactttctggatactgggttcaccgtagagttgcgcaagctcgtggttcattcttctcctccatacgccgttctcacatactccgccgaagatcgtcctaagcacacgtcgttcaaaaactcctagcgcttgcagatcctcttcgagcattgtccacgtctcatgcccgtagaggactaccggtcttattagcgtcttgtacatggtacacttagtacggaagtgaagtttaccagaccgcaaggtcttgtggagtccgtagtaagcacgacttccggcaatgatacgtcttcgaatttctctgctgcagttgttatccgacgttatcaatgatccgaggtagacaaattcgtccaccacctcgaactcatccccgtcgatcatcacgcgtctgccaatgcgagctctatcgcgctcggttcctccagccagcagatatttcgtcttcgacgtatttaccttcaatccaacccgatctgcttcacgtttcagcctggtatactgttcagcaaccacctggaacgttcttccgacaatgtccacgtcgtcagcgaaacaaatgaattggctggatttattgaagatcgtgccccgcatgttgaagcccgcccgtttcataacagttacatatccacggtaaaaaatcagcatgttcgattgaatagattgatcacttgactcaattcaaaacaccaatcaccatgatttgaagagttctaactttggatttgctctactgtctctagaacaagagtatgaagtgaaaagttgttgattttgaatatcatgtcttttgtgtgaaagcaatcattgacagctcgttgtacactcagaaataaaaatagtcacagaattactaaagtttatacattaatgactattttctctctgcctctctttcattctgctgtgaatttttacactaactgtcatttcgactgggttgaagcttagcgatgcttcaacccaggtgaattgacaaatagaaataaaattccctgcatgataaaagagaggcagatagaaaatagtcataaattactaaaatttagtcattttgtgacctcccgtgtttctgagtgtagatagtgattgtgatcaattcaacaccttacaacagatgcgagttggtgtcgaggtaagacactagacttgcactccgaagattggtggttcaaatctgggtgagaaggaaatatttattttaacttttttttttcaaatcaaaacatgcaacgttgaattcaagtgctgttaccttgattttgtcaagattgaacagtagtgcaaatccaagtgcagaactattgatagcatggtgcctattttttaccgtgtcagatggtacgaaattccataatcggagtcacaactatcacactcaaatgagtcagtacgctgaatattttccgtgtgatagttgagtcggcagaggcctgtcaacgctctgaccaagagactgcaattctgctttgacattgcatgtacaatatcaatcagggccaatgaagtcatgcgatactccatcgcgagctagctcatcagccaattattttccagcaatggaagaatggccaggtacccatacaaggtttacagagttgactgaattcagttcctcaatttgatttcgacatgcgataacaaccttcgaccttgagttggctgaagtaagagcttttatactgcccataaacgcatgtcaatcccatgtttgctgtatttcctatgcacatgagacaataatgcgtttatgggcagtatggcagcctgactatttgagcagaagtatattgctgtgtgcgtttgaaatgcaaatatcaaatgcgggaacaccaaatgcggtaagattttttacaagcaatgcgatgtcaaggatagatttttcctgctagggcggcggtgatttatataaccgttgctaggtgtcctttgattgttttgtgttaccgcattcgaaggacgtttagtcgagatttgcatctcaaatgcaaacagcaatatgactacccattacgcgattgcactgcacacataagagcaaatatttccgcctgataaacggtgcagtttgtaccaagtgagtaaaactgattcagccttagctcacgagaatatacaccaacaccagctctacctacaagatgggagtcatcagtgtaacatactatattgtttgatatacttctttccaaatagtccactcttcccgtaaagagaattgtgtgataaatgtcctgtaaggaaagtgacaagcaattgtgaaatcacttggagcaaggacaattttgtcccaattcactgaaattgaaaaccctgggcttggaattatattttccagggagcgatgaattttgataattgatcgctgttgttagtagttttgattagatgttgggtgaatttcaaagcaatggcaacctctttattacaaaatttagattttatcttctgacctaaagattctggttaaactactgtactatgcagttgggctgcactacgctatcactcatcaaaattactttcacttcgggaaaatataatttcaaactggcgagaagattacagactgagggtgggttaggagctgggagggaggcaccgatactacacacgaaatatgacatgattttttttcaaactgcaagaaaactccagcttgccaacgacaatcaaggcagacttgatgaaaatcgctagttttcttttgttgtgtaccttccaccttttcggacaaacattgaaaaaggaccaaagttttctatgcatttcattttcgtttttattagaaaaagtaaaatgatgcgtatttaagtactttatattcaatcagaataaaaggtgctatcgtgacattacttttgaataggcatgaatagcttatcaatcgattttttgtcacatttgatgaaatgccaaaaaatgttttcatcaattacgcactttttccatgtttgtccattgtttgagatccgggctcacagtgacagttcgtgacagcagaatctcggctcactatgacgtacagaaatttcgtatcggtttctccctcccaggttaggagcacaatcaaacccttgaatgtgcaatgtggggtagtaattgggaatgccattgacggtttgtaatcttctacgaggttttcgaaaaccaacagggcgcgtgcaccgggttgcggataggagcaaagggagatcaatagcatctacctaaaataatagagcaaaaagccgttccttgattaggtaatgtttagcgatcttctatggtgttctagtactataaaattcttcactcactggggcaatattgctcaaatctttataacaaattgtgttattattatgttttaattgattcaaatttaagaaagcttttgttattatacctgtttttgttttaatcatggcaaaatttactccaccaaatcaaagtgggtctaataaaaataaaattaaatatatttgttgttacaaattttgataaagtgtcaatatagtctatgaatggagagttgcgcaaagagtgaaacctaatatacctatcgaactgtcaaaccgtctacctatcaacagagcagcaaaacagataggagctattttcgatgacaaagaaatacaaccattcaaagtagtctcttcgcgcaactctgtatatatagactctgggtaccactcgtagaccacataagaacaaaaattcataacgaaatcagctataaggtaccgtagggcaagtgcgtaatcaacatcgtatggtagagatttttcaaatcgtcaaataaattagatcgtatatatattttagcttgactcccaccaaatataatcgatatgctaaaattaaaaggtggcccatatgaccatattgtcccgtctacatactgctacattaaaggtactcacacactttcttttgtttttctttacagtgcaaagccggtaaagattcctctatgccagatggatcggtcagcatgatgtccatgagtgggctatcactcatcagcgatgccgattcaaattatgataccattactgtgtataaaatgcctggaagaaccacctctattgattattgtagacagaaaaaaaagtaagttgtattacagctgttacgaataatttcgaagtcagtttgcagaatcacccttttttgtaacaattttctctgattgagattaaaataagtacccaaaatccagagaattttggagcaaaatttatgaattttaagtcgtttctgattgttaggcattttactacctgtcggatggctagtatgcagtattgttttataaacaattcacattttaaatcatgatcatgttccgggttcctggttcctgttctagacataaatcgaatggaattctcagtgcaattcgctgaggatttgctgaagaatctcctggacgaatacttaaacaattttatggagtagatgctgaacgaaattttatagaatgcccttgaacaatttctgataaaattccaagaaattattagaggcatatctgtatgaatcattgaaagaatctcttgaataattccatgaagagcttaaatgagaatcttgggcaagattcctgatggaatcactcgaattattttagaatgaatttttagttttattcatagaataaatacttgataaatccatggaaaaccgtgctgttcaaatgaactcaaatttctgaaacaatctagcagatattcatgggcaaattttaggagaaattattggatgaatcactggggaatttctaggaaccgtttccggaaaaagagaaattcttagaaatatccttcaattaaccctctaatacccaaccccgcctttagacggggtacactttggaattttgcgtatttttttgcagctcgaaaatcaaaatgatttttttttggcttaaaccttgactcataacacgcatataagaaaagttttttatgacttttcaaacttttttgtatttttgaaaattgtttgaaaaactgtattcttatataacctacaaatgcatatggtttatttaacgtgtaatataaaaaatcgtaccttttatattttgctacgatcaacctatcatagaaaaagagcttgatggtattaaaatattttcaaacctgtttttccgttaattacacggaaaataaaaaacaatccagaaaaaaattaaaaattttatattttcaaaagtaccgcaaaaacttgaatttttattattgctaaaaatttgtaactagaagaggattcaagaaaaaatgacaaagaatagggatgttcaaaaataaaaattataaaaatcaaaaacaaaaattcatagatttgcgaataaaaataaatcattgcccaaaacgtgtttagaacgattttagataactgaaaatgatatttagatcgaaaataaaaatttgggtattagagggttaatacaggatggccaccaaatatccattttggaattcccgcccttttcccggtataattttcaaaattttcccggtttttgattgaggggcccaaacgcaaaggggtgatattttagtcggtttttgagttgaatatattaaaaattgtactgttttcaagcattccaatggtattatggggtgatttttccatccaatagttaaaacaatattatggatccaatacaattagtatggaatgaaaatttggtgaaagaactttaaagtcgaatttctcaaaactaggttattgtcatttacacctttttgcttctaaatccctcaattaggctattaggacagtttctattcttgacacttttgattcacttcgacagggattggttttaaaagctcaaaaatatacaattcctaatttttcgtttttttctcaaacaaaaaatgaaaagttcgctaatgtaaaaaaagtttgaggtaaggctgaaacaaagccacagaagacgcagatttactgcttcaattttctcaacatagaaaagaagtctacaataacgttattcaagaaaatactttgaactgatcatccagattttttttaatgtttagttactaggtactgtcaggtctcctcctacaagatgctgccgctcaccacaatttatcagctgtcgtctaaccgattcatgtgaaactctataggtaataagttcatgttatgccacggctacagacgcaaaactagtttcatcctattgaaaattactgagaaattacagtgggaggaaagtgagtggcagcggctaataagatacctgaccatatgtgttatgtgtaacctagaaaggaaaggctgaacatttgttacgatttaatacatgggggttgagagtgtagaaaatggtaaaaaattgcgtcaattgctatggattgctagaagtgtccttaattgcaataggaagttgaaacttctgttctgtgtgagacatgggccgataatcgcagattttttatctattataagatagagaataaaatggtaatcttaaaaaaaatgcatttaacaatacaagaatatttgtaaaaagttatatccaataataaattttatagaaatatgatatctaaaaaacttttcttatcatttttagagagcatgattatcgtcacgatttgttaggcgaagccatgaaagctggaactccgtttgctctttggaatggtcccacaattgttgcatggctagaactctgggtgggtatgccagcgtggtacgttgctgcatgtagagctaatgtaaaatctggagcgataatgagcgccctaagcgatactgaaatccaacgtgaaatcggtattagcaatcctctccatcgattaaaattaaggctagccatccaagaaatggtatgtttgacgtcaccatcagcgccaccaacaacgagaacaacgttagcgtttggtacgtacagcttacatttattattcaaacttaatatctaaatcaaaaataatggcggcatgtcatttttatttaatctcttttccaggcgatatgaaccatgaatggataggaaactattggttaccagggttgggtctcccacaatatagaacaacatttatggaatgcctcgtggacgctcgaatgcttgatcacttaaacaaaaaagatctcagaggacagttaaaaatggtagatagttttcatcggacgagtttgcagttcggaatttcatgtttaaaacgcttgaattatgacaaaaacattctcgaagaaagaagaaaggcgtccgaaagttctactgacgatgtcttagtttggagcaacgacagagtcatacgttggattcattctataggtttaaaggtaaagcaaattattccacattttcatcaatatcattttactaagcatatttatattgtcttgcaggaatatggtaataatttattggaatccggtgttcatggtgcgttgatagcattagatgaaagttttgatgctaattcactggcactagcacttcaaattccaacgcaaaacacacaggtttgtacttgactaggaaatagaaatgggttatattatcacaatagtaaaatgtatcatcaccactattaagaccgtcaagaaacgaagactagaattttcttaaatatattttcctcagcgcttcgtattttgaaaatcataagaatgatatgcgctattcttaaaaccaacatgctacgattgaaagcgcaacgcgatcgcaagcggcccctagacgacatcaatacagtcaggtcttctattagacgctgccacccactttacgcccaccgcaatttctcggctactgccctagagatgctgatgaaatttggtaggtaaaatctcatactatgcctcagtgactgagggccctattttataactcgagttgattaaaaacgactcgactggagtcactgtcgaccaaaaatttcgctcgacttggctctatcactcgagtttatcgacagttgtcactctatgtgtctggattactatgggagtcgacaggtgacatctgaaatgcgcatgcttactttgatcgacaatgactacagacgagtcacgtgaattcgttcgaattacaaaatagatccatgaggctcagtcacatatgaaaaatcagcttcatcccttgagaaaattccgcgggaggaaagtgggtggcagcatctccttaaggataaaccgattttcactgaatatgacaattgtttgttattctaaatgacatagaaccgtttatataacatgctttttaccatctatgaacacaaggggtttaaacaaatcgttgaataaaatggctatttttgtattatttattaacatcaatcaattatttctcttttcaggcaagacaaacactagagacagaatataataaactactcgaatttgccacagataggcgaatagatgctgaacaacttaaatcctgacacaatgcaaatatatctagtctacaagaataacttaattagaagctaacataacttcagcaattgtcattagtcatgccacaaggcaattaagtaatcaatatcatcactgtaaatattgaataaattttaaaaatagcacactctaaacgagtcagagcaaaacctattatgctgtattataaacagataggaaaaaaaatgaaaatattaaaacataacaagcagtattcagaataaaaatgttttatttttgtccggattcctattggcgatcaaaagtgaggttgggttgcgaaagtttttcaaattgaaatgaatatttacggtttcctgtgccttaaattgcaaaagcttgtcagtcaaatgattgtggtgatttttcttccaaagttatcacgagaaattttgatagggatgcactaatccctattctagaagagcgccatctatgcatttcagctttgcattagatcaccaatgggcaaatttaatgcgccaccatctatgccagtgatcctcagccatgttttttcaaccatttttattcctgatagcggatagtttacgtaatggttttgtttgatgttgtcaataactttgggagtagaacagcttcccgaagaaaaaatatgcggaacttatcagaacttatcgaagaagctggaagaaatggtgttttcactcgggtaattaaaatgcatgagtttcatttatgaattgaaattaagccgaaaacagtgtttcagtgagaaaaatgtaggtttacgagcaagcagtagcagtttcgcatcataaggtaaaggtaagggtagttaaaatcggttagaattgg

SEQ ID NO: 128 - DNA, 11368 bp, Aedes aegypti
ttccgttccaatgacgggtcggaaaaaatctaccgactcctctggttctcaatagtttcaagttctttcgggcatgctactatggtgagccgtcatgcgctagcggtgttaaagagatataattttataataaattctttttggtaatcatacgcattgatcattggcttttataagacaatcttatggagtacaataacgtacgtaacaatttcatacgaaaatctaatgaattacggagagcgatgtcaataagcagtcggggaacattttctccaactgtcagtcgtttcaacctgatacgaggctcgcgaagccgttttattttttctgtaattgctgacgattccattccatctaaaacgaaggtaattcatcaagaattgccagaattgccgaaatggcctcaattttaactttttttttccatttgctgggtagatacgggttgaggatcaaatttcctggaatccgatacctctcatacaggtactttgattttccacagcgagttgctcaaagcagctggtgctatccgtccgatttgacgtctgtcaggcagagcggaccgcactgaaaacgaaactagcacggcgagcagcaaacgcacacgactgtcaaagaacggtgaaggtggaaaacttttctgatgcaacatcatcaaattggagttttctgctagaaaaagtgctttttggtgcaaaatcccggtgtattttcgtgcaatctagtgaaaagtatattccacaatcatgtctgaagacgatgcggtaagtttgggtcgcggaaacgatggtagtttgggattgatttgggtttttaaagtgccatgctggaactctgaaagccaggtagctgcggcaccatcaagtaccatatttctaggataagcggaattagttttcgaaataaatcaatttatgggtacaatttagaaaatttcataacattttcggttatttttgtgaaatacggtttcaattgtgttaatcctttgatttttgtgtattgtagattttcgatccttcgttgatgaagaaaaagaagaagaagaagacccccttcgatttggacggtggaatggccacggaggaaggcggagatacagaggccccggccggtgaatcggcggcggccagtgaaggtgcgtcggcggccgatgctggaaatgacctggaggataatttggatctggacacattcggtggcaagaagaaaaagaaaaagaagaagcccttcaatctggatgacatcgatagtgccctggcgggagtggacgcggaaggagagaaggaatccaagggcggagacgatggcgagggtggtggttttgggggagacgatgggctggacgatgacatgaagatcgatttcagcatgaagaagaaaaagaagaagaagaaggatctgaccgagctgatggaggcggaagatgccgccagggaggaggaaaaggagaatggtaagtttcatatgaagaggtagttttctgttctgatctgcccctatttgtatacctgtatcatgtacagtaacggacaaaagcttaatacctgggacagatatatgctttacgtactacgctccaagttaacaagaaatttattccaatgctatcttaagttaagacaattatcagtttggaactcaattcaagatacttgtatcatggtactttggggccttccttagtcgagtggttagagtccgcggttacaaagcaaagtcatgctgaaggtgtctgggttcgattcctggtcggtccaggatctcttcgtaatggaaatttccatgactttcctgggcatagagtatcatcgtacttgccacacgataatgtgcgaaaatggaaacattggcaaaaaagctttcagttaataactgtggaagtgctcataagaacattaacctaagaagcaggctctgtcccagtgaggacgtaaggccatgaagaagtagaataagagaataagaagtatggttcgaatggcactagtgtgtcataagaacgagaccacacaagattttcattttccctgaaacgcttcacttatagcatattgctatcaggattttgtgtttataataacataacaatcgtgcaaaaacatataaacattaaataccttaaaaatgcgcgatagaaacataataccactattgggaaaaatagtgttgtaacaatgatttatgaaattcaatgctatccatgatttcttgtagcatatcctttatctcctagcaatacactgcagttctcctggaaattgtgcgaattgcttaatgctaatgctaatgctagattataaatgatgcgagatttcaaggtttttttttgtgtagtagtaaagtgggattcggttttttgcaagctccatttctggcacccctgattttggcaacacatttaaataccttaaacaatgagatggtacacaaattatatcacgctaaatttcaacttttacgacttccttggaccccctaaggaagtgattctagttttttgttccaattaattattgcacagcgtaaccaagtcaaaaaccctgacttaatccaccgatggtgagactgaacccttcttacatttccatacaggtttgagataattattattcatcatttatttggaaccttgtaccagtataactaaactttagaatgttgtgactatgttctatcttccctaatagtttgttggtttgcgagaaagtcctggaaactgcacgtcaaaaggcggatagaaaactttaaggagtgtatcgaaaagtagtcgcaaactttcaaaacggtatatctcagagcatagttcatatttttaaaagcttttaacacgaatatcttcatcatgtcatcaaatattgaggcaactaaaaaaatattgaagacagccaactctcccttactcgatattaaagggaccatcgagttagggaggtatcgagttacagaacacaaatccagtgcaactgcgatccaagggaccatcgagttagccatgaaaaccaacttttactatggttctctaactcgatatcgagatacggattatcgagtaagggagagttaactgtaatatgcagtcttaatataaatacaacatggtttataaagcatagaaaataccctccccttggttatgcgaccttgcctcgatgggagggcataatccattagcccatatgatggaaaccaaaggcgtaacctgtagtggtggtatcacattttggcattttttgcttaaagccgcgtcataattcatatggcatagacacaataatatctcggatgtgatccaacggacattctgcgtcattgatagaattgatgcccatttcaaataattaatctattcgaagtggacattaatactattggtgacgttcagtttgccttttgctaaccagaatgatccgtagccactcttactattagctagctagatacatcgttatcatatacgacgtagggaatacttaggaactcttaggaaaattactagtagattcactgagtagagataagtgacgacaatcttattttaatatggtttttacattgccataaaaagaaatacctcttttgtaacagcggtataaataatctaattccagcttcattttcgcaaaatttacaagtagaaagtaggcgttgtgaagcattgcatttgccaccgaaaagtgaatcttgtaggagactgtaatagaagcctaaggaaactttactcttcaatattcactataaaaatgactatggaaagtaagacgctgagatcgatcattagggtacacttgctagtttcgaaaaattgttgaacagacaaggaaagcgacttttttctttaaggatatatgaacgtaatgaccaataaatacttttaacaacaaaaaatgaaattaactagaactactgctaaacagcctaattttgttaagacttgacgacacttgacatttaagactctaatcttacgtaaaagacaatagtaatcagaatagcacttgaatgacaaattatttaaaaccatttcgactagacagtattagtaatgcactactatttcaaacaaattctacactactatttcaaacatattctaatggagctgctgattttcataatgcttccttttctcagaagcaagggaatatgggtacttttcaaaaactaccacgtcataatactaataaaaaacagtgttcatgtgggcgccattgcctagtccgtctgagtattggtcctggtagaggagaagcttggcaaaagccagaccgagggttcagtcttgacaagttaagctgtcaggcagctccaactgaaaaccatacaaaaaaaaaaaaaaaaaacatggtttataaagcatagaaaataaaatattgcacaaaataacatttttgaggtgtcttctgaagattcgatgatttgtattgaataaaatgtatatcagacaaaataggatgaaaagctttttctatcgggaaatatgtttacttcacacagcacgtaaaacggatttcaaaaaaaataaattattgctctaagaaagcttaattattgcaataaggtcggttttagaaagtcgcttttgtgtaatcaagttttgaaactctgtcatatatagcggtaattatatagagtacaattttttacttacgttacttcataaatatgcaaagaaacttttccaatcaaaaaacaattttttattcgttgcaatcgttcgatattatcataaacgtgaatatagaaaaaatcaaaaaacgaggttcttaaaaatcgacttttttcaatttttgtatttgctctcaaatgcttgttaatgtatttttcaaaatattttttacactatgcatgagaattgtgacataaacagcataaacaaaaaccattttttcttaaaatttgacacatttattatcatattaattttttcagaggtgtgaaaaattatcatacaaaacgacaattcattgaaacaatatcaccgcatcattatttttaaatatattgtaaagcatttctgataaaaaaatgtttgtaggttcaacccaatatttttgagactgttttgaatgtttgcgactacttttcgatacactccttattacttttcatacgctttttatcatagtttaagagggtatataaacccatgtggccatcctgtaaaataatatcgaaaaatgaaaaattgatttcattgattgctcggctgggatttgaacccaggactcttgtatgctagacgagcgctttatcaactaagctaccgagccacttggtgacccaataactgatttggttaaaatatttgaatggaatgaaaagtctagaaagcaagatacaacttaccaaaactgttttaaaaacagtcactgtaccggaatcatagttcatctgtatcttttttaccgatacagatctattttcaactataatctatatttatcatctactttcactctcttctattcttttactcacacagagcaggtaggagatcaatcaatttccatatatgccataagtccattgttcttgcggtggctcattttttcgtgttcctgagtcgtttgaggctagccagccttcgaagagattctgtttgtctcagtcaccatctgatactgacggaggatggatgtgctccccaaaacagcgtcttctggtggctggacgggttttttttgtagaggggctggaaatcaaacccatgaccatacgcttatgaagcgaatgcttaatctcaaagctacggacccccctatggagccattatcaacttaccgaattttgtcgaatttgacgcttgcgcttacagctagtccgtcccactcgggcttagattgggtagcacttctagtactgcttttgttcccttggtactgcatagaaatagggttttagagcgatgcgagaaaaataatgggctcttctgttgtgttttattttcaaagataattcattctgatgaaaaaaaatattcaaggacttcaatgtaaattttatgtgaaatacaatgcactttttcaccttaattcaatcggaatgatataacaaacaaacatgaaacttttgaaacttgtatttgatggaaaacatagaaaaagtataatttatcagtaattcctctaccagcagcttcatgttttacagcaaaaaaataattgaatcgcgatgactcttatagttcttgatacttttgcaccattttttcacaagttttcttaaaactcttgtttaagaatccgtgtcgataatgatcattggtgatctggttttaaagatggcacttacgagggtgtcgctgagtctgaggcctctcattgagtaagtgctacatcaacatttccttccccaaccccaagttaaagaacattaatattgctagtatattgcttgggggaccgacattctccatataaaatggctggcagctgttttctttttggtcaattgataaaaaaaaaaaaaaaataaaatgtggactataaatgccaggttactgtgaaaaaattatacaaattggttgagtattcttggagatatcgcaaaattacgatatgatgttttttgaaatttcccatacaaaaatatctcatttattttcttacaaataggtaatcacaatgctcttgtactggttcaaatgctttaaatacacgagtaacaatactaacgagtgtgagaaataaaaaatatcaaccttttgttagcaaaaactaaattagcattgagtcaattcaatgcaagtcaattccgtacaaggacttttgagaaatttgcccttttgtatgtttcttgatatgataaaatagttcgatccaattttctgtcatctcattctgtaagagggaataccatttgaccctttgcaagttcgacggtatatccgaatacgataaaaaatctgtagcctgacaaatttacgtgggttttgattcccaaggaattttggaatatctccggatccagatagccaataattttttatcaacacagattctaaaactagaagagttttttgataacttgtgaaaaaatggtgtaaaaatattgagaaacaaaaaaagtcatcgcggtaaaaaatgaagcagctagtagaggggtcaaatatttcccatgcctttatcaaaatgtttacccgaaaaactgcagtatgttgctagaagataaacgatattcgacaagaaatcataaataagtttgtaattcatttagtttttggttggacactatttttccctagtagggtgccggtgccattagtggactaccgtaaaatggggcgaatgtttgaatgtgtacaacttaaaccgtgtggacaacaaccaattttattagccttaaatatgggtcgcgtcatactttgctaagaccccaattgctgtttaaaaataaaaattatatcgtacaaagatttatgaaaatgttgtatgtttctatacaccccgcaatggggcgaatagaatcactgttcagtaaatatcaatacttttcaacattttaatggaaaaataaacacatttttaagtgcatcttgaagaaatatcaacatgtatttacttagtgaagaaaaaaattaaaattttcaaaactaagttcaatattcgatcatttttgaaatcagtcaaaatggcggatgtttcaagctatcaaaaatgattgagatttcaatattttcttcacaattttttaatgagaaatgtagcaaaatttttaatttgaaaatagtctagcgatactctgttgttattgaactaatgaaaaaataatatttcagtaggtttttaaagtttatctatataaataaaaatggagtggtgtttgtatgtcacgaaatggcttgagaacgagctatcggattttgaaaatacttccatagttacgatcccaaagtgttccgacgtgtttgtgtatataaaaagcacagggtattgaacggaaaagtctaaaaaatccggagtgaacggaactctcattttgtacgggtcgtttcatgacgtttttcaacagcctacttgatggcaagacgaagtttgccgggaccactagtcattacataatagtcgcatttttaactgaaggtcgctttgtttctattcgccccacgttttctattcaccccgttttacggtacctaagctataaaaaatcataacaaaataacgaaaagccttaaaaagagatcttttggcgtcaacagaaagatttcaacctctactatatgggaaaaatataaaaagagtgataaaacttaagccactattggtacacgtgttccagtagttgcgctagtgctccagtagtagacgttcaggaaagatacaaagaattttgaacaaaatggtaaatttttacaaaggtttaacattttttcctcggaacagcaattaatatctttcgaatgaagcataaagatcatctctagggcttttcttcatttttatacatccattttaaaaactgcttccatccgttgatctactactggaacacgacggcaactactggtgcaagggagcaaattttttgcataaacttcattatttatatgactttttgatgaaataaaaagctgaaatttgccaaatcggctaaactagagacaatctatccaccaaaaatagcacatgtcgtttttatagaaaaatgttcgtttcatttcatagtccaacctaatggtacattacaaccattggtaccggcactctaggtcttatgtttttgtcgcacctttttagaggcacctaatgtttatatgttcctgctaaatatttttaccgttgttatgttatgcaaatctgttattcgtgaaatggaataataaaatgagattatgaacgcaatatgtcaatgacaataatgttaaaaataaagctattcagtggttatgacaaatttgagtgatcttaaccctttctttcccacagctttgttcgacaatttaactatcaaaatggcgtttctaaaaaaagtgcttgaacaaaagttgttccaaataagctatattattcaataccacaataaaaaaaaatttgattgtttttcaatagtttgacgcttaggtcacttatttcgatgtttgataagacaaataagcgtataaatttattccaactattattgagcttcttcttcttctttctggcattacgtccccactgggacagagcctgcttctcagcttagtgttcttatgagcacttccacagttattaactgagagcttactgtgcctatgaccatttttgcatgcgtatatcgtgtggcaggtacgatgatactctatgccctgggaagccgagaaaatttccaacccgaaaagatcctcgaccggtgggattcgaacccacgaccctcagcttggtcatgctgaatagctgcgcgtttaccgctacggctatctgggccccattattgagctactcgtaccaattcggtttagccctcgttcgttgaaaatcggtggatcacctgtgctaccatggggaagagtatgttaaagtattgtccgtcactgtatgtaggctattcccttagaacatgggacaattatgcgaacaggggcagtaaagtaaatcagccaaaggatgtagaacggtagttatcatgaacttttctaacattacatgccttacggataatgacggaatcgtaacggaattgggtattaacatgttttcgaactcttcgtagtaggaaattgcgtgctattctataaattctagggctggtagcagggttctgtgtaggggtggatcgaatcccatccccgagacatgatcttaaggttaatagtagtgatttccttcgagaaacggaaaaagccgttggttcctagagaactagcccaggattttatgcacgcattttccgaactacggttattattaatgttattaagattctaatcaattacctccatgatttgttttacatcagtggacgagcaatgcaccccatgggcagccacggatcgtgactacacttatgacgaactgttgcagcgtgtgtttgaaatcattctggacaaaaacccggatatggccgctggcaggaaaccgaagttcgtcatgcgtccgccgcaggttctgcgtgtcggtaccaagaagacgtccttcgccaactttacggaaatctgcaaaaccctccacagacagccgaagcatttgctggactttttactggcggaattgggtacgagtggttcggtggacggtaactcgcagctgatcatcaagggtcgcttccagccgaaacagatcgagaacgtgcttcgacggtatatcaaggagtacgtgacgtgtcacacctgccgctcgccagaaaccatcctccagaaggacacccgtctgttcttcctgcagtgcgaatcgtgcgggtcgcgatgctcggtggctagtattaagtccggtttccaggccgttaccagcaaacgtgcagcgatccgtgccaaaacggcttaagcgcgctgcttgtggtcatcaaaaaattgtgttctattgtatgcaaaaattgtttgttttgtttccttcagctattattccgtgttgcgtgggaaatttgttccagaagtggaaagttctgcggtgaaaaatactgtgtttataaatccataaaacagaatatacaaacacatagcaagcataatctattagacacaagtttgtatgtttaatcataatctttattcgagtagaatcacctttttacaaaaccttcaactgactcaataaaactgcacttatcttgtataattgtaaacatatttggttttcatttcttcgaaaatgtccttgacttttagcagaacgccttacaggaaatgcttagaaataaacctcggatttgataattctactcagaggaaggctaattcttttgttttctcactaacaacaacaaggctggtagcaattttgtatcttaaaaaagtaactttaaagacctaatgcaaaaaaaaacaacacgaaccaagtaaacaaaacgaaatcaaataagaatagtagtttccataaggatttcttaaagaatccaactaaacatttattcaaggatattttcaagcggcataattttccttcagatattattccgaaagatacgattgttgctgtttttttggatctcaaacgcgcttttgaaacgatttctcggcccttgttgttgagaacaatcaagcgctttggattttcgggttctgcatatagatggtttgagagctatttaactgatagaacccaacggactgctttcaatgattctgtttcgagccccgtggtgaacagccttggcgtaccacaggggagtgtattatttattcattatgtatataaatgacatgcgacgagttttacgtttt

SEQ ID NO: 129 - DNA, 14664 bp, Aedes aegypti
gtcaaaaaccaacatttttcgcacggatatattctagcaatattaacaactttcaaatgaagtcgtctgactttattttcatttgatatttttttttattgaaaacacaagacctcgtgaggtaactgcgcatgcagacaaaacaaaattttaaataattgtcgattttagtatgcagccttctttattgtagtagtaactatgaatatcagaatatcagaataaataacgaaattcgaaataatgcatattttagtaagttcgtcacgaaatctgtttatcgtgagcggatataggaacacttagatgctgtaacaaatgcaattaaatatgtttttatgaaagttttttttaattctttttactttgccattgattacctatactaggagctatattgtgacataaaaatagtattgatcgacgcaatagttattttataataaacatttgaacacataacatcccttaaatgagctgaaactggtgtactgacggtactagcgtactagtatatccaaacacaacccaagaataataatagcatctcaacagtgcagtgaataatgttccatattccattctcttcttcattgcagagcacgtccagctaacggcgaaaatggagttgcgctaagaaaaggtcttcctcacgtcatttattgcagactttggcgctggccggatttacaggtaagttttcagcattccattatggaggtcaccatttgcctaaccgcgagctatctaccaaaatcgccgtcaatgttcgcgtgcattagtccctatcttttttgttttagctcattagcatgatttatgggtagtgcgcccatttttcatttcgcgaaaaaatgcaattttcgccagaagcgaacagacaaggaaccaaaaaaatcatatattcatcaattatctatccgtctgtccattgtgtcctctattgtagagtcaagccgagctcaaagcgctggacatttgcgaatacgcgttccacctgaagaaggacgaagtctgcatcaacccgtatcattacacaaaggtcgactcgcagtcgcaacaaccgctgacgatcctcgtaccgaaaaacctatccacacctcagggaggcgaaagctccatcacctacaccttggacgatctaagcaataccgtaccggtcaacattcagtacaataatgcattgaagtaagtggaagccccagacgcgcacacgggtgtaactaggatcaatcatggccaaaattattatctgacttcaatgatcttattttgctttattatcaattaaaaaatggttaaagcctaattaggattatttcgagccctttcatgacacctattacctatcaatcaataagtgaatagaaaaactaacagcgtttgcttatttgttatctaaatatgcatctcattgttaggtatatctaaaaattatcgaaatctatctataattcttgaaattacgtaaactcaaagtttaagaatgcagaaaaaatgtcaaaaaaatctcgtcaggctgtattcaaggtcattagaaaaatcattgaaaatcttactatttttgggacgtcatcatatatttttttcttacggcttctcaatgtagccgaaaaattcgaaattcgttaagatcaaaaatcacactttttaaattagaattatggccacgattttgttctagttactcttttgtgcaatggcattggtcacctagtacccattaaccaacctttttcattcattttagtgacaactatgtaaccagtccacaaccagccaccccacagcaggtaccacagtcacaacagcaacagcagccacaccaaacaaccgcaccatcctacatggaggtcacactgggtcagcagataccgaccaacaccacgattatggactcggtgaacattggcgtcggcacgattcccaacaccgaaacgccaccacccgggtacatgtcggaagacggcgatcccctcgatcagaatgataatatgagtgagtctaagatattgtcggtatccgcgcactgcacctatcctatcataccttaccatttcttcataaatcatcaatcgtgttgtttgggctgttgataaggaggagtcaaacatttgtgtggatttttcgccccaaaattgtaattcctggtattgactgtggcgggcaaatgtgtgttctgggaatggcttttgcaggggaaaacatttccatctgatccatcactagggactttcgatgcgaaaacagcagtttattgcttggaaaattccattggcatataatggaaaatgtgtttcgatggtttcttcacgaagattggttgtttcggaaaaagaaacatgaataagtcagacctgtgaaagttattatgaaaaatgatagagatgtttcgttgttcccttacttttttatcaaattgcattgcatttcaaatgcattgattgacttctttcatcaattttctctcttgagtcaagaaatctattactgccattacgcccatataatattgtatgtacgtcagatttaatgtctactttctgttacagtagagaagttgttctctgtcgttttaaagaataattatttcatgttacttctgatcggttttgatgttttcttgtctattgttacctgtggatttagaaaacattcataaaaacatatactgcattcggaagctataggatatatgaagtcattgtccattcctacgcataaatatctcgttatacctaatgtcaggatttccaaaagagacactcaggggtttgctgcagtttccaagttgtaccagttctcagtgattgtggatttttgaaatacccttaataaattctaagagtttcctagggaatcccgagaatgctgaaggtgattcacggcgatcctattagatccttttagaagcacttcgtatctgcagatcaatccatcaaaactctgttagctaagcagaagacaggaaaaccatcgaaaacaatagaagattatttgggatacgctttgtgggtcatgtagagaatacaggttgcaccagagttcttacattccggcttgtcacttttcaatccttattttcaaccgttgcggacaaataaccaacacattcgagtaatcattcttaatgatttcagttataataccatcttttccagctaccttattgctgttgagctgttggatagcatccttaattttacttaacgtgaaagtaggcacatcgctcacatccgtcgtactaataaagtttggccgtatgtcatcttgtttttctgcctccgcgctattcaggtttttatcaaagtgctgcttccacctttcaatcgtctccgtcacctccatcctcatcccagaacgtttcctctcgcttcatgacgctttgagcgatgcgttgaatttcttgtgaagtttgtgcgttttctgagagtctacatttcaccctgattttgagttactagtttgtttgctacatttacattacatctaaacaaagaacactaaatccactaaaatttcattgattcgtggccgcatatctacattcttgtctgcggctatcataatgcgcaccccctagctcggtagccttctagatttcaccaccttttgactactcgtagttcatccttcgccaccacccaactttcttctgcactccactaagcatggttctaaacaccctactcttaagcactcgccgttcaaaaaccccaagaatctgcaggttcttctggagcatagtctaggtttcatatccgtagcggagtaccggtcttatgagcgggggtaacccattttgcataaagacgtttcacataaagacgattcgcataaagtagcttcatataagagcaggtagcatcttaaagaaggcatataaggtacaatgggggaagtgtatcagtggggtaagtggatcatttgtccatattaagcataaatacttgaatatgttgaatgttttcgcaccattgcttcgttttacgttatattcttacgtccacactaatactattgcaaaactggtactacacatacactaacacaagcaaacttgttagcagcaaaaatcaattagtttcaaaattgttttctaccaatcaaaaatccattgtatctcagtctaaaatcgaatactattagttttttcaacacatggtgagcatttcagttctaatttaatgaatatcgatgaaaaatatgtgatttttataaataaatacagatatattggacatggtacacttaccccttcttcttcatgaggtggggtaagtggatcaagtatttttatcatttgttggcagactacttacaagaaattaaataagtttcaatatccgcaaatgttgttttcctttaactttgtccattcctagcttaaatttgtcaaagtggccatagaaaatttgaattaatccacctaaaaggtatatcaatctttctggtataaaaaatataaaagaatgaatattgcaaaattcaaacaaaactttttgtggtatatcttttgtttaattgcaaaaaggcaaagtatacatttttttttcaactgaaagcatattaaggaaccttatttgaccatattaattgttatagacagatgtttcggatacaagttccagaagatggcgagcgtttggatgtgatccgtgttctagatttggagttcgtgacgagcctttggaagtgattcgttttccagattaatccgttctggagaagaacttttggatctgttggatgcaaaatatttaagaggtcgttcaatatcagaagcgttccattttttgatgttcatttcatgtttcaaacgactttcaagcttgaaatactttcccggacgttgtttttgagtttatttggattaagctgagtataatttttaatttctttatttctataattttacgttaagatcttttaataacactatatatgatatattactatatattgggtattggggaggggtagcctaagggagttaattgaactgttgactggatgaaagtgcgtggggttgccagccttttgtcatgagaaaacagccttaggtgtcggctagggtagacgcgtcacgcgaagcgacgcgaaaatcctttcgagtttgacaattcattattagtaattgttattccttcccatgcaattttcgcttcgcttcgcagttcgcgtctactctggccgcgcccttagtgttgtcttccaaaggtcttcaaagatattaactagccctgctacaacaaaccatcaagtagatcataccatcccggtatgattctgcagccataggtaatccttgcgctgatggtggctaaaaaatcatcatcatcatcatattaattgttatagacagatggaacaactaaattaataaatagaataaaaagatttcagtatgttaatcaaaagtaaatgtaactaatattttttaaattatgaatgtttttcaaaagcatcgttaggaataatactatggggacggacctggtgtagtggttagaacacacgcctctcacgccgaggacctgggatcgaatcccatccccgagatagtcaccaaaaatttcagtgacgacttccttcggaagggaagtaaagccgttggtcccgagataaactagcccagggctaaaaatctcgttaataaagataaaaaaaaaaaaataatcctacaatacttctgtacaacttatgagtattaaatagatgatttttctcccacttactctagttacaatatttttttttgttagaattagtgtaaactaatgtttaaatatttttcataatgttttggtaaaataaagttactttttaattttaaaggtatcaaaatgtaacataaatagcattaataacaagaacaagagtaatgtcattcatactatacataattacaccacatttgttttgagaatagatattttttattggtgatccacttacctcaccatggtggggcaagtggatcatttggcgcaaattttcaagttcctcatactcactacataacaatcaaaaaaatcaatataaatggtgatttgaagtatattagtccctcacttctcatccacagaaaaaagtttgattagcattattaacgttagctgtacataataatgaagtagactattgatttttctgtatccacttaccccacggtaccttaattctctttatgccaaaagtccattatgcggaacgtccaccaataatattatgcgaaacgtcccaagcgatatatacatattacatttgctgaagattttgattatatttttaccacagctcctcctagagcgcatagtaagcccgacttgtacaaacgatgtgccgtcgtatttcacgacttacgttatttattattgatcgtcacttcgtcagcaagggtactaggtagacgtactcatcgaccaccacgtcaggcacgtcccaggcaaatcctgtcgctctgggctccatcaactattatgcagtttattttcgacgcattcactcggccggatatgtgcattatacccgcaaaaaaaaaatcactagatctgcttaaaatcgcttcttttgaacgataggcacgaagatccatcacctcgtcgtagtcacacagatttgcacacctttctatgtcgccctgatcaatcttgttaaagtcccagaaaatctattctcatgcatatatgcataagttttggtctgctgtcgatcggcctttaacgacgtcgatttgataactttccaatttttacttcatttcatttatttagttaacatctaaacagataacaatactcaatttgtggccgcatctctccatcctcggccaaatcgatgcgcacttgatccgcccacttagctcgctgcgctccacgccttcttgtaccaaccggatccgaagcgaatactatttttgcagggttactgtccggcatacttgcaacatgccctgcccatcgtatccttccagctttggccaccttctggatactgggttcgccgtagagttgggcgcgctcgtggttcatccttcgccgccacacaccgttgtcctgcacaccgtcaaagatcgtccttagcacccaacgttcgaagactccaagtgcttgcaagtcctcctcgagaatcgtccacgttccatgcccgtagaggactactggccttatgagtgttttgtacatggtacatttggtgcgggtgtgaatctttcttgatcgcagcttcttgtgaaagccatagtaggcccgacttccacagacgacgctaacgttattgtcagccgtcagcaaggatccaaggtagacgaactcgtcgaccacctcgaacgtatccccgtctatcgtaacactgctaccttggcgaaccctgtcgcgctcgacctcatcagctagcatgtactttgtcttggtcgcatcaccatcagtccaacttttgctgcctcgcgtttaaggcgggtgtacaggtctgcaaccttttcaaatgttcggccgacaatgtccatatcatccgcgaagcaaacaaattgactggatctcgtaaaaatcgtaccccggctgttaagcccggctctccgcataacaccttctagcgcaatattgaacaacaggcacaaaagtctatcaacttgtcgtagtccccggcgggttccaaacgaactggagtgttcgcctgaaaccttcacacaattttgaacaccttccatcgtcgctcttgtcagtctcgtgagcttcccgggaaagctgttctcgacaatgattttccatagctctacgcggtcgatactatcgtatgtcgctttgaaatcgataaaaaggcgatgtgttgggacctggtattgacgtcatttttagaggatttgctgtacagtaaagatctggtccgttgtcgatcagccatcaacgaaactggttgataacttcccacgaatttgtttactgggataatactttgtaggccgcgtttagaataatgattactcgaaagttctcacaatctaactcgtcgcccttccttccactcctctggtagctgttctgtttcccagattgtgactatcagccggtgcagacaaatggccagcctttccgggcccatctttataagttcagctccggtaccatccttaccagcagctttattattcttgagctggtgaatggcatccttaacttccatcaaagtgggagctggttgatttccatcatctgcagtactagcgaaggcatttattcctagcttcattgcctatgctcccagcgccattcaggtgttcgtcgaagtgctgcttccacctttcgatcacctcacgctcgtccgtcaaaattctcccatccttatccttgcacatctcggctcgcggcacaaagccgtcgcggaatgcgtgtttcttgagaccggcacagctgttccaatggaacagtgttctatcttctcgcactccatctcctccaggcgacgtttttctcccgttgttgccgtttccgtctataacactgcggaacacgtttttgtctcaagcaccaaaattccgctattcactcagttaagggttgctgaatccattgccattttcaaaaataccatagcacgtctagtttttgagatattgactgttgagaatgcaaaaattcactattacagtcaacttgcatgcaagtttgccagcttgtaaggcaatttatttgcctaatttgccacagaattcaaactttatgtatgtaacaatacttatcggcacagtttataatactttcgttgcggaaaagttattttttgatggtttgaaaaagtattgtatttttccatataagagatactaaaaattttgtatggagatagcaaacatgttaaaaaataggtttaatctaaattaaatcgcgcaatttgaaccaaatttaatccaaaatgaaagtttaagcgcaattagcatgcttagtggattagatcacaaaaaagtttgataaattatcctttaaattttatgtaaacatcaataaaatcagtgttttatacaactttggcgacctgtagcaaaaaattgtgacgtgctggaatatttctgaaaaacggcatcagattcagcaaccccaaatctacacgagacacataatttgatccttgagacacgcaaaaatgtcaattttgttgcgctgtgtaacgtttcacattctttcgggtcccttgctgcccgcgctgcattcttctcctccagaatctgcttacattcctcgtctcctcgcctactgttctccagcagtccttaagagggattccatccagcgtatgcagttgcgatatccggttgcttaagccgctcttggtcatacaggggcggccgtcggtaccgtacgttattaacgacggagagttttgggcgcagtttaaccatcaccagatactggttaaagtcgatgttagcgtcacgattggtcatgatgtcgataatgtaggagaagtgccgtccgtctatcagaacatggtcgatttgtaattctgtttgctgtggtgctgtcgtactcgctttcgagctgcgcgtacaaagcgtttttatcatcatcagtgcttccggaatgagggctgtgtacgtttgtcatgctgacgttgaagaaccggcctttgagcctcaacttgcacattctattattgatcggccaccacccgatcacgcgcctctgcatatcacccatcactataaaagctgtttccagcccgtgtgtgttgccgcagctttggtagatggtatggttacctctaaacgttcgcatcattgatcccttccaacacacttcctgcaacggtacgatgccgaatccgcggtacttcagcacgtcggcgagtatgcgtgtgctctcgatgaagttgagaaatttacagtttcacgtaccgagctttccaatcgctagtccatttgccgattgtcgcggttcgtattctctcgttgacgttcctgtgctgatgtgtttttacggttggcttgcagggccggacaccaacccgctagatttccggaggaccattccccctaaatgttcggagggccatagtgcacagtttagcttagagtccttctctggcactcggacgatgatcagccgcccctgacatggggaacagacgctgttgtgagccgctcctaacatggagtacagacgctgaaggtttgcagaagcaaaagcaaaagcaaacccccccttccctatcagcatacaaccaaagttcccaccgggggttggttacccgatcttccctaaggttacttgtactacggccggatgacaccttttgtcagggccatagtttacatttttgcccaatgtctctcacctgcacttggacgatgatcagtcggaccagaacagacactattttgtcagaatttagaatcagatttttttgttggcatgcgtccaatgttcccatcagggttggtacccgatgttctctaaggttgctcgtgctccagacgcgccgcgatttggtaaggatagtagttattgagcagaagggtaaggaccactcaacaaggttaattttaaaccttcatgaacaaaagtacaccatgaccatcaagcctgtatgtgttcttgtagatttagtgtatgaggtcaggatcaatattaaatgggggatttaattgaatagtctcatattttcgattgctatttccttctggtgttatgtctcatattgaacagattctgttcctcgttctaattgcttttaactagattggtcttccataccttagtatggatagcaccacgcctgtcagaagcttgcgtttgctggtaattaccgcagagcagttagacatcatctttgaaagtaccgctttggaggcatattcaacgtggctagcgtagctgagcttgtcatctaccattaacccacgatgtctaagggatcgcttggactctaaggtacaatcacctaccgataacagcgcccgttactaggacttgtggttattgaccaccaccacctcagtcttgtgacgggtcagtcctagactaccattcttcaactatggagatagagtgcgctcctgtgaactctacttcctccatcgattcgccatagaccaaattgaccaaagtgtggcagatggttcatgccctacggaatcgatgtattcgctttatcaaacataaaatgtgataggtacttggctcacgtcttagatcgtgtagaagaacttactcttctgctgttgttgttcagaagatttgtttgcccattcatcgatcattatgaaactcatttcacctaatgttgcacatcggatgtaagtttacttgctacaactccaataaggagccgtaaatacccaccttatcattcaaaaataacgttgatcctttcccctgcagcggatatgtcccgcctgtctccaccaatggatgcacaaccggtgatgtatcacgagcccgccttctggtgctcaatcagctactacgagttgaacctgcgcgtcggtgaaacatttcacgcttcccagccctcgatcacggtggacgggttcacggatccctcaaactcggaacggtgagaattgatgactacctatcaggcagtgatttgaaaatttaaaacgtgcttccttcctcttctagattttgcctcgggctcctgtccaacgtgaaccgcaacgaggtggtcgagcagactcgtcgtcacattggcaagggagtacgcttgtactacattggcggggaggtgttcgcggagtgtctcagcgattctagcatttttgtacaaagccctaactgcaatcagcggtacgggtggcatccggctaccgtgtgtaaaataccacctggtgagtattgcggcattgtttcaattggttcatttagtaattgttataaatcattgtttttgcaggatgcaacttgaagattttcaacaatcaggaatttgcagctttactatcgcagtccgtctcgcagggattcgaggcggtctatcaattaactagaatgtgtacaattagaatgtcgttcgtcaaaggatggggagcagagtacaggtaagtgtccgaccaccaacggtatgtctgaaaattttattaacgaaaaaatgaccatcaattctggacccactattcgtgaggtaggtatggtatcctagcaccctttcaatgagtttgaaaatgtttcatcaaggaaaatggaaagtagtagtgatttgtagatttacgcccattttcaagggatattatcaaatatgaaaaaaatcccataggtatgctgtatcatttaccgttcaagaagaaaacatataaccattattatcactttcaacattcaaaatcaaagcatgattttgaagacattttgttgatggaatcacaagttacagcgattggtttatttaataccatatttagtttattctataatccataagattggcactgggcattcaaatgaataaaaatttcgacatcttctttgaaggtgaaacattgtgggcttcgtagccgtgtaaacacacaagtctacggtggcgctatctgtgcttttcatagcggccattttgattattctaattatcaattagtgaatgatgtaccttgcggtttttttgactttgaaatcaatattagttttttcatcgatgaaatattttcatactcaaggagagggagctaggtgtatattttgaatggttggtatagaattgatggtcaacttttttgttaataacagtgtcaagcaaaccgtccacccttttcgaaacatttctcagcgaataatatcgattcatttcaaaacctagacgacaaaccgttacctcaacaccgtgctggattgaattgcatttaaacggtccactgcagtggctcgaccgggtcctaacccagatgggttcaccacgattgccatgtagttctatgtcataagagcattcaggaaacgactcacaggaaagattttctcgcgattaaagctgcagagaaacaaagaagaaatatcaaacaaaaaaaaaacaaacaaattcgtactatattaattaaggaatgctagaatttacataagagagattttgaatgattgataccagttttgggatatttttgttttagttttcttttcgtctgaatcctaatcattgttttgctgctaaaagagaaaacaattatgtacgcttccttcctagaaaagtagcgataacttaaagttataccaagtcggaaagggacatccgttcaggtccctttcaagcaaaccacacaatctgtacaggttacaagagtgcgtatacttattgactaactatattattgataacatttttttaatatgttttgttggcagtgccctctagtgtctactttcgttcatattattttgtaagtagcgttggtattttcctaattaatcgtacttttcaaacgcgtactctgctttaagcatattatattgacaagctgatgaatcaatcaaatgtagttgcatgaatcaacaaattttgtttacaaatatattttatgatactgttaagcaaagcgaatgcaaacaagagaatcgaaattagaaatttccaaattcaaaatttattgataccattatacatacaaacaaactgtaaatctttttggcacaagacgaggcaagttctcgctaaaaacaaaaaataagcaaaacataaaatgatgcaaataaaataaaactgaagctaataaaattggtaaacgactggtgattttagaactcgtgaggcggaaacaaaatttgcacgcggagaataagcattcgaatcgattttatgccgtacgcatggaaggacaccccttccggagagaaatacaaagaaaactaacaaaaaagcaaaagaaagcgaagcgtaatattttctgagaaggtttaacgaacgttttgagatgatacgattaagaatataggaggagaaacaaaaaaaaaaaaaacaaaaaatggggaaagaagcaaaacaaaacgaagaagaaacaagtaaagcatatatgatgtttgtgatttttatccttttgtcctttatttcgttttttttaagagaaacgattgaaaaattagtaagaaaaaatctagagattagttgctttaaatacatatacaaaagtaaaatttctttggccttagctttcttatggttctaacagtccgaaaattccataaacaactagctacaatcactacctaaataaacaattagacgtgtctaactaggatactgctgttctaagcaaggaatgtttgaaaactcagtgctgtgccaaaaacatgcgtgctaattcgaaattatttgtgcgtttcctattatttgcgagtaaaatcaaagcaatgtgcaggagacaatggatcatttaaataaccaaaacggccgctatagaaagcatagatagtgtcaccgcagccttatgtgcttgtggcgcctttgttttgatgcggtgagcactgacaaaaactaccttcaatgatccattaaattaaaaaaaatgtttttgtgggaaataaagcgaagcacattctctactctgtcaatctttttcgtgccagcacaaaaattcactctaggaagacttcagctaggtatgcgttgaaggcgggcaaccttaataagtgctttacaaaaacttataggtgtggatcttaatatatttggtaaagccagaaacat

SEQ ID NO: 130 - DNA, 24258 bp, Aedes aegypti
tttattgataaattaaggcacaacagtatgtactgatcaataagtgctacgttgaggtcagtgtttgtcagctgtgtccaccacaagtcctgcacgccagccaaaccattcgccagattgacaccataacaacgaccatatcgatcgggtcgtcatccttcacaggcggaatcacctttggcatagaatcgacggcgcaaatcttaaagattcaccaatctgtcacccagtcgatagcagcagtaggaaggtaaacgatgacttcattcattccgtctccgatcgacgacagcgaccacgaccattgaacggtggttattttgagaattttccccctaggggttcccattttttcacgcacattcacgccgccattgccagtagaatgcttatgacgacccaaaacagccaagaaacgtggtgggtggatgtaatggcaagtgggaaggaggcggaaatttttcgtgtaggcgcaatctgtccgagagtacgtggcgagcgtgtgtgtgtgtgcgtgtgtacgtgtgggccgatcgtatcgtgtcgtgattttcgtgccgagaggcccccgtgatcgggccagaaattgttgcagtgaaaatagtcagcctttattcttcggattgatcagtattctttccgagatccgagagttttgtgtgattcaatcttcctttttttctgtagttgaggtgagttggaattcctgggatatcctgggtgctgatctacatggtgatctttggatcgccgtcctggttgctgtttgctgctgctgctgctgctgacgttgctgaagggcactccagtataaggagcttgtgctcgccaaagcctgctgcgattcggtgtgttgatcttggagaatttgtagtaatcaaagaaggctctgttcgccatttttcgtgaattatgaccataaatgggaatacgatcgtgactgcgacggtgtgcgaggcgtacgattgcggtgaagaacgaatacggacgaagtgaattacatcatactgttcgctgtctcgagaacgaggaatccgattccggtttcggtgacttttggtgtacagcatgaatcatcgcttttgtattgggtcatgatgggaaactttgagtgcaatggaacaaaggaacaatagtgatggaacaatttgatcgttgaaaaaatccatagtgtcacagtgaaataatgtcatgacacaaggtgaactgatggatgactttttcgcaagcgaacagtgattgctcaataacgaatcctatcatcattgtctttgatcgtgagtcaacgtgcaaatatttcgcaatcgtcagacttgagtgagaaaaaacccgcataaatcaggaacttcggcatgaggcggcgctcggacggtgaaaaagtgttgtcaaagtgaaatttctcgcactgccagtgaagaaatgatataaaatttcaaaaatagctcacccccgaaagaaaaatgtattgccatcccagcacagagtgcgaacaaagttcgtattcgtgtccgcgcaaatgtatattcaacgatgctcggacctgaacctcggctagtgacggcggcagtgttttgccagtgtataaaaataaaattttacccaagaaatgaaggcagcaggcagagttgagccatgttgtgtgcgcgccggcgcattccacgatcccgctgcggtcaaacgcaaacacacacacatacacacacagacacattacaggacagacttggaacgaacacttgtggatcaaaaagaacgatcgcccggtgcgacgcttcgagtgaagtaattttagacccgacgaattttcctcacgaacctttttggtcgtctgagaagcttacaatgtgcagggggagggggtggcgtttgagacgaatatgcgcaaagcatgcacaaataggaccagatgacacaacggacagacaaatgacgcttgacggtgcgggtgtaggtgtaggtggaccatctacaagtgtgtatgtgcgggtgtatgcgcggttgacaggtgggaacaagaggaagaaacggtgaatatgggacgaatacgcctacactggccaggtcgggcgcgcacggcacagcacacggcacccacttgttcttcggaaaaagcggggccgaatgtgtggcgcaactcgctgtggctcagctgcgaagacacaattcctctttgcgatgtaatttattaatttttttgggggaaaaagtgaaagtggagaagaataccatgagcggaggagggtttgcaagtcgttaaaatcggggcacatatgtatggagagctataaataccgaacatacaaggggggcatatgggttcagggctatcgcttccagcgaaaggaaatgagtcatcggcatgggactagagaaattcactcaatggaggatggagacgcatggtgcgtgacggtgatagaattagacctgaatgttcgaaatattgggtgactgataactgaattttcatactttttcaaaacttttgaaggaaacaaatgaccctagaggtaaatggaattgtatttcattcttctaatttataacgactgaagaaatatgcgaaagctaaatagttttgatggataaattcggagtatattgctgcaaacatcatattgaacaagttgaagattgttgaaacatagtattcaagaaatcttctgatgtataaatacagcatgaatttgttatgcaaaattgaccaaaagttgcatataagatatgatacaaatcaaagagaatttgttaaagatatcttaaagcatacctcataaaaaaaagtcataaaagaacaaaattgaaacagttcaataaagaatggagacgcatggtgcgtgacggtaattatattatacctaaccctctgaaacatttgggtgatttaaaaatgaaacggctcatttttccgtacctttgaaggtgataaataagactagaggtatatggaggtgtattgcattcttgtaattcataacactaagggaatatgcgaaatcttctattactgttttaatcgattaatttggaggaaaaaaaaactgctgcaaaagtcctataaaacaaattaaagaccaaagtattaaagatatcttcagaatgcagtatacagtaaattgaaataaaagaacaaaattaaaaccagttttcaagagcaataagggcaaaactgagacaagatgtacgcacattccatcagccagagagcagtaggcttctcctcatctttcgatttttctacattattgaatgaaatctgtttactagtcggaatgatattataaaatcttcattaatcgatgatttgtgatccgatacagttttatggaagcaaatggagaaactaaaagagtaattattaagttataacaactgatgtttttcaaacaacttttcaaagtttttgtactatgactcaatatctgaaaaatctacgatccctgcaatatcgattaaccgtggtttggctgaagtaaacactcaaaatgacgtctgtattaggagggcaaaaagccgtagcgataaacgcgcagctattcagcaagatcacgcttccaaggatagtgagttcgaatcccatcggtcgaggatcttttcggcagtgtttggattttgatcggaataagccgatcgaaatatattcagagagtgtaacagttcgtggtacggtgcaatcgaatgttgctattcactctttaatttggtacgaggcgagagagcgttcaagagcagcaactttcacagactacaacggtgtcaagccattcaagtgatttacgttttgcgtaaaattcgtaattactttcagattttctggtaactttggttgcaaatatagcacggaaaatggaaaatatttgcctctgtttcttgattagaatgagaatgtatcagcgaatgttacaagtgctgacacacagtgatcggcgccaagtagtgggtggtgtgtgtctgtcttttttcctttcgtggctcgttgccttccacgaacgataaatttcatgcgtgttgtgtgaatgcaggcggatagatggaataaaattacggctcgtgtgtcgttaaattttccaaagcctgcttttcggataggaaattttcccgactgtcttctttgctttgccacacgatacacaaatgcaaatatggtcaatgattgacaatgaaatctcttagttaataagtgtggaagtgctcataagaacactaagctgacaagcaggctctgtccccttaatgacttgttgccagagaggaaaagagaagagaataagaaaactacgtccgaatggaatgttggctcttattaatgttcgaatcctctgtgcagaatctcaatagagaaacttaaaagtagatggagtaccgtgaatcttttgattccgctccttaatgcttatttttgacatttcgacgactaccatttgcagtcttcttcagtgtcagttactcgtatccactggatacgagtaactgacactgaagaagattgtaagtggtagtcgaaatgtcaaagataagcatttagtagcagaattaaaaggtacacggtactccatctacttttaagtttctctatagaatgttggactagcattagatttttagcgaaacatttgccagtaaaaaaacgggattaagtattggccaaaattctgtgaaaaaggtgtcaagacatagaattactatagttttatttttaatcctttcaaagattctgcgcaggtgcattttgctctttacggcactgtttttctattcacgcacagaaaaggtttctacataaaaattaatatatctgttgtactggcatagctcattataggggaaaataaagtggaaaaatcctcacgattatgccctatggttaacgtaagacttactgaaaattgcagctcatttggttactctatgagctggcacatttgaatttaagttaataagacacattcagctcaaacatttaaaaacagcacatcatctaatgtttcgttcaggaaatgtgttgttcgtgtccaattgaatgtcaaatatactattcgataccaaagggggctaatgaattatgaaacataaaattagtacaattgcggtttaagggaccatccaggtagccatagaaaccaacttttactatggttcgctaattcgatatcgaaatataaaatatcgtgttggggaatgttgactgcatgcacctgcatgtacaatagactgatgcaaatttgaagtttttgcttccctatgcttaaaccatgtaaaatatgatgaaaaacattctccctatatttgaagtgatttgataaaaaatgactgtgcacaccccatttgaagtttatatggaaacaacaatgaaaaaggcattttttgtgttcagtcctctcaatctatggaaaagtgaacaaacttttctcaattgaaatcttcccactacgactttgctgaagattacattttgatagtaaggataatgtgttattgttgtgtgcgtttgaaacgcaaatatcaaatgcggaaacaccaaacgaagtcaaagcttgattttctttgctaggttggcggagatatggagcatgattgcaaattatcctttggctactttgtgttgccgcatttgaagcttagttagactagatttgcacgtcaaacgcaaacagcaatattattgataataaagtgtgaatcattctgtagatgtagaacatagtgatctattctaccctaggacaggacgtgacagctcaactgagactgccccgttgtttttcagtcgataaccttgacgatacaaaagccagtgtggccagaattctttttaagcaaatcttgtggacaaattcaaaatgcaaggctcataatttgattgtttcttgcacgccttattcatttatggcaaaaaaagatgccatttttttccggttcaaattcaaaacaggcgatatttttagggaaaattggcacaatatccattattttgctctcaattcagtattttttgttttattttagtattgtacacaggcggtctgctaatcaaagacaagtttttctgtcataaaagtaccttaccctcaacccttccgcatgagcaggcgtagatgcaggggtataaagggcgaacacgaaattattgcgacaccgaaaatgtcatgccaattttcttataatgttttgaatcaaaccaaaattttagggtagttttatacatatatttacttcaaaaatcaaaagaaaagttaatatatggagccttgagtgtaaaattgaaggtattttcgcttgatgccctacatcaaagtctttacagtgtcatgcggtaccagtttctcagtattttttttcattttcttaacatgtccttctcgtctttgactgtcttcttgctcttccgaagttcccgcttcattattgctcagtactgatccaccggacgcagctccggacagtttggtggattcatgtcctttggaacaaaatggacacaattggctccataccactccaggacacttttagaatagtggcatgatgccacatctggctaaaatagcggagcttcgacgtgctgctgcaagaacggcaaaaagcgcttctcgaggcactcagatttttagatctcgccatttactgtggggagttctgtaccttgtatgtatgtagtccaactctcttctttgcattctggacgtagctctgcgacatgccgatctttttagccaaatcacggcttgagacgttgggatttgctttaatcatccgcttcacctttccctccgtctttttgttctccggtcccggttttttttccagcttttttccgtggcccaacgtcaaccgctcctggaaccgcttcaatactctggagacggttgaatggtgaatgctcaacatttttcctaactgccggtgcgacaggtctggaagttctaggtgtttggaaagaatgtgttctctcgactcgcgttggttgacctccatttttgttgaatcgaaaaacacgacttcgagtttgacagcatgtaaacaatacacatcaatgagaaagtgcgcaaaatgtggttgattattacccaatggtagaaaagttatgccctgttgaatgtgtcgcaataatttcgtgttcgctctttatccggtctataatgagccagttccaaaagcaacatcaatttatctcccttctcctgtggaatactggagtagctcaagctttaaacttcgtattgcactgattttggctacagttgttttgaaacggtgaatgccaaaagattcaccttcaatgatttctttcggtcatctctgcattcaaaaaatacattgcgtttttcttactggctggacaccacttgctgaatagatcttggatcacctatagatggatattccctgatttgatcttgcgcaacccatggcgcaaccaggatttggttctggggggaggggtttgtgaagctggaggttatgctttttgaaaaccaaattgacttttgtgtctacgacgaaatttggaatctgaatgtcaaaaatgtgtttgatttcactgttatgattttatgaaagcttcgatagcgttctgaagtttttagtctctgtaatctttaaaacccaaatggcttcttcgtagttcatgtgctcttgacttaaagctgcgccaaatgaaatatttttaatgtttctaatcagtagggacaatggaaattcgcggcaaaattcatgaaatttcgcgtttgtccaaagctacaaattcaaaatttcgcggctttatcgcggtcccaaaattttgactatttcatacataaaaatacacattttcagtgaaaatagctttcacggaatgttttagacggggttggtggtttaatggctaccgcttctgcttaataagcagaaggtcatgggttcaatcccaggcccgtccctttcctcgtactttgtagttgtatctttcacttgctttctatcttccactctaaatctatcacactcacacactatccgttcatagcaaacgctagaaccagaaacggacaagaaaccgtttccctacgcttccactctatcgcatgattatagcatgcctttccttacgcttgctacataggcagtagtgtgggacaaaatttagatcctcactccagtccactttttggattgcatttaggtcccataataactgtgcaaaatttcagctcgatcggtgaaattatatttacgcgccagcccttgaaagtttgtatgggatttactatgggaaaacttacttttgcaaagaaaaatcgccagaggtcgcccattgacctctataaaaattctgaatgctgacctcgataggtatttctgcgatcaagaatattgtcgacgaccgcgaaacaatccgacacttgtgaaaaaagttattcaatgaaaacctatttgcaattcgacgttgattaacacgtaaaggaataacaataataacaaaatcgggcaaaatttacaaatagtatttgtttaataacttttttcacaagcatcggattgctttgcggtcttcgacaatgttgttcatcgtaaaaataccttttgagagctgtgttcagtatttttatagaggtcaatgcgcgacctctggcgatttttctttgcaaaagtatgtttttccatagtaaatcccatacaaactttgaacggctggcgcgtaaatatagtttcaccgatcaagctgaaattttgcacagttgttatgggacctaaatgcaatccaaaaagtggactggagcgagaatctaaatttttcatataaccgtgtcccaggctaataggcagtctgctaaccaaagagcaaacctctctgccatgcctttccaccaacccatacacacccgcatgaactggcgtagatgcagtggtatatacggtctaccgtgggagcaagttcaatgcatcatcaattcctcccccttccccacattgctcagcattctgacgtggcaggcgccattgttgtctaaaaatggagatcaccggcacttatacactgagggtgtctgttagtcccaagcagtcatctggttggttccttgtgtaagtgcagctgatttggcaatactggagtagcaaccccgggcggccaatcaagctcaagctacatatttagatgatatgttttatatcagagtggtactgaaaaaatcaaaacaaaaatagcaacgcagaaagacgtcctagttgaaactaaacgataaaacatttttgatggaactcttcaagatgattaaaccattttcataaacaaaaacttggaattcactgtggttatcataaaaaatcgccaaattcaactaatttctcggcattttacggggtttcataaatttcgcgggaaaggccaaatttcgcggcttccgcgaaatcgcgaatttccattgtccctgcttatcaggtaagcaggtatatacctaaatatttgacgaacttaccacacaaagccgtcagtttgtttttcagaggagcaggatttttttagctatatgatagtagcaatttacattatattatgaatatggtaacattttgtcgtaataaagggcttcagcaggattaccaaggtatttccatattattctcataggaatcttaaaggtttccgacagaactccaataggaattcaacaggattctctcagtattcttacaggattcccaaagtatacccactgaattcccatatgaatttcctaatgatgctaatgaaagtaatggggaattcttataggattctcaccaattcctgcagcatttgttcacaatttccacatttttcctaaaggtttcgcacaaagttcccagagaattctcacatgactcattttacatgactcaagaagtatttcctggggactctctcagaaatacaatttgattgccacataactctcacaggatttcctctgaacaaacaccggatcctcccagaatttctagaggatttccacaggacattcccaagaatttcgacattccagtaagactcccaaggtattgtcaaactatttcctcactattgtattgtcaaactatttcctcactatttccgcagtatttccacaacattcctcaaaatcttctctgaaatctctggtttcacactggaattccacgacccacgctacaatcccaagatccaaactggaataccaggatgcacactggaattccagcatccatacttcaatcccaacattcacactgaaattccacggtcaatactgaaatcccagaatccatactaaaatatcatgatccataatagaattcaagacccacgctaaaatccgaagattctaattggaattccacgatcaacactacaattttaggatccatactggaaaaccagggtcaatactagagatggacaaacggctgtagtaaacggatccgatccgaatcactcattttagtagagatgggcaaaatgaatcggagccgttcaaaacaaccgaataactctattgaacgagtgatccgtggctatttttttggcgagagtcggttcattcgatcagcatcggatccaataaaatgtgaccggtaaaaagaacaaactgataattgtcttctattctcttttgtccgtttctcggctttattacgcttgacgcgtgtctcgatttgcgcgtcacgccacacaagcaaccagtagcagtttgctactactccgtgctctcagcgctctcagcgcagatagacaaattttccccgcccacttgcaaaacgtaagataaaaaatgaaatcacaaagtgcatagtttagcatctctcgttacgttcgggtagtggaaatcggccgagtcgtgagtttcaggagaacaatgtacgaaaaaagaactgcaaaagatcgtacaacacaaggcacgcgaatcgcacaacacggaatgaacagatggatgcgttcactcggttcagttcactctgagagctgcagggccactgaaccgttcaaaagatccgattcgcggaagtgattgattgggatcggatctgctcacataaaattgccgatttccccatctctacattttagtgatccggatcttttgaacggttcagtggctcgcaaaggaagagcgaactgaaccgagtgaatggaaaaaaagagcgtttcaacccttttgcgcgacatgcgacgtacctttcatatctttcgctctctcattcttccccagaaactcacgatatgctcggcagatttcccctacccgaaccaaaaggaagaagcacaatgtttgcctttgtgggcactttttctctctatctttcagctgcctgttgcaagtgggggtgtcaaattttggacaatcatttaaaaagggaccaagaggtattgaaccttttttcagaaacgttgctgttgagccctttttagcccgcccacgcaagcaaaacactactatcataaagattggtgttagctcttcctgatagaggtattggtgagcgtgatcgagttgaattgggctcaacaacttcggggtcatgcacaaattacgtcacgctccaagggggggagggggtcaagccaagcgtgtcaagccttacaaaattttcgaaggactcatacaaaaaaaaacgtgacaaagggggggggaggtggtctaaaaattcgaaatttagcgtgacataattatgtaccatcccttcttgcaaagtcaatgtttaccaatgtcgatgtgcccttttgaaattctaaagccctgtcccaattttagtgccgaacgcttaagtttaggctaaaatcacatgtgaactcaatcttttaatgttttttgtttgtttaagtccaaacaacatcttgtttatgtttttttagattttgtcacactttttgggttaaactcagatttttgggtatattttgtatttcgtgtcccttccgaaatgtttctatctgacaaccccagtgctaaaactacaacccctgtgatgtttttgtcgactaagcaaacgtcgaacacaggcccatggcacgggacgatttttagcgtagtcaacatctccatgtgtttactcattttcgggtaatttgaatcgagagtacaatcagaatgtgaagttttgtttaatgtttatgatccataatcgagcaagagtcgcaatcaaatcactgattgcttgcttggaggcttgcaggatgccttttaatgtttgctctccttccaaagtcatcgaaatgttgaatgggcttcaactttttggcacattattagctgatttaacaatatcaaaaattgataatcaaatcataacaaacaattaaacaaaacaatggtctctattttcacagttcttacaactgacagtgggcgatattcacttatcgcccgggacatcctggctacaaagcacactgtgtatcgatatatggtcgaacatgaccaaaagtgacaaggttcatttatggatacaattttaatattaaagtttaaatatgatatggccgttatttacgcgagaaaaattgctaaagtagttgcagtaatatgctctttcatgttattaaataaaacaagatttcattaaacattttaggaccctattagttgttggttgtgtattagagatgggcgaaatgatcaaattttgagagcgaatcgtaggtgactcactcacaaaagtgaatcgactcttttgatcgattcggtgactcatttataaaaccaaaaataaatcatgtatttaacacaagaaacaaaaagtataacagtttttgattgagaatatttttcgtacagcagctttaactattaatacatgtccgaattgtttgactatgacaattgcaactcgaaaatatgattcctagtaaatttttaggccctcttccaaaatattaggtgcaaatgaatcattactcttttgaaaagaaccgtgattcgttcactcatttttgagagtcgactcttttgaatgattcgtgagtgagtcgcccatctctattgtgtatgctgagagtttggagctgcagcaaatggtgtttgcatgtgtgccgtggcgcgcaaagcaacgcgtggtaaacgttatgataaagccgagaaacgaacgaaatagaataaaggaaaataatcaaaatcaccgaaaagagccacggatcactcgttcttttgagtaatccggatctctctatcggctccgattctttttgcccatctctagaatcaacaaacactggaattaaaggatctagccagtaatcatcctggaattccagggtccatattgatatcccaggatccaaactgaaataccaggttttacactggaacacgagtattaacactgcaatcttagaatccacacaagaataccaggatccacatgggagtcaaaggatccacacaggaaacctgggaatcaaagtccactgatatctaaattttgtgtgtacattacaattccaggatccacttcggaatcctacgatccacgctacaatcccaggatccacactgaaatcccaagaaccatactgtaatccccacttaaacacctgggttcacattggtaatccaggatgcacacaggaattccaggcagagttaccacattaaaatctgtatattttccttgaaaaatctgtatttctatttcgttcaacgctccgtcatcgtaatcatcttcatcatcgaaacttcaaaagcagtttttctgttcaaaactaaaaaatattcgatgaaaatgtgttcactgcgtttcggttagagaatagactacagtgaccattttttcacgtatattttcttgattttgaacgaaaaaactgcttttgaaaattccgaaatcaatgacggatcctgcccccttaagcacaatgctacaaattgtcagtgtattttcatcagcagtagtagcaacagcagcagcatcagcagcagcatcagcagtagataccagctattgaacacttcaaccatttccgcttagctttcctattaaatccttgtcttttctccctctgttccccaacagacttagctcctaacaccaccaacaacaaccatggctgatgatgaggcaaagaaggccaaacaggccgaaatcgaacgcaagcgcgctgaggtgcgcaagcgtatggaggaggcctccaaggcaaagaaggccaagaagggtttcatgactccagaaagaaagaagaaactcagggtaagttacgatgagtgtggaaaatgaggacaccgtattgatttcctttctgttttaaatttccctcgaaaacagttgttgttgcgtaagaaagccgccgaagaactgaagaaagaacaggagcgtaaagcagcggaacgtaggcgcatcatcgaggagcgatgcggcaagcccaagaacatcgaagatgccaacgaaggtattgttgatcatgtcgcccattctagagcgtaggcgtactttagtcacaattcgaatccgcacacccaaaagtagtagtactattgactgttgctgattgttttccgattagcctcaccttttgagcctagtcacttagggaaaatcatgcatcattctttctatctcatcagcgtcatcatttttttaagtgtccatctctttccgccattttggtcatagtgtacactgaaaaaaaaatcatcagctcattttttatctcaccttctcatctcatgccacatggaaaaatgcacacatccaaaaaatcgcataaaaatatgttacacactttctacattacccctcgccattcccctccaccgcccaaccaccaactcagagcaaataaggaaagtcctccgcgactatcacgccagaatcaatgcactggaagaggagaagtttgaccttgaatatgtagtgaagaggaaagatttcgaggtatagcagcattactacaaacaaaccaacactctttctctgtctctcaaactttcactgtctctatcttttttggtatcactgtacaacgactctacaaaattgaactgcctgaacactaggagaaacaatctacgaccctcttaacagttctctgataaaaataagctcttctcaactgtctctgtttctgttcctacttctgtaatcctcagcttgagtttcctttcggtgaaaggaagtttttcaatctagtaaccaccgccttgctcgatctattttttgtgttttgctctcggatgaaaagcgatccatcattggaagacccctcgttcggtgactacactgaaacgaaaacctaccctggattgctaatgtttttttttttgtggaacgtccatttttttgtcgactgactatttgttttttgatgttgtgtaattgttgtcactaaacctttcgaatcgcgagagatgtcttaggaggtagatgatttcaggttcaggagaagatcgataggtgctaaccaattccccaaccatccggcttgaatcaatcaatcaatcaaccaatcgagtgaaagcgataggcttctgtagaagtagcgaacgcttgttgcttgttgaaaattgggaaccgtctaaaattgttgtcaaaatttccccctttctgtttttgtagcaagtgtgaagcacatatgcaaagaataccacaaaagaatttgtaccctggaagcggaaaagattgattatgagtatgaagtggctaggaaggacctcgaggcaagaatcgatttttgtttttgtttctactatgcgatccgttttgccttcggcacatttatatggtcttgtacgagaagagtatttaacgcctcctaaacattcacaccagtacacactgatagaaaaacaagtattcaccatataaacactgccgccgtttaaaaaccaaaactgaaaccggaatgtctgacagtagccgccgtaactgccgccgccgccgagcgcttgccgttgcgccgctgcttctcacgtgcgctaataacgaagtttctcactcttcctcctgctcctcctcttctagcctccttctctctgtctactatctgttgctgaatctctcaattgacccagcagcttcattaatcatttgtgccaggccttgctacggatttttttttgtctcttgataaacaccgaacttaaaccaaccggatttgcttcgatttttgtgtctctaaaacaccattctctcgatgatcctttcgcgaaatccggccctgaacacaacctgcaacacaaatacacgcacacacatcatactcgttgatccgggacgcaaaccccaatcaccgtttgtccgcttcaaccgagggcgcactccgaggaaaaagctaccaactttgtatcatcgttcagaacagacccagaaccaaaaacagaacttactatcacattccaaaattcatttttgatccacctgtcaacagttttttgaccgcccaaaacaaattacaaccaatttacttaccaatgattcaaaccctccgtgtatttatccactagccgagcttcaaactattgtccgcgaatattggaataggatgtttcttttggaaggtgacaagtacgatttagaaagaggggaaaaattaaaacagtttgaggtaaaattttccaaacgacttgtccaaattttcacgagtttgccaaataaaatattaaaaaccaaaaacaaacgaaacaaacgccacaaacacaaataaacacattgcgcaaccgtccatttttgtttacattgacactgttttttgtttttttgtttaccaactgccaacaatcagagcccaaacagaattcaaccctgtacaatcggcattgacacaaccacactgaaacaaatactacccctaaaaacgagcagatttttgttttgctatttttactctcgaacaaatattttatttttgattaacctctctctagaaactaagtcaagaaaagaaaacaaaaaaatacaaaatacaatcaaactacacctagatgcgaagaaaatgctaaagaaaaaataacaagagatgatcgtgtcggaatttgaaccgtccgcaaacatggccgcaatcgtcatttcgcaatcgcagactcatgactcattcaatatcagtccagctctgtcgcagaactatttgaaagtaaaccgcccccgaacaacctgcccaaatgtcatttatctgatcactcaaagtgtgcaaaccttgcaaatactttccaatcgaaacaattgatcgaaaatctcagtagaaaaatcagcaccaaccaacgcatcgaagcgtatcgttcacttttgacattcctctttgatatcctcgttctcgtctctctctctatctctctcacacacacataagctatctctctatgtcactgtcaaacaaaggcaaacttaaattgaccgtgttgcacattcgttttcccattcgcagacgtgttgagagacattgttaaagaatatttcgaccgtatgtatacatgtgaaggccaaaaatgggatttggaattcgaagtccggaaaagagattgggaggtactgccgaacatatccacataataatctgtttcttatactcatctgaagttcgttttttagtttttcgttttcattttgttcgttttcctagttttgtttttgacgtatcgaattcagaaattaatcgttccaaacattgtccaaagtttgcgtatcacttcgttaccaaacaaccagtaaatagttaattaatagacccatcacttgtttttttgtttacatttcactaaaacaaaataaaaattgacaatcactcccgcgagcgaagttttgatagcttcctttgcaaagccttttcgaatttgcaatcgatcacaacggtcggagcgatagcaggacgccatagcgatggatcaagactcgcatcgcagcaaaccttgcttcctagcctgttaatcgggatggaatcggagcctttgactgttttaaaaaatgtcttgatgcttcgctctttttgatgtcaaaatgacgaatcgcgatcgttagcgctctgaccggatcggaagtgaagccaatatcaaccaaacaccacccaccaccatcaatgagattttgaattggagttttcgtttctgactaatcgactgaccaatggttttatcgtgttccattttttcgtactgtgtgaaacacgcacaccaacaaaaattcatcaaaactagttcgcgaaatcgttgttttttgttgttcattctaataaagtaggccacgatgcgttgatagttgacagatttttgcaaaaaaagtcttacgccagtgcatcgtatggtaactttttgaatgaaatttcggtgtaaaatcgcgttttttttcgaacgatagggatttttttttcttcaaagacaagtgtcaaataaatacacataaatgcgacaattattaccctcctcaacagttgtttactaacaccgtagttgcgtaggatttttctcaaagtttttggtacatagctttaatgtgtacagtaagcatagattgccgggtactgtttcatgacttcctacttccgtagacgcacaagtgacgtgtcgaacgattcgtggaatggtacctacagtagagcagctgtaaatatttagcgctagatcattgcacttgcgaaaacggttctacagctcagccagtgcgcccaaacatgtccaaatttcaaccaacctacatcgggtcgtagacatccgcaacctaattgtcatggcctgctgtgcatctgtcaactaatcgcatgtcattttcttcgttctcactttctgcctattctttctgtccaaagtactaaccatctcttgcaattgacagccgtttgtatatcgtgtaaaacaagctcttgtatcattgtatcatacactgaagtaaaaatgaatcgtcaattctacatgacaattacacttagcacatgccatttttttctcaaagtgaccactgcgcttcctacaagcgcatgtgggcggcatcattgccgtaacaatgcaatcaactacaccattttgtgatatatatttaaacgtaaatatgactgccaaagcaaccaattgaagatatctctcataagtgacaggaaaaacggagaaaactacaacactctcaaacttcaagctgttagaatgtttccgattagaacagaaaaactaattcagcttgttatttgcccgcgcgtgtctctcccccggtagtgtaacctttgatctgtcgttaggaatcgatcgtttcaatcggtgtttagccctaatttgcctatagcttgctacttagttttgtttgttaataatgttgaccaatttgtgacagaaaaaaaaacaatcaactgaaagtctagaaacagtatggcacaaaacctgagaactgtaaccgtttttcgccgccgccgtcgccaatcatcccttcatgtaatcgacccttgttccattcatccgatccatttcagagtgaacgcagctgtcaaaacaattattcctgaccaacaagcattaggaatttgacagttactgccattttgtcgtcctagatgtcaaaacgttcccaccgtttctccaaagcataaccccccgttatctaacgttcgttttgtttattatctgttcatttccgttttcattttttgtttcgcttttctttccctctctttgtcataccgaatggaaatccgtccagtggaaacctcgaaacaaaactaaactagcccagttttgcacgtggtttttgtgatttcttttataatttcattttacagtgtactaacctcgagacccgtcacatttgaatgttgttatgtgttatttgacatgcgatcagtccgggaaaacttgttttgtgtctagctaattctttactttctgtttggatttcatttgagtaaatttagctaatatattgaacaaacgattgaaatcactttatgtgccatactgtgcagtaccttcacaagacgactatctctttctcattttgatatctgtcaaattgtacacacacttttatcgtactaagaatgaataaccgatgcattccgggagctaaatccaccaacaaattctaaatccattgaaacaaagcaaaaagtgcctttctaagctaagtaaagttgaacactctacagcctggtcaagttgtcacccatgtaactgtcaagctatcgacgaatttcagacaaacaaaaacctgattgcaatcagtcctgtgtcttgttgcgatatcatccaatctgtctcaatgttgaatattttgattctgtttcaacatcgcgcgggccgtgtatttgtcattgtactatctctgtctctttcaatgttcctgccttgttgtggtgtctctttccttcccgtgaaagtgacactactcgttcaaccaaccaaattccaaattcgtaccaaccaatcagtcaagaaatgtcaatgtagtagatgttttgtattttttcgtttttcctttcattgttttgttcaacacaaattaaaaatgaacacgtagaaaaaaacacacacaagtaaattttaccgtgtttctctaacacgccagtctagttctccggaaaggggaataacagtgtcccaccctctgtgtctgtgttttgcgattgttgttcccctttccagtggctctactgtgacatagatataatgccagctttcacgaaaaacacaactcaccacaattaacactgttactaatgtagctcttaagaatactattatcttaaccgacttcctcatggaataaaaaaaagaacctaacctaactttttagtgaagattcacttgaatgctgtgtctactagtagtagtccaataccacttgtctaacacttgtacatttccgatacctgtattttccactactcactgtataaatttcaaactagtttttcccgttaatgttttcccataaacatctatcccctcaattcaccaatcgcacatattaatttatctcgttttctatcccgtgccctcctgtctcatctggatccgaccgatagatttccgacctgaacgcccaagtcaacgaccttcgcggtaaattgtaagtacttaccctgcgcttttcgtccagtgtaccggttgctcattttttgcgtccctttccagcgtcaagcccacgctgaagaaggtctccaagtacgagaacaaattcgccaagctgcagaagaaggccgccgaattcaacttccgcaaccagctcaaggttgtcaaaaagaaggaattcaccctggaagaggaagataaggaggtaagtccacgttgtgacattagagcgcattttttccggctcaaggtgcaaatcagatttttgaagcacagcaaacaataaatcgcgagttgtttttggctcagtgtacgaacgctactgggagctcgatccatccaagtagcccactgatgcaatctttacgttttaagttttgcgcgacaaccactgagtggtctcgccaagcctgctgtgatgaaatttttgaaacagcgatggccgccgaagaaaccacgcgttctcaaacggttgatttttgacgagacgctggcaaagctgaacgatcgacgttcattaaccgccttttcgtttttcgaaaccattctctctttctcgcaggctaagaaatcggagaaggctgactggcagaagaagtagagggaattacaaaaccatttttcttttaattaccatttttgtatatttaaaattaactgcaaaaccatatgtgtctatttattagtttcgccaattattgttaatttttaacaacacaaaaacgtaacaaaaaaaggcttaaagctcatgatttgttacaaaaaccgtcgctaccagcagttatacagagagtaactaatcgaaaatttcgcaaataaaagcatcgtggtacggaacaactgcgttggtgtgattcagtagattaaaagaaaacgagttttgtatctgtccgtcagttccgaggaactgagcgtaagattcgcccaagcaaaaagtcagtcaaatgtttgttgtggaaataggtaaacaacgtcagttttagacttttgaatggattgtcatttccgtgaagaacccctttcccgagaatctttctctctgctaaagcttgaatgagtgaattgccattgcaaacgaaaacattacgaaccacagttttcaattgtatcttagtaaagcacctcacaggtagagtatggtaccatcgatgacgcacagtcaaaatctgacatgattgtagaactgcgcatttggctgcactgactactaaacacagtgttgccattttttccattccgtttcaattgtcacagctttagaagattttgactgcgcacgcatcgcttagatcgaatattagcacggcttcgagtcctacccttgaagatgatccaacttaaacccttcagcattttactcacactacaatttgctcattccttaaaaaaatcacatacatggtttatactaatgcaaatattattctttttccatttatttcctcctctcttgccgcgagcagaagaaacccgattggtccaagaagggcgacagcaaggtaacggccgaagcggtcgatgccgaggcataaggcatctcctgtgcgctaattctaaatcttcgtccttaccaccacttaaaatccataagcactctcatctttatttgtctgttttttaatctaaaaatattaaataaaaagaaggcaaacacatatgtatgtacaattgtcaaccgtagccggagcgtggagttgaacgagaaatcgaagagaaaagaaggagtcccgtccccctacccacccttatcagtgtttctgtccctaatcaactcaaaaacccccttccccaaaacaaaagcaatctccaccagaggtgtcactagatatcaaccttgggccagtctagtggtataatcgctctgtcgtcgaacaaaacctcctttaattctatatgtatttatgacgtcaaaataaacgtgtattttggaacgagtaaaaatcattctgtgaactaatcgcctcgttggtaccgtgttttgtgtctcagtgtcaatttcttcgaaacccacattcaaactcgaccctattctgttttaaggaggaggaagctgccgcctaagccttgactcgcctttggaaaaccgcttccctcccgcatcgatcttaagtaagtgttcgacgaatcgccgcacgtcaatcagtcgatttgtttcagtgtcattcttaccccacatcgactaaactcgcttccaactgttgcaggagggctgagcgcctaacaaaataccactcgaaagcattcaccataccttttttataataaaaatccccgctgatcgatttggactcatcgcacaacacctgccgccatctaccggagggaggaggatccggacggccgacccaccctgcatgacaaccctggaatgtttcttttgatacatacaaatggccaacgcaaaccactcgataataaatagtttcgttataatttaatggctttacacactgtggagatgtacacaattagggaaataaataagaactaagaataccgattttaatttatacaatacatggtagtgacatctgttgaagtcaatcgaaggaaacacactctcatagtaggctaaggtatgcaaaggcaagcgtctcctgttgattttctctctctgtaatgttccgattttgttgagctttctagtgtatttcagtaaagcttttttaaataatctgaaggaaaatccagtagttttctttaagtgttactttgacttgaataaaatagttttcctagcaaatgtccaggagcatctttaaggacgggcaagaggtaatccagatatgtatgaaagcagtacttcgatgagcacttgaatggtgcagagaacattgacagatgctcttgcaagcgaaggtgacaacgtctacacagcgtacagtggaaaccagttcgtattataggggaagttgaggatgtctttcagcatcttcaaacaacaaggttgccaagaatgctaccggtcccgaactcatcaagatgagttcggagacgattagccgcttgcctgcattggttagcatccagaatctaggagacggaatctaaaaagttcaaactggcgttaaaactgtcgggcaaagacgtgcgctaaacgctgcctcaaagaaagttaccagcgggttttatcgatgccggtcgccaattggccagatctttttcgcgtgacaaaccctccgccaatgtcgtgattattcccgagcaaagtcgaataacaaccgcataacatagtgataacaagatatacatgatgaattcattttgttgtcacattttgatttgt

SEQ ID NO: 131 - DNA, 2633 bp, Aedes aegypti
agtaattttagtttaactagctgagctacaatttgtccacacgtttgcttcgtttgttttctgctttttatcatgttgtttctactcaccggttgacagacggtgaacgttacctgtcatcgttgtgaacgctgctggtgtgtgtacggcccagggttgatgtatggaaggtgcgcgctggctgccaggggcttgccaacacgtatgaaagttacttacgtcgatttaaaaaagtaatcgagaagtgaattcagcaccgctcaaacgtcaaattagtgaactcatgcattggtccattgatggagaacgccatggaccaatgcacgagttcactgatttgacgtttaagcggtgccgaattcactcgttgccatggccacgtaaataatacggcaccgctcaaacgtcaaatagtgaactcatgcatcggtccattcgaaacacggctgttacgaacggtcgtgtttgattaggaaatcaacctacaataatgtgtgcaagaaaaagtgtaaccacgaccgaagtcagtgatgttctcgtctcgagcgaaatgctttttcgacttctgggacttgatccctctctcaaaaacatttccaggcgaaaaattgacagatcattaaatcgttccgtcagtcgtcggtcttttaggtgacgctacttttgagtgatttggaaaaacttgcaaatttattcagttttcttcattaaactagttaaactcagagcaaaatcgaataactacatcaacaggatgtctctgaaaacatacggcgacaggccggtcagcttccagctggaggaaggcggtgaatatttttgcatcggctccgaggtaagtgcttttgttttggcgttacgcccccatcacttaataacatgttttctaatggattccaggtgggaaactatctccgtttgttccgagggttgctatataagaagtatccggggatgatgcgtaaaaccctttcaccggaagaacgcaaaacactgctcgagattggcatcagcaaccagttcttggccagttcggtgtcgctgctgagggcatcggaagtgcaggacattttggatggtaatgacgagaagtacaaagcggtttcggtgaccaccacggaaccgcctgctccacgcgagagcaaatccagcaagaagcaacccccgtgggttccgaccatgcccaattctagccatctggatgcggttccgcaagcgacgcccatcaataggaaccgggtccacaacaagaagattcgcaccttcccgatgtgctttgacgatacggatcctacgttgaacattgagaatgctgcccaggctgaggttttggttcctattcgcttggatatggaaatcgaagggcaaaagttgcgcgatacgttcacttggaaccgtaacgaatccatgatcactccggagcagttcgcggaggttctatgcgatgatttagatttgaatccaacgccgtttgtgcccgcaattgcagccgccatcagacagcagattgaggcttacccgagtgagccgatagtcctggaagagggatccgaccagcgagtgctggtcaagttgaatatccacgtcgggaacacctcattggtggaccaggttgagtgggacatggcccagaaggacaataatccggaagacttcgccattaaactgtgtgccgagctgggactgggcggggaatttgtcacggcaatctcctactccataagagggcaactttcatggcatcagcgcacctatgcctttagcgaggcccctctggccacggtcgaggtaccattcagaactccgagcgatgccgaccagtgggcaccattcctagagacgctgaccgacgccgagatggagaagaagattcgcgaccaggacagaaatacacgacgaatgcgccgattggccaatacttatacgtagacgtagggatctgaatctgggaggcttcgatgtcttgaagaactttagatttaagctagcattttaaggtaagtgtcgtcaaaatatagtgtccacaaaggaaattgttactcatttaatgccgaatacgattcttggaaaacttgtcagttatttctgcttcttctaatcattggcttcttcttggtattacgtcatcactgggacagagcctgcttctcagcttagtgtttaatgagcacttccatagttattatctggaagctttctttgcaaaagttgccattttcgcattcgtagatatatcgtgtggcaggcagtgttgaaccaaaatgaacacaccgataagtggctcgcggagctttcccactcgtaggattcatttagtaacgcgctgttcattctcgtgattcattgcaaggttgcttcttctcgtaaagtcaagcaaacactctgctggttgcatggtgtactgagtacatgcagaccaacaaaaacacgcttgaagtgcacagcacgagcgtggctgggtgctgctggatatggcttggagagcgaccgctattgagctaattgcgcaagaattttctggtaatgtttaggtacaattgaaacataaaatcgatggcatgtaaacgaatcgcaaaatgtactgattttgacacttattattagtgagatgtaaaagtatagcatcaaactat

SEQ ID NO: 132 - DNA, 43672 bp, Aedes aegypti
  misc_feature (23568)..(24199): n is a, c, g, or t
tctaaaacgcgtatatgctatttttattttcttgcaggaaattgtggccagccaccaggagcttcggtgcccagaatgtcgagtgttggtggaaatcaaaatcgacgaactgccgccaaatgtgctgttgatgcggatcttagaaggtaagctaccagtcgggtttaatccgtatcacaagatcttccgtttatccggtgaaccacaccggggttcatattaacacagccacggtgtgtctgaaaccgtcattggtgaaaaaaatcctataaattctgcacttaccattcgaaagatatggatcctagcgtcctctatctatcgtgaataacgatttcagccacaccgtgcagctgaacgcatcatatcatgcggttcagtacccttcttatcgccagacgatagtggtttatctttcccgtattatctttatttctccaaacaggtatgaaaacagctgagctgaacaatcaaaacacaaacataaacaaagcggcccggaccggcgtcggaggtggcagcgggaacatcttcaacctacaattgcagcagcaaaatcacccaagcatagcgtaccatcatcaaggttcttcgaatcatcaacatcagcagcaacagcagcagaagaacaataaaaacgatcaactgcatcaccattcgcatcaaggtcgcatcatcgcaggaaatgcgctagatttatcgaaaatcccacacgcgaaggcattctacgacttcgcctccagtgaaaccaggtaactacgtaatggaatgcacattgtaaaaggggtccgaagcgtgtgcaggtttccgcagacctactaagaggcgagaggcttttgtgtagggtgctgtcgtaaaacagtcaattagatttttttttctagaaaagcgacgtttttggttacatttcttacagtgtttctggcttacattggctcaggcagtgttatagaatcttaatttgaatgtcgctgggttcactaaattacctacatggaggttttcctcataaacgtgaggtgcttccattagcgccacttgagcgcataagtctgcaaagattgatcatttattaaaattgttaaattaaaaaaagatgccaatgcttaaaaagcacagaatacactgttcaagatgtattcttctttgtgggatttttccacatcttatactggcaactatggcggtatgattctgcagccataggtaatccttgcgctgatggtggctaaataatcatcatcatcatcatcatcttatactggcaactatttcagaatgagatttctgcaaatatcttctcaggggtttctgaccaattgcaccagaattttctctaagaatgtgtttttaaattaatgttccatggtgttctgtcttgaataattctagtaatttatcaagaaactgttccaagaatccggatagatattcctccaaggttttttaacttgcatcattgtatttacttcttttccttccaaaaaatatttagagattcacttatttttccagtttttttagcaccatagtggtttttaaactcttccaaaagtccttgagaaaaacatctccaagaatactctcagagcctcataaaggaaatccttcaagagtttttgaaggaaatccttaagtaatatctgaaagaactcttgggagaaaaactttaaaacttttgcaaaaactacagcaacgatctccaaaagatctcctgaatcctcgaagaagccttactatatttttctgaaaatttgctggaaggttgaaaatcactaaaagtatatttcgataacatcgtgctgaaatttctggagaaatactaattattaattattggagaaatcacttgggggggcactgggaagattgttgataaaatccttgtaacatttactgataaaaacctaaatcaaatttctttgatgattttacagtaaacagaagtaaatatgtacactaaagtttttttatacggtttttttgcacgttttatttttacacggctttttttacacgcctttcggaattcacacggtactttttttgcacggaattcggaattatcacggttttttttacttatttacacggatttcggaattaacacgttttttttttcttatttacacggattccagaattaacacggtttatttttacacagattccggaattagcacggttttttttgcatagatttttttttgcacggcacggggaaccgtgtaaaaaaagaccttagtgtattcgagaaaactctaattgctgtatatgtaaccaatgaacaaaattatggacaaaatcctggagagcaaagagttaggctctctggtgcaatttttggatgaatccttaaaaggtgtactagaggaaaaattagaattatttttgaatttctcggcgataaaatttggtaagatttctattcataaattcttggaggaatccttagaaaaaaatatgggaggaatacaagagcgtaagcaaatttttctaaggaggaagaggctttggtttgcttggcccctctgcttgttttacgcaaatgttttatcaaagacaaattaaagacctcgatgtcccttgcagttgcccaaaattttatagctcataaggtaatctagaatgccgtgaaaagtgtactgcgatctgtcaaacttgggtaccttttatactaccgagggaccaaatgcagtactagaagtggtacacaatctgagcccgagtgtgacggacctggttttatggtttgaagattcccaataatcgaaatgctagatactcaggatcaacttttgttcttcattgtacactactgttgaatggtacaaggccttcaaacagttacctaaagtttctccaggatacattccaacaacgttacttttagcactaactccagaattacttcagacatctcccagagagtttgtcgaagtatttttgtgaggtaattaaacataatttcccatggaattcttgtacatatttttccagaaattgttttggcgcttgtgaaatttcctggagttcttccaaataattaataataaaacctggtattcccatagacttgtttaaaggatacttgctgaagttttttcaaggggtaaagatatctatcaacaaattcaattgctgctttggaaattggttcgttgaacataaatgtcagatcggtcagtcacagaaatcgaccgtcttcgatttggcttgaatttcactatgttctcggtatggtagaataagtggtttccacaggtaatcgatcattattgctcaataaaatggtctacgagtttttgcatgtgattcaattgaaaaattctagcactgaatctgatgatgaaggaattgtagtaaatcttttgggctaaaaaaatgctcctgaaaaaatatattttttaatcatggaaaattaaaaaaaaaaattaaattttgaattaggtcaaaacccgtttttttttattttcatcatagaatcttgatggaaaacagatattcatgaattaattaactcattacgatggataaattatgagtgtcattatgaaaaaaaatccacgtgctcaggtgggattcgaaccaacgattcttgtatgccagacgagtgctttacctactaagctaccgagccacttggtgacccaataactcggaaggttataattttcgagttcaaagcccaacagttcacgcaggcctttctcattaccaatatctatccatctcatatttaccgtcgttgagggtgagaatgggtcaaaaaagggtatgtacgatttatttatcgaataactatcgcaatttaactccaataaacttcaaatttggtttgtatgttctttgatgacacattaacaactgttcaaaaaattaaagaaatatattttttcacagcggcaccacaacgtttttccccagatatgggactagatttttctaataaattccgtgcaagaactcatcagccattttcaaaagttattgttgattcataaagatcgatttatctatggaaaacacgggagcaagccatttggcataaagtcatttgtcatatggtcatttggtataacgtcatttggcataattatcaattggcatatcagtcatttggcacaatgagtatttggcataatcagaattatagccgttctttcaaaagatggctgtttttgatgaaaaaatgtacattatgccaaatgtccttaatgcctaatggacttataccaaatgacctcatgccaaatggctctatgtcgaaatacccagacctggaaaatacttattctacctcaccgaaaacatgtgtaatttgttattcttaatcgacgattatcgggcgaattttaataattcaactcattctgaatggaattcgtcagtagtaaaattttaaggaatcactgaataagctcctcgcataagagttattgtaatctactattaaactagttgctgaaagaatccctgtaaaacattagaacaacttttttaaatgttcaattaccttggaaccagaccccctggactccttatccttacattaaccataaaaagacactcattaaggtgaagatgaatcaaagccaaagctcaaattttcaagagcacaaatctgaagaactaaacatccgtttaaactgaaaacttaatcgattggtcactagctggtggtgaccaatcgattaaattttcagctcaaatgggtgttcggttctccagatttgtgctcttgaaaatatgaagtttggcttcgattcatcttcaccttaacgttacagtgcactgtgttttattttctcgatttcatgcgctttttgaatagcgcccaaaccgtttaacatttttcatgtcttctacaaagttgttaaacatcttaaaactcgtgtttttgctgaatgtcgcacctctctatctcttaaagtaaaagaattatcagtcttatttggtttaattaggcttatttgtttgaaagtaaaaacccatgcaaagacgcttatagacaaaaaaatttatcaactgccgaaaggggagatatggtaccttcaaaatttgtaagagttgtctgcgccattttgcgccgaagccagttatagaggcctaaactaccccttgaaaaaaaaaaattataattcaccaataactttgttacttcaaaaaataccgtaatgacaacggcatacatctcaaaaagtataagagatagaaaaatcgtgtcttcgacaaatttgtttcaaattgccaattctaaattctacaactttgccgaagacaccatatgtctatcaaaattagagttttcaatcccgggaacatttcccgggaaatgagatttctcgggattcccgtttcccggaaaatgatttcctgtttcccgggattcccttatttcccggaatttctgtatttcccgggtagttctattaaaaaaaggattgaccgttcattttcaaaccaaatctatcgtataatttacttttcatatcattctaaccaatgacctcactagatcacaagttatactttgatattgatttgttgtttttttttgtaatcaaatagttgttgataaaatggatagttctttgacgatatgtttttttttttctaaatagattatatgctatacaaaatacaggatttttcgagggatcctccatgaattgagtacgctcataaagttttcatggatttaaccgtcacattttctatcgttagactctagttggtttttattctagtgcttgaaaggtttgatttaatgttggtacaggtcggactcgattatccgttgtatcgatttcccgggaaatggcaaatttatttcccgtttcccgggaaatcaaatcccgggaaatttgaaaactctaatcaaaatgttttgaaaaaatagtttttctagctcactgctaggtggattgatcacaaaaccttttgcatcaaaagatgcgctttaatacaccaagaaacttcttcgaacaaactatcaacggtttgggcgctattcaaaaaggacatgaaatagagaaaataaaacacagtgcagtgtttgtatttattcttagctgaaaagttaaaatgtttttcatttttgataaaagctagaattataacacaaatttccaagtaaatttgaatacctattaaagcaccttgctttgaaaactgatccacatattaacatctatgtaactttgcaatggtaatctcaattgatgtattcacatcatcacaaattaaagaaatgagcgagatcgatttaagctcaattaatttattaagttgttaaggtttaagtccacttcatgctagaggaactgcccgaacaacatttataaatgttttataatatttcatgttaccggtacaatgtaataaccatatttcttctttcgttcaaatatagtgacatcagctttaaaaagggcgacatcgtcatcctgaagaagaaaatcgaccacaactggtgcgtcggggaagtcaacggaaaagaaggtgctgttccgttgaaccacttgcaagtgatagtgccgctaccttatcctcagtgtaaagcgctgtacgatttcagcatgggaccgaacgacgaggaaggctgtctgacgttcaaaaaaggagctctcatccacgtgcttcggcgggtggaccaaaactgggccgaaggtcggatagcagataaaataggaattttccccatttctttcgttgagatgaacagtctggcgaagcatatgatggattcggcgttgaaacagtaagttgttatctcttcaaagatcatactctatctttcaacatcaatttttattacagtattttggccagcgcttcaaacaatcgaactgtccctccgacaccttttgacctcaatgccagtgatacgaccagttcgagtgtaaccaccagtcccaatacttccaacagcacaaccagttctaattccagtacagcaccaagtagtcctacgtctaatttcttaactacatcaaccgctgcttctacgacggtagcagggagtaattccagcagtaaagaacatcataaggagaaacgtcactctctaacgacctttgtagctagttctagtgcgggtattgctaatgtcggaggacctctgaatcatcctaatcggtaagaatgaactctatcgttattccaaactgttagtctaattcaagctccattttcagccactccgctgaaattttgagcacacctgatgcggatcgacaacaacagccatcatctcatccgccgagtacggtgccgattgcgtcctccgatctgccacaacagtcgagccgacctgatatgcttaactatcagaagtcgaatgctgcaaaggccgctagtcaacactaccaacatcagctgccccaactacccgctacctacatcgctctctacccgtacaaaccccagaaaccggacgaactagagctgaaaaaaggatgtaagtaactgtttgctaattaagatctaccattcatgtccacgagtttctataaaaaatgtctttatgacacaagtctttccataatctataaaacgctttgatgttaataatgcgacgttggggattcattaaagtattgtgcgctcggtaaactattagactattagactatttttacctgaaaacttgtctagaacactaggggatgtacccaatgtggccctctacggaacgtggctgaatctttcaatatgtctttctttgatcttgtcatggataatcaatcattaactttgagacgtttcaaagtaggtttcgtagcgtttatacatgtgaccattttcatcgaaaaatcagattaccatttcaatgacattcaaagatttcgttttcaattaaatgatcagtaatcccagaaatatttttctttgattatgctttgattattatgctcgatattatgaagatttacgtgggctggtgttttttttacctttatttagttaacgtctaaacagataacactgaatcaacaatttcacgctacaatactcgattcgtggcagcatctttctattgtcggttctgccccacgctcgcctaagcgctgtgcacttgattcgcccacctagctcacctccggcattcttgcaacatgccttgcctactgtacgcttgcagctttggacatcttctggatactgggttcgccgtggttcatcattcgacgcctcaaatcgttttcctgcacaccaccaaagatcgtcctaagcaccaggcgtttggagactccaagtgcttgcaggtccttctcgagcattgtccacgtttcatgcccgtagaggactaccggtctcatgagcgttttgtatatagttcatttgaatcttttttgccagcaaacaaattgactggatctcgtgaaaatcgtactctctgcataacatcttctagcgcgatattgaacaacaggcacgaaagtccatcgtcttgtagtagtccccggtgggatacaaacaaattggaatgttcggcaaaatccttcgcataattttgcacacccttcatcgttgctcttttttctaagacgccgacacgttaatgcttccagtggacgatttatcctttgaaggaagcaccacactagacaacgcactagcatgctacgcccagtggcacagtcgaaatactttcatgacgaaaagtttttcggactgaagcgggaatcgaaaccacactgacacgatgcaaataaatggtaacactaaccgcccggccacgaagcccacagtttcagtcttgagagcttcccgagaaagctgttctcgtccaagatttttcatagctcttcttggtcgatactatcggatgccgccttaaaatcgatgaaaaggtgatgcattggaacctggtattcacgacctttttggagaatttgctgtacgtttaagatctggtccgttgtcgatccgtcgtcagcgaagccggcttgataacttcctacgaactcgtttactacaggtgacagacgatggaagatgatctgggataacactctttaggccgcgtttaggatggtggtcgctcggaagttctcacaatctaacttgtcgtctttcttgtacatagggcatattaccctttctatcagacgctacagacaaatttttcgggcccatctttatgtttggttggtttcaatcgactgacaccgttggcttcattgcctgcgctctcactaccattcagatgttcgtcaaagtgccgctcccacctttcgatcacctcacttcgtccgtcaagatgctctcattcttattcatgcacatctcggctcgtggaacgaagccgttgcagcattcgttgagcttttgataaaacttccgtgtttcttgagaccggctcagctgttccatctccacgcactccatctcctccaggcggcgttttttctcccgaaagaggcgggtctgctgttgccgcttccgtctattacatcccacgttctgccggatcccttgctgcagcatgaccgcctgcgccgcaatcttctcctccatgatctgcctacattgctcgtcgaactaatcgtctccgtcccacatacccgacgttgctcacagcttcatagttgatggctgctttcgctgttctccagcagtcctcaagaggggcttcaaccaattcatcctcttccggtaatgcagcctcgaggtgctgcgcgtatgcagttgcgacatccggttgcctaagtcgctcgaggtcataccgtggcggccgtcggtaccgtacgttgttgatgacggagagttttaatgatttgacgtcgtcgcttgggccgctagttgtactcgctttcgagcggcgcgaaaaaacatcttcatcatcatcagtgcttccgaagtgaggactgtgcacgtttattatgctgaagttgaataataagccttcaacttgcacattctcgcattgatcggccaccatccgatcacgggcctctgcatatcacccatcactataaaagctgttcccagctcgaatgtgttgccgcagctctggtagatggtatggttacctctaaatgttcgcactattgatctattccaacacacttcctgcaacgctacaaggaaaaaaaatcgttgccggattcatgaacaaaaagtcatgaattcataaaattgactaaaagtcatgaaatcgtgactattatgcaataattcgtatgctcaggacgttacacaaatccaactgtcactttctgcaccttagtaaacgtgtctcatagcgatcggtgatattttctagtgaaattataaaaatagttttgtttttgaaaaagtttaaattcttcggaaccttgtcatcataccgataacattcttggcgaaattcccgtgagttcctacattgtttcacgatacaatttatctaccgaagcccttggatgttccataatgcacatacttcatcctgattatgaagaaccgggcaatgtttggcttcgagcgaagattttgctcgacaagctcgtcggcgattttaactgttcggaagtgatgcattccccacgtcctataacagagcagctcacaaaaggccttcggcagccggatgttccagttccacatccgcagagtcgttaaggagtgttccatctctcatgcaatccaccagcccagggaccatttgccaattcatttgatgctcgaaacaacattttgcgcaccaacctaaccaccgaatgtttgcgttactgctaaagatgttacactcgttaggttgacatttgtgaaatgttttcacggttcattacgaaactaccggcacaaaagcagtaacttaaatctaaatattatttgtttaccaatggcaaatataaagtgggatcttaattgacgtataatgtttcgttttcatgaaatgagttcatgattcagggatcctgcttcatgatttcatgactcaacttgctatttttcagcaccaaaattggaatcataaatgacaggcatctgaatacatgaaaagtgcttatgttttcatgacctgtgttcatgatatcagatcctgcttcatgatttaatgaccgaaattgccacttttcgtagcaaaaataagaatcataaatggacagatgactaaatccatgaataatgattacgtttccatgaattttattcatagttccagcatacatgcttcgtatttggtgattacaaccagtctggtttggcttggaatgtgcaaagcaacaacattccatcgattgacgtcaaccgctctgtcatatcagcctcgtgcagctctcttttggacggcttctctctgcatggtcttgtgcagctcaatacgattttcaacagaaactcccgattgctcgactttttgctagtaaacgaagttgccctccccgactgtacaatatgcgaagcgcccgagccgttgattgggcttgatgcagatcatcccgcactagaaacgcaaatcaatatgtctttacccattcagtatgacaacttcgacgatccactggcctttgacttcaacagagctgactttgtttcaatgtcacaagcacttgctttaatcgactggcaatacctcgaaacttgcctctgtgtcaatgaagctgttgactattttactaataatctgaaccatataatatcagcaaatgtgcctctgcgaagaccaagtgcgaaaccaatttggggcaacgcacgccttcgatacttgaagcgtttaaggtccaaagcactacggaagtaccttgaaaacaaaaacccgttaaccaagcaatcttttgtttttgcaagcaatgaataccgcagctacaatcgtttcttgtacaacggctacactaatcgcatgcaggataaacttcgcaggaacccaaaatcgttttggtcatttgtgaaaactaaaaagaaagaggatggtctccctagcgaaatttatttcggcgacaaattcgctgcatcagtggttgataaaagcaatcttctagcagaacgtttcaaaaacgtgttcaacgactctactgccgctgaatcacaaatagatacggcgctcagtgatataccaagggatgcgttcaatctcagcatgttttctgtcactccggatatggttgaatcagcgattcgtaagctaaagcattcaaacgaaagtggcccagatggtatcccaccaagcatcttgaaaaaatgctctaccgaacttattctgcctttgacgaagctgttcaacgcctctttgctccaaagattgtttccagagcggtggaagtattcttacatgtttccggtattcaagaaaggagataagaagaatgcggaaaactatcgaggcatcacatcactctgcgcctgttccaaggtttttgagataattgtcaacgatgtcctactctcctgttgtaaaaactacattttagctgaccaacatggtttctacccccgaagatcgatctcaactaacctcgctcccttcgtatcactgtgtctgcagaatatggaagcaggagtacaagtggacgttatttacaccgacctcaaagcagcgtttgatcgcgtcgaccactccatactacttgctaaattaggcaaacttggcgtatcgtcggatttggttcactggttccagtcatacctaacgcaccggaagctctgtgtaaagctaggttcagcaaattcgggctactttacgaacacctcgggagttccccaaggcagcaacctagggccgctgttgttctccatctttctcaacgacattggattcgctcttcctactggatgcagaattctgtttgctgacgacatcaaaattgttgtagttgttcgctgcgagaacgattgtctggtgctacaacatctaatcaacgttttttgcgaatggtgcgataggaacttcgtcaccataagtgttcagaaatgcaacgtgatcagttttcaccgcaagcaaaagccaattatattcaactataccattgatgatctgccactacatcgtgtagatactattcgagacctaggtatcacgctagattcagctctaacttttaagctccattatctggacactatcgccaaagctaataggcagctcggatttatattcaaaattgcggatgaattccgtgacccaacctgtctcaaagcgttgtactgttcccttgtgcgttccatcatagagtttggatccgtcatctggtgcccataccaaagggtttggataatgcgactggagactgtacaaagaaaatttgtgcgctatgcccttcggcatctgccgtggagagaccccacaagtctgccaccatatgaacatcggtgtcaactgttgggtattgacacacttgagagcagaaggtctacagctcaatcagtgtttgtagctaaagttttggttggcgaaattgattcaccggaaattcttgccaatctgttagtatatgcaccagaacggccactccgtacaagaagtttcctacatctccctgctcggacagttatttacggattacatgaccctattcgatacatggcagcacgcttcaacgagcactatcatctcttcgatttcggcttggcaacttctacatttcgacaacggattgaacgagtgttacgcgaggaagaacgggaagatatttgatatttgtttgacgcatttttaaaatgttagaattaagttattcgttgtatatgtcttcaatatgcgtttcaaatagttgattatattttttttttactttaattgttcattaagacacatagtcagatgaattgacaaatatacaaatacaaatacaaatgaaatgaggattttaattgacatttttcttcgctaaaaattgaaaatgtaacgtacagccagcgatacggtaaaatgcttcatgatttcatgacttttggtcatggtgtattttcatgacatgaaaacacaccttcctcccgaaatcatgactatttttcctgttttgttctcctgaggcctttcaaattttgaagacactccgtcgctatcagccctgagtatgtcaatctaaccaaacatgaagagaacagctcatggccaaacgtgcaacttcattgaatgtaccattgtaccgacactatctcatccgcatcatgagatatattaattcgaaatttgtaatactcgctagggtaaccaatataatttggaccaccatatattttggaccatctggggcattttccaataaatttccaagtttaaatcaaaagacgaacacacttagcatgttatttggatagattggactgttttacatttgtatcaacagtttgtgcaagaaaaatgtccgaaattgattcaatttcaatcggttcatccatgcaactgttacgacacgttacacacagaaattgaagccgtcagatttttttcgaatgtgtacaaaaactttttttaaatgtctgggcttaatgcaaaaattacttcggctttccattattaatcgatcaattggactatgcgcaattttattaaggtgaaacatctcggaatccagagatggccgtcccaatggccgacttgtgaccctactcgcgttttcataggtgctatactggagaaccaaactggagaactgcattttcttccagcttgtttttaaataccttgggcgattttcaaactttggccttcattatagcgcaaaatctttccaccggacgaatttctgctgaatttgaggggttggcggtttttggtacaaaaataacgttattgtctctgtaccaatccaacgtcgatcgcgcgtaatggtatgatgccagatccggcctaaataatgtctcgcctccgtgagaccgcaggaagggcaacagacgcttctggaggcactcggtgtggtaaatttcactgttgatggtacccgttgtaatgtacggtttactcagtttaccgcattggcatatagcctgccagagcaagtatttattggcgaatttgttcatttttttcttccatacaaggaagacataaattccagaacatcaaactgtgatttggcaacgtagaactccagtccctgtatctgctttgcgtctgccttgatataggtttcgtcatccataaccacacatttcggtttcgttaaccactctcgatacagcttcctcgcgcgagatttggcagccgtgttttgttcatcacgccgccggttcggtgtcttccggaccttgaatacacgaagcccagcttgtttcatggtttgctgaacgaaccaggcggatcacttggccgccagagccgcgtcgcgaatcgtaaggttcggattgcttgaaataattcaacaccttccgggccttcacagggtcagctgtcttcgattttcttccacttccagcccgccactcggtcgtctgggactccttagaagattttaccatccgagagacagttgtatgggtgattcccagttatcttccgatccgacatgctcgcagtcggattttccatgacagcgcgcaaaattctccggcgcttttcttcttgtatcgatgccatctcaataatcactgaaccgattttgcagatgtaaacaatacactccactctagttatacccagattttcatcaatttttacccaaggacaaaaaagttacacacggataaaaatggcgcattttttcgagtacaggccttagtaggcaaacgttcctgatctaccgaaaagctaaacattacatataatttgcaattggattagatggacaaattgatgtgaagatttgcgaaaaagttacacgtcttctcagtgagaatcgaactcacgactccccgatctctagttggggcgcgttaccactacgccatgagaggactcatgaacgcagaagttaatctgaattcgatttcagctcaataatcacgtggtcctttttcgcaaagtgcacctctttcggaagaattagatggccatccaaacacaacgctttctatatatatccaatgcctatcccgagagcgcattgtttttaggtataggaatagcacactacactagccagcaactgcgctggctgaggtatctattgtgtgggcttccgatgggttgcgacgttctcaaacgaccggttacggaacatgagtccgttgctcgataaatacatgtttttaattatgaatcgtggtttacggctaaccagccgagtggaagtttaacaactaccgaaaagctaaacattacatataatttgcaattggattagatggacaaattgatgtgaagatttgcgaaaaagttacacgtcttctcagtgagaatcgatcctaatccaattgccattgccatcgaatccatctaatacaattgcaaattatatgtaatgtttagcttttcggtagttgttaaacttccactcggctggttagccgtaaaccacgattcataattaaaaacatgtatttatcgagcaacggactcatgttccgtaaccggtcgtttgagaacgtcgcgacccattggaagcccacacaatagataactcagccagcgcagttgctggctagtgtagtgtgctattcctatacctaaaaaacaatgcgctctcgggcttggcattggatatatatagaaagcgttgtgtttggatgggcatctaattcttccgaaaaaggtgcactttgcgaaaaaggaccacgtgattattgagctgaaatcgaattcaggttaacttctgcgttcatgagtcctctcatggcgtagtggtaacgcgccccaactagagatcggggagtcgtgagttcgattctcactgagaagacgggtaactttttcgcaaatcttcacatcaatttgtccatctaatccaattgcaaattatatgtaatgtttagcttttcggtagatgttaaacttccactcggctggttagccgtaaaccacgattcataattaaaaacatgtgttcctgatcttcttatttcaaagtttctgattagttctgtgcttagtgcacaaagccaaaacaaaaagtgcactgttgttggatgctgccttcgcgagattagtgccttttaagttatagtataatcttagaagctagatttcaaactgattcaccttaaccctttaattaaccgcctttagacgtgttatttttcttagctcggtaaccaaaatgattttatttttggattatattttgaaccttaacacgcatatttggaaagttttatacaacttttgaaagttttttgtatttttaaaacatgtttgaaaatatattttattttataacctgcaaatggctgggtttaatttaacatgtaaaacaaaaatttgtaaattttatatttttccataacttatcagctatcaaaaggctgcttgggcacgtcaggagttaatcatcaatattaacctccttttcccgagcagcctagatagccgcgtagtgtcggtagcggttgtttcaactggctaagaattaacactacggactgcctgttccggtggtaaaagtccacctcacaggtgacccctaatttatggtgtgatgcgtaccgtgcctaagaatgaatggttaggggggtctaaataaaacctaaccgctaacggagcctgtggggtaccagggcgccctccacagtattgagtccttcctgtgctacccggagcaatggtgcaggtgaccttgtgtttctccgagataatcggctgcccttcttcagtctctatcctgaggcttaataagggtgggattatgaatatgttgacatttaatttaaattatcacctatatggattcgcattatgcgttttacacagtgtattctgtgctctttcgcctttggtgactttaaatagataccgatctggttttttcgttgctggtctttttcgtgctgagattgcaaaaagcttaatcctgcctagtttgggtagtggctacggttaggttagctcagatcaatcttcagcataaaagaacagcaaggatcaatctttgcagactcatgcaaaatggtgcagcccaagtggcgctagttcaagaaccctactttcgtagagggaacttctatctaggtaaccttgtggacccagtttttgctacttttagcaagcttgaaatggcaaactcgcgctccatgccccgcgcatgcgtgctcgttaataaagcaatcgttgctacactcatttctgagttaactaccagagatgtatgtgctgtcacaatcgatgtttctgttggtgacctcaacaggaagtacgtctattgttcggtatatttaccacatgatgaaccatccccaacggatgacttcaaacgagttgtcgtacactgcgtaacaaaaggccttccgctgattgtgggcagtgatgccaatgctcatcacatcatctggggcagctcggatatcaatttgagaggctccagtctgatggaatacttaagtagtacagaccttggattacttaacataggcaatcgcccaaccttcatggtttctaatagagaagatgtgttagacataacgctctgctcgaatagaatcagtcacgagttgacgaattggcatgtatcagatgaggaatcattatctgatcatcgctacatcttctttgaacattcaaatgtaactgcgcagactttgcgttttaggaatccccggtcaacaaactgggaactctacattgaattggttgcgaccaaatttcatggatattctccgtccattgaaaatccaagtgatctggatgatgccgttgatactacaacatcctacattatggaagcttttgaagaagcatgtcctctgcggtctgtaaagactacaagagggaccccatggtggaattccgatctgactagactcaggaaacaatgtagaaggagttggaacagacgccgttcagctggatcagagtcgttcaagtcagctcgcaaggcttacaagaaggctcttcgttctgctgaacgatccggctggaaaaacctttgtacaaatgtttccagtttgagtgaagtcagtcggttgaacaaaattcttgcaaaatctaaggatttccaagtgaacgaaattcgcttacctaatggtgactttacttcttccgatgaagaagttttagaatgtttattcaatacacacttccccggatgtgtggacatagcatctacggatgaaccaaatgtcttttcatgtagttacgagtctctggcctcggctcgcagtatcgtaactactgaatcgattcaatgggcacttaatagttttgcccctttcaaatctccaggagcggatgggatttatcctgttctgctccaaaagggatttgagtctatcaaatatgttttgaaaaagctacttgtaagcagttttgctaccgggtacattcccaaatcctggcgtgatattactgtaaagtttatcccaaaaggaggacgtgcgtcgtatgaggaagcgaagagttttagaccaatcagtctgacctcttttcttctgaaatgtctggaacgcattatcgatcatcacatccgtgatgtttatttggcaaacatgcctcttcatgtgaatcaacatgcttaccaatctggaaagtccactgtgactcttttacacaaagttgtatacgatatcgagaaagcattcgctcagaagcaatcgtgcttgggtgttttcttggatattgagggtgcctttgataacgtgtctttcgatgccatattggaagccgcacgaaaccatgggctacctacaatgattaccaattggatttatcaaatgctcaaaaaccgacatctcttctcgacattgcgtcaagcagcgattcgaaaattgagtgtttgcggatgcccccaagggggagtcttgtcaccacttttgtggaatctcgtagcagatacgctattgaggcaactcaataattgcggttttccaacttatggatttgccgacgactatctagctctgatagttggtatgtgcataagcaccctattcgacctgatgcaaagtgctcttcaggtagtcgagagttggtgtcgccaatatggcctttcggttaacccgaataaaacatctattgttctttttacggaaagacgaaatcgcgatggaattcgacctttacgtctttttggcactgcgattaatgtgactgatcaagtaaagtatgtcgtagtcattctagattccaaacttttatggacagctcacattgatttcagagtcaaaaaagcttgtatggccttcggtcaatgccggcgaacctttggtaaaacttggggcctcaaacccaaatatatcaaatggatttacacaacagttgttcgaccaatattggcatatggatgtcttgtgtggtggcaaaagggcgaagtgagaacaatccaatcaaaattgggccatctccaaaggatgtgcttgatggcgatgtctggtgcgttctctacaactcccacagcagcgctcgaggcccttttcgacgttgcgccactacacatatatcttaaacaagaagcactttcttgctcttaccgtttatgggtactggatctactggagaaaaatccagtgaatcgtagatctacacacacttcgttgtttccacttttggtgaattgggacaaaattgtccttgctccaagtgatctcacaattgcttgtaactttccttacaggacatttaccacacaattcccttcacgggaagagtggacgtctggctatttggaaagaagtatatcaaacaatatagtatgttacactgatggctcccttcttgaaggtagagctggtgcaggagtatattctcgtgagctaaggctgaatcagttttactcacttggtagaaactgcaccgtttttcaggcggaaatatttgctcttatgtgtggagtgcaatcagcacttcaacagcgcgtaatgggtaaagtcatatacttctgttcagatagtcaggctgctataaaagctctcgcttcggccaactcaaggtcgaagcttgttatcgcatgtcgaactcaaattgaggaactgaattcagtcaactctgtaaaccttgtatgggtacctggccattcttccatcgctggaaatgaattggctgatgagctagctcgcgatggagcatcgcatgacttcattggccctgagccggctattccaatttcgaagtgctgggtgaagcttcagataaactcttgggcggcaactcagcacaagcaatattggaatagtttggagtcgtgtcgtcaaacaaaattgtgtattactgagccatctccaaaggtggcgaagtatttaacaaatctgtcaaagcagaattgcagtctcttggtcagagcgttgacaggccactgccgactcaactatcacatggcaaatattcagcgtgctgactcatttgtgtgtgatagttgtgactccgattatggaacttcgtatcacctgatatgtaactgtccagtttttgcgcaaatgcgattccaattacttggtaaacacttattaagtgaaactgaatacagaagcctgaatcttcaggacattctgctattcttaacccgctgtggtattgagctatatgctctctttgcgctcatgcgtattgcagtgtcctttttagggcgctgttcgaacccattgtggtatggagctacatgctctcatttcgcttatgcgatcttccctcttcaagggaccccactcctatttcctcccatctttcccttccctttcctctcccatcgggtagatgatgaaataggctcaaatatggcgttagcgttagcgttagcgttagcgtagttacggtatacttcgtagattggatactagcaacattcatgtttctttttaataatctcatcctgactactttcaagaacaaggcaggggagtataccttgttcaaatcataaacaagaatactaaaagcatgaatatcgctattcccggccacgcccatctttaccgtaacttgggataggggaaggaaatgttgatgtagcacttacttaatgagaggccaccgactcagcgacaccctcataagtgctacggagttggaggttggggaaggtatattgtcaggattcgcctagaaagctggcgatagaccataaatatttgttgtttaagcgttttcaagttaatcttttgaatgccggcaatcaaaagagaaaacaatagcttatttatagtataaatagtatttcgcgaaatgcagttgtgcagtaatatttttgctcaataaccagtaaaaagcaaaaccgatccctccagggtcatcggattgtataaataacgatacgcgtaaaaaaaaaaatcacgcctattgaaaaactgtactgggtggtactgtatttttagataatcgaaaaacgaaaggaagcgcgttcgaactaaacaccctaggataacacagtcggtttttctgctcaaaattatacgaaaagcagaatcgatacctccagggtcatcgaacggttaaaaagcatccacaaccgattgttagttgcgtaacacccgcccggacagaatgcgcaatctgaacataattatcaaactccgaaaataacattttccgttcaagaaacgatcagaagttccacgacgcggacaaaaacgatccggaaggctcacaaaagaaaaagtatcatactggaacaaactcaccggattgattctctaaatttatgtgctgcctgtcacttccggatggttcggtgaacttagggcagccaaaaaccaacagtactgaggacacaaatcaaacaaatcactttttaatttttcacttttcactattccatttctgaatgtaaaaactgtcctgcttgggcttcacgaagcactactaggctcaaatatggcgatggcacaaatctcccaactggtggggaacgtgcctttggagccggccttctgataccttctgatacctggctgggtttaatttaacatgtaaaacaaaaatttgtaaattttatatttttccataacttatcagctatcacagaagaagagcctggtggaattggaaattccaaagtgtatcccgtctaaaggcggggttgggtattagagggctaatttaattttcaaaagtactgcaaagacacttatttttattattagcaaaaatcggtattcataagaggattcaaaaatgacaaagccgaaattcataaatttgtcataagaggattcaaattaaaaaccgaaattcataaatttgtgaataaaaataaatcattctcctaaacgtgtctagatcgatttcagatagcaaaaaatgatacttagatctaaaatataaattttaagtattagagggttaagcactccaataattactttgaaaacttttccacaaactatccagagctttcaggactagtttgattgaatttattgcaaattactggaagagttcctaatagatttcttggaataacccatctaaaggaatttacagagcaattcctgagctctagaacgaatttgtatatacatagctggaaaaaaaactaaaaaaacctacattagaattccttgaagaattctgttaggatttttttgcaagaatggaacctatggaagttctcctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaaacttgaaatttgaaattttgaaaattttcatgccctaacgttaaaatgaaaaatgtgaatttttggcgtttctactaagagttttgaaaaatctcgttatcaaacagaattcacatgattttgactacataaactaggtttttcaaaatgctttgtgacaaaaactacttcattacaacagttttatcttattttgcagacaaaagaataatgagtgaaaattgtttgaatattctgtaggaatttgtatgtgtgcacggtgactggtgacttaacggtatactgtttgtttacaatttcgataaaatttgtaaatttcaaaaaaaaaaaaaatgttcaataacattttgtttagaccatttttcctattaaaaactttgtcgtgaacgggaaagcttaaagaaatccataacgacaatactgaagaaatttctgtaaaaatgctgattgaattcttgaagatatgttaaatgataatcttggctaaaatcgatggaataatcatcagctgaaatcctggagacttagaactttcgtaggaaatttaaaaaaatatctttagagtatttccgataagttttggtgttcctttcaatagttatgatttttgaaagcttggaaatagcccaaaaacacataattgatttgaagcgcacctaaatttactccaagttaactgaaactttgaccagaagttcatttcgacatgtaaaatcaaagtatcggttgactaaaaagttttcagacatttttgaaaatatgaataggtctaatttccagtggtgcctgcagaacagctcaattattataaccgaatatttttaattcatacaaaaatcaataattcattactgagtcgtccgatttgaaaacggtcttcagcaaagttatagcttattagtgtatctaacagtatcagcatagcctaacccagagaaggacatgggcaaccactatggctgattgaatgaattgcttgcttttcccatagtaattccattacaaactttgaagggcttgtgcagtctcagttttcatccaaataagctcaaatttggggagaacactcaaaatttgatctagaatagaatgagcggtgtgcagcaaaagcgatttttttaaccaccctagtagatataggtgtaactattttcacctgagtttaaggaacactcagatgtgtccaatgtaaccaaaatctatttgaaaactcttcttctcttataccgtaaggacgccattcaccgctcatttaacagcatttcaacacattaaattctgtcaaaaatcggtttttcgatatttttcgcaactttttgcgccagacgcaagttaaaacatttgtttttgtaggaaagaagttgaaaggtgaacaacatataatggtgccgaataaaatatatgccaatgatacatgtgtagggcgccattcaccgctcatcctaagtatgaggctctatataatcaactagttggaattaatttactttctttaactggttgttatctttgtactatagtacaagaacatattaaagcgtggcagcttagaagcatttttcgatctgccataataaaatcattgctcaactcatgtttaccgccttaaacagcctaaaattattttctataaaaagtatataatattaaatcatatgaatttcattctgatacaacccattctggtatactaatacatgctaatgacttttattgcgaaaatttgttcagatttttcaaaataattcaatgagcggtgaatagagcatgagcggtgaatggcgtccttacggtattgtcctgagaaatcaccccggaatatgaccattatggtcaaaattccccaaaatgaccttctttcacattattctaaaaaatcatgaagttcgaagtgttgtaaggtaggttgcagagaggatatgaatgtgacctattctatcggaaatcctggttttcgggacatgaccgttgtagatcgttcagcctgtcctgaaaatcataaagtttgttaatcggaatatatactgaatgctttgagacgtttgcaatagcctgggacacggttatattaaaaatttagattctcgctccagttcactttttggattgcatttaggtcccataacaactgtgcaaaatttcagctcgattggagaaactatattttagcgccagccgttcaaagtttgtatgggatttactatgggaaaacttacttttgctaataaaaatcgccagaggtcgcccgctgttttgattttgtattggattgtgacttttactggccttgttgtttacaaatttcatggaggagtgaaagagatggcatggtttttgtgtagagccccattcggaaattttgcctgattttgttattattgttattcccttacgtgttaaccctctaatacccaaatttttatttccgatctaaatattatttttagttatctaaaatcgttctaaacacgttttgagcaatgatttatttttattcgcaaatctatgaattttggtttttgatttttatattttttttatttttgaacatccctaccctttttcattttttctggaagcctcttctagttactgatttttggcaataataaaaattgaaatttttacggccattatggctaaattttcaatatttttctggaaatatttttattttccttgcaattaacggaaaaacaggtttggaattgttttataccaccaagctcttcttttgggataggttgatcgtagaaaaatataaaagatacgattttttatattacacgttaaatgaactccgggaatttgtaggttatataagaatacaatttttcaaacaattttcaaaaatgcaaaaaagtttcaaaagtcataaaaaacttttcttatatgcgtgttatgagtcaaggagtcaaggtttaagccaaaaataaaatcattttgatttcagagctacgaaaaaaatacacaatattccaaagtgtaccccgtctaaaggcggggttggctattagagggttaatcaacgttgccttgccaataggttttcattgaataacttttttcacaagtgtcggattgtttcgcgatcttcggcaacattctgcatcgtaaaaatacctaccgaaataccgtattgactcatattccgaacacttaaggccaacagtgacttcaaatgcatctgggggcatacattagctcatgtttgtgaaaatttcaatttttttcgtaaagtttaactgttagctgttgggtgtgccgataaaaatgtttattaaagcttgttcagtactgtttttacgaaaaagtgtgataaaacattttgatttaaatgccgaacactgcgctcattctgtctcatattccgaacaccttgattcaaattccgaacagcacgaataaatcgtatccaaataaataatttcacaattaaattcatctgagctagttccactgacctcgaacaagagaatcatcactactcccgaagaattaaatagtttgaaagatgattaaattggtttgtaattggctgccatttcctggtgatttgatgacatatttcagcgaaacatttcaacctcatcgtcatacaaaaaccgagtgttcggaatatgagtctgttcggaatttgagacaaaacggtatgtgttcagaatttttatagaggtcaatgagcgacctctggtgatttttctttgcaaaagtaagttttcccatagtaaatcccatacaaactttgaacggctggcgctaaaatatagtttctccaatcgagctgaaattttgcacagttgttatgggacctaaatgcaatccaaaaagtggactggagcaagaatctaaattttgtcccacactagtgtccaatggagccaaaacccttcaaaacttatcatgctgcaagattaatttgaaagccgattgccttttttggcattgttttaaaaaaaaacatgaagtttaaggggcaggatccaaaatcaagaaaatttacagggaaatgtgttcactgtattctattctccaaccgaaacacagtgaaacattttcagttctgaacagaaaaactgctcttgaagtttcgatgattacgatgacgaagcgttgaacgttaatgtgtgctttacaaccgtaacataattgtatatgcatctgacaaaaaaaaatacctcattacgtcccaaaataactccggaatcttgtagccaattccttttcttggtttagatttctaaactggagacaccgggcggtggtggattcaaaaagccaaatcaggaatgtaggagttatgatttcttttagttataagtacccgaatcatcctttcagacgataataagtgttagcaaaaaatggtctttaaaaccacaataaaacacagttgttcattagaactagttgttcagctaatcaaaaaaaatatcagtaaaaatattattaagaattgcttttcttattctctagttgatgctaattattttgtttttctaatagcgatctattacgtcaccgaacgatgtcaggacggttggttcaagggcgccaaccggcagcaaaagtctggagttttccctggtaattacgttaccgtgtacaagggccgtgaagttggccactccagccaatccaagcacacaaacagccagggactatccccctgtaccactgcctctaccaacaccacttccggggtccagaatccgtccaataacctagcccaaatcacactgcctgccttacccccacgggacgctactattaccaacagtccctcatctgccgctgttgctggcccattgtggaccaaacagcaacaacagcagcatcccaatcaatcgggatacatagattccctctttggaaggaaatctggaagtgcacccccagataggaacaccgctgctgcagccggagcagaaccttcaccgagtgcagcaactgcacaaccggtcaaggagaagaaggattcgtcggcggtcagtttgatgaagcggctgaccaatattaagcgatcaaaatctccgacttctggcagcagtggtactaccaacccggcttactccatggataaccccgtgttcgaggatagttctttgccgagtgctgcacctatgaagaacaacctacaacaaattatcaatccggtacatgtgaggtaagtgtcgcgttttatttctatactgcgtggaatacatgaaatacctaaactttagatctggttcgtgtccgagtcaacttcttcaaaatctcccagtcgacgtactgttagcgcaaggccgcgaaaatgttccttatatgtatggctcccaacgggtcaaaccccacaaagagcgaccttccatgcatgggtaagtgtaccgctatgtcaaaaaatcgaacatctcttcaaccagttccttcattttagtctcaaagctgaagccaccggtaagcttccctcaaaacatgcggctgctgcaggttcagcagcacagcaacagcaacaatctcacgaagcgcccgcctcgacctcgtcggcgtcccatgggccgaagcaatctcatccatatcaccggaaatctcaaagcctggacgcctctgccatcatctcccacatgaacgggacgccatccaagtccaaggggcactcgcagacggtccgagagaggtgagtttttctatttcgacaattttgttgttctatgttcgaatgggtgtcataagtgtatttttaaaaatttcgtacaaaatggccaacttaagagttatttaagaaccgatttgaatgcaatttccacagctcttcaaacataacttgaatttcaacatatattaattgaaaaatttaaggaatgtttatatctcacaaataattgtttatcatggttttatcgcttatcaaagtgaattctgtgacccaacgatcctctccattgataaacatccctcccagtaaccaatgtggaaatgcagaggtaagcaacggatgtttgggcacgtcaggagttaatcatcaatattaacttccttttcccgatcagcctagatagccgtgtgctgtcggtagcggttgtttcaattggctaagaattaacactacggaatgcctgttccggtggtgaaagtccaccttacaggtgacccctaatttatgcggccttaagcttaccgtgcctaaaaatgaatggttaggggggtctaaaaaaacataaccgcaaacggagcctgtggaataccagtattgtgcccttcctgtgctacctggagcaatggtgcaggtgaccttgtgtttctccgagataatcggctacccttcttcagtgtagaacctgaggcaaaataagggtgcgattataggggtgttgtaatttagtttaaattttcacccttatggtttcgcattatgtgtttttcgcagtgtattctgtcggggcagcaggaacgaaagtccgggggcttaacggactcctccaggacctctgcgagttggggagttgcccagggtgtggtgaagttcgcagtgggctttgatgaaccttcgtaaaaaccacaaaaatccgaatgcaactctgtcacagcgaccggtgcagctgaaagtaccaaagcaccctagcccaaactaacaggagtgtcaaccagcacatcaggattgatgccagtaagatcctgattatggcatatctactggtcgcgatacaaacgggcaaggcaacgaactacaagtaggagtgtttcgagcacattgggaccaacgccaggacggccctaattatgtatactggcagcacatgactaaggacaaaaaacggtatatgtactggataatatgctttgaggctgacagcggcgacattcttctcccttagtagggtcgggtgacactggcccgaaacggcgagtgggttaatggcgcaggctgcctccgtcccgtaaaaccgtggcaggccttagagtacgttccaaatccgtcgcctggttgttccaactgggcgggagtaggctcaaatgcctttacctgacttgcgccgatccggctctgaacatagtaccccataaaggactttgtcaactctagcagtgtgggcaaaagcaatatcagcaaagacttgaaaacaagtctactgaaaatgcgacaatcagtcctagctgcaaagcaggactacgagaaaaccaaggaacaacttggcaaagtagaaggaaaaagagacactacccagacaaccaaaatgtacatataacgaaatcacctggaggctttgtatgtgcaaaatttcacttataagatgtcgcgaaaaggccttctacgtacaaaagtggaggcgatatgcatgcatatattatgtgatgaataataacatacaatgcgagtttataaatattctaccgaactgacctgtgatcttatgcgacttaacttatgataacaaatgttgatttgacagctgctacgaattgattcgatttactttgtacgagtgtacgggacgaagcaaaatgtacaaatgaactcagaaaaaaagtgttttatgcgaggaaaatcatcaatctgacgagtttatccacggtgttttgcgagttcgatgtaattagtatgaataaacgagttataacgtgaactttcatgcgatttctggttgtctgggtaagtcgtgtcagaccgaagtgttttccttcacaggcaacgcgaatatatctgatgaaattattagatacgcgatgcgaaagagggggccttccgaggttgaatacgtggcgaaaagacgtatggttgctaagggaaaagtgacctacgcggccgtcctccagagcagagaagctggcacgagccaaaccccgcgatcaagaggatatggctacaaagaagaggccaacaccaagcctaaggagcccagccaaaaaggagcccagggataacccgaaccaggcagtgcatccacaggaaccacgggcgcgaggcaacagcaacccgtggatacgagttggaaataagaaaaaacagaggctccggcccaaggaaagcgctaaaccgaaaacagcgaaacgtaagaatttaggtgaagacctcgttattataccggagaaagcgaaatacgccgaggttctgaaggcgatgcgaagcacggagaagttatcgccattgggcgcagacgtgcggagcataagacgaactaggattggggaaatgatcctagtcttaaagaaggacgcagaggaaaagggtgcagtctataagcaactggcacaagaagtacttgacgacgaggttgatgtaagatcccttactgctgaagcgactctccagtgtaaaaatctggatgaggtcaccgatgcagcggaggtctcggttgcccccaaagagcagtgtgtcatcgacgtagccagtaaggccatccaccttagaaagggcccgcagcgcaagcgaagaacttgggcatactggcatacatttgccggctgagccagcagcctcctgaagtttgcttcaagtgtttcgggaagggccataagtcgtggaattgcaatggtcccgacaaaactaagatgtgcagaaaatgtggcaccgaaggccatagggcaagcgattgtaagcaaggataccaagactaacgtggtgttactatcggacccataccgcataccagccaacaacgggaactgggtggcggataggtctcaacagctagcagctatagggaccgagggacgacaggacaataccaattccatgaagttgtctctatctcaaatgacggtttggtgacagaaaaaaaataacggcgtgttctattgcagttgttacgcgccccccaaggtggcgattgaggaattttgccacacggtcgagaaatagtgcagaatcgattatcgacgtgacgttttgaagtcctaatcttttaggtaccaagaactggcgcgttgatgacggttatactcatagcgatcaacgctgcattgatcaaggaatcttcccggatgtatagaagcgacagaaattggtgctactaccaaaagcggggaacccgtcacccaccaggtgacccgtcggcgtatagacctatctgtctactagatacgacgggcaagttattgaagaggttgattctcaaaaagctagtaccgtctacggagagtgcggatggcctgtccaacaaccagttcggattcaggaaaggtaaatctaccctggacgctatccactcggtagttcagacagctgaggtggcaatcaagcataaaaggagcggcatccgttactgcgtggctgtcactctggatgtgaagaatgcgttcaataacgcaagatgagaagcgatagcccacgcacttcaccgcctcaaggtaccggtgcagttgtgtaagcttctagaaagctatattgatggtaggattctactgtatgacacagaggaggggcagaaaagcgttcgaattaccgcaggagtacctcaaggtatcttggtactttagtgacttgcgataatgatgttacccgcaaggtgaaaaggcgtcttgcgaatagggcttttacgggctccgtaaccagcttaaggcccgtagcctgcagacgaaaacaaaattcgctctatataagactcttatccttccggttgctctatacggtcatgaaccagaaagcgtttggagtttttgagcgtaaagtgctgcgagaaatactcggtggtaaacaagaaaatggcatctggcggcgtcgcatgaatcatgagttgtaccaagtatataaagaagtggatattatcaagctcataaaacacgacaggctgggttgggctggtcacgtggtacgaatgccggaagaacgacaagcaaaaataatattcagtagagaacccggccgcgcacacgttggctttttgcagttgaagaggacttgagggcacttaacgttcagagcgactggaagcgattggctcaggaccgagcccagtggagaagagttatccattcggcgtagattcaacgcagcggattgtagcccatcaagtatcaagtaagtacctcaaggttcaatcttgggcccgctgttatggaatgcgatgtacaacgacgttcttaggctgccctatgtcaccctagtggtctataggatcgatggaggaagtagagttgacagcagcgcactctatttccatagttgaggaatggatgaagtctaggaaactaggactggcccgtcacaagactgaggtggtggtggtcaacaatcgcaagtccgagcaacgggcgcatatctcggtaggtgattgcaccatagagtccaagcgattacttagccatcttgaggtaatgatcgataacaagctcagcttcgctagccacgttgaatatgcctgtaaaagggcatctacggctatagcggcgctttcgaggatgatgtctaacagctctgctgtaattggcagcagaaatgggataactccactaaaggtagatgggcccatcggctaataccaaatgcgtcatattggtatggaagaaaccatggggaagtgaacttccacctgacgcagtttctgtcaggacatggttgctacagacagtacctgcataggttcgggcactcagaatctcctgcgtgccccaattgtgctggaatggagaaaacagcggagcatgtcgtgttcgattgcccacgtttcattgctttgagaggtcgcatgctcgaggggacacgttgaccggcaatataatagagagaatgtgtgcggatgccgaatgctggaatgcagtaactacggctgtcactcacattatgttagaattgcagagcctaccaagagttggctgcagaggattagccctgccggctaggctacttctgctacacgtgttgtgctatatgcactggcctctccccggacaaatttcgtaagttggttccggggagataagggtctgaggccacgggtaatatcgatgcactgtacaccacttgagctgttcaaaaagaattgctcatgtacagtgcatgggcgggttttagggggtcatcgttggtgcgtcatccccgcactccctgagttaccttctctgtttgcagattttccccttgtaaaaaaaaactttttctgatcgaggctatgtttcatacagaaacgtcaagtgattgttaaatcccgagcctgaggtcaaacttagaggtattttctcttgttagggaaaagtgatctgagtagcttggtatccacttaacgaatgagacttcggtctctcatttattcatttcatcaactttcgatattgtagtttacaatgatgccagttcttccttttacatcggaatgcgttcacagatcagacactctaaaattagttcgatctactcgagctaaacacaacaagttctccatccttaagatcaatgatacatacagacttatgcaattaaacaactcgaatgactactaataattataatcaaatttaattcgaaagcttggtagcaaaatagatccctaacaaaattcactttaaaacttctcttttgatcttaattctatgtatacataaaatcactatccattttcaaaaatcttttccttttcgatctccttggagtagcattcggcattgacgccgactcttgaagtttcctcttcctggaatgattcgaatgtgcacttgaacaccttgtacttgcttgatttgacgaatcttcttctgaacgcacttcatttgcttggggtaccatccccccttcattacgaatagacaccatgctctctttctcatgcctcccatcttgctgagttcctcttcggccctcttgttgaatttgactctcgcgttgcacgaaaaagtttggtcttggcaaatcgccaacggccttacataccctcagttggttgcgatgagcgtgaaggaccgcgcttccaatttgtatctggaaaacgttttttgaatatttttttataaaatgtgattttatccaacgaagattattgttaggattgttatttttgtaccacaattcggctccctcagacaaagcatcaagtggatcaaccgatcccttggaaacacatccctcacctaacgggtgaacactatcatcattatcatcgctttgtggtactaactgtttcaaaaaatgcttcttaggatttagcaaatcaacaagagtttttggtttatatgtaaatattttttcagctggaaagctatcgtctttagtcacgcaggtatttctataattaatcaaaaaaagattgatttggtcctccaacgataaatgagaaagatctgagtctattaaaaatttcttcaaaacttctttcacagttcttacaagccgttctgcttgtccattactaggcgggttatacggtgggctcttgaaaactttaattccttgtttttccagaaagttcacaaacgcatacgagttgtagggtggccctccatctgacacaatcacgtccggtaaaccaaatcgtgcaaaaaatgcaaccaattgttttagaacttgtccacaatccgtacccttcttcatccattctacctcgatccatttcgaataactatcaacaatcaacaaaaaggtatggtgggaaaaatgaaaaaaatctatatggattcgactaaagggccttactgtcggaatccatcgtgactcaatctttggtttcttcactatagccatgctattacacacatcacaatttgaaaccagcttctcaatatctgtattgataccaaaccagtatactgatcgtctcgccacctgcttcattttcaccatccctaaatgattagcgtgtatcaatttcaaaatatttttctgtagtttttgtggaataacaacccggtcctgatacaaaagacatccgtctacgagttctagatcgtgctgattggagaaaacatcaataagacttttttctaatttttcaggccaaccattttttaaaaaacttattattgtttggagccatttatcatgttttgtctcatttgcaattactgtaaagtcaataggtaaatccttactgaaatttatgctcctcactaagtcatggtcatattctgccggtatattttgatccaaagggaacctagagcaaaaatctgcatttcccattttagcagaacatctgtattgaatatcatagtcataaattgacaactctaggataaatctttgaagtcgggtgacataaattgagtttctgccagattttccaaaaattcccacaagtggtttgtgatcagtaaaaatttgaaacttttgcccatacaaatatttatgaaattttttaactgtgcacactaaagccaaagcctctaaatgtaatatagggtacgatttttgggcatcattcaaactaaaagaagtaaaacctattggcttttctactccatccacaatgtgagcaatcactccccccaaaccataactagaagcgtcactgacaataacaattggtttattagggtcataaaactcgagaaaatcagcattaatcagtgaacttttacatttttcaaacgctttctgacaattttcgtcccaaacaaacttgacaccatttctcagcaggttgtacaaatgataaagtttggaagataaatgaggaataaatttattataatagttaatgagacctaggaatgatttaagttcagtcacattaacgggattttttgcatttttaatcgtgtctaatttatctttacatggtagtaaaccattattactaataacatggcctaaataatcaagattctctacaaaaaacttacatttctctaggtttaccttaatgtttgccttttcaagcctttccaaaacaataaccaatttacatttgcagtcttccaaatcttttcccgcaattaacacatcgtccaaataaacacacacattttcaataccttccaaaacttgttccatgacctgctgaaaaattgacgcacttgatgaagctccctgtggcaatctgttatatgtaaataaacctttaattgtatttattaccataaattgctttgacctttctgataaactcaattgtgtataagccccttctagatccaatgcacaaaaaactttgcttccagccaaactagcaaataaatcctgagctacaggtaatgggtatgtgtttggtattatgtacttgttaacagaaactttgcaatctatgactaaacgtatatcgtcattctttttcataactactattacaggggaagcccactcacttgttttaacaggtgttatgaccttctctttctgtaacttcatcaaatagtcacaaactctatttttaagccgataaggaaccgtataggccttcttgaatatcggtacgtcattttttaaaacaagatccgcctcataccccactatgggtgacgaaaaatctttggtaaaaacattcgaaaatcgctgcttaatttcattaacatattcagtgcatcgtccttcacttacattgttaaccattgattgggttataaaataatttctccaatttggataaaatatatcaagccagtctcgtcccagcaggggagtgaaatcattactacaattcagtactaacaatttgcatttactctcaacccctctatagttgaccaaaacactcgtttctccctcaatcaacaactttgctccgttaaccactatcaattgctttgaacttttttttaatttcttttcaaaattagagaaatactgagatttattcataacagtcactgatgaaccgcaatccacctccatttttatatttttttgctcaacaatcacatcaaccaaacacggattgcttatcttattaataaacgtcactaagttgcatgcataattaccttcatctaattcactgtcgctgtccgaatccctagcattcatcctgtccagtaattcgctaagatgacgatcaacacttggttccggctccgacgtctgcaaaaggtttaccgctcctttttgtaagtgtttaagcttaaagcacttacgcttaatgtgacccttgatcccacaaaagtcacagatcaagtctgcatatcttgaaggttgccttccgtcatctctgcgccagtccctcggatggcgattttccgtttggtttctgttcctaaatttgtaatcaaattgacctcggtatggttgcttgtagcctagtctagccttgatcggcctccttcctggctcctcactctcaacatgatgatgactattttttacgtggtcataaacctgagccaatttactaaaacttttcccaaccatatttggactgtaggtacgcattgatgcaatcagtccagaagtatttcctgaagtatattttcacccgcaatttcccaagtggcaatgagtttctccgcactttgtaaagttaagctttcttcattgagaagacgttgtcttaaagcgccatctctcaaacccgccaaaattctatctctaattgccacttgtttaaattcaccaaacgaacagaattcggcttgaagttttaacgaaagcacgaaatcttctgccgtttcgtcgggttgttgcacccgagaattaaatttcatgcgttgaaccaaatctgattcagtcttgtccaatcgggcttttaatttagccaccatatccggataagagacctcggacaagctttcccttgggtaaagcaaacgaagttccgaaaaaattacaggtccacttaatgcaattagatacgcctttttgttctgatccgtaatcgcattaatgacaaaagaatattctaagcgttctacccagtctgcaaaggaacaacctttacggtatggctcaatagtaactgccatagaagccattgtctatgcccttttaattatttcaattgttgttttacaatgtaattattttccaaacaaaaaaaccgagaaaagacaactcaattaggcaaagaaacaaatgataaaaaaaactttttgactcaccggtatcttcgctatttctgctacagtgaaaaaaggcaccacagcagtaagatgacctcgaacgggacctcgtatgtacctttgaaaccagtcgggaaggattctcgctactcggagccgcaagctcctacaaaatcagtttgttcggacctcttttaaaaaaacgttctctatagctcacacaagaacacgatccacaccggatcaaccactggactccgctcactccggtagatttcaagcgtatccacggattttctgcttttcaccacacgcgtttttacaaatccttagctgaagggaaacgttacttcggctctccaacgttaccactagcgttcacaaatattccgttgtccttagaagatcctttttcgtagccttgtccgtttaccaatcctttttttctcctgttagccgaaatccaaacgtgtccaaatcgtagtcctttatctcgccgccactgttaaatcccgagcctgaggtcaaacttagaggtattttctcttgttagggaaaagtgatctgagtagcttggtatccacttaacgaatgagacttcggtctctcatttagtcatttcatcaactttcgatattgtagtttacaatgatgccagttcttccttttacatcggaatgcgttcacagatcagacactctaaaattagttcgatctactcgagctaaacacaacagtgattacagtgccaaattggcaaaaattataaaagaaatatgatttgatgttttaaatgggaaaatatttgttaaatacgtataacactgtaaatgaaatgttcacagacaatttaatcatttaattccatatcttttttggaagccacattgagttatatcttttcgatttatttcagattcaaatgcatcgttccttatccaccgaacagtgagtacgagctggagcttcgtgtcggagacatagtgttggtgcacaagaagcgtgataatggttggtacaaaggcacgcaccagcggtctggcaaaaccggcctgttcccggcatccttcgtcgagcccgcagaaaaatgatatcgtaactaggaggcggcgttggaatgaatctgttagttttattttctacttatggttagtagtctccgaggcactgattaagtgcagcacccaacagtggtataatcaaaagtcggtattaatagtggtcgtatcgtgtagcaaagagtcagtatgtgttttatgtttttttatttgtctctacaaaagtggtactagtggtagaacaagagtatttagcaatccttaggtaagcgaaagaaatacagtatgattgaagcaaattttagggcaacattgaattaggccaacaaaaagtgcaaatttgtacctaatttttatcttattgggtcttttaaagtctgaatcgtaaatttaaatgaacagttttaggaacgttaaacttaaatcctgatgatgatataatcaaccataacagttgtaggcaattgttagcatgacaacaaaattttatgcaattcagattaaatttaaaaaatacaacctattgttttcgtaaaaacgctctgtaatcgttgtttgtgtctgtctttctaagcaactttcgtgtgtctgtctttgtatgtataagtttatagatcaaagctcattccgctaacttgaagaagcaaacatgttgttgtacaaattttctcaaccatattctagcctctgcattaaatgttgtgtttgaattatgtgactactttccaagtaacagaagatagacatcttcgacacataatagcagcgaacgaacgcatttataatactataatactcttatcacacaatctaatattcaaccgcatgcaaggtcacgaagaaactcatgtaattcgctaacgatcatagtttcacattttatgactaaaaacgttttccaggaaacactatcaccatttgatggccataaggtcaaaacatactcgtcaacgatatgatccaattggcttgatgtttttttttaaatcaaaataatggatattgaattgttgtttcttggtgaaagtgtttcatgaatgtcataatctaacgcgcaatagtcaaatcttaaaaataaagatggaaaagattaactcaaaagcaagtattgtctaacaaactgcagctaacaaaccgagcaatgtctttgttcagttgcaacaaaatagcaaaatcaaaacgaacaaaatgtaacatgtgcaacaacttctaatagaaatataccttattgtagatattgtgctcggcataatctgagccaacataactgaattcatatatttgtttttgatcgagaaaactttagagtatttactgttttctagtaaacctatgcattatcgacacaagagaaataaatgaaattgatagctaaaaaagtttaatcacgtgaaaaaacagaaccaacacgactcacataatggtctcaaaagtttataagctcgttaaaaataagtagaaagagagctgaagtaaaaacaaagaacatcattatcgcactaaatcgaaacagggttagtttatgttctaaattggcgaaaattcaaaacttcgcttttcacggtaaaatttgactcgtcagcacaagcgtaaaagatggatgcctacaataaagtgaagaattgaatttccggagctgtggatgggtttgggtaaacatttggaagcattttgtggtaattgaaacaaggttttgcatttatagtgtgacgaataaaataaacccttttaggtatgtaatagcatcatgtgattcgatccaagtgtttggtaataatctgactttagtttgggaaggtttggatatataatagttaaaattagaaaagaataccaggcaacataatgttatggggtcacgaaaaacaggtatactcgtactttaaatataaatcacttaaaaaaaaaataatgtgtttgttacttcatatcacacattcagagttatttctagagcaattctttgacgtgcgggaaacattgttgtttgtaagatactagtggcacagactcgtaacattgatggtattcattcattcattcattcatttatttatttccagtagcgtaaggtttaaccttttaaattactacattcggcgacacattgcagatttaacataaataataatttcacagtttataattagttacatagtgtactataaagtcttatataatactatctactccaaaaattcaaacatttttccttgaaagctacttctgatgtttcccgtttaatagaatggggcaaactgttccaatttactattcctctaacaaacattgagctagcatatgttaacgtgcgatttgctaggattattatattttgcgagcgctgcccacgaaaaggcacaagtttttgaaacagggctggtgggtttttaatctttatcagttttctcagaaacatacaggatcgatatgcgtaaaagttctgaaatggacagccaaggaggttcttttggagatggctcacatgtgcaaaacgactcaggccgtaca

SEQ ID NO: 133 - DNA, 19793 bp, Aedes aegypti
atccgctccgtgcacagcgtgtaaattgataaacaaattaccccgacttcaattatttgcaatcgcgcgcgaaacctctcattagtttatgagcatccactcttccatcatcacaccgccgcacagaactaaccgcaagctgcatttcgtcaatcaacgcgcgctggccgcaaagcaaaaccgagctagccactctggcggccgccattttgtaggtacacataacgaacactgtgcgtttcgattctccgtgaccggtatgccactccgtgtcacacttggtggtggtcaagtggtctcctgtgctactaccccttcggagaaaaccacgttgtccatctaacgttttattgcccatactcgcacgcgtcgcttagcgcaagcacgagccgagcgtgatttcagtccacaacaacaacccccgcgaaaataaggggatatgtgtcaggggttctcaaacttttcaacggcaaaaagtagaagggcaaaaaaatctgtaccttttctcaaatagaaacttacgagtctcttactaagaggtcgaaacaacccccctatggatccccggaccaccaattggggaaccatgctctatctaatatgatcccacaattgattgaaccgattctaattgctctccgtttccaacacttgtatctttccagagctgcaaacacgaacatgcacgcgtggctttatgtcctcgcggtgctggcgattctacagggtgtaacgcaagtcgctagcaccggcgatcaaccatcatcctcctcgtcctcctcgtcctccacctcctcgtcaacactgctcagcatccggagtgcagatgagcgatcagatcgtcggccgtcgtcaagtgatggtagcgtggcgcaaagtgagtcaaaggtggacgaagatagtttagaacgaccggcggccggcgagttgcacctgcagctcggtccggtcgacaaagacgcagacgaagaagccgaagtgaacgggagtagtgatagtgataacagtctagatattagtggtagcagcagcagcagtcatgatggtagtcatagtagtgatagtgatagcattagcagtaacagtaagcccgatcctgaaacgctagtcgaaatcgagaagaatctcctaagtctgttcggttttcccaagagaccaaaaattgatagatctaaagtggtgataccggaggcgatgaagcagctgtacgcccagatcatgggccacgatctggtcgactcggtcaacgtgccaaaggagggcctcaacacgcgcaacgcgaacacggtgcggagtttcacgcacgaaggtgagcattctgcatacttcagctatttatttaagcaaattattgagtgcaaaaagagatttcagaataataaattctaaaattcaaacacaaaaatagtgatcgattcatacgtgttgcattatatatagggcggttctgaaaatatgactcactccacaccgctttctaaattctaagtcagattctgcttgactttccaaaagttgagctcctttggacgaaaactgagactgcaaaagctcctcaaagttgttatggaaatgtgtgatagtaaaacagtcacttagcacaaccccaaataatatatagggataaagggattttagctttgcaaaacgttgcttgcaggaatttaaattgttcaaagttagctagtaacagttttatcacgggtatggtttcgatagaattttggataggaatttcagagaagcagacattaaaattttgttccaagcatatatttatagaaagagattcccacgtctcggacacctaagtcgataacttcgtaattccaacataattgttttttattgcgatcttgttatccatttggttcaatttctcagatggattattctaaaaaatcgtactggtgaatacttgaaaaacaatcttctcggaatatctccagaaatttcattatgaatttctgcataagtcttcgagtatgtatccaagaagctacccatatactactaaaaaattttcagaattctatgttgaaaatcctttctttgattacaagttgttggcattatcaggctaaattcgacaaacacaactttattgaatcaatagctgaatctaatttcctaaatgtaatctgaatacaaattataggcgaaaatagaagagaactttgggaagaaattttaccggaaatacagttgttaagaaatctcaacccgacattatctacagcatgattctcaaaaaaaaaaaccttggaaggaattgttacagaagctcgacaggattccaaataattatatgaggaaacttgtgtattttaggtgtcttctgcctttccaatgtatggttttgcggttcacatcttcttatattcagccttctattcaactgagtgtgagttttggaaatccagtcatgacgaaagctgacgaaaatacaacaagtcatctaaggtttccagatgggttttaacataatctttggtattaatcttgaaaaatacattctgatagattctgatggaatcctagataaaactgttataggaccctgaaagggttgctacaaaattcatatgcagaataatttacactatatagggaccatttggtcggtgttcagacaggccagactagatgattttttgacgttttaaatacgttttaaatacgttgagaactccatcaattctaatttttccgatgctattttgattttgatatatcatcaaatagataagatccattattacagcaagaaaatctttgatattttcaatggctgggatatgtttttctgtacaaaacatttggtttagtctgtctgaacaccgacatttgacttattaatataataattatatcttcattagaattgactttgattaactaagtcaaacataatttaaaaaattatctttctttctgccttctcttaaaataatgccattcaatacatattatttcagtaactttgaaaaattgactaacagttatttgagaatcttttgtgaaaccacttataataaattattgaacgatttggttttaatatatgctcgatcttttaaaagctttttattttatgagattttgctgaatataaaattgagaggatcaactattcatttctattgataagtaggatacacagtctttatcgcaaaaacgaatgattcagcaatgttaagaagagttttgtaatacctaaaaaactcgctgagtcttgtcaattgctcaattcacttaactttaaaacgaaaatgtttgcctaatacatcccacagtttctgcagacttgtttcttggcatataaacttacagttgcctctccacatctcgatttcgcagagaccatcgagatagggagagatcgagacaacgaacacatttttgatgaatactagattgaaaaacactccgttgctaagtaagaaatacacaaacgaacgtcattttgccctccttatttgttttgaatcccaaaaatcttggtctagtaacctttgatattggacatatcgacaaacggagagaaaattgagaacaaaaaatcaacagaaacacatcgagatatgtagatatcgagataaggagagtaaaaatgtatgcagacagatgggacttatgaaatcatcgacatagggagatatatcgagatgtagaacatcgagatgtggagagtcgactgtatttatattagggccaaatattattgtgcgcacttttgatttacttcagcagaggtttttatgaaactactgcgctcatatttactaataatagcgatagaaccaaaaaagttttccgaaacatttcttgttgcaagaaaatctcaaagaattcttaaacgaatgtccttggacaattattcggaattttctgccttaccattataagcagaactcacaacacaacaaatgaacttatatgtgccaaatcttataatcacttcccaaagatattcaaaaatatatatctcatcatcaactaaattccaaagtagtggggacttacttaaaagaaactcttaaacttatttgaaggtgtaaaatgaaatgattttgccgctatgattgagggatttttcacatatccgagataaaaactggatattcgtcaaccaatataaggaaaaatgttgcgtgaaatcttggaacaattcttacagaatttattggatcacccttaaaaaatatcttgaataatctaggtggaatgtcttgcagagaatattgttgagatacttcagaaattattacatgacatgtccatgacacttcttcaaaagattcttcacaaaatacttgaaaaagagctttttaaattccaataattactttggaaacacattgaacgaatcctacagggatttctttagaaatcattccagggatttctcctgcacttcgcacaggggttgtctcgaaattcatccaacgattatgttaaggatgctcaaaagaatttctcatgaattttagttcagaaaactcttcagatgtctaatgttgattcttccagtaatttgcatattgattgttgtgcaatttcaccaatgattctctcagaattttcaccaattaaaacagttgtcatttcaaaaattctttccctacaagaattcttcattgaatataatcaaaggttcatatcagaacttctagatcaatttattaagagatatttaacaataagcctttcaagccttcgcaagcatttcccacaatgataacttcattatttcccccaatgaattcgtttagggattcctcaaaaagcgttttttttcaagttccccatattttcatccagagattactaaagaagactctcacaatgatttcacgaaaaaaaatcctcaaaacacctgtacctcctgtaacaccttgcataatgttacgaggaatcattgaagtaatacttaaaaacagccaataagaaatcccgaccaatgcattacaacaagattgtagcacaagtgtatcaaaatttgttaaaaataacaaactttgtttgatttttgtaggaagcactttgagttgaaggagcaaattataacaaatttaaaacaaagtcagttataattcaaagactgtttcaaatttgttacattttaaaacataattataatacaatttattataacaaattgcttataacaaattttgttacaattaggttattaaaaataacaaaatgagttatatttttgtttgatttgacacataatgggtatcatttttgtttagaacacattttgtttcaattttgttgaatgtagaggaaattgtgttaattttttttgttattttaatactaaccagcaaaaactataacatgttttgttacaaaaacccgctaaatgagtaacaaaacctgtaacaactctattgtaatccaatggtcgggatgttatgatggtttatcaacatgttcaaatttatttattcgaaagctcctgtcgcgtaagtaaagaaactgcattcggttagtcaaattgatggagtttttgagagcccctcgatttttgacaatttttggtcactcaaagtgtcataattcggaaatttctttaacaaccccttcacaataacatggttttggaaagaaaagcatagaagcttcgtgtgcaaaaatgaaaatatttggcggccatcatatcgggcagaaatactttgttgttttcagtctaaatacttcatagaggtcacatttgacattatttgcgtgtgacccttatgaagcatctagactgagaacaacaaagtatgtgcccgataccgaaatgagtgatcattgtaaaagaaaactatatgttgacacttgtgggagtgggtctcctatattgacaccctccctctttttgtaccccccccctcctttctttgtgaaaattcaaatatgacgttcagcattttccgtaatttctagacccccctcctccctcttccgtaatttctagacccccctccttaaagctcaaaaaagctttaaacttttaaaatcggttgaaaaattgcagagatattgacaaaaatgatgtgtttcgtggagtctcttcaaaaaatataagattacgattctaatgacactttgattttaaattttggtcgacccaatgctgaggaaattagaaatgatttttcagtgtgttttttgaaaaatgtcacaactttaagtataaatttagtatacaaaatccaaaaaatgtttttggaaaaatacatacgaagtaagaataactctttgcatttcgaatgcgacttaagagtttgaattggacgtgtaatcacagagatatggactgaacacttttgtatgtttttgagggggtgaacccaaactttgcacgggagtgtatgtttattttttttttcaaaaccatgttattgtgaaggggttgttgaagaaattttcgagttattgcagattgagtgagtcaagagttgttaaaatctaggggtcctccaaaactgttttaattataactatcgaggagatgatcaatttgaccaaccaaacgcagttttttacttactcaacaggagcttttgaatttgaacattttgaaagaccaagtgtaaatagtggaccggtctcagcgagaattattctatgcacaagtgaagtcaagtttgttacaattctcacataacttctgatctcgtcctaaacaccattgtatcattgttgaataacgtgaaaatcggttggtgtgctcattaacaacaagctacacatttagttaccaatggcttttagggtgagatcataaattatgtgagaattggaaattgttgtgagctaaaattgcattttttctgacgaactcgtgagataacaactgcgattttaaaacctgagacatgtgaccaggatacatgttattttcactttacatagttttttcaaggctgtaaaatcgaatcgacattcatcccgcacttttaccttggcaaggccgtctcttcagctgtctaccgtgtagataatccacaccaccagcagggaactaccacataccacaccatcccatttcaggcacccgcgcaagacttcgaaagagcatcgtcataacttgttcgctgctgggtctgagagatcggtggaatttacaatttcacattacgtgcatgtacgaattaaggtcagttgaaagggatcccaataaccgttttgcgagatgtctgagtaaactgaagcacaatcctcacagtgtaccggttcggtttgaaccctgcagctggaagaaagtgattgtaaatgtatccatcggctgggagccagttgtgcaggttactaaacgatcgctgtgcaatcggttgactatcttttcggtgaacgcctacccttctctctttcactcgctgcgattcagcgatggagctatttctccggtccggcagttggcattggatcactttcaattgctgctgcggggtcccttagaaacagttgtcgaagcagttgcgcatgcactttgtgcatctcgccccgtatgcaatgactccagcagcgacaactacgggacggcacggagaaatccatttacctatagggtgtgtggagccatttcagaagatttatcgtgaatttattcaaattgaagaataccagaagccggggagggttctgcgtgtctctcagccgccgcctgccttcagttggaggccgtgccagtagtcgctaatgaaatatcgataatttatgaccctgactaactggtgcgggtttgtctggtttctgggctgctccaacgccaacccttgacgccactgccttcggctttgctctggaccttggctgcaacccctcggcgatccgttcgttgagcggttatttattgaacttgattgtttacgtaattaattccctcctctgtttggcggagcgagtgcgatcaccgtcgttccgcttcattcctggatcctgccgggccatcaaaagttgaactactccatcagaggagtactagcaatatcgagctggcaggcagcatcacaatttgcacgagcacgtaatggccagctcccagctgggcgtgcgggttcaaggagaaccgttttccacttcccctcccaaggagtggcggctttttcccgccgagcgcgaaattgacctacacttacttacaccgagcgaagatgatcgcgaacggctcaaaacgtttgtttaccaagcaactggatacatttgtttgatggagacgcgtcatggattgttcgcgttgggaaatacgcggcaacttcgctgctgaactgctcgaagcgcggagaggggctttccaaaaaagtgattttataacaaactggtccggcgagagcgacagcacctgagccggcttggaggtttctggttgtcatgcatttctcgtggacaaggtagcctgattgtgagacacctgattcatacgcctacgcatcgccttgaacgactatagctatcgctcgcgaaaggtactccggacgagtgcgcgctggttgatctggtgatgatgatggtatggagcgacgaaggggagatattataatggcagcaataatcaacagtcgcggtcacagctgtcacagatgcgtttttgtggctggacgcatatgagatggaatgtgctgatcttttggaattcgttgttgatgttttgaaagcagtttcgtatgataaacaataaattaattagcctaacagttatctggtatcggcgttgcagtttgtagaaatcaaaagctgattcattttattatccgacgtttatttaacacctttttgaggattagaaactgcaacgtcaatatcagatcactatcagttccctcatagaatttcttcctcattagcctatcatcgaaaaaataaattttgttcaacgaattgaaagcatattatgttttgctcctttaatttactttatttttatactgtgtatacgggtcagtgtacgctatgtgtacacgtcacgtataactgtaaaggaatagaataaatatactcaactatccataacatagtattgaaaagaccatcgagttggggaggtatttagttatagaacaaaaaaccatttgcaattgcaaaacattttgcaaataatgaattgactagatggataggcgctgtaagggagcgattagattgaacttgcttaggtagtgaaaattaagcaagccatcgggaaccagtaagcatcgaaagcatcctgtattttgcttaccttctctactggagaactgttggctcaaagctgtgggatttgctatcaactcatgcttgcctctcgaattacactgtaaaagaatatctagtgatgcaagaggtcttaatttataaagtaaataaagtcgcccatctgattctacagaattggttggtacagaattggtttcttgaaaattcgaacgttggctttggaaccagaaacaactttcaataaaaccaagcgcagattgtaagtctcgtcaaattgtactacaatactacaatataaattcgaaaatttgtcgacatctctataatttcataatgttacctgaagggaagtgaagtttttaatatgtcattcctccggaccaattcgtaaaacatggaaacgcttgtcttgtaccgttttgattcatgtttattccgggtcctcagatgcatatcataggcatgaaattttgaataaggtaaaaagttgtaatacgccccccccttatggaaaaactgctctatcgcagaagcaaatgcatcactcctaaagtttttttatgtcaatgtgttgcttattcagttggtcatgctctgcatacaactttctctttccaagttgcttctaaaaaatgtactagatgtttttttgtaaaccgtcccaatgtttacatttcaaaacaacccgggcaatatgcccctcccatagaaaaaaggtccagagtgttttagaaatgtttccaaggagaattccaccacttgctaagcttaaaggggtcctgtaaaagtttttgtaataagtacaatagtaaagcatgggcttcattaacggcaaggcttgcttatcggacgcgtaattttacgccaaaaatctgatcttcgatatttttagaatttctattgattgtttatacttctcaaagaacatatatgcgcaacatcatttattcgcgaatagttaaaaaatgtaatcatatttacgtgtaaaagaagcctcaatttcgtgaaacttcagaggggcgtattgccccggtggggcgtattacaccgagttaccctacattccattgcaaagttgaattaataattattgtgcctgctgataaatatattctttgattatgttttactttaatttttacgcaaaagtgtggaacaacattttgcttcaaatgccgagtattgtactcattctgtttcatattccaaacagcatgaactaaataatatcgcaaacaaattcatctgactcttattaatgtattcgaatcctctgagcagcatctagatagagaaacttaaaagtaaatgtacagtagatttgaaattcatctgagtttgctgttacaatctcgaactactatatagtggaaagatctaaattaatattgaaagcatttagcgtgagtgagatgcaaatgacctgaaaatttattgacatattacaaaatttccgtgaaaaacacgagtattcagaatgttcggcattagagacgaattgtattcctaatgttttggtttcgttatagcgcatgtggtacaagcagccgcatgtggcataaatgattaaacaaacaaacagtgaatgattaacgcgaaaacaaacatggttaacaatcctcccaaatgcatcgcaaatcgattccaagcaaaccatcacattaatccttttcccgatccgggaacagttccacgaaccgcaccaaccatcaccggcaaaaacaatcactttgcgcgcataataggtgcgagagttttccagaaccgcacaactgtcaaatatatcaataaacaaacacttaatccacccgtttacgatttgcaccggcatcgatctgcacacacacagagcatcgcattcgctccgaagccgaccaaagtcgatcgcactcgaagacagccagccagcggatcggctttgatcgtggccgcacctcaattaatcgatatcacgttccgggcactcctgggctctcgtcaccaccccgcccccctttttgtccaatatcgagcaccacatcggtcggtcgcactgcaggcatttccagtggattgcttcatcactcagcggccactcaatcgaccagatgcaaattttccgcttaattttgagagccagatttgcgccgcgcaccgtttccaaacattcggttcggaaatttatgcacttttacatggggcacatcccgagagacatgtagctagaagggggagacgcccccttggccgtcgggatataaattataattagcctctctacaaatattaatactttgtttgaatgttccacagattctctatacaggttatatctgttgaatattgtgtcataaataattttactgagtccaaacaacccttatagacctaagtaaaagcccgagtaacatgcatgttataattgatgcatatcaacagatatatgaccagatctagttatttaaaagttattctgcctcaattataacataagcgctactcgggagaaaaaaataagaaaaaaaactaaaacttccaccgctcagcgaatatttatcggatttaagatggccaaagaaacacgggaatgttgtggttggagttttccggtgggtcactgggtccgatcgggtaaaaagggtaagtacccagtactgtgttttgtgcccctgtatgtaggcaaatttaaagtcacgagtagtttgtggaatcggttataatgtgcctatatcagaaaattttaggaaaaaaagaatcagtgttaaccttttgacaaacgattgagttggatgattatccttcctgaatttgattgatcctacaaatggccattttcgggttccctgagacacttcaaatttgctgtaagtgaccaatttgtacctaagaatttgtgctaagctcataggaacgcatttttgcgagcattaagtccgagtggccacatccggaacattctaaatggctcaaactttttcatttataatattgaatgtcaaacttccatgatttatgaaatttaaattgattttcaaagcaaataaatgaagataacttaccatgtcccaaaaaatagcctttttatcaaatctccgtaataactccgacaacatgaacatcatcgagttcctctggtcactagacatgtgcacgagtatattgacaaaatattattggaatccgttaagcattcgctgaacggtgagaatttcagtattttagcttttgctcaggcatacacgggttaaaaatcatgtttataccaaaaaaaatgaaatattccaccaagtgttatgctagagatttttcagcaatttcttcaagccttgctctagcagtttactctcaaatattaggagatgttttgaattctttcatagagtcttcaaggtattttcataggttttcttcttccgaaaattgtattttgaaaatgtcattattttcaagaattttcttgaaatgttttcaaaaggagaatgtctaaatttcttaataaatctctctttataatcggaatttcaaaatctcacaagcatgttaatcatatcaactgttatttggaaagctgaaggagacttgagatgagagtattgatttgttcatattggatgatcttatggttattttgggcaaacatactttgcattataatcaataatgattctatctacatcataattatcacctacgctttcaaatttgattagttttgtataccatatattgtcaatataggattctggtaaatacttttattcttcagtcattttaggggtggacgacggaaaaaaggaagcctttgatttaaaccaatttttggagtaattgaatgatgattaggtctattaattgctcatcgttagaattataatgatctgttgtatttattattcttctaaactatcatcattctttggaaaacaaatcgtatttgaatgtcacattgttgaatttattattctttcaaaatgtctttttttctatacacaactgagtctctatccatagacatcttccggtgggtgtgcttggaatctttatttcgtatcaaatttcacatcaaagtgcatcaaaagtttcctggtgtattgaaaaatgacatcaagtaacaacaacaacgcaagggttcaatcgattttgtaggggagtctgggtgagcatttggaatcccaaaatatcgctcgtcacatattgaaggcttgacatttgttcaaagaatgccagtagaccaatgcagattttttgcactttatcatgttgttctagcatatgaaactccagttatagcacctaccatacatgattttctcttttcaatggcccaatcattatgatattaatgtaaaaatgtcactctaaaaaataatctgaaaagttcgtttgttgacatctcaacaaaagtgagatttgatgtcagcggcacccaaaggtgctttttcgtggcatgtgttttttcgctggcatcgtttgcttgcttagtgctttgcaaaggcccaagtgattcggttttcgcgcaaggatttttattacaaacatcttcaggcttttctttgaacagggatttccaaagaatgtaatcaggagtttgttaattaactcttcttgattacttacaattattacaaaagcaattcttccagtaattttacaaaaatatgctgctcttatgtgtctttactgaagtgaatatcaacacatttatatggctagttctccacccaacaatatgttgaggtatttacctagaaattgttctccaaaaaactgaagtttcttgaatatttccggattagaggaagtattacatataatagctcctacagaaattgttttcagggtatgctacttgatgagccaaaaaaggtttttttaacccttgagaaattgcatcctttttcaaatatttcgtccattattttgtcttgttttccggctttataccagtatatttacaaacattcaattaaggattttttgcaggtattagtccagcgatttcccctgaaagtaatgtttcatttttcagaatttcacaataattccagctaggaattacttaaaggatgcataaggaatatatccagagaaggaagttcctcaaaaatattttttggattgaaaatatgtgatgaagctcctcggaatttttggaatctttaagtgaaaatctttagaaaaaacttcctattcaacttctggaggattgttttctggtaatttctttaaatattcctaaaataggcaaaggaaagcttctgagaaagaactttattttttttttaaaggagtttcatggctgaattttcgaaataatgttagtaattcattgtaaagaagaatctagattactagagtagtagttgatatacatttttaaagaatttaagaatgttaaccctgaatgatggagtttttgacggtatttgtgaattaatggtaaattcttgaatgcattccatagaaatctcctgataaattcctcataaaaaaagttccacaaatgctggcagagtttcaagggaattattcagccattcaatgaaaaaccgatctaggggctcaccgaattccgtgaaaatttgctattttgttccttatgcgaaataaggatacacgtgtttttggattttttattagggtgattatttccaaaaaagagtgaccagaaaaatcgcgactttgcaaatttattttgaattataacttttgaaccgcttgaccgattttcaattttattggacgaaatgaaagctaaagattttgattatccaagaaaaaataaaatttcactaaaattgttttttaacacgaaaaaaatatatcaaaaatttccgttctttagtgttttgaaggcctcgggacaaaaggggctattgctgtactcattttttcttgaaagttcagaaaattttacgtttgctgtcaaagatctcaaaacctcttatattttcaaaatctgcctcaatattgaccattggtcatctggttttgatgatgtttcttgtagaacctacattcagcatgtacaactaacttgtccatatttttgtttttagtcaattaatcgcaaaatatggactatgcaatgatagttattagggagttttcctcaaataatcataaaatagacagccacctctgaaatcttcatacagtttctggataaatcctggaagtattttatcaagaagtagacggggttggtggtctaatggctaccgcttctgctccataaacagaaggtcatgggttcaatcccaggcccgtctctttcctcgtactttgtagttgtatatctctcacttgcttctatcttgtattcttaatcttttaaaatcaaactattcgttcattgcaaacgctagaaccagagacggacgagaaaccgtttccctaacgcttccattctttcacgcgcatgcctttccttacgcctgatacataggcacaccacaaaagcaaacctctctgccatgcctttcctccgatccatacacttccgcatgaactggcgtagatgcagtcggattccacggtctatagtcggccagtataagtgcaacatcatttcctcccccttccccacattgatctgcattctgacgtggcaggcgccagtgttgcctaaaatagaagatcaccagcactttatacactgagggtgtctgttacatttgacttgactgccttcaatgtgatttttaaaagttaaatatttatctagcatgagtcctaggtacttaacttcatctgaccaatttattagaacccctctcattgtaacaacatgtctacttgaaggtttcaaataaagagtttttggttaatgtgggaatattattagttgggttttgaaagcatttggagaaatcagccatttttgcaagtgagaagaaaaaaattccaaacttttttgcaatctactacagatgacacgcagacttcgtcttttggcggagaggcctgtgtcatccgtaaacaaggatttttgagatccctgaggtaactcaggtaagtcagatgtgaaaatattgtataatattggtcacaaaatgctgtcttgcgaaacaccagctcttacaggaagtctttcagacctggggttctgataattaacctgaagtgtacgatttgacagataacgtgcattattctaacaatatatgttggaaaattaaagtatttgaaattttacaatcaagccttcgtgcctctagaagagtaagaccagtagaataaccttcagatttgttggaacggatcaaatttgttacacgtaaaagttgatgagtggtcgaatgtccatgtcggaatccgaactgttcattggcaaaaaattaatttccattgatgtggatcattattctgttcaaaatgaacttttcaaaaagtacactgatggggagagaaaactgattggacgatagctagaaacatctgcaagatttttgtctggtttcaaaattggtacaactttagcatttttccatttgtcaggaaattatgccaactgaaaacatttgttaaatatatcaactaaatatatcaatgaaaagctactttctggaagtttcttgaagaacacatgaagttattcctttccttcgtctccgatggaatcctggctacgcccctgtcccgacgtgagcttattagcgctcgttcgagacagaaaggcgcagcaaatggcggcacgcggcaacaacggcaacacaaatttgcaccctccgccgccggctccgactaaatggccaatcattccccgggcatgtttacagatattcaccagacaaaatccattcgcggaatcattcaacatcaaacagaaataaattacgctctttattagccgctcgccgggggatcgcctttttgcgcaccccgcttttttttgtgaccgcgtagacacgactccacagactatacaggcctaccccaaggggacgcgtggtgggatctgcgtgtgatgaggatcgatagcgatatcgattgcctctgtgcgcgagattttcggactttcttgttgtcgagagccgccgaaaccacccgccgctgactgacgaaccgtatcgccccgacgctaccgctatgtacatccctataccatagagtacggaacggagtccccacggctagcaagaggcaactgttgatgttttgccgcgcggaacacaagcgtggatcaattcacacccaaatcgcgaaacaaataatcgtgtaaacacccagccagcaacgccgctgccgccgtacgccatgtgagcggagggaaaccctgggggatcagtctggggggattgccagcgcaaatccacagccgccaaagtagcttcgatctaacataaacaagcaaacaacaacggtgcactgcaatcgagagtgtgtgcttacgagggcaaaacatcacgagagtgcgattccgcgagggagacttttttgcgtgtttgttggttccatgatttcgagaaaacgcaaaaggttttcggaagatctggtgtaaggaacagtcggaattctattcgacgaagtgactggaattctaacgaaataaaaaatcgtaattcaattagatgaactttaaaaagtcctgtttcatttgacgttaaatctaaggactaaattttaagaagagcattttcagtaacctttggcgcaggctcttcgattcaaatgaggaagcgaagggttccgccagttgtggtattatttccaaattttctgcatttcggcagagatcatgaacgttcttcttcttcttggtattaacgtcctcacgggaacagagcctgcttctcagcttagtgttcttatgagtacttccacagttattaactgagtgctttctttgctgattgaccatttgctctggccaatttgggacgtaatgccgggttttgcgcttttggagatttgaggtgtggctccgatgcatcttcaccctaaacattatgaagaccataggcataaaattacgacaaaactttgttcaagttcgtactcaataactttaacagtgcaaaattaatttacagatataattactgacttacatctgatattcatatcacttcaagccaatctgtactccgtcagatttcacaacaataactaatgaatctttttcatctcgctctcttccagaaagtcacatagacgaccgcttcaagcatcaccaccgcttccggttgatgttcaacgtgtccaacatccctcgaagcgagaagctgcgggcagccgaactcacactgaaccgtgacgccatagaggacctgcgggcacgaaccgtccagcatcagatcctggtgtacgacatcgtccggccggggctcaaaggcaaacgggctccatcctttctgttgatcgactccaaaacggtcaagatcaacgaaacgggctcgatcagtgtggacgttctgccagcggtcgaacggtggctgcgatcacccaagcagaaccacggactcttcatccaggtcaccagcaagagcaagcgaaaaccacagtccacgccggaacatcaccacgtgcgactgcgacgaagtatagacgaaagccacgataagtggtctcacaagcagccccttctgttcacctacaccgatgacggtcgacacaagcagcgaccaattcgggatgccatcagtaatgccaatcgggcccggagggcgccaatgaggaatcgacgaagaaagaacggcagcgaaacctgccagaggcgacctctctacgtggacttcagcgacgtgggatggagcgattggatcgtcgcaccgccaggctacgaagcatattactgtcacggagactgtcagttccccatcgctgaccatctcaatacgacgaatcatgcgatcgtacagacgttggtcaactcgatcaaccccagcctggcaccgaaggcgtgctgcgtcccaacgcagctctcgtccatctcgatgctctaccttaacgagcagaataaggtcgtcctgaaaaactaccaggacatgactgtagtcggatgcggatgccgctgatccacatcgcaatgtacatttcacaaaaacccctgtattatagcagcgtatcctcttaaagaagataccgacaaagtatatagatatacaaaaaaactagattcgatgttgaaccggccgggccgtagcttacacaactcaaccttcttatctgatgtcatgtaaatttttagtccataagtgaacaaagaggttaggaaacgatcgattgagtcaaccgcgtggaaacaaatgagtgattgaatgagcgaatcgcgtgcatgatttgaacggtttcagggaactccacccgataggtgttaggcttcgtaagctctagaaaccaaccccagtgttgatagaaggaaacatacaaattgtacaaacaaccaatcgaatgtgtgtattgccaggcgagtgcacgcttgattgagattgccaatggcgaagctgaaacaaagcccccatccatgatgcaacccaggcagtgctcgtgttagccagaactcgcaagcagataggcatgcaaaacctgttttgtaaatacgtctaatttaaacccgctagctaatatatatatatttaactgcgacccaagctaccactgtataaatgaaaaaa

SEQ ID NO: 134 - DNA, 9706 bp, Aedes aegypti
atcaaatgcgcctttatgtttttctcacttatttcgtgtaagacgttatttttaagaaacagttgtgcagtatatgattgtagtttatcaaataaactgtaaggtgaataaaactcaatttgtttacaaatgacagttaagacccaacgcaatgatagtggaacggcaagggaatgcggaaccggttcgccagcatgaatcacaacatctcgactgagctgacaacgaatgaaattgaatcaacactgagtcgacaagccgattatagttcatgctggcgaactgattccgcattccgttgccgttccgctatcattgcgtttgggcctttaggccgttgttctggtactgtattgatttctttttaactgcatactgcgatcaaagaaaaatgctcttcttgagcatttctttcaagaaaattcccatgcaacgagataggcgattacttttctgttgaagtgcatacttcccataagaaaatttcttgtccatttcgttcgaagtaatttttactgtaagcggaactgctttgagttttgttttcagtgcatctgcatgatctgcatacagccgaaaaggcttttctccattcgacagcccctctcgcaaacttcagcgcaaaaccaaacgtcaaccggctgccgtcgttcgaatccgttaggttggcagcaatcatcaaccattctctttctttccggtccaaaatggtaagcgagcaagttctgcggtcgattcgctcgtaccaaaattgtgtcgaaaatggatgaaaagcggttcgagctgaagtgtaaccgattccgttgtgaagaaactgcgccggaatgctggaaaaccggagtcgtgtgatggagtttgggggtatttaggtgaaaattcggtgttgagagttctgattgtgatttttgagtgatagatccttccacatgtgtttacctgtcaaagtatgagactgaccaagctggaagcggattcttcgattgaaagttggaaattcgcgtaagctgttcgaatttagtttaaacggaaccggttctggcagatcttcacaacggaaatcgacgatgcgtgttggaatacgagcaaattgtgacgcgaatctgctgaaagggaaaacggttatattgacctattgtgttgttgttctttgattgcagaccttcacacgttttgtggagactggccgcgtggccaaatgcgccagtggaaaatacaagggaaaacttgtcgctatcgtcaatgtgattgaccagaatcgggtaagttatcttaagcttaatttcgttgcgattgttagccttaaatctctctagcgtgatgaagtattcccacagaggaaactagaagattaggaagagccgcctgattcatgtttgaagacaaatcttccagtactgaaacccgtaccgtaaaagcttccctagaagttccgtaagttgaatggtcgaactgacgggtttctccttcccttacttttaggtgctcatcgatggcccaaccaccggagttccccgccagcagtaccccgtgaaccacctgcacctgaccaagtaccgggtgaagttcccgtacaccgccaagtccaaggtggtccgcaaggcgctggaagcgtacaacctgaaggagaaattctcgaccaccagatggcaggaacgcgccgccgccaaggctaaggtaagaatcgggtccaagatgcgatgttttgtttgaggagcgaaattcaaatgatgaaccacttaataataatttcattgataggaaaggccgactgattcacacatgaagccacttaattctgaaactgttaagagaaagtagcaatctttagttctattcggtcagtttgatattgcacgcgataactgacccgcgttttgtattaaaaatatccatataacaaaaaaaaaaaaaaaaaatgaccgcgatcaaaatgatctctaaggccacctttatccttattctgcttgcagtgaatgggataaaattctaggctccagaggtttgcgcgacttttccacagattttttcagaatcttcatgctcctcaaggaaaacctaaagggatgtattctggaattctttcagggactcttcgagtgatcccgtcagaatattttccatagaaatctatagatattcctcaaacaatcttccagcgatttttaaaggatgcttagaggtttttttccagactttgctcctggaaaaactcgataactccaatgctagtacttccaggccccatctcattttccgctaaccaggcaaatacgaccgtttcctagaaagtggaagtttttggcatgattttggaccccaggaattacactgattttgttaacaaaagtcaacactaacaaattgttatgtagcctaaaaaccacatgttatatcttcattctgtagtattggtttgtattttcatcaactggttcacttgtacgagttgattcagggcgtctactacctagaaaaccgggaagggaatttcattcaatctgaaaaaaaaaaaactggaattctcagggaatttcgattacaatccgggacattattttgagtctgtaatttatgatagaatatgttcacgacaaaggattgttgcgtcaaaccccaggactaactattatttgtcagtaaattatcttgaatcgaaggaggatcttttcgactatgaattttaacgacttaccaaaacatgattgatttttttaatatctatatttctcgcataatctgtgatcttgccctaataaaagcttttggtaaccgagtgtgtagcttgttgttatcgagcaaacaaatggatttgcacgttatttaacaatgctacgatgaagagaagtttcgcttctatctcccagtggttatagttctcatcctgggccattcatttgcttagaaacgaggagatacacactcgattaccaatggctcttagggcgagatctcaagttatgcgagaattgatcagtaaaggattctcatttctagggttggtagcaggtttctttttggagacttggtctctgtataaatatgaaagtctatttgtgatgaaaagtctctgcagtctttaaattatccgaatttaaaggtctctaaagtctctttcttccttatcttgcttgaaatgcaaaatttgttttcatatttctagagaaaatcttcaggaattatcctagtggtttttccagagatttcatctggaaaactcttagaactaatacagggttctctctagaaattttacaagagattcctctaccaattcttccaacaatttttcaaaggatgcgtaaaggatttctccagaattttcctcaggaaatccttgagcacttcaacattactactttcagtaattttctcaggaattaattgaacattttttcaaagactagcttaggatttcctccagatattctttcactaacttctcaactgaattctctagttgttgctataagagatcttctaaagattcccacataaatcttccaagaaaacctgcaaagtcaattctagagtttttgataaaattcgtttaaggatattttttaaggtaaagatgaatcgaagccaaacctcaaattttcaagagcacaaatctggagaaccgaacgcccgtttgagctgaaaacttaatcgattggtcaccaccagcgagtgacccatcgatgaagttttcagcttttgaggtttggtttcgatttatcttcaccttaagagacctgatgtagcgtattatttgtgctaattcattcacggttactttaaataattattgctccaaaaattcctctatgggttattcgagtaaatctattaaaaccatttaaaacaattccctaaattcgacctgtgattcattattgagtttcgtttcaattatccttagaaaacaggataactgcaattctttcaaacattcgtcatagaatttatgaaaaaatcgcctgatgtttttcaaggagttccttcataaaactgcaagatattatccagagattcaattgatttgtttttcttttattatttttgcaaaaatctagaaaatcttctaaattttcgtcaagagatagttttttctagaaatcctcattcattaagggtagcttaagaacttaccatttgctttaggcatacgtcatgttttttttcaacaatttcgcaggttcctggaaaatttcattgaagacttccttgagaaatctcttagattactggaggaattcccgaagaaatcttatgagcattctctgaagtaattcctgaaggtaaccttataaaaattcatagttaaaatcttaaagaatttctgaaggacaattttgttggtaatcctgagaaattcctattgacatttctggaaaagtttctgactgaatagtttttaaacgggatgttctagaaaatgggagaatcaccgggaaaaatcttggaggactaagggcgttattgataaatatttgaaataatatatgaagaaattcatgatagaatctatgaggtaatttttgtggtattctttgaaaaaatccaggttgtattttgggttctatctcatttttccgtatgtcatcaccccgaatgctatttccccgacttgacaaatatgttgacatgatgtcattgatgacattttcccatgatattggaattcggggttatgggtcgttcgaggatttgaaaaacggggtaatggccttcgagttagtggccttcgcggtaatggggtagaatcgtattttgaaatttccggaacaaaattattggatgaattcctaaagaaaatgcaaatctctcaaataaagagctatgcatctagcaaacctaatgaaatcttcgaagttatatctgaatcttttggcaaatgcctgaaataatttctgataaaattccttgagaaaatcagtaatacaaacagtattttttgtcgtaatgtcacgaaaaattgaaaatagttttagaaatattatcagtaaaatatctgatctgattccatgaggaatcaaactgtttgctcctgattcctgttagttttcgtagttttttgattactgttacaatttttaaaattattggaaaatatttgatctaaaataaattattattattattattttggaggaacagttgtgcattacatgattgtaatttatcaaataaactgttagatgaataaaaatcagttttttacatttgtcagttaggcctttattctggtactgtattgaaataactgtttatcagtttatcatggtttaatcgcatatcaaagtgaattctgtgatccattgacaaacatccctcccagtaatctttgtggagatcccacactgaggaaagcaaacgtaagactgtcataagatttgcttatggaattacgacacaagaaaaatctttgaaattcataagaccatcgtatggatttcggcagatgttgtttccataatacacctcgaaggaatttcgtaagatgatcttatgaaccagcattgacatgataacaaaatccatagatagtcttatgaattacgttctgatccattcttggttccataagactgtcttgtgtaatttgagctttagattataaatttcaatgaatgaataatactaatccgcgttgaaaaataggttaaccaacttgggaaaatcaaattttcatccattttgtcgtgtcgcaattcgattaaagcactttactgtaagcattagaatcgatttgcgatactacaaaatggatgaaaattcgattttctctagttggctaacctattttgaacgcgaagaagtatattatagcagcgaaacattaatgagaaaagttgtgaagaacgcctgaattggtgcaggtttacgttaggggcggattaatggatgaggggggtttgtgatttcttacgcgtcatacaaattgttttgaattttcagtcaaaaatcttattctttggatccaattccttaatctgatcgaaagaaagtgttagttacagcggaattgatgataaatagaaaatatttaccctgcattagaaacggagtcagccagcgacaaatcagcaaacacgtccatttcggaagccatattgaatttctgatagtgaaatggctgtaccgagaaaatttgcctcacgtggttcttcacaatgatgaacaatggggttcataagcgttcttatgacattgacaattgattgttatgaaaaaattacacttgtcttatgaatctcaatctcgtcgaatgaaatacgcaagtgtcttatgaaccaacaaaaaaataataaaaaacgcgttcattagtgtgatcttatgaaaatcatgcgagatttttgcctcagtgcaccttacagcaaggacgtggccggcgccgattttgaccctttttaaatagaggcactgaattatgcacactgaagaagatatggccaatcccagccgaactctagtaacaactgttgattctttatacatcttcactgacttcggtcaatcactgtatagcaaccatagcaatgcaagtgagtctaagctaagctgaactctgaactaataagctatattatgttaatttaaataaatatttatcactattcttcaaaatgtaatgatatacgcttctttcagtcaaatgtcaaaatttaaatatacgatttatttaattttgcacaaaaaaggtatgcacccttctttcagcattctcttgttaatgctataggtaaaatgttccaattggatcaattcttccagggatgcttagaggaagaaaaactactattattttgagcgatttcacctggtgcttaattttttaaccggtagtgtgaaaaatttcatattttctgataataaaattgagtatatgtgtagttttccgccaaaatttagtgccgattgcttgtgaggaaacaaagttacagcataccaaagttgagcattttgtatgaaaatcggcttttactactattattctgaacacaactgtacatatctcgattactttttaacatattttcgccgtgtacatcgcttaaattttgaatacaaacaactcgcgttgataaactaggtagtttcaattatttctcataaaaattatggcaaaatgataagccgtttcattcagttacttagttacttagtttttgtatcagtgtaaagttgactgaagtagtgtgttgtattgattcgttttgagtcatttcctcattttgtttctagcaatttctcgagcatctccaaacactcaaacagggattatatctgcgtatttttcaaacatctctcaaacattttctaaataaaaatgtccatttattcttaatcatttcatttgatgttttacaccagcaaattcaacagcaatggattacctgctttgctttttttttttttatctttattaacgagatttttagccctaggctagttcatctcgggaccaacggctttacttcccttccgaaggaagtcgtcactacaacttttttgtcagtgactatctctgggatgggattcgatcccaggtcctcggcgtgagaggcgtgtgttctaaccactacaccaggtccgtccccacctgctttgctcttgcccacagctgatcagcagaagttttctcgttttattttgtatggggaaaggcatctaacttcaaattgctcgttaatgaaagcattaatcgaaaaaaatatttggtaggcgtgatagtcattatcattacgtatgtacaaccggtaccacatatttgttcggaaaaagttcccaattttgagaaataattcgttagatgcatttcgccataataatattttccgcgttgccttttagcgatttttcgtgcatatacactaccgcaagtgcgttactatgtggcgcgtagcgaatcagggcatgcatgtaactcatttccccgaccatcccacattaattttcagggtttctgtaatgtttttcaagaaataccttcagaaaatcctcgaagacttttcaaaattccaaaaaggattctttgagaaactcttgcaagagttctgcgagaattactacagaaatttcatcgaagtttactgatttcttttaaaatacctcccaaattctttcattttttttttaataatcctaaaggaattttaatatgagtctctggaatgacatttttaggtatttctaggaaacatcctggttgaattctggggtcgtccatgaaccacgtggtaattatgggggtacaaaacattgggggccttccttagtcgagtggatagagtccgcgactacaaagaaagcaaagccatgctggaggtgtctggattcgattcctggtcggtccaggatcttttcgtaatggaaatttccttgacttccctggacatagagtaccattatgtggtatcatcgtacctgccacacgatatacgaatgcgaaaatggacaagttaataactgtggaagcgccaaacaggctctgtcccattgaggacgtaatgccaagaagaagaagaaatatttggaattctcgtcacctgaattctcgtctaagtcaaaacttctatgaggttaattaaatttaattatttgataattttataaaaaatcaaacaattatctgtcaaacagaaagataaagattgctactatctcaacgctattccttcgctcaattccaattgcagctaaccgaacagcaactaacccaatgcattttatttattctctctccctcccaacagcgttgcaatctgaccgacttcgatcggttcaagctgcgtctggctcgttccgagcgcaaccgcatcgtcagcgcccagttcaagaagctgaagaaggaggtcgtcaacaacggtatgctgttcggcaagccagtcaagggcacgaagccactgccgaagcgacgcaaccccatcccgaagaaggagggcaagaagaagcgcgtccggaagaacaagaaggccccggccaagaagtgaacagcttcttaccgctgagtggaagggggtgttttactattacgtgcggatgtgtgtactgaagaaatgggagaatatacataattgctaaaaagtaaacaaactagttacgcttaatataggatgaaataagtgttattattcgaaaccaaaatgcggaatatctttccatttccaccgtctcgtctcgcgcagcgtcgaagtttgtcgtctgattcgatttctagggagctaaaagatgaagaggtttaacaattaacagggctggcagcagatcactctttagaggattgcattggtctctatttttgatgaaaggtctccaaagtctatactgcccatactcgcataacagtcccattcatatatgaaatcccatataatatgggactgctatgcgagtatgggcagtatatttatgactaaaatggtctttaaaatcttgttcttccttattttgcttgcagtgaattccgatgcaaaattttacaagctccagagaaacctttattacgcggttattcaactaaattttcaaaatatcttgtcagattcctcgaggaaaaccttcaggatcatcaaggtagccatgaaaatcaattttcattgtggtcctctaactcgatatcgagacaccgaatatcaagtaagggagttgactgtacttccagtaatttccctgatttcctcattgattactttggatttttttgaagattattctaggtttt

SEQ ID NO: 135 - DNA, 6680 bp, Aedes aegypti; identical to SEQ ID NO: 60

SEQ ID NO: 136 - DNA, 50577 bp, Aedes aegypti
ttgcggtcgaagtccttgcagcttataacgaccgcaccagctagacgagcgacgacaacgacttagtgcgatcatcgttcgttttcttcgtcctttgtcacctctcacatctctgataccgtttgtgtcctttattttccatcgtttactgttttgtgtggtgaacgtggccaatttcaaccaaccagcagcttttccagtatttccgtcttagttttgctgcctaatttgatttgagtccgtggaagaaacgactcacctatccatcgaccaccacctccacccacgaaaagctgcaaaagtgcaagaatccaagggcgcgcgaggtgtcattgcgcggtgtgctgccctaagaatatattgtgagaagcaaaccggaggataagcgaggaagaaaagttgtagtaatcaaattattcagtgttcacggtggtgctgctgctgcaggggtgtgtagtgtaatagtaaattgtgataatacaaaagcacgggacaatcgggcaccgaacgtgagtccggtgttggagcccatccccgtttagtcgaccaacggagccgccaggagcagcaaagatcccgcggcaacgcgatcgtcaaagtgtgaccaccctcacactcaactcaacacacgacaccacaccacaaccatggagtgctgtctgtccgaggaggccaaagagcagaagcgtatcaatcaggagattgagcgacagctgcgacgagacaagcgagatgccagacgagagctgaagctattactattaggtaagtggcttgttttttccttattttttttcttcattgccctcagcacatggtaatttactgaagcgcaatccgcgtgagaccccgacaaatgaacacttttcaattagagttgagataattgcgttccagcgaatgggacctaatttgattagcattgatacggtgggactagcgagggccgagatagttcgaacttcttaatggttttcgagcctagtacagcactaatcttccaccttcaacgttacgttgaaaacaagaaacgaaatttagagaaacttatagatttcgagtgcgattagaccagtttggtaccgtaaaacggggtgaatagaaaaagtggggcgaatacaaacaaagtgacctacaggtagaaatgcgtctattatgtaaagataaacttcaaaaccctactgaaatatatttttttcattagtgcaatagtaacagtgtatcgacagactattttcaaatcataaattttgctacattttgcttaaacaaaataagaagaaaatattgaaatctcaaccatttttgatagcttgaaacatccgccatttttgacaatttgcaacatgatcaaacattgaaattgtttttaataatttcatttttttttcttcactaggtaatttcgttatgatatttctttaagatgcactcgaacaaatgtttattttcccatttaaatgaaaaaagtattgatatttactgaacagtgtttctattcgccccattgcgaggtgaatagaaacataccacattttcacaaatatttgtacgaaataatttttgttttttaacggcaattggggtctcagctaaggaaaacgggacccatatttgagagtaataaaaatggttttatttacacgatttaagttgtacacattcaaacagtgtttctattcgccccatttaacggtactcaataatgtacgtttcaagccattcctttcaacattcgtactaagtggttgcagattaaaaaaaaactgattccaggccagagcggataaaaataaaaaaggatatgtgtatgggaagagaagaggacatttggaagatgctttgaccactgtgacttcttgtcttagacaagtttgctgaatattttgccacccctgaaaacattaaacaatacacaattgaggggcccaaacgcaacctcctcaattatatttaactatatgacccaaactttcaaaattggttgtgttgagttgttgctttagaattgaatgtctagcactttgatatgtatatgtatatacctgattaagagtcaattaagttatgcaatgctcttgcgcaagctaacatagaagtaaattaatttcaagcaataaaataatttccagctgtacaaagttcaggtaatgcatgtaatatgctttttttttttggctatagaagattgtaggattttttatttttgaaattataaattattttatttgacatttgttccaatgtttcaacattggatattctatgtaactcattggtactatacaagggagaaggcttcagaatcattttcaaaattttattttgaatcctctgcttttttcctagtattacaacagctagtccatattggtacagcatacaacatggctgacctgaacttatgtttgaatatcaaatgcttgttcttaagacaaagttttgattttctaataataaaggtatagagacatttgacatatttgttacgtttggcttgaatgccctcaatgtggtttttgaaagttaaattcttatcttaacttcatctgatcaatttattggaacccctctcaacgtgacaacatgtctacttgaaggtttcaaataaagagctttgggtttatgtgggaatattattggttgagttctggaagcattaggagaaagaaatcttccatttctgcaaatatgaagaaaaaatacccaaacttttttgcaatcgactacagatgacacgcagacttcttcctttggcggagaggcctgtgtcattcgcaaacaaggattgtcgacatccctgaggtaactcaggtaagtcagatgtgaaactattgtataatattggtcccaccaggaacaccacctcttacaggaagtcttccagacttagagttctgataattaacctgaagtgtacgatttgacagataactttgaattattctaacagtgtatgttggaaaattaatgtgttttaattttctgatcaagccttcataccaaacactttcgaatgccctttctatgtctaaaagagcaagacaagtggaatagccttcagatttgttggaacggatcaaatttgttatacgtaaaagttgatgagtggtcgaatgtccatagcgggatccgaactgttcattggcaaaacatgaattttcgttgatgtcgaccatcattctgttcgaaatgaccatttcaaaaattttactgaaggaggaaagcaaactgattggacgatagctagaagcttctgcaggatttttgtctggttttaaaattggtacaacctcagaatttttccatttgtcaagaaaatatgctaattgaaaacatttgttaaatatatcatttaagaatgataagctactttctggaagtttcttgatgaggatgtggaaaattccatcatcgctaggagctttcatatttttgattttttaataatagttctcacttcatccaaatcagtcttccaggaattttcgaaaacgttcgcttgattgaggttgcaaaactgcatagcaagtttttgaactttttcgcaattagttagtaataatttgttttcctctttccggtattggcttcttaggtttttttttcaaaattttagataatttccaaattgttaaaatcgtatttaatttctttcatagccatataattttcatagcaggatccgcgagtgcgttgaaattgccttctcctcacgatttaagacggatgaagagtttaagatcatcgtctatagtcacggattcaaattctggaattgcaatgctagtggcatcaacaatggaatttgttaaagtttcaagagcattgtcaatatcaagttttgtttgtgatgaaattttaacatcaagattagagtcaataaatgttttgtatatattccagtcggttcgaaaataattgaaagtggagctgataggattaagaatcgcttcatgggatatttgaaatataacaggggcatgatcagaatcaaaatcagcatgagtaatcagttggctacaaagatgactagagtcggttaagatcaaatcaatcgtagatgggtttctagaagaggaaaaacatgtagggctatcggggtattgaattgagaaatatcctgaagagtactcatgaaataaaattctgccgttggaatagctttgtgaattataacatgaccgatgtttggcattaagtcaccaatggcaaaaaaatttgacttattggagaaaactaacttgttgcccagagctaaggcaaataggcagctatgaaagtatatttaccaagctgtgtttcaacagaaacagctaaagtttcaaaagctttagatgttttatatgcttatgaatgatgattccaattcttccacatgccccatcaattcgatcattacgataaacaaaatagtttgagtctctgttcagtttggatccaggtttcaaaaaggtttcagtaataaccgctatatgtatgttattagctgtaaggaaattaaacagctcgtcctctttaccattcaaagaacgagcattccaatttaaaatacatatgtaaattattatttattggaaccattagaaaaacgtaataacaatttgattagtaaattttacaccaacttggactgcttcagtcatagtggtggttttgaacattgcatcaatcatttgtttcaattgttcaattagaaaaataaaataagagggagatatatcacttgaagtgggtacattatctgatgattttccgttagaattttcggtagacgaagaggcggagtagaagtttacttaaatataaaataagtttgtggaataaatttagtttgtgaatgagcatgattgtaatccacatgatgggtatgattcctattcaagtgatcgttagctgaaaaatgatcattattcgatattctactaggggaattccgggaacgaccgttatcgtaacggacattaccgttcatctgccttgcacgagcctcgacgactcgcctacgcgaagggaaagcccactggattagacttatgattgtccccgcattttgcgcatgtgaatttatcggtatcttccttcacatggcagacgtccttagcgtaagaagaacctccgcaaatcatgcatttagcatccatgcggcaattttttgtttcatgaccccacttttggcatcgacggcactgagtgggattctggaaatttcctccaggtttctggaaatgttcccatgtcacacggacatcgaacaaaagttttgctttttctaaagctttattattatttagttcctttttgttaaagtgaaataaataatattcgtgagagagctctttccgaacaatgccagattaggttcttttttttcataatgattacttggacttaggaaaatccaagtaaatcatttataccatttttttgatctcttcaggtgacttatagtcacttgagagacctttcaagacgactttgaacaaacgttcagttttgtcgtcataagtaaaaaatgagtgcctcttttctccaagatgtttgagaagaagttcgcgatctctaagagtttccggcaaaactcgacagtctcctttctttgcgatttggaaggaaaccttgattcccctaatggagtttgagatctcctgcctaaatccccccaaatccggaacaacctgccacgataggcggtactctttgctcctcacttgaatcaaagtgcctgggctagagacttcttcgatttggtgttcggaaaatttgtctaaagcatcgaactgattgcccattacgatgcaattatcaacattaaccatttcacccttggaagaaagtgcgcatccctgagaaacgtcttttcttccattcttgccacgtttggtgagagtaaaactccactttttggaaggaagttgcgaattccttcacccttcctttcgtttggggggggctagattgtttagtgaataaacgaaagaagaaggggccttccaagagagttttcccaagacggtatccggttcggttccaacgaaaaattgaaggcacgagtcctaacaaggatcgtgaagggatcaatagtagaaaaaatagtactgaaaagtactggtttagtagcactgagaagcactgttctactactttaggtaccgtaatccggggtaacattgatcatttttttgaatatttcttatatatttcgtttgaaaatgcaaatgttgcaaattttatatttttaaaacaagtactgccacccatagctcgtgactatatactgcattttgttttttgaaagatttaagcatgttttaaaaatgtttaaagtgattttttgatttagctgatatggggtaacattgatcacctatgtaaaaaaacgttcagtaatattgaaaatatcgttacttacttatatcatggcccccaaagccgaatatgaaggccaaacgcttacaagtcatttactttttgagttattttaaaattaaaaacacttcgaaccacggaatacgcctaaaggtaggcaatttcctaagggaatcctatattgtttacagtaattcgttaatgttgcttaattgagcatacttataaaagttttgacaacggaatcgtttcggcgatgccgtttttagtaagaaccacattttccttgctcatatcgtttgcaaaacttatgtgagacatgaatcttcggtagtgtcatcattacccattgaaatcattgtttcgaaaagttgacaaatttacgcataatgtaaaagtaatttccgcaaaaatcctcacttacattagcttatgaattgaagaaagagaagcaccattcgtaatttggaaatgttccatcaataaatgatgatacgaactttttacgaggtaagtcataccgatcaatgttaccccgctgatcaatgataccccggattacggtagttttaaaaacattcaagagcagcgagcatttgtgtacgcacagcacgaaggtacgatgcgcactgaatgtacaaagctttcgttcagcagatcgtaaaggcttctttgtaaggcctgcgagccgacctgaacgactttgatctagttgaacgacatctgttccaactgcttctatattgcccttagtctaaccaaatcgaaactttagcattgagatcctcttgtggtcttcatagacctccaagcaaaagcattgtctaggacgtcgttgcactatgactcgtagtatcgatggctttggctaaatcaaaggtatccatggaattgaatcgcattcaattcagtaaacgcaaagttagcgaagtatattcaagttttcaaattgtttgcagcgatgatcagataagaattccttatttgacacatgtcgctttgtcaattgtttaagaagagagtatctaatacttattttctagcagattcatattatgattgatccttatccacatgttcatgaaactagatatgaaattaactataaacatacgaatttcagctcgagtatgtaaatctgttgcatcctcatcaactgtcctatatttgtccaaatctcaacaaccccgcttattgagactgtaagatatggcctcagtcgtattgtatgcactacaaacttgtgctgccggaacgaaactacttcgtcttcctcctcaattgccattgtaaagcattcaagttgagtcaattttttcgttgattcaatttgtaatgcttccaataactgcgtcctgcaatactcttatttgcaccattttatccgttgctttgctcgtggtgaacttcaaacacaaacattctaggctttcaactccaggttcaatcactctattatgaaataaaaaaaacaaggtgcagtgtaaattcagaatagtacaacatagtctccgaaaaatcgtgcggggagaaagtgttcgagatgagagcgccaaaactcgtcagaagttctgactcagaacgcttttccttagtgtacacatacatgtgctcggccacaccaaacaatacaccgaaccaaagcgagccgtttctcgtcggtggatgagaatttgcagcgagagattctcgaatcgaaagttttcccttttttcgggagtcttcttttcatcgtcgtattaaaagtaaagtcgctgctcccaaaatcgagacagactgaaaaaaaggaagaacgtgcaaacgtgaaggcaaattgtttctggtgtggttcgatatcagctaagaaaaaggagccaagcaaaaggcaggggtttgcaggcttatcagatggcagtatgatacacgacttttttgcacagtggcctaatggagaattatgagacttatgagaatttgggtcgttaataagacccatgcggagacggactctcaagaccacctcactaaaattttgcattttcgctgaaattctgtgtttttatcatattagtttagtgattctgaattttaattaagaatagaagatcattagcattcatacattgggggtgtctgttaatcacaaacatttatccggttggttccttgtttaagtgcagctggtctggtgatactggagtagcaaccacgggcggcttacatttcagccatttcggattactagaaactaagatacagattccaaacttggacattttgtatgggaaaacaatatttgattacttactttggtaattactgtatatagaaaatttaaggttcttatatagtttttgtattgaaattttacatattctgtattaattcctaaattttctgtatttgtgaagatattatttagattttgtattagggcttgttgtgggtgtagatccccttgacgtgtttgctccgcaaagctgcacctgaacatcccatttgttgcaaaaagtatattgcaaacagtgcaggtgcgcatgtgctgctccagaaatacggtatgctttggttgtttttcccagtcggaatactgctggaacacaaccaactaccagtggagctgatgatgattcgctgtggctccattgattccagttagtagctccttatgaagtgatgggacagacctccaaagtcaatacaagactagttcgtaccttccgacgaatgccgtttatgatggcttggtggacgaaacgggatgtgatgtgttctaacagtttggccagggacgttgaaagactagtgaatgaaaaatggggctggtggaaaacactgccaaacagtggacaggacgaaatatcatgaatgactttgcgcttcggtgggaaataattgcgcggaaaaggtgcccacttgggcacgttttgtgctgtattctgttttggacgccgatgtatccaagccggtctaatatgatatgcatatgaccatccatcgggttacgtatacgaatgatgcggtcgctggcttttggttatcgattaccaatcgattaaaggaagagtatgttctgttaaggttaaagtaataaagtatgccgttagtaagaaaatatatagtaaatcctgatacctattatgaactcaacaatttcaagtagagacctgatagaatcaggcattgcagagttcgttctcaattgatttcaaagcacgatcaaagcaagttagcttagcttagactgactacacatatcaatagttgctattccgtgattgaccgaagttcactgacttgcacaaagaattaactagaagttcggctgggattcgccataatcttcttcagtggaaaaattgccaactaaacaaaactgcttcaaattgctttcaagtttctgaacaactttgtagaagacacgaactttttaggaggtcaagatcatgagctagagtctactgcaatatgtatgaccaaattacatgcacactagcgccacgtcgcggcaaaattgcgcatcaataactccacctaatgtacgccataaggctgttgaacaactttgctgaagaccgcaactttgcagtaagtaaggatttcgagatactgcatcataaatattataatttttaggtgatgcaaaacttttcggggtgctgcaatattcaactgtggtgttgcaatactttttttttaatttctttattagtatcattccaaacattgcattcatttcttatatctaggtgttctgtgttagacaacactatcatcctaatttggtaaaacaaatttaagatgttattaacattttgttaacaacatattacatttcatttgccgtagcagttcagattttttacaggtgagttgatttcacctgcttatatgagaaaaaaaacacgtgttcaatttacttaacttaacttaacctaaatatttctcgcataacttctgatctcgccctaaaagccattggtaaccatgtgtgtagctcgttgttactgagcatctgaatggattttcatgttatgtaataacgctatggggaagaaaggatcaatatctacctgcccgtgatgttggtttggatgcttattccttcattcgctcagaaacaacgagctacgctcgtggttaccaatggcttttagggcgttatctcagagtatgcgagatttaacgcattaatcttggcaatagaagattgtaacgatttttgcctgaaattattagttattttatttgacatttgttcccatgtttcaacattggatattctatgtaactcattgatactatactaggagggaagcttcaggagggagcttccttcctagtattacaacagctagtccatattgatacagcatacaacatggctggcctgaaaatttgtttgaatatcaaaagcttgttcttaacacaaagttttgattttctaataatagaggtatagagacattttacatatttgttacgtttggcttgaatgccctcaatgtggtttttgaaagttaaattcttatctaacatgagccctagatacttaacttcatctgaccaatttattggaactcctctcattatgacaacaagtctacttgaaggtttcagataaagagctttcggtttatgtgggaatattattggttgagttttgaaagcattaggagaaatcttccatttttgcaaatatgaagaaaaatatccaaacttttttgcaatcgactacagatgacatgcagacttcttcctttggtggagaggcctgtgtcatccgcaaacaaagatttttgacatccctgaggtaactcaggtaagtcagatgtgaaaatattgtataatattggtcccaaaatgctgcctttaggaacaccagctcttacaggaagtctttcagatctggagttctgataattaacctgaagtgtacgatttaaggtgaagatgaatggaagccaaacttcaaattttcaagagcacggatctggagaaccaaacatccttcttcttctttctggcattacgtccccactgggacagagcctgcttctcagcatagtgttctaatgagcacttccacagttattaaccgagagcttactgtgccaatgaccattttttttgcatgcgtatatcgtgtggcaggtacgaagatactctatgccctgggaagtcgagaaaatttccaacccgaaaagatcctcgaccggtgggattcgaacccacgaccctcagcttggtcttgctgaatagctgcgtgtttaccgctacggctatctggaccctcaaaccaaacatccgtttaagctgaaaacctaatcgattggtcaccaccagctagtgactaatcgactaagtttaaagcttaaatggatgtttggttctccagatccgtgctcttgaaaatttgaagtttggcttcgatgcatcttcaccttaacagataactttgaattattctaacagtgtatgttggaaaattaaactttttgtattttacgatcaaaccttcatgccaaagactgtcgaatgcattttctatgtctagaagagcaagaccagtagaatagccttcagatttgttggaaaggatcacatttgttacacgtaaaagttgatgagtggtcgaatgtccatggcggaatccgaactgttcattggcaaaaaaatgaattttcgttgatgtggatcatcattctgttcaaaatgaccatttcaaaaagtttactgatggaggagagcaaactgattggatgatagctagaagcttctgcaggatttttgtctggttttaaaattcgtacaaccttagaatttttccatttgtcaggaaaatatgccaattgaaaacatttgttaaatatatcaactaagaatgataagctactttctggaagtttcttgatgcggatgtagaaaattccatcatcgccaggagctttcatatttttgatttttttttaataatagttctcacttcttccaaatgagtttcccaagaattttcgaaaatgttctcatgattgagaatattttcaaagtccgtagtaacttgattttcaattggactagtatgtcctaaattaaaattgtgtgcgctttcaaactgcatagcaagtttttgagctttttcgcaattagtaataatttgttttcctttctcaatgccggtttaatttccaaaagggcttagagcccgggtccaatcgagatattttattttcaaaatatttgtttgttaaatgtgaaaaacgtgttttgatttctttctgcagatcctgccatataattttcatagcaggatcgcgagtgcgttgaaattgccttctcctcacgtttttaagacggatcaagagtttaagatcatcgtctataatcacggattcacattttggaattgcaatgcttctggtttcaacaatggaatttgttaaagtttcaagtgcattgtcaatatcatgttttgtttgtaaaaaaatgttaacatcaagactagagtcaacatatgtttcatatatattccagtcggctcgaaaataattgaaagtggagctgataggattgaggatcgcttcatgggatatttgaaacgtaacagggacatgatcagaatcaaaatcagcatgagtaatcagttggctacaaagatgactagagtcggttaagaccaaatcaatcgtagatggatttctagaagaggaaaaacacgtagggctattagggtattgaattgagaaatatcctgaagagcactcatcaaataaaattctgccgttggaattactttgagaattattccatgaccgatgtttggcattatggggggtgttgtaatactaggtgatgcgattccatatttatggtgggtagtgtatgtaaatataattaatttataaataagaattcatgccgacactcactgtgacgaaccattcatagtttattaaaaaattacagatttaaaataaaggcttgaaacgagctcaccaatcgatcaaattttttaacgcgaattgatgtcaggttctgtagatctatgaacttgaaaattcgaagtttggcttcgttctataatcaccttaactgaaagttttctttgttgtactactgtactttcctattgctcatgttttctgcaatcaaatcaggtatcagaaggccggctccagaggcacgttccccgtcatttgggagatttgtgccatcgccatatttgagcctatttcatcatctacccgatgggagaggaaagggaaggggaagatgggaggaaataggagtggggtcccttgaagagggaaaatcgcataagcgaattaagagcatgtagctccataccacaatgggttcgaacagcgccctaaaaagggcactgcaaaacgcatgagcgtaaagagagcctatagctcattaccacagcgggttaagaataacagaaggtcctgaagattcaggttactgaaatcagtttcacttaataagtggttaccaagtaattggaatcgcaattacgcgagaacttgacagttacatatcaggtgataagaagttccataatcggaatcacaactatcacacacaaatgtatcaacacactgaatatttgccatgtgatagttgagtcagcagtggccagttaaggttgtaaccaagcgactgcaattctgctttgacagatttgttaaatacttccccacctttggggtggctcagtaatgtacagacgtccactcgtcccgcgaagggagttgtgaggaacatgtcctataagcaaagtgacaagcaattttgagatcactcgaagcaaggacaattgtgtcccaattcaccggaagtgggaacatccaaatcactaggatttccaatggacggagaaaatccatggaatttggtcacaaccaattcacagtttgtggagtataacaaatgcaaagtctgcgaatttacattcttatgttcatatagagatgtaggcgatttcctactataagtaatccaagatttgaactacttaagcattccatcagactggagcttctcaaattgatatctgagctgctccagatgatgtgatgagtatcagcatcactgcccacaatcagcagaaggccttttcatagacagtgaacgataactcgtttgaaatcatccattggggatggttcatcatgtggtaaatacaccacaaaacgaaagacgtatttcctattgaggtcacatacagaaatatcaattgtgacagcacatacatctctggttgttaaatcagaaattagtgtagcgacgtcagcgctatttacgaccacgcatgcacgaggcatggcacgcgagtatgccatttcatgtttttgaaagtagcaaaaactggatccactaggttacctagataaaagttcacaaaagtaaggtttttgaactagcgccacttgagctgtaccatttgcatgagtctacaaagattgatcgttgctgacattttatgctggagattgatctaactaagctatcctagccgtagccactacccaaactaggcaggattaagcttttcgcaatctcagaacgaaaaagatcagcaacaaacaaaaaccagatcggtatctcttaaaagtcgccaaaggcgaaaagcacagattacactgcctaaaacgcataatgcgaaaccatataggtgaaaatttaaactaaattacaatgtattaataatcccacccttatttagcctcaggcttgagactgaagaagggcagccgattatctcggagaaacacaaggtcacctgcaccattgctccgggtagcacaggaagggcataatactgtagagggcgccctggaactccacaggctccgtttgcggctaggttttatttagacccccctaaccattcattcttaggcacggtaagcttaaagccgtatgaattaggggtcacctgtgaggtggacttttaccaccggaacaggcagtccgtagtgttaattcttagctagttgaaacaaccgctaccgacactacgcggctatctaggctgatcgggaaaaggaagttaacattgatgattaactcctgacgtgcccaaacagccggaaaaaaaaacaaatcaattcaaatatcgtgccttaatcttccaggcccataactgtaagataacgcttattacaataccataataaaatgttttaccctccatcaagaacaaaagcgacaaagtatctgagaggtgacattgtcggtgtttgttctgtccatgtatcgctcaagaatctccaaccgaggccaccgatctacttgagacagtagtcccagtagtgtgcctgtcatgcatcacttgagattatattacctaggttggaaccctctctctgggtatatcgcttttcacgacgattttcgcacaaatgcgcccgaccgtggtgtcttatttgccaatatcatttgtttgcacctcattgtccgctgcgctagcggcaaccgacgcgggcgcgcttcttattagcgccatcgaacgagaaatcgattagtgcgcgcggcattgtgcattcaaccaacctgctgatgtgatggctgtatgctaatgatttgtttactatgctgttgttttgttgtgttgttgctagctgttcgagtgactggatcctagggattcacaaaccttcgattaagttcgtatgtttttttttcagttatgatgggctaaccatgtttaagtttttttgtcggatgtctgtagaaataatagagctagttgtaatgggttgaaaattaaaattgctgaaaaatattggaagctcgtgttttatatctataattcgatacagctattgttttgataatggcattgtaaaccattttgaaacttaactaaagggggagctcttgatcggggtttgttttcaggacgtaagttcgaatgttagaaaaaaaatttcttcactggtacgattaggaggcaatcaaattgaataactagcaaagatattcttaacttaagattcttaaattcttaactgcatgttgaaaatacagtgaaacctccatgagtcgatgtttcatgactcaatatcgactcatggaaccatactagaaacataatttcatggttactatgatggtccctagagacatctttccaaaggattgctgttccatgattcaatatttccatgagtcgatggtccctccaatatcggttcattgaggtttcactgtatggcgttttaaagaaagtctaaaaatcggcattttgaattttggtggggacgttgttgagtagttgcgctgttatattttgtgtgtcacagaagggaaagcctagctctttatacacagcatcagcatggtgtttctgtagccaaaagcgtgacaacgacaaccgaaaggttaaaaaaaatgtcaaaatgcaagaaattatgaaagtatgtcgagaaattctctagagtgaattgaaaataaatcatctttcttattcttggcctaaaacctccaatgtaacaaagaatgcttctcatttttatgaatattttcagtgatttaatctgaatgttttgccaacatgtcgtgtatcatttgtaaatacttgactctatgatattttatgctcggggtggtcgaggaaactcacaaaaaaaggatcttcaactggaccggaaataaagccacttaaagaaggagtacattgcacttaccggttttattatcggatataaaagtacacactaaatatcaaatacataaatcagcgaaaactctatttaagcgctcatctgtagagcctcttatatctcggctctacatttcaaaaacattgaaatggtcatcaactccctacggccccatcgtcccctgtatttttgaattggcggtgttttattttttcaatacaggtcggagactcgattatccggggactcgattatccagggttcgattatccggaatttgtttttgatgttcttgtttttcaatttttatgcataaatctgagataatttggtattgcaataaacaatataaatggttttgcagtttagaacaaatttatgaaaaggggggtttgaaaaagtgtttatttgtgtatgctggccattttttcttcttgtaaagacccctactgtccctaggttacgcccccgcatcatataaataaaataacgaaatagataatatttaagttcttttatcaaagttttattttttttttcttagtgattcgattatccggaggtttcgattatccggagtgaaaaaaaatcgatactccggataaccggtataagaaaacaaatttatttttttctgggaataattgacaccgtaattcaataaaatatattcaaaattcagaattttcatatttcaaaactttaaggacttctttgacttcaacgatcctctctctggttaataactacgccaaaactcatacttcagcaatgtttctagctcactctgcaaaaggtgaatcagtttttttgtaataatgcgaagatagcaacggaaatatattatacagtgactccatctcattttcgtacggggcactatttccacatcaagtaggtttaacactactaaatgatttacggacttcgatatacgatatcaattacgaaggtcgtaggtgtcatctattgctcggcaataacaaactctattcattcgctgaaatctttggaataatggaaaagtattgaatttgtgtctaaaattgagccaatcccaaaatcaaaccttcaacattcaaaactattttttatgtgcaagatgattaacaatgattaatacgaatacgaatacgaattaatacgaataccgaacgagtttcaaaaacttatgatcagtttacgaggacttactagtggatatcggtatctcatatttcacaattttggtaaatataacgtttataaaaaatctaaaaccaaaagttttagtcaatttctttcagtttcaatccaaagataatgttcctatctaaaaattgcgcaattattatttttatttaatatttaactaccaaacattatcatagagattgatagaataaatattattgctgcaaccgcatcacatgcgttgtttgaaatgatgaaaacaacaggttatgttctagtaaaaattatatcaatgctctccgctcattctgagtgtattttgtatttttgtatttttattataaaataaataaaccgtataatagggtccttttttgagtataatttgaatatgaattcaaaaataattgaatattgagataacaccaattatgtgaaggtatgtactgtatagtatagggtacgttgttgtaaaacgaagttcttattaaagattctttctacagtcaagtttgaaattaaccttttactgttgtttagaacgaaaatttggtttacattgtttgaaaatagcattttagaagagttttgaagttatgacataacaattttctaaactcaagggggataaaacactttttatgatttctgttatctgaatatgtattcaaccaaaactctttcagtgctcacgaacatatattttaggttgaatcctacaacaaaaattaatgcttttgctagaattattggattttatagcaaaaatcattgaaaaactggtatttctaatgattttacctaagtttcatatatgtccgcttataaattgtccaaatgtactctacaacatctgaacaacgtaatatagcacttgagcaatcaactagagcattaaaaatcagttttaaatgttgtatgtttaaattttgataagtgtacgaatatgagattgggtgaattttagacataaaatcaatacttttccattaatccaaagatgaatgtaaatggaaacattttatgactgttaaataatagatgacacctatggccatcaatatagataaagcatttcaaattcaatatatcatttaatagttttttacttacttgatgtgacgccagtgtcctgtacgaatatgaaattggaccactgtagcattagaacatcaatgaaaaattattatcaatttctcgtcaatcgactagttttggaaaatatagaaccagagattttgtaatccgtgttcaaaatatggaaacatacatctccagccgatgctgattctatttcgttggcacccatgagcgaatttcggaaaacttggctaaaatgaaatctcgcgaaacattactaaaggacctatgtacaaatgagaggttctctcctctctcgctgtctttcgattataacagtggaatagtaaagcttttggaaagtttttcactacagatcggaaggcaatttccttgactagcgtttcatacaaaaaacgcaacagaagaggttgatgtgactcacttattgatcaaagagagcctctcatttgtacataagtcctctagtaatgtttcgcgagaaatgtttttaatgtagtgctggcatacatgtaatccaaacatttgaaagaagaatttcattttctgacataacctataaaagttcctacggataaaacatactcatacataataatatcccttattattcttatgtaatctgtatttatttatattaaaaatattcaattctgaaataaatcaatttttatccgctcagccgaaaatgatcgcaaataaaggatcttgcttgttcgttaccgaaaacaagaaaacctaccaaaacgaccaaaacaagagcgccactgacagctaagaatcatatatgtattggtaaaaagagtgcattatctgctacacccatttcgatcagggtgtaggattttctgcaccggtggcgatcgagtgtaaaaacggtgcgctacctgcggaataaaagaacggttttggtgcaacttttgctacaccggtgggaaaacggtgcaggcggtgcaaataaagaaaaacgacattagtcacgtgctttgctagatgttcatcctacaagcatcaattgttcattttattagcaaagtgcaggtaaaggaaacattacatcacatacattgtccacaataaaaatatgtgaaaatattgctatcttattccgaattcgtgccgctgctttgaaaaacattccttattttgatgttgtgtgaaaaaactgcatatgaattcattgttttccattggaaacgggatgaaatccacgaagtatttatttttccgccacatctccaaaaagcaaacaatattgtgccataatacatacttatgaaactcaatcatgtcgtttttaaatccaagaatgcaatgtcataaggtagatatgataacatcttgtaacaatctgtctaagtgtaatgcaaaggagcaaaaaaattaaggatttgtattgttttctgctatttcctctctaggtgcctttttctcaaacattcttattatcgtagctaacacactgaaaaattaaaaattgcttaaaatacgttcaaagtcgctttgccattattactggtacacccactatcactggctcagtcaccctaattttgggaaatttgttcgctatcgtttccaaataagtttgtcatatgtcttcatcttcagcagtaatgccttttcagggaaacaaatataacttttctaacaacgagataagtggctgtttagaaaggaaaatgttaaatgcaaaaagaaccatgtaagaactgataagtaatcggcatgttgcaagcctaagtgtaaacataaaatcgaattgataaaccaaatactcccgcgccgtgtcgtgctccgcaatagctttgcgcttgtagtgatgattgttgaattcaaacctgtccctgcagagattcatttctctgtaagcaatgcacaatagctgtagtatatatctgttatcgctggtctttttgccaggggcttcacgaatcgtattagaatttaaagctccgttgcatgatcaatactttttagatccttgtcatgattcaagcgagatccttggggatttttacgagatcatagcggtatctcattaaaatcttacttagattactagatacatcataagtagtgcagggctggagcaggtctctttttagatacttggtcattatttttaatggaaggtctctcaagcagagattgaatttttagaacattgagataatccttcacttatcgcgctctgtaacaatcatgttccataatatatcatgagaacatgtttatcatcttctaccacagctctgattagatcgtcggggtaacagtgcatgataaaccccgtctaaacaagccccgactcctaggggacacttttgctatcagatgttcggggactgctttttatggcagtaaaataaaacacctacccccaatggtaaacaggcgagaaaaaaaaaaaaggtttcatcatcggtctctctctttggagctctcgatcgctgctgtaatttatcaagcttgttatgaattgcgatagattgccgatcatggagcaatacagatgggatatttttcttcgtttgttttgatcgtgcttcgaaatcatatgagaacgaattctgcaatgccaggtctttattttcactttttcctcggcttgcaatgtataatgatgcgaaaatctagagtctccaggaaaaccttccgagactattacgcagttattttacaggaaaatcatccgcaagtttccagcaattactccggagatttcttctggaatacattctgggactcttccagaaatctttccaaaaaatcctctagagattcatccaccaattctccttgaaattctcgttgggatttttcatgggatgcttagaggaatttgctccagaacagtttaaagcattccagtagcattttaatacttgtggattgtgtgttgtatttttccatcttattcatatggattcctctaaaaatttatctacggtcactcccaggagatatctggaaattcctccagagattcttcgcataattcttcagggaatcccaatgtttggagcttgataaactggttattttataacttacacaagtattatcagagttttctttagaatttcatttcaagatacctgtcattattttatttttcaataattcctaataaaaatgtttataaattctttgggaaatcaaaaagttactggaagtatgccttaaggacatatctggaaaaccgaacacccgtttgagcttcagcttttgcagctacgagtaaaaaatgacacgtttgcaaataatttcttacgtcctcatgagcaatttaggtacaacttgcaaggtttttcatggacatgaaataatttagcacttgagtcagttttgcgattatgcgtatttcatatgtcatttatgcacattacagctcttttgaacaaggatcagtttcccttccatatcaaggagctgaattgtagggctgttacaacagtcgctaatttcgtggatttcgtgattttcgcggatttgtagcggatgccaggcgcgaaaatcgcggatttctcaaatcgtgccacaaaaatcgccaataaattgtttcgatacgacaagttatgcagttcaatcattaggaaatttgtatttaaaaatgttaactctctcatctcattgagtgctgtaaagtgcacttcataattaagtcactagggcccagttttgctgtttagttattaatttttgcaggtatttttttgttttcctccaataatttgaaacatttcgaatattcaattctccaaatgaaacacagtgaacagaaaaactatttgtgaattttcgatgatccagttttgaaaaatcatggcagaaattgcgcattctcaatattttactatttttagccattacaagtgttttgcaacatgatttagggtggaaggctctagtttgggcatagtcacaattttttgattgttatagtgcaaaattctaacaaaaatgctgtttttcatacgttttttggctctcaacattttcaaacaactatcgtttaggcaagcttaggcaagaagagtcttcttcaatcgattccttggtcttaaacgcacgtttgagcaagatatctccgaggggagtggcgggcagcgatttgtacggcataaagaagctcttctttaaatatttgaagtacatacgacaataagtacacagttaaaaataatgaggattacacgtcttgtaaacttcattcatgcgatgtaaacatgacatcatgtaaatttaagtctgaaataatgtgaaaatgtgttatatgtcatgtaatcactcaggatcctgctggattgcatgacatataattgaagtttacatgacatatcatgtaaatatcaatgatgttccacgctccaattatgtgcattatatgtcacagaaatttacacgttttgttcgaactgtgtattcatttaataagccacgaagctccctgttttgaatcagtaaaagctggtatagtaacctttgaaaacggacatatcgatatacggtggcgcatttcgcatacagacataatggacataatggacgtttcgcatatagcaagtagcatttcatacatgacataaaattcttactgtgtcaaatgtacattatgccaaacgtccatatgcgcaatctaccacccctcctcttaagtacatacagtactggacagaataaattgcgtttttcatacaaaatggtctattttggaggtctgaggtgaattattgaaaatttcttatgttgtgataaatggcatagtgggtgacggattcgcgcgtttttgttgccggagattttttttccccctgttttggagcgtcttgctgggtagtgcttcgtgaagcccaagcaggacagttcggttttgcgtcgtccgattgattttgccgacggattcgcgcgttttcgttgccggagaatttttttccccctgttttggagcgtcttgctgggtagtgcttcgtgaagcccaagcaggacagttcggttttgcgtcgtccgattgattttggtgacggattcgcgcgtttttgttgccggagattttttttccccctgttttggagcgtcttgctgggtagtgcttcgtgaagcccaagcaggacagttcggttttgcgtcgtccgattgattttgccgacggattcgcgcgttttcgttgccggagaatttttttccctctgttttggagcgtcttgctgggtagtgctttgtgaagcccaagcaggacagttcggttttgcgtcgtccgattgattttggtgacggattcgcgcgtttttgttgccggagaatttttttccccctgttttggagcgtcttgctgggtagtgcttcgtgaagcccaagcaggacagttcggttttgcgtcgtccgattgattttgccgacggattcgcgcgttatcgttgccggagaatttttttccccttgttttggagcgtcttgctgggtagtgcttcgtgaagcccaagcaggacagttcggttttgcgtcgtccgattgattttggtgacggattcgcgcgtttttgttgccggagaatttttttccccttgttttggagcgtcttgctgggtagtgcttcgtgaagcccaagcaggacagttcggttttgcgtcgtccgattgattttggtgacggattcgcgcgtttttgttgccggagaatttttttccccctgttttggagcgtcttgctgggtagtgcttcgtgaagcccaagcaggacagttcggttttgcgtcgtccgattgattttggtgacggattcgcgcgtttttgttgccggagaatttttttccccctgttttggagcgtcttgctgggtagtgcttcgtgaagcccaagcaggacagttcggttttgcgtcgtccgattgattttgccgacggattcgcgcgttttcgttgccggagaatttttgttcctcctgttttggagcgtcttgctgggtagtgcttcgtgaagcccaagcaggacagttcggttttgcgtcgtccgattgattttggtgacggattcgcgcgtttttgttgccggagaatttttttccccctgttttggagcgtcttgctgggtagtgcttcgtgaagcccaagcaggacagttcggttttgcgtcgtccgattgattttgctgacggattcgcgcgtgttttcgtcgccggagattttttttttttttttttttttcacctgttttggagcgtcttgctgggtacgtatttgggaaggcccaagcaagacggtttattttcgggacgccaagaagttttgctgtcagtgtcagttttgtgttcagtcgagaatggattaccaactggtgagttcgtttcatgcttatgataacacatattttcttgaaagcgtaacttttatgtaatattaaaacaaactttgtatggttcgtcactatatgtgtcggcattatgcttttttcttacacaatttgaatatacatatacaaattctctttttgatattattaaaaattatttattaaaaaaaaatcttttggaattgttcgacattgtgaaatggtggacgtattttctaaaacttctaccatatcggagacaaaaatgcacagtaatactcatatgtaattttcaaacaaactatgtatggttcgtcactacaagtgtcggcattattcctgtttcacataagtttaaatatatacatgtaattttcagttttcgtcattaataaaaacgtcttttgaattgttcgacattatagatgttgacgtattttgccaaaaacttctcgagacaaaaatacaaaactagctttaaatacaagtcgtatatttccccttgtccatggatcgcatcaccgaccagaggtgactcccagatcttttcctccctcactaataaacacccttcccgtggtgattgtggagatgcagaggtattctcggtctctagaagcaacaatcattacaccctaacattccttccccatcccaactgactgtaaggacttggccggcgccgttattgatcaataatattagatctgctaaaattgcacttcgagagtaagcggaaactcccatcccttattcatttggatcgtagtgcaattcttaccagttccgatcaatcacggagtagcaaccattgacatgtacagtcagtctatgctatgctatgctatgctatgctattttggaggtctgaggtgaattattgaaaatttcttatgttgtgaaaaatggcatagagttattctagaaatattttgaaaaaaaaatctgctgaaagatgttattttacgaacttgtatgtctcattaaattgcacaattttgcaaaggggcattttgatcgaagcaccattacctgcccatgttccagcagcccgctcacgagtttaaagataagttaatttgagtaaatacacaaaagattgcccacagtatgatacaatttgtcgaatcaaaacgtctagcggctatagtttttaaatttacattgtttaaacttatcctttttcagtgtgagcgggcttctggaacatgtgcgggtactggtgcactgatggtatttccatttataaattatttttaattacaaatcgcgtcatttttttccaatatttagatttgcggtgacttaaaagtttgtttataaaatgatttgaattaaaaaaagcttagcaaagttgaagttactttatagctgcagtgaatatttcaggccagttggagtactagaagccgagatccaagtcctatcttggccattttatatggaaacacatccaattcatccatttcttctgtccagtactgtacagtattggacaaaacatttgcaactttttagattttccatacaaaatgatcaattttgataaactatatctcggttatttatggaccgatttgaatgaaattttcacggaatatcagaaataacttgaattttaacatatatttttgagtgatttttctaatcacaagttgaaaagcagtaacggtttgactaaagtgaacttttttgacgattttttataattgacttaactaaacatattgaaggaatagcttcatggtatcttcagcaaagttgtagattttgacgagatgaataagtttgctgaaaacagtttttgtgtagagctatcagattttgagataaaaagttttgaatttttcgtcgaaaattacactttagtcaaaccgttattacttataaacttgtgattggaaaaattattcaaaaatatatgttaaaattcaagttatatctgatgttctgtgaaagtttcattcaaatcggtccataaataactgagatctagcttaccaaagttggtcattttgtatggaaaatcgaaaaagttacaaatgttttgtccaatactgtatataccagacactcagtgaccctgttagtggatttctagtaagcttctcaatgtatgataaattttcgagctgtgtggaatacctttaaataaataaaaactgaatttagtacttaattcgggtttcatttcacttctcaatgcatttctgataaggtttttagtttaccattcgttagatcgctggaagaatttaagcgtgatggattgacgaattacttgtaagatatttgacaaatcgctgaaaagttcgcccatttccgtcgagcgggtgccctcgagcgggtgccctcgagcctttccgtgtcaatgcttattaaatcaaaattgttgaactaaaacaagaacagttcttaaagtgtaccttgaactgcaactcatattttttctttcgatctcccaatcgtttcttcccaaacaggtaccggtgaatcgggtaaatcgacattcatcaaacagatgcgtatcatccacggtagcggttactcggacgaagacaaacgtggctttatcaaactagtgtaccaaaatatttttatggcaatgcagtcgatgattcgggcgatggacctgttaaaaattcagtacagtgatccagcgaacatcgtaagtagcgacccgcaggagggaaccagttctgcaagtgatcttctctcacatttgatactttatttttaggaacatgcggagctgatacgaagtgtagacttcgaaacggtgaccacatttgaaccgccatacgttcaagcaatcaaagatctgtgggcagacgcgggaatccaggagtgctacgacaggaggagagagtatcagctaacagattccgccaaatagtacgtataacggtgttccaatgtcattttccaatgttgagagttatcccaaagatattcgttcaaacaactaaaaggattgaaactattcctatcgtagtcgaatttcagatttgagttgaatataatttaacaatgatgattacgatgaaggacatatcgggcacgacaaagtttaaccaaattttctttctgatctctatccatctcgaattttctcccaactttcgtcgcaatgaaaaatatagttacctaatggaaattgatcgcgtggcggcgaccgactatcttccaacggagcaagacattctgagagtgcgtgtacccacgacgggaattatcgaatatccgttcgacctagaggagattcggtttaggtaccctgcaaaatgcctcaactcattgctgattctaatttgttttgtttttgcttgcatcaaacacctcaacgactgtgtttcgtttgattgtgtcgggcgaatgtttcgttgcatctctgtggttacgttctcttctgttcttgtgatttaatcaaaaagcatatgcagcatccactttaacagttttttttttaatcgcatcttcgttcattgtttgtgttaattcaagtcaaaaccgacagttgactttaattgtactaattttatcatctttgtttgtaagtacctttacgccttacacattttctcgcatctgtctgcgcatttttcatgttctctatttactgtctggcctctcgagctccggtcaaagagataactgcacgcaacatttatattatatttattttacctagatttaccacttactttcaatcatcattgttcgctggctttctggcacgtgcgtgagtgtgtctgctgccttgatgagtcttgtctccactgctgctaactcaccattataatacccgcggtgtttgtttttcgcttcgcccgcgcatctatcataatcatatcagcgaaacgttttgccacttgaagcatatacggctgttgaccaccggcaccgggtccgccctagcccggcattctgacgagtcatcctctcgcttcagttctcatcgctactcgtgttttctattgtaaaaatgaaacctgaacctatggtgcggagcggcgtgatcttgaaaaattaaggaccatttctcctgctcattgcacacacgttaggatgtatttcgcctgtccatctgagccccaatcgctcatcgcaataagtaatttgctttgacagtttacttcactcacgtgtgcggttgcatgctgcactgcaaccggatcaatctgctgcattagcgttggaatctgtcgaactaagtggttttcaacctttttcataccatgcatccctgttcaaatttctacaaacttgattccccaaatagttccacacctcactatgaaacagtgatcattattaggctttatttgaaacggttcattcttcttgacttaaacacgtgactgttccctaataggtttcacctgttcacccaatcatttcatattaaatatgtttgcgatcttcttgtttagctgccaaaatgtttcgtttcgttgacatttaaattcacaacaaaaatagaaagtacattctagttagatttttagatgcctttatctggaattcttgtgcgtttacagctcagcatatttgtgatagcatagagcagtaatttagtgggactccttgcatgaccatttccccccaagacaagtcaaattttcccctaaggagaattcctcctggttgaaaaccactggtctaacactacacatggtggcgtgcattagcagtcacttagtctgtagatgatctgaccgtataccaatgtgtgtgtgcatgtgagtctgttgatgggctgactgtgtatacgcttaggcgttgatcgcttccaagaaacgggcccgtccagtcggatgtcgtcctttgatctctgatgcgcatcgtgaaaaatcagcattgaatcactatcagcgcctgtcgggcacgtgattttagcgcttatgtgggtgctagaggaggcggttgatcgttcctggcgtggtcggttgaacaaaatcgaaggaggaaattatcgcaaagagaaaaagctgtgcagtatgtttgggcgtacgagcttttggcagaaaacctgttgtgttgagatgctttcaggcaggaaatctactacgaaatggtcgtccattgatttcttgatggataaggagaggggcgaatttggaatttcttacgtgtttatatcagacacctgttcatcacctacagacactacccgccaaaagtatggaatcgcttcaatgagtatttcaactcccgttctgtatgcagcaccctaaaacagaactgcccaacctacggcccgcggaacgcatgctaatgtatcagtttggttattctttagttgaaatttgaatacccgttagaacgactgtgcccacacgtgagtctagcctagcatgctagcctcgaaactgttcgaggttcagaacaaaccaagcttttcaatttgttagaatatcaaggacaatttatctctttcgttaaatacaatctcaatctcactgaatgctggattttcactgaatattgggcattgattttacataatctaagaaggatttgaacaaaatgtagtactaaatcttgcgaagaattctcacagaatgttagacaagtttttttttgcatatttggacaacatgttcatggaatcttagacatcattcctcagaatcctagtcaagattgtcactgaatcatgaccatatattttacaaaatactggacgttctcgcataattctagatttctagaacccctaaaagaattcttaggatgattcttatgaaaccgttaacagcaccctaacagattccaatacatgattttaaaattaatcttaatagcgatttgtcggtattctaatcacaactctgacgaatctctgggcagaacacggggtcttcagtaaaatggttctggaggtgaagcgctatctgatggtggctatcattattccaggcaaaagattcgagcaagttgattcaaaattttgccttcagatggcgctaatgatcaagaaacttttgatttgcaaatattctcaggagcctgaccgcttataaagatagcgtcttcggcaaagttgttcattagatcaagaactatcattgttctaggccaccaggcgacgctagtggacataaaactgttgttttgcgaatataacagaattgacaacttagaagtatggcgtcttcgacaaagttgttcagtagcacaagggctatcattattttagtcaatctccaatttcaaggcttaaaccaagatagtcctcacggagaacaaaatatagtgttcgtaatcatttttccggtcaagttaactatattctaaggttaatctagagataactataaatatagttgattagacagtatattgttaaaatcaactataccgtatagttgttaacaactatattttttattgaatttacatacgccaaacgtcaacattcaactataatttagttgactcaaagtaaatttaattgagtttataatatgttgcaatgtttactcagcattttgttcgtctctatcaacatatctgaaaagattaactgctgctttatcgatctaaaaaaacacattgcaacaatcaaaataaagtgcgcgtcggcaaacttgatacgtggtcccctgagtgagaggtggtcatcttatcaactacactaatccttacaagttaaaagtaagtagatttgtgagcatgacttgaagtctagggatgcgaatgtttgcggatagtggtaattatccaagttataattgatataggtacaagtggataactgaatcaatgaagtgtgtgtatttgatttgacgttaatttagtgttggcgtaagttaattttacttcgaaacaactaactgtgcgtaagtaaaagtaattaacgagatagtaatctcaacataaagaaattcttctgcgtgctcaagctactgaacaatccgccgatctttctaatttctaatcacgctgctaaggtatttgcaaaacaaatgtttcatgctaattggcttctcctggtggcaaatagcccgatcgaagtttgcccttggcttataaaacaacttcgccgaagacgccatttttataagtagtcaggactcagggttctgagatatctacaaaataaaaatttcatgcccattagcgccgcctggtgaacaaatcttgaatcttttgggttgaataatgacagcctttgactcattaaacaactttgccaaagacgccatctttttaaacagtcaggcttctgagatatctagaaaacagaagttgcatgctcactatggctgcctggtggcaaaattttaaatcaactgcttctaacaatgatagaccttcagcaactgaacaactttgccgaaaacgccatctttctaagtggtcaggatcctaagatatccgcaaaacaaaagtgctctatagcgtcgcctggtggctaaatctcgaatttcttggctcaaatattgatagtccttgagctactgaaaatctttactgatgacgccatctttctgcatggtcaggctcctgagatatttgcaatacaaaacattctggcacactagcaccgtctggtggcggaattccgaaactgaatgatgaatgtcatcccttgatctcctaaacaagtttgtcatagatggtttttctatatttaatccagatcgcgaggtattcatgttgaacatacccaaggaagtcaagcaaatttacatttcgtagatatcttgaccttttagaaatcgaacgcataaaacttcagcacggttttgcttcatagtcacacaccttactacaataccaaagaaggcctcatcatcaattatgtgagatatgaaagtcctatgcacaattgtaagattatgtaagccctatgcataattggcagtaccgattagaacccaataactgattctgatggttttttatagggtcaagaacgagatgtgtgtattgtcccaacatttcggcctttttatattaaagattatcgatgaacaatacgaaccttcaagaaagacataaccgttcggccgaaacgtctgggacaatacacaaatattattcttgaccctctgattgagaaaaccatccgaatataagatcaccacagggcgacagcattctacacgcataaaaatatgtaaatgccgatgtactgtaaacagaagagtactgtaaaaataattcaaattcatgtattgttacagcatcttgtaaacctttacaattatatatttaattttcaactaagaatacttaaatgttacacgatcgtgtaaagtgaattcaattgaaaaataatcgatttgtcgttgaaatttacgtttattttgatgctccaaatatgtgcatgaaaatgaacttaaatttacaacatatttttagctgtgtatgctcattgctgaagaagattactctcatacaatgcaatggctttttggtgttgatgaggttgaacgtagaaaatgtagagcttcagcgttaatacaagatgagctctgaaactaagtttgctttgtttgtgatgggttgttagccggtagtgaacgatagtttcaagacgcagaattctcgcgtaacaattctaatgggccaatgatcaaattctcgcgccatcaagagggcctacaatcggaaaatttcgcaaactgtcattggccttagcatggtgagaggccaatgactctctcttgctctttcattgaaaaccgaaaaggcctagccttaggccaagcacgctaataaaattctattttggccaataaaaaaggcccatgccttgttgaaaatcgaaaatgggtcaatcatttaaacttatattttttttccacatttttgtcagttttccgaataaaatcgattattagcctgtagttataccaaatcgtcactcaactagcaagaaatcacattgattgatttgaatattgagaaaaaagaattgaaaatgtggtgaataatattcaaatcgaattttctcagagtcaacgatctgagcattggcatttttgaattgttatgcgagaattctgcttaaataaatgttgtcatctcaaaatttcttgatatacctctgaggagatatttggctcattattcatgagattgtaacaccactgacggacggttgtttgttaagattcgctgttgattgtgaccgcaaacttgagcgaaatcaacaaccttcagcagaatcgattatttgaaaaggtttttttggacattttgcatacctaattttaatcataaacgtttgatctggaaatattttacgctcccgcctaaattattcaaatatcgtctaattttaaaatgtgtgttacggtggataacaacgtctctttggataatagaaatattagtagtagaacgctaatagcgctgttctcacaaaactgaattagtttattatcaccttcaactgtattttttcattatttgttcgatgccatgttgtagtggatgatttcaaaatttatttgacactttgaggaccgatactcaagctgtcagcgcgtggcaaactagatgttggtaacacgaacagtagcgacattagcattcttaggttaatgcttctactctttggataccccttggtctgacacgaacgtagtgcgctagcttttgacatctgtcattacaatagaaatattagtagtagaacgctagtggcgctgttgtcacaaaattgatttaactaattattacctttaattgtaatttttcattaattgatcgatcccacgaaacagagaatgttttgttttggcctttgacactttgaggcccggtactcacgctgtcagatcgcagcaaactagatgttggtcacacgaacagcagcgacataagcattcttaggttaatgcttctactgtcattactcacgaatctaggtagacgtatcaaagaatgaaaatagatatcaacacctctatgaatcagttgtagctagcgagaagttatttcaacgtttaatttagtttaaaagcagtttttggcaaataatattgaatttcctttattgtaagtagtaatattaaaaatatgaatattttgaattcaattccgaatcttatgtagatttttgagcacctataaagacagcataattctgcaagttaacgagcctggttgtaacctaaaagtatatattgtacacctattaaatgaccagcaattaatagattgaattttagggcgaaactcagcagaatagctaaaactatattttttgttggccagaagtgggatagcggatcaaatatgtaagtttactgcgtaattaaggtacagtgggggaagtggatcagtggggtaagtggatcatttgtcaatataaagcataaatacttgaatatgttgaatgttttcgcaccattgcttcgttttaggttatgtttttacgcccacactgatactattgcaaaactggtactacacgtacactaacacaagcaaacttgttagctgcaaaaagtaattaatttgaaaattgttttccatcaatcaaaaatccattgtatctctgtctaaaaacgaattctattttttttcgacacatggtgagcatttcagttctaactgaatggaatcacaatgaaaaatatgtcatttttataaataaatacaaatatattggacatggtacacttacccctacgttttaatggggtggggtaagtggatcaagaatgattatcatttattggcagactgcttacgagaattttaataagctttaatattcgcaaatgttgtttttctttattttgttccattcccagcttgaatttgtcaaattgaccatagaaaatttgaattaatctaccttaaagttttttttaacctttctggtataaaaaaatataaaaagaataataatttcaaaattcacacgaaacttttcgtggtttatctaagttgagttgtaaaagagcaaaatatactaattttccaatcgaaagcatagtatcgtaccttatttaaccatataaattgttctagacagacgatacacatatatccataaataaaatagaacgatttcagtttgttattcgaaagtaaatgtaactaatatttttaaaccaagagtgtttttcgaaaatatcgttaggaattatcttacaatagttctgtataagttatgcgcataaatggatgaattttctccaaatttttctacttacaatgtattttttttgttcaaattagtatgagctaatatatacatactttttattatattttgattaaataatgataatttttaattttaaagtattaaaatgtaacattactagcactaataacaaaaacgagggttatatgattcttattaaacataatcacactacatttgtttcgagaacagatttttttttaatggtgatccacttaccccaccatggtgggacaagtggatcatttggcgcaaatttttaagtctctcatactcaatagataacaatcagaaaaatcgaaataaatgacgatttgaagtataatagtccctcatttgttatccacagaaaaaagtttgagttacattattcacgttagctgtacataacaatgaagctaactattgctttttctgtatccacttaccccacggtaccttatcttaaaaatgtaaccaagaattaattgaatgaacttagcttttagcgcttatatcaccaacatcatcggtgttattgcttaaaagaagccgaataccctacgccaacaatgtgggtctattttgatcaatatttagactttaatgggagaccgactcattaatcaaaaaatgttgcaccaattttcttcatgtattgattattgattgaaagcgaataaccgaatatgagaaaaaaatatgtagtcgtgggctacgcgtcgtttcaccaagtagtttcggaatatttccgaaaccaatgaaaaagtagcgcaaaaatatcgaaaaacaaaaattgaagtgattcgttttctgttggaagggagggactaaacaattaaccatttattatatttatctaggggtgcgaactggatatcaacaagcagccaggctgctgtcaagctaaaatttttatcaaaatgatccgagtatgcctaggaatgtgtagccatattacttcgtcacgctaaaaactggtgtgcattttatgtgatacaaaaacaatcaactgttcaaaaaacgtttacttggtcttactgatgagcaagtttttcagaacttttgttaaatatttttttaactaacatacggacagaaactagggtgccggtaccaatggttgtaatgtaccagtagattggactatggaataaaacgtacattttttaatcaaaacgacatgtgctatttttggtggatagatcgcctctagtttagtcgatttgccaaaattcagctttttatttcatcaaaaagtcatataaataattaagtttacgcaaaaaatttgctcccttgcaccaatagttgccgtcgtgttccagtagtggatcaacggttggaagcagtttttaaaatggatgtataaaaatgaagaaaagtcccagagatgttcttaatgcttctatcgaaagatattagttgctgttcgaagggaaaaatgttaaacctgtgtaaaaatttgcctttttgtttaaaattcattgtataattcccaaacgtctactactggagcactagcgcaactactggaacacgtgtaccaatagtggctcaagcgattttatgttaaaaaattagttttaacactatttttatatttttcccatatagtagaggttgaaatctttctgttgacgccaaaagatctctgctaagacttttcgttattttgttatgattttttatagcttaggtagtccactaatggcaccggcaccctatctgcttcagctgattgattgaacttattacctgcataaaattgcagaagctttgtgtgaagtattttaagtgtgcatcttgaaaatggtttcctgcgagacaaccaaacaaacaacggttagcactggtagaaaaaattgtgttcaaattgaatgaccaaaatgttcgagaccgcacccctcagaaatttatgatcctcccttgcaattcagtgtaatcctgtactatgataaagtgaccagacgtcctgcttttcgcatttcgaccatttgtcccgcgctgaaaagattcccgcgaaatgtcccgcattttattcaaatcattaaaatgtccagcatttcaaaagcgataattattatctcatttgctaacccaacattaacctacattttcatgcatctctgtgagtcatagaaataaaggcagacgcacagaagttatgtgtacattttctaggcgtattaaagttactctattctataacgcaatttgttttgggtaccgtttgttctacaaattcttatgaaatatatttaattaaaataaactatactgcccatgaaagcataactgtcccatataggttttcgcaccaacaccttttttcgtcgcagcattcatgttgcaatatacactttgctatgcatttaaaaattaacacactttttaacaaaacatgaagttggtgcagtcccatattggaaaataaaggcataacagtttctatatcaaatttcaacccccccagaatctgtaaaacgtgaatcatgttcaagtttatttgttagccaatcaatagaaacaaaatgagtggtttgtgcggtggtgctaaatgtttatggcttgcaaaaatgtattagaaaattttgaacatttgtatgagaaaacaagcttcaaactttgtgcgctgttttctcaatgcctactttttccatatggaacagttatgcctttaataaaaaaaatgaactaaaaaatcggaagtgatttgtccagagcttcaatattttaaaagcagcaacatattgtcaacttaaatcattaacacaaatggtcaccgatagcattacttgtatagttgagatcgtaactttatggaaaaaatgtgtaccttaaacaattcaaaatcatgtttttgtattttttatgaggttctgtctttcacggcatattttccactgtagatcagtgatatgcgcaagaatttctaattttcaaaatatgtgacattttaacccgctttggagcaaaatacatctggtcactttatactaactcatccttttctaagctgtattgtaaagtcagtttctgccagtttcattgaatgatgattttttgaagtgtctatttcctacatcggtctaatagaaaagttacgattgacaattgagaagtctcgcgttgtaagtacgtaaaagtctgaaaaatctatcccatggttactgagctccataagtgttctatccctatcaatctttatcgagtgttcattcgatttctctctacacatcagaattttggatatctttttcaagcttgttattttcatccgaagttttcaaatataactgatagtattaaggcccaaagataaacttttttaaattaggctgatacaaatattaattttcttttatgtccgagaccacttggaaggtacgaggggggggataaaaataaataaggaacaaaaaaataaaaattgaaaaaaaaaatatttttttgaatttttatttttaacgatagttgttaaactattttcaatcgtcatctggattattattttacctgttttcgacttttaaaattaaaaaaccttactgatgtcaaaaaaatgatgaatatttttttttctcccctttcaaaattttctgatttttgaagggggggggtgacataaaagaaaaattaatatttgtatcagccttaggtgaaaggaatataaaaaagtacacattgtaaaatagtaaaaattaacatattcaaggaaaattattagagcttaaaaagctttaagtttttaacttatcactcattttactgttttgcatttttgttaaaaaaatcacatttgttttcgactagtttaggatttacaaactctggtttgaaaaagttttcaatgttaaactgattcaaaataacataataagtatacatttagatctgtatcacatgatgttttcaaaccagaattattaaaagttgcaatcaaaatgttctattttttttttttttttcaaatcggtatctgagatattgaagcaagcatttttcgagtttctaaaaaaatcttaaagtttttggatcaaacataatccaagaaatctgaaatctgaatctagaaaattctaagttagatacggtgagttagtttgcttaataaaatcctaggaattcagacttgatagtgggaaaaaaatgcacgaattgagaaaacattttgagaacagaaccaatccaaatgattcaacgattctgaatagaatcatgagaggtttttgaacagtgtcagattatgaaccaagtcgctgcaaatataataaagagtattcggcaagattccggctgaatctttgagaacatttctaccgtacgtgtactgtaaaaatttcaatttctaccagaattttgttagatttcctgttaagatcctgttaagatctcgattagaatctttttggttaatggagaaagccaaccagtatatggatgttaattttcaatatgaatataacaatgaaaaacatttcattgtttatatttctagtacatttttttgttatctctacaattcgggatgttttctgggatgcttggttatgcgggaaaggttgctcaaatccggacgtttatggtaaagggatttctctggtgatgttaccttctcacgtccaattttctcagcagtagatgtttctaatctgttactgataacttaccatcgtcttttattgtccttcattaaatgtgctgatgtagttgggctaccattgctcaactgtcaattgagcaaagcatgttgttttcgcatatgaaaactatctgcagttactccaatgcgttacaaccggtataaatttaccataagtttgtattgctaattttatagaaggggaataaagtgaatatgcttaaataaaattaaattccacctttgctcccaatatcaatatctgctgctttatattaaagcaatttcaaacgtctacctgttcctcacgtccacctgacacgcatgcaaattgggctcccgattctaaagaatgctcgatattctccatcccaaactgaaatcgactgcgttacaatcgaattacaaatataagtcaaaagccgattcctcatcaaaaatatctttaattcaatttgttcttctccgcggcgatcccacaactgacagttatctcagtgatctggcacgtatcgaagccgaagagtaccttccgaccgagcaggatattctgcgtgctcgagcaccaaccaccggaatcctcgagtatccgttcgatctggatagtattatctttaggtaaactgctggctgtgtccaagctgttttttatgttatccgtcaaaacgacgttatcgctagaatcgttccgggggttgttgtccaacgcggtggtagtatggccagaaatgttcctccgccttctatctggtgctcaatggttggggtactaaaagaggggaatctattttttagaattaacgttggtgctagaaagctactttctttccccttcggaataacaacggctactgtatgtgagttttctgattttacccactgcgccatggtagggtgcattcatgtgtgaaaagtactgtatagtgtctgcttctccctgtgaacagtgcttcaaatcatccccagctccaaacactaagcttcgccattcagattcaaaggtcatatatttataattcagcatatcatattcgcattatggtaatatcatttataaactcatttatttagtgattaacatgcttggctcattttattttcatttcgtcaaggtgataacagctttggttgttgtgttttgagtagtttactaatttgcttaatgtatgtttttctataattgtctacaaaaatattctaatatttgcctatttttcctcaaaatagaatggtcgacgtcggaggacaaagatctgaaagaaggaaatggattcactgtttcgaaaatgtgacatcaataatcttcttagtggctctgtccgagtacgatcagattctgttcgagtcggagaatgaggtaacaccaatcgtcaccacaagcgttcctgaattgttataattaatcgatcccgcccccatttccagaaccgtatggaggaatcgaaagctttatttaagactatcatcacgtatccatggttccagcactcgtcggtaatcctgttcttgaacaaaaaggatttgctagaggaaaaaattatgtattcacatttggtagactacttcccagagtacgatggtaagttacgcttcctttttcatttgacttaataatacgggcaaaaaacgtttgaatcaataacgcaaattcggactgataggaccgaagcaagatgacgtcaaggcgagagagttcattctcaaagtgtatctgcgggaaaacccggatccggacagaatgtgctattctcatttcacttgtgctacaggttaaataacatttcttttatgacgccagatgcaaatgcctagaaatgcgcgctagaaagtattttgctagaaactatcacgttcaccagtcgaccctaaatagtcgtagttttcattatcgctaaaccaacatccccgtatcttattcctccacatactttaatacactttcaggaccacaaagagacgcaatagctgccagagaatttatactccgcatgtttgtagacttgaatccagattcggaaaagataatttactcgcatttcacatgcgcaacaggtgagcagcttgtgctagatacacattttcccgtagacgaatttcgatcaattcttcctccatgcatcatcataactcgtcttcctactcatatcttaactaaccaaatatgtcaacattaggtgaaattgcttcagttgactgcttctcggtagtatcagtttggtcaaaataactcatttaaaatcaaccgactaatttaccttcctttttgttttgttcttatttcttttgctccttcggcgacattcgaacagatacggaaaacattaagctcgtattctgtgccgtcaaggatacgattatgcaaacagcattgaaggaattcaacttggcgtgattttctatacttatcgcatattcataccgtttttaaatactcaaacgattcataagtgcagggttttccatatattgttgtatcgcgcgtaatttccggcagtttcaatcaaaatgcggaatagaaaatttgtatagtgtattgttattttatgattggatagatcatttttagctcactcactactttcgaatcaaatgctcactagctaaactgcatcagtggtttgtgttttttttttgctctttccgtgcagataaataaaatattagaggacaaaaacggattctgagatgtttaaactagctatttctatacaatgttatacaagggctgaatttttgaacacgtttttttatttatctgaatcgatttgtctcgcgatcgtcgaaaatcaatggagctctggagctaccatgggaaagggaggattgtaattattgtatgatgacgatgatcattgatacttctaaggcagtttttctgttcaaaactgttgtttttttcgatgaaaatttgctcacagtgttttggtgaatacaatacagcgaacacattttcatgtacattttcttgactttgaacgaaaaaattgctttgaaaatttgaaaattaacagatcgtgcccctttaaagctgatttgcactttagaggaaaccactcaatggctttctttttgaccccatacaggaattgtctacaatgccccgctttgaattgactttctttttcaactgcgtaccccgagatgaactactcaaggatttctctgtttgaattttctacgtatccagatgagctttccattacccataatgcgagtagatcaccttttagtggtgcgttactgggtaagatctaccaatttgagccctagtctaatcttttttgtcgggcctgagtaatacgttctgataattcaaggagatgcggtacaaaggccttgttactgacaacagtttctgaaattgaatctattttacctagcagatggttgaagactcggagttcaccagtctcgagactacacttgaagccaggataacaatcatgagtattacctcaacaaggactgttaagtactggtaattcaaggactcttcttcttattggtattacgtcctcactgggacagagcctgtatctcagcttagttttcttatgggcacttccacagttattaactgagaactttctttgccacagttgccattgttcgcattcgtatatcgtgtggcaggtgatactctatgcccagggaaggcaaggaaatttccattacgaaatgatcctggaccgatcgggtatcgaagcaagccgctgattctgaccactgggaaggcccctgattcgcccagtcattcatctaaaatttactctttgaatttggcgaagaaattgttagtccaagaaataataagtattcgcccaacgatttctgcaggaatcccaccaggtgtttgtccaaaattgtttccataaaaaaatgtctaagcattccgtctgttattctttcattaacaccttacggacgttttctggtatttatctggacatttctcaaggaaatttttcaagaattttctgcagccgggtttttgaagagagagagattagagatctcttcaggaagccaagaattactcaagtataaaaacacttatttaagttactaaggcattttctagatattttatcagcaattcctccattcattccttcattggctcttgcctaaaaggattcttccagggatttcatctggagtatctccgaggatgcttttaatattttattcagggatttgtctatttatacgatttttttcaaacattccattcagggatgtctccaagggtttatttacggtctcaagggtttcttcaaaaatggttttgtatgcccaatttaagcaatataaacggtgaaaaaatgttaaaaaggcgattcatttcaaaacagttttagaagacaggttgtgatacttctgaactaattttctcaaaaccgtatgggagttacttacgtcgatttgaaaaagtaatagatatttggctcattattcctgagattgtggcaatactgacggtttactgtcaaaaagtccttgtgtcatatgttaatttttttgatgatttttggcgagatcattgatacaatttttcattttcgttaaaattgagttgagttcagtttttaacatattgcaagtcaaattgtcccataataaaaagtaaccgcatattagtcccactacagatttacgttccgtgcagcacaaaaatgaaccgtgttatgaccatcttcatatttttctcggaaatatatcgtagcaaattgtgaaagtttcattaaaacttgaacatgtgctaatgctctagaaatttttgaatattcgtatggaaaatgagtttggtaacttcacagcccattttctcaatgcctactttttacagatgggactgacttgcgattcacgacagtttaacagaatcgattattttagattattttaaaaggatttcttgacgatctggcagactgatttgcactgtaaggagctagacttttcgcataccctaattttaagcataaacgttcgatctgaaaatatattatgcttccttatatatgtatgtttgcagcatttttcacaaattgttcaaaaaaatcatctaattttagaattttgatctatttggatcaacactcagattttaatgggagaccgattcatcataaaaatttgttgcatcaatttgcttcattttttcacaacagggatgtctccaagggtttatttacggtctcaagggtttcttcaaaaatggttttagggaatttacagtaatttcaagggattttcctaggaattcgcaaaggaaaaccttcatggattgatcaaattccctcattgattgcccaagagcccaaaagcccgggactagacttgtgtgctttagaaggctcgttctcagaaactagccatccgaatcacgcactttttgaagcttctttaaggggaaaagttcggctaaaagatggcatgctcgggatggttccttaacccttcccctttttctggggggcggatgtaggtgtagcatgaggcatattttcaactaaccttgattatatattatataaacatggcaataacaaaagatcatagttttccagaagcaagtttccagaagtcctgcaaacttagcaaaggatgaacgattctcctattgctctttgctctacaagcaaaatctggctgatctgaaattggtcgaacataatttcagattgattctaaccgtctagagggaaccaagttagtccaggatacccaggaatccctggtagaggggaacggcatatccagggaagtggctacttttagaattattttgaaaccatccttgcgacacaccgaacttcatggttttgaaaaacaagttcaaaagaagatatttcaatgacttctggaaacattcgccacctactggcatatttcggagatgtggtgctcttaggggagttactactattaaaataattccgaaaccttccttgtgacacaccaaacttcatggtttcgcgaaacaagctcaaatagaagtccgccagatatcattgatatgccttctaataaatttgttcacatttttctttattattgaggctttcaaccctaggctggttcatcctataataaatttgttttacaaatgcataaagtttggtatgtcacaaatgaggtttcagaaccatttcgaaagtggtcacttctctgagggcaccacattccctgaatatggcattccgggcataccatcataccatcttttagccccagttcccctttgaagtaacttcagaatgttcgtgatttggttggctagtttctgagaatgagccatttgaaacacgcaagattttgtgggttaaaaagaatatctttttgggaattcgctcataatgctccaatcttccacatgtgataccactaaaaatggattaataatttgacacaaattctttagcagaaatgttaccaatgcgttgaaagtccactgtgtggtatttatttcttcgcaaccgaaaatattgattatgaatttcacttaagcctaacttttttcagcttaactataacttacttttttattattctgctgtttcgtctattccgccttatgcaattgttccgcgttgtggttttcgacattccagggtaaaatcgtttttatcaacattgagatgctatttggagcgttatttcatttgattttgtgaatatacgtattacgtttatgcattagaaaaagatatctttgtcggtttggtaaaatgtgaaacctttgctaattagttgatattaaaaaaatgaattgcggtcgcatatttttaattaacacgataaggctgatacaaataataattttcttttatgtccgagaccacttggaaggtacgaggggggggggataaaaataaataaggaacaaaaaaataaaaatgaaaaaaaaagttattttttcaaatttttatttttaacggtagttgttttttcaacaggcatctggatcattattttacctgtttttcgttttaaaaattaaaaaaacctaactgatgtcttaaaaatgatgaatctttttttttctccccctcaaaattttcagatttttgaagggggggggggtgacataaaagaaaattaatatttgtatcagcctaactaatatacattcatctttcatcttccatgagtttctgcatgactgtaagatattcctcatacaaattttaacattcttgaatttcttctgtactcaaattacaatatcacaatccataccgcatcgcagataccgaaaacattaggtttgtgttcgctgccgtaaaggatacgatactgcagtccaatctaaaggagtataatttggtctgaactacaacgtcgtcttcgtcatggtcgtcgtcgtggccgttaccgaaatgtcgcctctactcttttcctagtacgagctgtcacagccgccatcgtcatcgcagccagtaccgtaacagcaacagtagtagttatagtagcagcatccgtaccagtagtcgtggtaggaatagtggcattagcagtagcattagaaacagcaagcatcgtcgctaccagaaccaccatctccatgaagcataccgtcgcggagttcgcaggaaccactgtgatggaaacttggttgccaaagtagctgttatcgtcaccatcaccagttcaccatttccaacgggatcatcaccacgaaaaacgaatcgttgctgctgccggggataacatgagggatgtgacgaatactactgttaccgcgcaggaacgtttgggaaccatcgcgaaacaatagatacgaaacgtgctctaagggaaccgaattttttttcttctgtaaggtgtagaaccactgcgggaagccgaaacgagattaagccacaacttgccattatttctccgccgtttgatgcgaagaatgtgaattttagtttgccacagtaaattgcggtacggctttccagggtggtttcaaatcttgctagagggaaaagatcgtcgttaatcggctaaaaacagtgcactataagaatgttcagttcccaggtttactcgtcgttttcattcgtttcaaaaggtacggttgaagtaaagcaaataatattgatgactgggcgctgtcacatggttcgtttctttgtgtaatcaaaatagaaaatgcgcattcgaaacgaaacaaacaggaaaagagtaaacttctttattttatgtgcatttcttaattgttagggtttaaagaataggataccaataaacaaaagaaaaaaaaactaaccaacaggaaaaaaaggtaggcggacgtataaacaagtatgaaaacaaaagaaaatgcaaaacaaataatgatgtaaacgaatgcgttaggtttctaaaatatcgtttcctgtcctcctttgattcgtggaaatcaatctatgttgtgaataatctccctctcagtttactatttttagtttgatgagtgtttgagtctgtacagttttctgttattacaagcgcggtcgtcttagatgatatttatttaaattaattttaaattaaaatatttgtttattacaacaaacttcgtatgcattgttttctttttatataattttatttgttttttattatgttcccgagttttgttagttctgttttatttctctcatagcaacaaaataaatcaattgtacacacaaccacattcacacatacgcatatatacacatacggcgataatttaggcacttttttacaactacacccggctgcatgtaatgcgctagaaataaaaaaatccgcacacccactcatacacgcataactaggtacacaaaattgaactaaacaaagaaggatgaatgtttatatatttatacatatacatttaaagaaaatgtgaaaacataaaaagtcaatctatttattctgcaattttttagagttattttcttgcatactgaccatcattttttaagtgtatctaagaagaagtcagtttcgttctaaaactggactttccggaggtccgaagacctagaaaatgcgctctgattggtgttcgctttcctcttcatactttatttccggcctgtcgtacaattcttagtatttctctactagtttcaccaagcttcccgtacaggatcttcgatcgttcaaaaatttcaatttcatcactct

SEQ ID NO: 137 - DNA, 46846 bp, Aedes aegypti
  misc_feature (13477)..(16187): n is a, c, g, or t
tcagaatatttttggctggcctaaaaatgtgtttgaagattaaaaactcgttctgaagaaaacgttttgaagcgaaatcgaacgtattgctcagatgaagactttttacttttgaaacctcatcctttcatcattcaatcaacgaatcccaaggacgctcgttggcgatcgaaagcccctgtcgaagtaatgtcaatcagcactagtctatatctgaatcgccattctagctttcagcaggttcggaacttcctctccccgtctcagatggattgatagcaacggatgcacaacagaagcattctcacccatacaataagcttcgtggggcttcacccctgtagacactatggtgaaatccgatgacgcaagtttcgatttttcggccggatggcacgttttgctgtggttttcgattgtgaaaattggaaagcggtttcggcgtgtacataccgtcgtcagtggcgacgacgtcgaagttcgccgtcgttttcggcgactccaaaaatagtttccttcgcgaaacatagcatccatccagtgcataccttctgctgccagttgtacgtctccacggttggtgtcattgattagttaactatggccagagtcggtgctgcgttttttcacctcatgctgcgctctgtagagcatgttaggacactcgttatatcgagtgtctacgagggaaaatcaccaaaacaaggtgtagctacaccatcaaagcccacaaacaaccgcgaatggcaaatggatggattagatggtggcgtatgtgcctctgcgcggagttcggattaccttcaacgagtttgtttacctatgatctagaaactttagctctagcaagtggtaggtaaccctaccgcgctcagcacaagtacatatgtgtgagctcgattcgtgattggcagtgtagatgcgattggcggctacctactaagaaggtgcagtcattcaaaacagcgtgctcggtggccgtcaagttatgtttagaaccgaatggagtggacccacgcagtagcgtagctagagggattcgttggggcctccaaggaaagaacgttacctagtagtggtaattcgatttcttgcttacgaacgcacaaacatgcagagcgaaatccagtttgaagatggcatggattggcaaatttatgtcgaaagacaatacgccgaaagggcagaaggtagaaacaaacaaaaggtcgactcctatgattcattttgatatgggggggattttaaaggattattctcaataggaatttcaaattctgtccctaaaaactaagaagtaatcacagggttttctcaaaaaatttcagtagtgctaaaattttccctaaatgcctaattgatgcagttactactattgcgtttcaggatatacttcagaaaaattgcacttttatggttatttactgcaagttctcttatgaacttataaatgaaaaaaaaaacctttttcatcgattacttgaaaatcagatttaatgttagccccgaaatcctagatacgccactggagccacgagacgagtcgagtggagagaagcatgcagcacttgagattgctatcggtctgcatggggatctgttttgggggcacgactatttgtgtaaagagtttaactgaataatcagacactccaaaagccatgtgtcctcagcttcgcttaatccaaccacgttatcaaatttaccatcaaacccctcccgccctgtgcgcagtgattatcaaattcaattcactgcgaaattccggacacaaatccgaaattactgcacaccacgatccgtaatccgccgtgaattatttccatttgtccatttcccgatagcttttctctagaacccgaattgaatcgatggcagtcacagtatagcagccaaagcggaaaattaattcccataaagggttcaaagtacgaccggtactggttctggtagataaacgatgcattcccccctcgtacaagtaccccctaactaagctgatcagggtaaccaacccgcccacaatcagacctctccccaaccattctgttctgttcagtaatgaatgtggaaaaattgatagattaccatttacgtaattaagttagcttctgttgcgggttgcggaatcgggaaatacggtttccacgtacgtcgttcgctgactataagctgattgaaagaggttccgcacccctcgagtggaaccggttgtcaatcgggaatcggggggaaggttgctcatcgatggcttcctccccgggtaaacacaatcctatcgttttaccaggctactgggcgatacgtactcggatagatcatgtgacataatggttccaacagttttcgcaaggaaggacacaagctcacattggtaaattgaacggggatccattacagcagagggaagttcacataattttcaagtaaaatctatgacggtacctttgatttggaaagtgttcccaaacatgctttgttgcgttcgattatttagacagcaaacaccaattatcagagacaattttcgtaatgaaaatttccttgacttccctgagcatacaaaatcatcgtgcctacttcacgataaacgaatgcaaaaattgcaacttttgcgaaaaaagctctcagtttataactgtggaagtgctcataagcacactaagctgacgagcaggctatttcccatagaggacgtaatgctagaaagaagaagaagaaagggtattcttgttggggccttattagccgtagcggtaaacgcgcaatattcagcaagaccataataatggtcgtatggttctagtcccgccgatttagaattttttgggattggaaattttctcgacttcccaggacattgctgtggagatcaattatacacagtgtataattaagtgtacacagtttataataatataataatcctcaatataaagaatgttttgatgtttcaaattatagtcgatatttctgaaaggatatgtgatgcttgacgagtgctgcccataactgcatatttgttactttgagatcttgttctagaaagatctaaaaaatactgaattgatttttcacatttctaaatataatcgcaaacagtcatatttaaattatacatgggctccacaattcaccagtaataaaattactatcagatttattctctatcttttcgctcaatatgctatataagctgtacaaagttttaagttcaaataagtattgtttagcttttgttttttagtttctacccatattgacaaaaaatgtctacttggtttgtacttcatttactcaatgtctttttttgacgaatgttgcaaatatgcagttattgtcagagtagtgattccccaaactcattttaaaattaaacgtggcttctttcagtagtgaatgacttgaatagctaaatctagtaatttattgtctgcattatattgtaaatttaccaaaacaccattttaaagatccatcgaacggtagttatgagatgctcctgttcttagaacattacccaaatatttgactaaattatggaggattcataatatatcaaatgttgtgccagtactctgataaaaatcctgtatatacttttgtcacaagtttcatcgacaatttttgcaacaatcatcatggaaagtcgttcaataattttattgaacatttcgccaataattaaatcagtttctaaaaaaagcattttttccggtttcatatgttgaggcatctgggaaaaatccaagaattggtaaattttgaatggacagatactattacataatctactacaggaattttaccatacacttcttgatggacttcggcagaaacctccttgcctttcacagtcaacaaaaagtgaaaactgtttgtgacatggatgtttttgggattacttttcattacatcattcactattttgttccaagtataagagaattcccataacgctagctggtttataatcaagcattcttcagttcgtactaaaggaaccattaatttataaaactggaataatttaaaacctatgtaaggtaccttcgtcgcaacctggaattttcttagtaattgttaaataactaagcaatagtaaattaagtaaaatcgctcactgttgatattgtgcttccgtatcgttaagagcccttcattagcattatatgcaagtacactcccaataaacgatatatcaaagcttgaattgtacagtactcaatattgaatgtaaaatagacaatctgaaagacgtcgtacgcccctgttgctcatcctctgtaaactaagtgtatctgtacataactgcatgcgtcgttctcggtaggttgacgtatcgttagtcgttatctgtcccaagttgttacgtatactttgtatagggtgtgggatcgtcagctgcctactgaattctcgcttcaaatagtgctaatcaacaactaacaggtccacagtgctactacatgcaactaacccatcgcatcactagaacttagctgtacctcttactaactacacgaccaaagcaaacgaaaaacatccctcccgctgttggaaaacctcgtcctttttcgtagccccctcttaagactttttctgttttcttttttattttagttcaaaaatattttattttttaccactaatcaatggcgaatccatcctaatagtaaatttttctatatctctttctccctttctctccacctacagatatggcagagttcaaagtgttagaattatcacctctcaggcgtacaatcccacctccctctcgtcgtcagctgctgaatcagcatcgtccaaggatcagcaacttcttcacggcgacggaagcaacactttcaacggacctaacctgctcgacgttgacggctctggaggaagtgcttcagctgttgcggcatcctcctctacttcctgtacgtcttcatcgtcctttgctcctgtgtcctcttctgcttcttctagtacgccattgtcgacatctgctgcaggatcagcagtcgacttcaatactatcaatagcactagtagtagtaacaatagtggtagtcataagaacattcctcctagcttactgggcagcggcggtggaaatgggctggtcatcagcgtttgtgcgacgatcgccttcatggacatccggtctgcgtcgaaggcgcacactgccgaacataagttcgacgatcgcatactgaccacagaatactacgaaccatcgctgctgacgatgcccccaactgtggccccatcgaccttgagcggcggcagcgtcaataattgtagtacaacgactcctggtgatagtaattgtaatagcgcatctagtactacaatgccaaaacatggcagtggtaccaacgacggtagcaatagtgcgaacagcgccggaaacagtattcagtatccttgtccaccgtcgtccggtgcaggcttccatccgggatcggctaccggcagttgtcccaacagtagtattagtaaatgtgaaccctcggggagtaaactgctagggcttagcgatgaacacggctcgttctacgagtgtagcaatggcaatagtactagtagtagtggcagcagtagtagtagaccggccagcttcaaccgcttgcagggtagcagcgacgaacacggacgccggatgtcctcctcctgcggatcaggtgctggcggctattctagggatcttttagagggcggcgtgggttgcggaagtgttgtagccagcggccgcggtcgtcaacgggatcggcagcactaccgcaacgggccatatgctacgacgacgttggcggataggtgagtgtgctgtttcatgaccaacctcccccccccccttgcgtattcttttgacccatgccccctcttttgtccaagtatactacttttgttcgttttcagacgccgacgccgatctcggttttgttttggtttcgatgcgctaaagataaacaaatagagaaaatgctctgaatggaagtactatcggagtttgaagacgttttttatgtgttggtagtatcttggaatgaagtatttgattttctttcttagatttgattttggataattttgttttctgtttttttattttcttacagttgtccttagaaccttccagaacgaatctgctgtgcttgaacttatgccgtgtattattagaagtactagatttttctcgatgtagtagatcttagatttaaatatttctccttagactgtagatagtgtttattagcggtaataatatagaagctttattgtagttttatctgaatgcttcgagtgccttatttagagaggattatctgggactcgacgaaatattgcggtttttttttcaacgtttcaactgaactatttcaaagtttatacacagatgtactaaaaaatggaggctgacttcagctaatctgtgaaaatctaccaaaactcagtaaaacgttaccattaaaaccataagaaaactaaatacggtatcagggtttgtttggcaaattctggacagctgcaattggttcaagtatctagaatcccctatgtttatctaccttaagggcgtattcattagacttacaagtcgtattacgtgtcacataactattgtgactcgtcatacgatttgtaactgtgctgaagttaacatcttttcatatttatcaatctagatgtaagaaaacgcaatatttcgccagaatttccagcaatgttcctcttctagccttagttaatgtccttttagtttttaagtttaataattctcatgttattttcagcgttttttagtgttaataaatcatctttgctcgttttcgcgatgaactttgtttgaggatcataaataactgaaattcgattcgagataccgctgaacatgaaaccgaatggaaaaatgatggattctgcatcccacgcccacgtctgaacgattgacgaagtgcagcatcgcatccagtgttactgcagtgcacttcaatcattcttatcgctcctcacacatgttctccgagtacatttatgccgggtgggggctgctgagcttgcattgacccacataaattttatttctcggaataatgaaaatacagtgtcgttgatattggcgggtgagacggcgggcagcagttcacagagacgcaaaaaaaggcgaacatcgtttcaattcaaggaagatttaaaacgagtttcatatgaagttcagctggccgtcactagtccaggagaatgcgatgataccatcaaaagaagcgaaactagaaaaagaaggaaacagcaccttcactgttcccatatattgcatcccttttttgtgcctttatgtgtgttttgtccgtcactgttcaattcgtagtttctgtgtgctcgttttgcatgtggttcatctgtaattcatgtatgcatatcactgtgtgtctgcactgaactgaacgatccttgcctgcattttgcaccagatttaaatttgctgggaaagcgagattgctgaggatttataagtactcgaattgtaccctttcgctgtgaagagaatggcacgaaaccctttcagaatgttcacttaagtttactgtttctcttggcaaatttgatgacttaacagatttctctaactagaagcatatgagtaattctgcttaagtgaccctaaacccaaaataaaacattgttcgatttcttgaaggcatgtgctcaattcagtccatttttccttttttcggcaaattgtttgtgggactgctagtataattgatattgcttctgctttgctaacagaacgccctgaaataaatcccatgctattgcaatctacgtttgtagcaaaggttacgattaatattagaaatcagctaaccatagcaaacctgtgtcataaaccgcttatccgtgatgtctgtacaatccgcatgacttcgggcggatgcagtgaaatttgtggtctgcggtagacaagcaaaggcaacataatttcctctcaaaagaagatgtgatcaccagcacttttagcgagcggttggggttcatcagaataaggtcaacgaaagagtcaaatcaatttaaagtgtcagtattctgatggtgtgataattctttgcttaaatgagtactattttatttcccaatgtttagagaatgctattgcaatttctttgcgttgtacgaacgatacatcctttgtggttttgcatgctatttgtcatttattgtatgttatgttggtttgtaagtgtgttatcaagaaaagttcatatacagtgtgaatggcaaatcaattgctctccagtaagttttgtacagtaatttttactcaaccgaaattttgcaacactaaattgaacagtttaagaaattttcacacatataacattgagttgtttatgaatcgctttgtatgaaaatttcaaagtcaatagtcaacagcaataactgtttgtttgtaatgagtattcgacattttttataattgacgtatctcaaaaaactgaatgaatagcttcatgatgtttttagaaaagttgttattttatacgagattgaaaagttatctaaagacacttttaagttgtatacatcaatgagggacatctagcttaccgaaaattactattttgtacgcgaaactgaaatagttacaaaggggttgtccaatactgtagattcagtagtgaaacccctttatcaaatctccacaaccttcttatacaaaaatgtaattaatgatgattgcaacctgatgaattaattaccgagatccatagggtaaagaactactttagcacctccatgattcactagtgaatccaaagtgtcaaaactaagaaacatttcccttctttcaatatcgttattgagctatgattatgaagctatgaaaggatgagtgccgttgcggaaatattgtttagcgttgtcgaataagaatttcgtgatttacaaaactttattcagaattatttgagatttgtttaggctcaaatgcagatacaaatgtcgatgctttgctcagtagcataactaaaaactcgtggatgtgttacttttcactgaacgcctttactcctaataactcctgtcgccaaaaagtgttgtagttcaaaatagtactggaacagatccgtcacagattaggttttgacttaggtcgtcaacttagtaggttttaatattatgaatctagagaccatttcggggaaatgggttattcggggaactggcgtttggggaaatcacatttgaggaaaagttagacaaccgagccttacatctaccaatctgttaaacacctaacaatgaaaacacaaactttttaacaattagtggatggccctattatttcaaattcattagttattgtttttcaattttgacataagtttcccgtacagttaatcaaaaaattttaattaagtctgaatgatgttgtcgaagtacaaatgcatgcatgctcaaaaagagaagacttctaatccacgtactcagtagcacttatgttagcttgttagtccttcgctgcttgcattgcgttttcaatttgaacttttaaactatagcattttgttcatttgcctaacccgattgtgtaacaccctttatatgttccggtttatttgattttactgtacgacatctgtcggtaggctggcaaaacctgttggtcttccattcaaagatatttacgcaaatgataatgacttatgctgaacttataattatattctgttatctaagtttgtcacaccaagtattgttttctgtcaatattgtttctattggtttcttcgtcgcgtcgcggttttacgttgtctatgaacacatatgtcaactgtttatcattcgttttgattactcaattcacccatagaagaacgcccccatcatatcattcgttcacatcttcatacaatcatttccatataaaaatcacaaacagcattactaatagaagcttttatcttttctccctttttctaacgatctcactaccaacaaccgttaccaacaccacatcaacgaaatcactcccaaccactcacacgaactgccgttcgatttcgtctaattcgccagatcgaacccaatcagtcatcatcgcttatcgtccagtagctggtacaacagcgcaaacaacagcaataccggaagcggcgataacctatcgatctcgcaccaacagcagcaacagcccacaggtctgagtccggctccactgacaccgactcgcagcgtctacagcgcagtcgttcaaccggaccacccgaataagcagtcgacgtcaaccgccgccaccaatccgcaagcggcgacgtccagtagtgctgtgccgacccacaacaatcccatcaccaacaacaacagctatgatcagagcttcttggtaaagaagaagcacagctcgcgctcatcagattcgggatcgccgcagcctcagcagcaaccatcgacgcactaccaccatcatcagcacctgcagcaccactcatcgcggaacacttcgccgatctcatcgacccatcaccccgctcatcaccaccatcatcatccgagcggtggtcacttgcataaccacatcggacattcctcgcagcaacagacgcacaacagccgaagcgatcggtccaattcgaggtcccgatcgcgatcgcccagtagctcctgctcgtcaacccacagtacaaccaccagtcagtcgaacgagacttgctcgacgacacgtagtccagctatcttagcccaaggcgtaaccctcaacagtggtggtccattgttcggtagttgtcgagaaggacgttccgatcgactagaccgtgatccggctgcacgtggaggtttacagtcggctgtaactgttagcaacaacaatggtggaggtagttcgggcgccagcactagcagtggttccggcggcggtagcctaaactgtcactcagatgacaatcgaccactggcgatttgcgttcgtaatctacccgcccgttcttccgacacttcgctgaaagatggcttattccacgagtacaagaaacacggcaaagtgacgtgggtgaaggtcgtcggccagagtaccgatcgttatgcgcttgtttgcttcaaaaagcctgaggatgttgagaaggctttggaggtgtcccacgataagctgtttttcggctgcaagattgaagtagcaccctaccagggatacgacgttgacgataacgagtttcgaccgtacgaggcggagctggacgagtaccatcccaagtccacccgaactctgtttatcggaaacctcgagaaggatatcacggccagtgagctgcgaaagcatttcgactgtttcggtgaaatcatagagatcgacatcaagaagcaaggtgttagtgcgtatgcgttttgccaatattcggacattatcagtgtagtgaaagccatgcgtaaaatggacggtgaacatttgggcagcaatcgaatcaagctcgggtttggtaagtcgatgcccacaaattgtgtatggattgatggtattgcggacgccgttggtgaaggctatctaagatctcagtttgatcgattcggcgccgtttcccaagtgacaatcgatcgtgaacgaaaactagcgttagtgttttttgagcaagttcaatgtgcgcaaactgcggtaaaagaaatgcgtggcgcgacgcttcgagggcgtaaactgcaagtggatttcgcttcgcgcgagtgtcaggatgcatttttcgacaaattagacaaacaatcatgtgcgtcgtttggttctccgcggttcgaatcgggtgcgggcggccgtttcagtggaaatcgtttcttggagaactccggtcgaagcagagcgacatcattcagccgacccggaaatcctctgagtcacagcggagcggtatcccctcggcttgatccgtcaccggtttcatcgagtcgcggtggcggttcctcaagttcacgatctcgcatcgttcggtattcgaacgatgagtactacccggatgctacgaatgctcacggaagtggtagcgaacggcggttccgtaactacgacgaatacagccaagggtcggctgccagttcgcacgaggatgtctacgagcacgatggttacagtggcagtcacgtgaggagtagtgctcacgatcggctacaaccatcgtctacgtcggactcaccacccccaaccgtgacatccagcggtctatcctcgtcgatacagtctcggctgggagacgtagaaccgaccgttggacttagtaggaagcgaagcgagaaaagtccaggtaagtgccccttttgatcttttgtattgatccaactgattagacaccaaaaaatatgttgtcagccgcttaccatgtttttactatataatgttaccagagatacggcgttcaatttttgtttctcatacaacgttaacatgccttttggacgtcgaaatatttttttctcacgacgtttactgcttttcttactggaaagataggtttccagaaactccttaagcataaattgttgtgaatatgttccagcatttttttataaaagggctgtaatttacaacttttgtatggaactaaaaacttttcgtgccgcatttttctattaaattgaatattggtattgtgtctgacaaagttagaagcgaaaaatgctgaaaaacttacgagcttctattcccaagtagcactggtaacaaatgcaatattttagaaaaataaaacaaattacattgccgttacatttcagataatttgtagcatatcttattgatgattttcaattttggttactaaactattacattgtaacttacgctttgtttacattacataggtgttgcatttttacttgcatgtaacttaacctagagctgtcaaaatgaataagttacattggaattgaatctgtggttgcaaagaaacaaataacacgctaggttacatacagattgctaagtcacatgtgtgtaacagcatgaagtttgtttaccatatgtcataggggaaggggtgaaaaaatgaacaggatggtaaaatgaacaccgaacttgttacacatgaacaacaaatttcaataatttttattacgcacggatgatttagagcataagcaagagtgtttttgttgagataaattgaagtcagaaccacgttcagaaattaaaactaatgtaattttaggcacagagatgttgaggttttttcaatgaagtgaatatcgtaatgatatgatgtcaaagcagaaacctttagaactgttttcgaagtgattataatcattcatagatgtttttttaggactgtgataaaaaaaataaaaaatgtttgttttgctcgtgtgttttaccaacaacataaaataaacatttccgtaatattttaacgacgatgaaagtatgtgaaaatttagctgtcttagtcttaattcgtatcgctgcgttaattaacatctctatttttgatgttgtgcgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacggtggccaattcggcggcagcggcaagtgattcgacgagtggtttgtgcggtgatccggtgatgtcatcctcgtccggccggggcggaggcgtcagcagcggcgaacatcatcattacaatagcagtagtaacaatagtaaccattacaacaatcaccaccatcaccaccaccacaacagtgcggacagtggtggcctgcagtctggattctccacttcttcctcgacatcgcaccaccgaaagtgtgttgaagttcggcggctctcggactgcaacctgcagcaatcaaaatcgttatcaagccaatcaacgccttcatctatgcatagtaacaataatagcagaagaccgtccactgacaacgcgtcattgcatcaaagacatggtagcagtagcagtaatagttcttccagtttacaacaatcacacctagatagcggacacctctattcccattcgttaaacaagcggcggaaaacgatcctcaacagtgacaacagtatgactgtcatagcgagtgcaggatcgacatcggtgtcgtctaacgagcaccatcattcgtcgcgtggccgaggtcaccagctacactcgttacattcgcacgaagcaagtggaggtgaaagcgccgatggttcgagacccggaacaccactctgcgatgaacggccagaaaacctcccaccaagcgagcccagacgaatacccacgagtcggtcgtacaatcaggaaccgctaagtttaccactaccacggtttgcgatacagttcctgcagcagtaccgaagtcaggcttcgtcgtcggtacctgcaatttcatcacattcatcatccaatgttgctctgccaagctcttcgctgcatcagtcaacatcatcatcgtcgtcgtcgaactctgcagctgcaccgttctcaaacgtcacagccgcatcgtcgtcgacttctacgttatcaacgcaacagcaaagcgctctaagttctttgcatgccgcttcgtccagtggtgctattagtggtccttcactctcgtctaattctagtctattaaccaacgctctgtcgagtccaccgccaacgaatccatctaagctatccctgctgataccaccgaatattggttcgagcagtagttccactactgggaacactcctgctagtgccggcacgtcgaacagcatggaacatgtcaaccaagcaccagccagtccactacgcgccccttccgttagttcaaattccagtgactccgaaggtggcccatcgacctcgccaacgctggaggaacgaatcaaccgactcgatgaaatgtatgaaaaatggtcaggcaatagccaaacgcggataatcaacgccctaggtgaacatcattttaacgatcgacaccacaaccatcatcatttgtaccaccacaatcatgccagtacgaccggaggcagcctgaatcagtcgccgctctccaacgtttcttcctcatcgacgtcctcgttccggcacaaattcctagagcttgatgtgcatgaagtacctccgtctgacatagtaaaatcagtactgtcgcgtaagtcgatatttgatgaagatctcaaacggttggaaaacataagcgacaagtatgaacccggcatgttcacgggctacacgaaaaaccctgcgagtttcaacaccgtcagtgcaaacagctcagccgctgcatcgccggtgaacacaatccttgcatcgcaatctccgctgcatgcactcaaagctcaaacaccgccagcccctagcctgcaacgacttggcagttgtattacatccggatctccaatgaacagtcctcagccatacaatagtccaaatccgtctgttaaatctggtctgcagtatccgttcccaagtcatccaccgtcaatgccatcggtagctgttcctagttctacatccttgacagcgtctgtgacgctttccatagccagtacggtcacctctgttgccggcagtactaatagcggaacgatattggcttctgcaaccacaagcagcggttcgctttctgcatcagcttcctcttctcctacgcatagcacagcatcgtccactcctggatcgtgtgcaacaccaagcagcttacctagcactgcgacgataaatacatctagctcaacggtatcatccttgagctgcagcagtttggctaccctagcaaataaaccaaagaccaatattttaaataaaagtattagtttaacggaaaaatcaagtacaaatattagtagtaacaacaataataatttaacgagtaacagtagtaatctagcgagtactagcggtagcagtaatactagcgtaaacgaatcatctgcattggtagcaagtactacagccactgcaacgacaacgagcataccaacaccgaaagtatcctcagtcatttcttcttcttcttcttcgtcatcgtcaaccgagacagtcgcatcgtcaactactgtcattgcttcctcaacggaaagcagcgcaacagaagcttcaacaagtgcttctacctcttccaacacctccaagaactctacagtaacggcagctccacctggtagtacaaattccggtacagttagatccaacagtatgtcgcaattatcaacgagcacttccacagatggagtccagcagcattccaatagttctaacactaactctggtatcgataacagtagcaatagtggcaatgaaaaagaggaaaaacccaataacaataactccggtagcaaacaccacaaagaccggcgaaaactttcgacggcttcgtcctgctcgactagttcaacgggatcgagcacgcccactgcctcctctaatgttcctttgccacctgagccgaagacaggtgctgcatcgtctactgatgacgatcaatctcaacatcagatcagtgggaagcataacaaatctatcaagtcaaataatcatcacggtcatggccatggccacggtcacggtcatagacattctagtgacagtagtagctctagcagctcaacatccactaagaaccacaacaagagtggaaccgatgatctgaatgaatttgataggcttaagcgagaggtaccagtgaacacaatcaactcgcgaaacaattcgtccaaccgcaaggagaaggagcgtcaagaacgtgaagagaaggaacgcaagctggaagaagaaaggatacaaaaggaaaaagaggaaatgcgccgtgctcaagagctgaaagagaaggaactagaagaacaacgacgaaaggagaaagaactagaagaacaacgccggaaagaaaaggaactagaagaccaacgacgcaaagagaaggaactggaggaacaaaggagaaaagaaagagaagaagctgaacgcagagaacgagaggaacatgaacggcaacttcaacgggagcaggaactagaaaaagagcgacagctgcaagttgagcgtgaagagcgagaaaaggcagaacgtgaaaagtggcagaagcaggaagaagccagaatggccaaggaatcactcaagaatgaattcgagtcatgtgacagcttcacaaatgatcacggttctgatcgaattgatcgagtgaattccactgacagcaattcgccctcgcaggctacttcgaagcgacgacacagttcccaagacagcaatgattctccagccgaagacgctaacgcaatgaagaagcataaacataataacattggcgagcgtcgcgattccggaaaagacggtaaacgtgagaagcatcataagagtcataaccgaagcgataagtcatctaaatcttcttcaggctcatcaacttcttcagacaaagttcattcgcatgtaaatgccctatgcagtgtgggtaaacacgacaaccatgacgagaagcagcaattcctactagaagaacgtcgcaaagaaatttcattctctactgatggcgattccatgcagttaagtcaccatcccaagaagaaggaccgttatcatgagaagcacaagtccaagaaagatcgggatgcttctagggataaagaaaacacacagaacgctaatttccctatggattacatcgaccaccgttccaccagtgacgaagatgaacatgctcgtcttcagcacagaaaagagcgtaaaagttccaaagattacagtcgacgatttcatggtgaaagtggcgaggagtataagaagtatgacagaaagctcagtcgtgccgaatcttccgctgacgaagaaggcagaaggaaaaagaatcaaactagcaatatccgtacaaaaacaaccaacagctcagatacggatgattcggatgaacctaagaagcattctatcttcgatattccggatgatggacccaatatttcaatgtacgacaaagtgaaagctcggtcatgcaagaacatgcagcgacaagaagaagagaagaagatcaaggccaaattctcaaagctgaagcagagtcgagctaagcgcgagggcaagaatcggtcgaagagttgggatgaagattctgataccgatggtatgaactccgatacaaccatcaacagtaagtacaatcataaggatcatctgaacaagagtggtacaattactacatcggaggacgatgatcatctgccatcaacgcccagaatgagacgaccgaaagaaccacttgctaccgattcggaagaggagtccaaccgtattcgttctaaccgagataggttgaatgatctttgtgatgacgaaagctcagacggagatcacgcaagtaaacgaccacctcgcacgcctcgtcggcattctgatgagaagaaaatgtcaagaaagaactcgaccagaatacactcggaaactgattcagatggccatcactctgtcgtgagaaaaacaccaactacaccaaattgtgaaagcaagcctgaaccctcagatgtccaaatggatcacatcaccatcaagcaggaaatgaagagcgaagaagatactcaggagggagtcagcaaagtagaaatcaagatggagactagagttcaacctccatctgcactagtgacaagtgatgtatccgaagatgaagacgtttctaaacccatcatcaaatcggaactcatcccaagcactatgatcaagagagaaccaattgatgaaggattcaacgtcgtgaagaatcgctacgccgatgtgtcatctgaaggtgagccgaacatgataacggtggccaacgcggaaatagagaatacagtaaacagcgcagttgaccagttgatgtacggacattcagaaggaaagaaacgacacaagaaaaaacagaagcgtcacaagaatgtcgaaggatcggaaacagatgtgaagagcgaaaaggaacattcaccacatgacgacgcttgttcggcgaactctatgtttgatgagctgaagaaatcgtccgacgatcagatttatgtcagttcgaagaaaaggcatggtggtaagaaggaaaagaggcgagaacgttctaaagaggatcatgaaaagtctggcaaatccaagaagtcgaagaataagcataaggactcgaacaagatatcagacgccatgacgacaaatgtgaagcgagaagagaagatagaagacatcttcggtcccatatctgatgaagaatctcaacattcgtctgtggaaaccgaagtgtcagtaaaacaagagccaagtgatgtgaaaactgaagataccgctaaactagaagaactgtctaacgaatgtgagcaaaccgagagggagaaaaataaggaggaatctaggaagaaaaaagagaagaagcgtcgtgaacgtgaaaagcttcgagcgacgattactatgaaagaggaagaaaatagtgtggatatggatgaagcgggtcgcgctcttgaagcccaactcatgagtgattctgaccagaaggctgaagatgcttcaccgacgtcaactgtaactactagcggaaaacgttcttccgttgacgtgatggatgtattccgattcactgacggagatgacagcatggaaacatcgttcaccgaaaagaaagagtccgaacatggtcgcaaagaaaagaaaaagaaaaagaagagaggtaaagatgagaagcacaaacatcatcatggtagcaataatcatactaatcctccaacaactactccgattactccgacagcgaataagttatccttggacatcatatcagcccaacaagaggataataaacatagcatcagtaaaccttctccgagcttaccatgtttgcttgacgagagtccgccggcttcgaacagcagccaacccactcaatcaatgtacgcatctacgccatctaggcagcttctgtcaccaactccaacggttcacgaaatggctagttctacaccgaccaaagatgaaatcgagtcggcgccaaccagtgtcaaagaagaaagcgcacaatctaagcctgttgattcgtcgcaggcgaaacgaaaacctgataaattgattcccggatttggcactgacatcgatgaacaattgcatgaaaaggccgttctatccatttccggcgagtttattactgaaaaggttaataaaaaagaagctaagagtacggatcctgtcgattctctgaagaataaatcggaagaggtgaaactagaagaaaagtcgagagtagtgatctcacaagaagaaaccgaagatgcagttgctgcccttcttggtgagagtttcggaacatcgaacactcaagacttctcaatcgactattccgaagatccggttgaggaatcttcttcacagttagcttccgattctcaacaaatccccgaggaagacaatgaagaaatcaagaaagctattcttagcttgaacactgaagggcttgacatgaaacctgatacaccgacatctgagcacgatttgcaaatagatacggacactgaagatcaaattgacgatgaacatcctgctagtctgctccgattcgataatccaccgaagactccggatgtggatctgagtcaaatcggcaaaccattgtcagatacgttgaatagcagctcttcggcgccgaattctgcaaagaaggacgataagcttgaagttcctgacacacctggcaaaaatgtaccgattgtgactagctcgccgtcaacatcaacatctcagagtacttctatatcgacagccatagttagtacaacgaccacatctgcaccaatcgctagcattgctccagcgatcgcaactactagtgtagctagcacgccacaaccaccagtggttgctccggtacctgcgataattgatcagcagaaaatgttaccgtcggctattagttcaggagttcaggaaacacatacgaaactagtgaacacgacacctccggtcacgaaacaaatctcggtgacgacatcgccagccttgccagtgcaaagcaaaccgaccccagttgttatacagaaaacaacggttgtaaatcaaccaccgatggttggtaatctaccacagattcgaccgcaagtggtgatgcaggcacctccaacgataacgatccccgagcaacatgctgtgtatcaaacgatggacgcaatgatgtctcccagaggactatgtggtaacgatcccagaatgcaatcccccaaattgcaacatcagccactatcaccgttctcgagaacttcgtccccgactgctactagtccaaacctactgagaccccaggtaatgattcaaaaccgacaacctgctcagttgagtccagtagttggccctcatcaaatggctgtccattcgccaggcagtcatgttgtagtttcctctccaagtcccaccaatcagtctgttccgaaacccgtgcaaatggtacaatctggcagcacaccatcccgattccctgtggcaatgggacaagtcaaaacaccaccattattgcagaaaccaaatgaacaaccacaactagcaaagcctaatctggctacattcactaacctgggtatggcttctggggtacgcgttgtgacaactagcacatcatctatgccaacgctcggaaatgaaaacccaccgatttcgactgttggaacgaagcctgtggtaagcacaactccaatgcctgtgtctactggctatgttatacaccctaacactaaacctctggactctgttccaaaggctccaccgggaacaccaacgaaaaccatcattcatcagcaaccggtataccttcagcatcctatcaaacaattcatgccacaacaacccgtttcgcaaatgggaatgagtcaacaaccgaatcgtctgtcacaacctgtgcttacaccagtaagtaacgttatcatcgcaaagccacaagattcaaaatcccagaatactatttctaccatcacttcaaatccaaaccacaaggtgctaccctctggtatgagtttgcaatcagataaccctctgtcagtcgctaagagtagttcagataagttagtcgaaccgaaggacaagttgtcgtctctggacgagaaagatcgggctcttccgactggcttagctagcacagtgctacatcaacctgtaatgaaactcgaaactccggcaccaattgacgaatccgcaagatctttgctcaccgaagagaatgtcgcaaagattcctgacaactccagtgtatcaagtgttctggatatcgatccggaagatcaggaggcggactctaaagaagacagtgactactggtcttctaaggatactatcatcgattcggtgatcaagaaagttgatgcgctctgttccgaggacgacatttcggaaggtggctctgaaatcaacaaagaagaatggaacaaagccgacgacaaagccaaaactgttgaaaaagcaccacttttgaatgtattaagcacatctggaactcaaggtttggaactacccaaagcagaagaaaagaagctggaacctactacctgcatcagtacgattccgtcgactattcctgttccgttgacgccaatagtaaccatggcgcaaacaccttcatctgcctcagagcctatcacgacttcaccggaagatgatgatacagaaacaggatcaaccgaaagcactccccctaatcgaggagggaagcgtggaggtcgacgtggaggacgaaagacatcggaaagcctatcaacaccagtcaaaccgttggttccggagaagatgcctgaaatggatttggggacgccatcgaagcgaggcggaaaggcaggttcgaaacgtagcagaggtgcagcaagaggtggtgctgtgagaggaggagcgtccaatgtccaacctttggtaatggcaggcggaaaaggcaaacatgcaagcaccggatcggatgtctatgaattccatgatgattctggtgaagaagtcaccggcagcgacaaacaacaggcggatggatcgcatccaaggctgatccttacgatcaaaggtactactgcaagtccaactccgagcaccagtaccgctccggtcgttgttacatctgctccgatcatactgcccaacatgaccactgtcggaactatcagtactccgtcggcacagctacaaccaacaacttcctgcccagctccccaaccaccgctggaaatgcaaactatccctgcaccagctgtagatgcttcaaaggaggaattcattcatccaacttcaggaaacactcgcaagtcgcgtcgcttgctggagaaagacggacgtaccactgtggatgacatcatagacgatgtaattcgtaatggtccatcatcatgtgtaatgccgagtgtacctgcccaactaccatcccagccaccgacacaaatgatcctgcagcagttccagccacaacatgtggtgaaccaggtcaaccagatcatgtcaccagcgcagccacaaattgtgcagatgcaacagcatccaaccggtccaaatgatcttcccggtccagctggaagaaggaatgcaaggcacaatgcaacccctgcaaatggtaggtgttctttatggttttacatagtaaacatattttatcatttttctttttgtttacttctagctatgggtcctgatgctcgtaaatctcctcgtgcaccacgtaaaggaaaggatcgcaagatatcggaaacatctaacgacagtaacgatgaacgatcaatgagcttaccaaggccaggacagatggacggcaaagttgaagaagcctctgtctctggtactttgtctgccacaacaccgataacaccgagtgtctctgtaacgcgacctaacgagatggcctcgttggcagataaatctaaagagaagcctaaatctgccgatgatgttaagatggagcttgatccagccactggtgagcttactgtgactcgaccagggaaagagggtcaatacttggtcatgccaaacgctccacaacctctaaaaaaggtcatagcagcggcagcaaatgcggctcaaaatgcagttgaacacctcaaatcatctcctactccaccgatctctgcttctgcatcgcccatccctaacaggactcctacacctgggtctgcaccttcacctggaatgacgagggttccaacacctaacactatggttaatccacaccctactcagcaaatggaagcccagaagttgtctgctgcaacattggcgaagcaaagcacgcaattgccatcgaacattccagcgcccactggaattgtaccatcaccgcatggcaatcctggagccgttctcatacaacacacggtgggtcaaggaatgccacaacctccaacaatcctacagcagggtccccataataagcctcattcattgaaggcacatgttttgagttcgcaacagatcataagtcagcatcctcagccaggaaaaccgatttacccaccatctacacagtcgcaacctcagattgtgtacaaatcggtcatcccacaacaaccgggttcggtttctggtgctatccataccaccaccggcaaacagatccatcccagtaccaacatgaaactccctcctcagggcatgcctactcaaggtatttcccagcatcctggacctcagcagataatcattcaaaatccaatgccccaacaacaaatgacaatcaacaagcacacgatcattaacaaagctggaccaccacagcagcagggacatccctcagccgtacatcatccaccaggaagcggaaatctgctgatcaatattcctcctaatctccagcaaatgggcaatattcccatgtctccgagaatgccccatcacgtggttgttaccaacagcaaaggtcagccgggacaaatgcagtctcaacaatctcattcccctcaaatcatccacaaacaaaccaatcaaccgccacaaccaggtcagcaaggaccgcctggtggccctcagcaaatcattatccacagcagcaaagcaccaccaggtcaccatcaaatccctgccggatatactactgtgttgcaaactggaggtaaaatcatccatcaaggtcctgttcaactcgcaggaccaggccaaccccaacaaccgcagccaggcatacttggaaagcaacaaacgcaaaccatccaaatctccagtgctagtggagttccaatccactatcaacaacagccaatccaaagtcagcctacggtggtccacaaaaccgttacaaccgttcatggcaatcaacacatcaagatacaacagcacaaagttggtccggaagccgttggtcatatgcatgttggtggaaagcatccagttggttcggtaggaacgaaaatacctctccaacagcagcaacaaatgcaaccagtcggaatgatgaaaccgaaccacataacaaccggacctgtggcaacgatcagtgtcaaccaacagcagcagcaaactgctccgccaccctctccatcgcagctggtaaccattcagccaggcaaaggagtgtcccctcacttgcatgcccaaccgcagatcctaaccggtgccgttgcaagtcctccgctgaagcaaccacacatgcagagtcaacagccgattgtaacgggtacgaaccatcataagttctgctaagacgaaaccttctcattctgaatttcgttttttttgttaacaggtgcgagcagttcgcgtgtagcattgccaccgatcagtccgcagggacaacctggtcagcaaccgccaccgccggcgtcccatatgcgacatgtacaacagcccggcgggttgattgtgccgtcacaggtgacctacgaatccaaccaggtgagtttgtattccaatcagcctctactacttttcagataggtctgcagtattgactttagatgcagaggtgtcgaaacttctgcagcacagatttatacgattctttggcacaaaattttctcgaaaaatgtctctattgatcgtggtatggctacatcgttcaaagaaactttggtatacattcaagcaagctcggcatttcagagattgtacaatgtttcatgactagtttaagttaattaacttaagtcttcaaattcgccgaaatgtcagtttttactgtactgctttcagcatactgaatactgttgtattgttctatatttaagtgtttgtaatgattttaaaaagctgctgtagaaacatttcagagtgtaattgtcagacaacgctgtgagtttatatatttgatgttacagaattgctggatttgttcagaacaaacatcacctacattatttacattaaacatgatacgtagggtcattttagtttgtacattttgtgtcaatgattcggtaattttcgttcgatttttcaatagacaggttcaattttaagttttcggaactcctctttttggacatagctaagatcggtttcacctctctttgaatgcttcattccggaccctcaactgattgctgctgccgtttctctgtacatgctgcagcacggagatttggtggcagggttcatcgctcggggccaaagtcctccaccagcacatcagcagcaaacgtcgcccattacaccggtacttgtacgcacagttaaactatttcaatgtttagatttgatctcttccggttctttctatatgtgtttcaaatatccgtggattattgttatctgatttattttattttgtgaacactttggtctcattaactgcttcgaatctaatagggcatcctctccttgcagaatgatccatccttccgtggcggaatgcctcgagaatataccaagtacatgtatagcagaggaaacatccacataccgaggtttgtacagagcatttttgtccagcatcgaagcgaatatttcaacttcattttgtacttctagtagcaggtccccaatgttgccagggtctgtggatcagcgtgagttgtccgaaatggaagaaagtgtggcagcgagtccgccactcgaattgcggcgtccagcaagtggtccacgtgtccaagtaacgactgccgtaccgagcagtttgcagagtcctggagatcgttccacaggtaaaattaacgctattttatcatgcaacaattttaatgatgttctacattttctcgcaccattcccagattcaccacaagtggcacaagtgtacatcggaagtgctcgtgttccacacaactattcggattcactcacccgcttctacgatccggcagctgggccgaacgctcctccgcgtgcattgagtgctgaaccaccaccagcacatcgacctcacagcttgatcaacaccggagcaggattccctccgggatcctacccgggaactcccagccagacaccgcctccagcgtcacctgctaatctcgctcaaatccagcagcagcgtgatcaacagcaacagtctcaacagcagcagcaacagcgcgatcgtgtcactctgacaggtagttacgatcgcttcaacgatccctattatagtttgtgccggcaatcggactacgaactgaccgattactttgatccttccctattaggtcacgcagcggtcgctccggtatccggtgccccgttgcccgcccatagtggaagcttgccggcttcgctaagccaacagcaaccacaatcccaaccgcaacaacagccaccacctgctgctgctggacgaaacctacaggccgcgactccaccgatcggaggagccgccgccgctcagatgccgtctgctggtccgccagcaccggcacaaagtgactcgctggaggcactgctgcaacgctatccggtcatgtggcaaggattgctagcgctgaagaacgaccaggcggccgtgcagatgcactttgtgcatggcaatccaggcgtagcaggaagttcactgccgagcaatagcgatggcacgacacctccgctacggattgctcagcgaatgcggctcgaaccagcgcagatcgacggcgtcgcgcggaagatgcaagtaagtacaaacgctgtgattctacagcacaccagaaacaaatagtattttataagacagtcttctgaatatattgatcctgatgatttcatagaattgaagcccaggtgcttctattgctcaaacgagtctctcagttgatccaggaatttttctacatcctcgtgtttgtcccgttttgaagcatcgtaaaacaaattcttgttcactggggtggtccctcaatatatttatttacttgggtacatctaattgagctatgtgcatgagcagaattttatcataatgaacaaacaaatctaaatgtaacaacttatgaaaaatgttttcgataatatttagggtcttaaactactttgcaaaatataaacaaagtattgtggaaaaatttaatattcgaagcaatgcaataggttgcctaacaagttgtaaaaataaataatagatttatattacatacaccatatttcggcggttttatcgatgtttatccactacttcgaacgttatctgtttttttttttctgcgtcttacagttttttctcgatttagaaagaaaattttgaaggatttcaagaatcgagcaaatgcgctaatagtattcaaattccaagattcctgattattgcaagttgcttggattttataagattcctggatcatcgattttgtgtttcggttcccagcttttacgtgttgatgccgaatttgtgacttccgttgaggatgaattaccaactggtgagttcgtttcatgcttgtggaaacacatatttatatcgtggcaatgtttgttaaactaactatggattcgtcactgtaagtgtcggcataagcccttattcctgtttcataaaaaaatgagctactcgaacatattcttttatttatttttcgcaattaaggtaccgcggggcaagtgggtaaatggggtaagtgaaaataattggtatatttaactgaatatgtgaattaacgttttaaactcatgcgtaaaactttgaggccattgagaacattacgataggtaagagatttctgagattattcagtcattattgcataatagagcgaaagattgttaacctgtcaactatcactccgtaacaagttggtggcgtgcaatcttattttaatattttcggtggacaaaagttgcggaaaataattttctgcaccacttctaagttgtcccctctgacagttttaaattacaataaaaaagttttagaattaatccgacatagacctaaaaataactaaattgaaacaccgtcaattttctaattatgtggggcaagtgaaaagtttctctttaaagattgaatttgtgttttctctttaggtagctatatgtatacaaggttcacaattatcatagaataacagaatgtgctgataattcaagaaacaatatacttaaaccgttaaaagctattatcatggccaaataatggaacttctctaagaaagaaggttgccaaatattacgatattaatatgtttacttcggacagccgattaaaaggaagatgttgattgaaaagttccaatataagagaacgcacggaaatctcgtggaatgtatgtgaagctagttcaaaacataaaaaatggggtacaggtgtatccacatgaaaaagtttctaaatacttaattgaaggattccgtttgatttctcccggctcttcgggtccgattttcttaacaaataacgagcggtgtaaattctacagagcagaaatgcaattgctgtcccatgatgtaagaactatcattggaaatgttgcagttataatgttgtcgaatcatgtcagcaaacataactgaacagaagaaaattcaagaaacaagaataaaattttctttgtttacatgttacttatgttattgttcattgggacgccttaacaaatgttaaaggtaataaaatcgtaaatataacggttaatttttgaatttattgttcaaaacgataaacttttcacttgccccacttgtggggcaagtgaaaagtaaggagacgtttttcaaaaactttttctgtacttttttcttcaattttacataaaaataaatttcagcatactgcttttatttggtgggagtcaagctaaaaaatatacacgacctcatttgttttaatttaaagtctataagatttgaagaattccaactatgcgaaatccattacccacttgccccacggtaccttactaaaaattatccttcgaatagttcgacattaaaattgtcgacgcacctatagacattttattttaattttaggctacatgagcataacttaccaaggtgaatcctgatcatgtagcttttgatctttcacactaacaaaacgccttcctataaaaaccatggagatgcaggggtgatctcggtctttaatagcaatgtcacactaacatttcttccccttccccccccccgatgaccgtaaggacatggccggcgtcgttaaattacaaagtttggagtcctcgaaattgtacattgaagattatatgctactcccaagctacatctgctgattccctgtacaattttgattattccggtcaatcacggagcagcaactacgaattgtacggtcatcaatgcttatgatttatgcttatgctgacttcgaacgttatggccgtatatctattgaaatactacttcctagaacctagcgaaccctgtcgttctcgactgcggactactatcgtattctttgaatttgatgcattcatcatcagtatgacatcagcataattccacggggcaacctccaagaagacttcctgaaaaattcagcttatttgggcgtttcataagctggcgcatttgaattgaggttaatatgggattttcaggtcaaacatatgggaaacaggacatcatctactgtttggttcagggaaattcttgatctcgttcaattgatagcagtgttttaactatctgaagtagatttgttaagcagctttgtatttattcaacagagctttatggtagccactaagcgcatcatagccacctatgacgctgggcgagcggctacaaaaggcgcatgcatatttgtacggaagtactgatctaagcctaacattcaataatgaaaataagcttaaatcagacgtcacactctcatcattggccatcgaccacctttttaacggtcggttcaaaaatatggtaggtggccgattcaccacccgcagcgctcgcatcgtttttgttcgtgtttggcgtttgcacactaccgccatctgttggcctatcggccaaatacaccggttttagcattgggcgtacatgtcctcgtgactatgattttgatcgacatttgttctaagtgttacgtctgtttgtctgtgatacaaccttctgcaattatgttcattggggtatcaactagtgcatttgtcattctgaaatcaattgaacacaatcaactagtatatagaacaaaactgtgacatagaatcaatttttaatatatttgaaacgaataacccatacaaactttgaatagaattgcctgatggagctacaaatcgagttgaagttttgtgagagctttttttagcctaaggctcatatctagggagtaccccgttgagttttacaacatttttgtttaggggccagcctaatgtacaggtctgccatcttttcaaagtttggccgacaatgtccatatcatccgcaaagcaaacaaactgattggatctgttggaagtagtttatggtcgttatacttggatctttgcattactcattctagcgcgatattgaagaacaatcacgcacatttttgttgttgtcaggcttgacagaatctactatgcgatgaacaaatgaggcaatttctaggttttttctgaggagtacaaactgaactcaaaactcataacacgaatcctcgaacgattgaaattgttactcacacttcaaaagaactcatgtcataaacgaaaaaggagttatgatggcactcttcttgggatttttttcttctgttgcgttttgtttcgcatcttcctcgcccatttttcattgcctttctgcttagtattttttcgctccctctcaaagaggcgaagacagtacgctgccctagagcatgctaccatactctggtgatgttgaggcgtattatcaagcctggttcggcggggcttaaacgagttgcagtattaccctgaaaacttcatacagttgttgaactgtttgttggaatcgaggtagtgtcgcaacttcaggtagaagaatcgtcggttgagaagcatgcgtcgtcgtaggtaaaagtatggaagttcgtcgagagaggtatgatatttgtgtaggataatgaattgtaaatggtttgaataaagagagttgcagctgctgattgaggtgtcagtcagttagctgcccagttgaaggagacatctactgtattgtatttctttatgatttgcaatcggatgtggacgggctagcctcgctaggatctagctctttaacactgttaaccttccagacgtctcgcggttcgccaccttcagaaccaccacgctactgatgtgagcagaaagcgagcttttttcatcagtgttaggcaaaatacaacagcgcgacgactcaagtgttaaatggcataattaatttccttcagaatggggatttgttggtttccattgtccgttgaactgagttagacatattcaccgaggtcgaccttcattgccagcaacaggtgttcattgaagtcctgcttccattttacgaccacctcatgttcgtacgtgccatcctgcatatcttggctagtagaacgaagccgagcgtcgatcttttgatagaacttttgtttttttagattggtactgtaacagctggttcaattctctgggtgggtctgctttttctataacgtttcacattttgccgagttgcttgttaatcattggttccttaatcgcttgcgctgtattcactacttgtagtagtaggttcgtttaatcgattcagtccaatgtacccgacgttactctaagctggtctcactgtactctcgcagtcttcaaaaaggcctatatcaaagtttatcatcttccggtaatgctgcttcaagttgttgcactatcactgcatgtttcatctggttgctttagcggttattgttgaaaacggatagtttttgagcgcagttcaactatcacctaataataggcatgagatgtctggcttctaaactcactgaccgagatcgtacacaaccgggagaattagcgtgaagtttctaactgtgattgttagaataaaattgaactggtttagttgagctctcagtgataattgatctgaatttttatttacaagttcgatcagaccttcttctgcaagaccgtttgacaactgatcgtatcgttaatcggctctcgttcacggagccacaaatcaacccaactttgacttcttttgacgcaattccgctcttccgtgggataacccaaatttgtgtaaactgacatatagctatcgttaggtagttctcctttgacaacagcgaaaaaaataacacagtgcaaacaaaaatctacccagcgttagctttcgcagtctctgtagtgggttaaaacaacttaattttaggtaaattcgattgaacctaaattaaatagaattattctattgaacttcgacgattgatcgatgcatctctctctctgtttttgacaacgttgctgttgcgagagaggcaaaacaacccaacagagggtaaaaactaaatacagtttacccaaaatagagtataaggaacatattttttgggtagtctgatttctccgtgttcaacggaatacattcgtgctttgcactcttaacattataaactaattttacatacaaaggtatcgaccgtgatgattttattttgaaattgtttatcggcatatcggtctattttgctcgaagtaagagggagcatggagaagaaagcaatgaatactagatggataggtaccgtaagggaacggcgagagaaattggattagatgttgaagagggcataccatatgaaacagtattacttgaaacgtcacttccttgtggctaacgtcccctatgggaacggcttgggtgtgttttgagaatgacactaccaagacagcctaggctacatacaggctctagactttgctgaggagcttgcaactctacgcgaaatattgggatgacgtgaatttacattcaaatctttaaagaagatgtagcgatgatcaaaaaatgacataatctgaaacatgccaaatagtcaactcgtatctgattctgttcgaatagagcgttatgtctaacacttcttctctagcagataccaagcgggttgctcgattgcctatattgagtaaaccaagatctgtactacttaagtattccatcagaattgaccttctcaaaatattattgcatatgttttgtccaatactgtaaatatgaattttgacattgagttttgatgatgtattttagtaccaaaatgatcgatcttgaaaggtggcacccaataccggacacgatctggaaatgcctcgaattctgtaaatttgaacatcattgaatgtgtacactatagcaatagtttataattaccaattcaatacaattgcaacatttacaaaaataatttgaatttttcttagtttgcaagatgcctatcaaaaacctctttcatatatgatgaaaaatagcacattttacgatgttgttatgaattgttcattcttcttaattttattgcatgtttgataccatggtcgacggaacccatgaaaaatgaaagtattttgagacactgatgcaataattacaaagatatcatataacaaatcaagctgtccgaaactgagggacaggaggtgcttaaccaaaattgtaatttgtccatatttacttcaattatggtacaaaatacattcatactatcaaattaggattgtgttcgatcatgcttgcgggatccaaagtattttttcattttcaaaataattactaaataggctcaaaattaagaagatacgtcaattttttaaagattttcaaacttttctacttttttaaaaagggatgcatatttcaaggatgtgttattctacgcaaacattagtctacacaaaagctttcttttctactaatacaccatcttgattggaccatgatttctcaatgtttcgactttgtccggtattgggtgctgtccggcactgggggatctccccctatatgattattttcggcgttatgaaatttgttaatgaacccctatgagctatcctaaccgtaaccactacctaacctaggcagaattaagctttttacaatctcagcacgaaaaagagcagcagcaaaaaaaaaacaaatcggtatctagtgaaagtcgccaaaggcgaaaagcacaggatacacactgtgtaaaacgtataatgtgaaaccataaggttgagaatttaaacaaaattacaacatctttataatcctacccttatttaggcatcatgcttgatactgaagaaatacacaatttatccggataacgcaggaagggaacaatactgtggagggcgccctgtactccacaggctcagtttgcgattaggtttttatttagactccagggaaattggctgtgtaacaaaacttgttataaatgtgtttcaaataataacacaatgagatatgtgatatctttagtataaatgtttgttaccacgtttgatatgttgcctgcctattcaacaaaaatgaaaacaaactatgttatcaaatgcttgttatcggaacttgttatctttttgttacccaactttgctcgggggtactgtgcattgcgtgattatttatcgcgacggcgatctggaaaacttgtttatagatcgtcgcagctacttaaactcgctttggtgtgttctgtgcgcgcgattattcctgattgttcaaggcatgatcgcacagcagacaccaaaatgatttgaagtagggggagattccccggtaccggacagcacccaataccggagaccatcgaaagattgagaaaccatggttcaatcaagatgatgtattagaagaaaaaaaagcttttatgaagtgtaatgtttgcgtaaaacaacacatccttaaaatatgcacgcttttttgaaaaaaaaaaacaggtttttgtaaaccgataaaaagttgacgtatcttcataaatttgaagttaattaattttgtatcatatttgaactaatgtatggtgaacagagtgctttgcgaagacccaagctgtccaattcattttcgcgcgctcggagtgtatttcggtggcttcgttcgtttgcccagtgctttgcagaggccagagcagagtgcgtggtcttttgatttgattgcgtgttctgatggaacgcgcgacggaatcaaaacaaagcgtgttcggttcgcgtcattcgagtacggacaaaaaaaaaaaacgacaatagtgcgtggtcttttgattcggttgcatgttccggtgggacgcgcaacggagtcaagaccaatcgtgttcggttcgtgttgatcaagtgcgaaaagcttcgtgttcagccgaggacgaagtactggtgagatcgtttcatgcttatgataattcatttttatcgttgctataagtagcttttattttattttcaaacaagctatgaatggttcgtcactacaagtgtcgactttttcgcgtttcattcaaacttaatataccattatgttttcgtcattgatcaaaataacctttgaatagttcgacattatgaagacatttttttttgttgcaacgaaactttttttttaattttattttaattttcaaacatactttgaatggttcgtcattacatgtgccgacaatacccttatttctgttacatacacttttaaaatacgcaatcctttctgtcttcgtcatttccaaaactaacctctgaatagttcgatattatgaatgtcgacttttttcataatttctcaatatatttttactgcgatacaaaaatgcaacactagttttaagtttcgtattttccctcctaatccatggatcgcatcaccgactaaaggtgactcccagatctttttccttcctcactaatcaacctgtcccgtgatgattgtggagatgcagaggtattctcggtctttagaagcaacgatcattacacaataacgttccttacccttcccaactgactgtaaggacttggccggcgccgttattgatcaataatatgagagctgctaaaattgcacttcgagaatatgcggaaaatcccatcccttattcatttggatcgaagtgcaattcttaccggttcggaacaatcacggagtagcaaccattgacatgtacagtcagtctatgctatgctatgctatgctatgctttgtatcatatttgaactaatatatggtgaacaaactacaattcaagcacctcctgtcccccagtttcggacagcttgatttgttacatgatatctttgtaattttacaccagtgtcgaaatttagaaaaattagaataacacgtaaaatgtgatggacgtagaattctgatgtacgacttgcagactaaataaagctcaaattcctcttgtggatgttgcaaatgcatttaattgacaatagaatgctattcctggagttaaaacattcaatgatctacgaatttacagaattcgaggcattgccacatcgtgtccggtattgggtgccaccttttaagattggtcaatttggtactaaaatacgttatcaaacgctacagttatgataacctatatcataaataagcacaaagaccgcataaaatcaatagtttaaaaaaaaagatgagtttagcggcttaggtgtccggtactgggggatctccccatgattgcgacgatctacaaccatttttaagatcgtcttctaccaccggaacaggcagcccctagttttagttcttggccaattgaaacaatagctaccgacactacgcggctatctaggctgaccgggaaaaataaattaatgttgatgattatccgctgacgtactgaagcagctacgtgtatttcaacacattcggctagtccttcacctaatcgaagcaattactggagtaattgctcatgtgctgttacatattttttaaaactagaattaccgtgtacgcacctaactttgcgcagctccaaactttgcgcatttttaagaagcatgaaaaaatgataattaatcaatgattttttcaacaattcagtttcagtaacatgttcgtttatgtgaaataagtatttgacatacatttgtttactaagaaaacctcgtaaatgttagtaaataacccaaaaaccctatcgtcacacgtataaacgtcaacttttacaccgtcttagcacaagcactaaggagtggctttgccaaaaatcaacattttttcgaacaaaactgtgttgtgagatgtatatttgcggtgtatttgcaaaaagaggtaatattctagtaattccctcaattttccatacaatatgtcgaatttttatttgaaaaaaaagcgatgcgcaatgttaggacccattttttacatgagggtcttaatttttgcgcacttctagcaattcaaaatggcacgtacatacatgtacgtcattacaaatgataatagctgtcgatcttaccaggaatggtcactcaatccataaggcagtggctacatataatatttctgaaaggaccttttgtatgaagctgaaggcaaggtttgcatcgaaaaatctcggaaaacccacttgacgcaggaggagacttttactgtgaacttggaaaattgatagcgcaaaggttggcttaccacttcatggacaataattcaaaattcagttgtctagcaaaaaacgttcaattatggaatatccgtactgacgtcaaataaataaaaaataattaatcacgagagatcaacgatacatcgaatcccgaacttatcgatgctttccatggattcgatgaagcttcagttgaaagtaaaggtccgtccattaagggacagtccctaagcaacctgcagcttgcaatattaatagacaaacgagaaatctctcgagcatagcatgtctgaactttaattgaagcacatcactgctaatgactcgtcaagttcatctggaaatcctccacttccagctgacgacatgtacaacagagaagattttctttagaaagcttctaaattgtgcgaaattgaatcgttcacggccatcagcagtgaatacgagcatcgaatttcggtagttattgaaggagatgaaacaaaataggaaaaacgaaaaacaaaaacaacaaaaaaataaaaaaaggttaaaaaattaaaaaaaaaacaagagaataaattatataaagcaacgtacgaaaacaaataagtatatgctacggctgtaaactatattgctcagattgtaatcttgtgaatatataataaaaaataagaacagtgtaaatcactattcgtggtcactctatgtttgtggttgttgaataaattaaattgaatttaaattcacggaaaaactactgatgaaactcatattagttgtaacctttttatttaatgcaaaaccagtaaaaaagtaaaattatttagagcgaacgagcaattaaggcatgcgcaaagttaggaacattatgcgcaaagttaggaacaattcagattttgtgcgcaatgttaggcacaaggtattgcatcacctcttgcatttttttaattttttatgaatcttttttattttttttaaatcacgtgttctactgaaaggctaaaagcctatctttgacagaaaattgaataaaaaaatacatattttagccttatttgaagcaaaaatacgatgataatttcttaactgcgcaaagtttggtgcgtacacggtattccactaactattctgctttatacctcgctcgtctgcgccaaatggcgacagcttttctctacgtctcgcttcgtcttcagaacttcggcttctcattggtcgccagtttcgaatttctccatactctcttcgtgccaatgtgtatgcatgggttgctattgcgtttcagtgtgggagcaatatctgtttcaaactctcttggaggctctcttggtctctgatatattccttatatagccgctatccatatctgctggaatagtcgtctttgtggtcgcattgttatctatgcaaggaacgaggctaggaagggttgacatagtccgatgcatttcaggtaatggcatctattcccggctagttagcccaaccaggcaacggatttgtaacgtaatcagggtcactagaccctactaaggaagtagaatgttgtttctccagtatacatgattggtaccgcactggtgttgcgatcagtgtcttcctgacatcaatactgatttgaaggatggctgtcctgttagtttgacttgtactgtaagacctattcatgtggtattgttaaaaatttcaatatttttaaaccgcttcacatattcataatgcaatgtttgacaaaccgaataacatattctcctcttacccaattccagatggaccaagagcactgcatgctcctggcgcttccgtgcggccgcgaccggatggacgtgctccagcagcagaacaacctgcagaccggcttcatcacctacctacagcagaaacaggccgccggcattgtgaacattgccgccccgggcagttcgcaggcggcctacgtcgtacacatcttcccgtcgtgcgagtttgccaacgagaacctggcgcgtatcgcaccggacctgatgcaccgggtggccaacattcagtacctgctgattgtgattgccaccgtgtaggaaaacgaaggtgagtacgaccccggatatgactgaacacccggatttgacagacgcaaatcgtaccacccatccgcaagacgaggtggtgcgtttcatggaagaggatgtgaaatgatctcattaagattacacggaataaatattagtagtaagctgctacctgctagagaaggaaagtttagtgaaccggagtcacgttagcgctctagcgcagtgataatcgataaggttttaaattgcagtgtaggatacaactgttgaagaggttacttagagagtttgtgagacaggattagggaaaaggcagtagaaatagtgcgttgagagcataagttgttgagtaatatggtaagaaatgagcaagaaagtggtacattatagggacttattattaagtggttgaataatcttaacgacagaaaagagcgaaactacccgactaagaaaaaaaaaaatacaatcgattggtcagagctgcgcagcttacatgttcgtagttgctttcgatgcgacgaaaataaacgcataggaagaggatgaagaaagtttatgtgacaactgtgattttgatcataatttttaagtattatgaactttttataccgtaaactgcaaaactaagcaactgattaaaaaagggagaaatcgcgtgtaatagacgtctaacgacacatgttgagtaaattacgagtaactctactgagtcccgctcttgagttttttttgttgggcaatgtcccaaatacatcggaggatggaaaactgaaactgaaagagatttttgtacatgctggtaaaatgagcgcaagaggagagtatggatttacctttccttgtctcattccccctaatttattgaattattgttttccttttctgttgacaggtgtgtaaaataggtactttttagtttttttttcattcccgtagaggaaacgatttgtacgatatattggatagaagagttgaaggcggagctgtcgtaaaatatttataacgtgtaaatacatagagcagaagtaattgttgaagcttaaatagtagttttacactaataacttgaaaacgacgacgatgaagaagaataagaagaagaagaagtataaaacgaggataaaatgtaaaaataaatatttcatataagctaactggtaaacaattcaatgtaggtctcatgaactgtttctgacgaagaagagataagcatacagcaatgctcgcagaaattgcgcatgcattgccggaaaagtaaacggtaaagaataggcgataagtttcctaaaattgaagttattgttttattttaaagaaactaacttaaggctagtactacgtgtagttcacacatacacacccacatttgtgtaaatataatcttaaaatatggcgttgcaaaaatgccaagaaacatcggagaataatgctgttttagaagtctactgtggtaagatcctaaatctaaaatatttacgcaaaattcttgtttgtacatagaacgctgattatgatacaagcaacaatcaccagcactttaaactgtggtgtggtgatgaaaaatgacacaacacgagcaaatattttgccgcagtcatttgttctatcgattgatttgtctcctggatgaatacctaggttttgtgatgtcgcgagttaacgctgccacatacacacacatacatacacacatacatacgtgtcctgcccatggttgtgagccacgcctatttgcagataagttttacttttaattgacaaagtgcacaatttgttgatatgcgggaagactttcggcagcttctgtaacgtttttcatcccaactgtgtttcgttggagcgcgacacgtgatctcagcactacttcacgtgtcatcactcggcgaatgcattgttcttctacaccaacagaaacattctttcgattcgtacgtttgtgtcggttaaaattctttaggcggaaagataaattgctcattagattggtagggtggggtaggatttacttccaccgtttaaagtaaaaagatgatagcatactttaacaactcatacacccgttagagaatcccaattctgcaaacgcgttgtaagttggaaaaggaaatctatttagatagcaaaattatgtgtatgtgaactgaatgtgacacctacatgggcgagcaaacatttgaattgagaaaatgttaggcgatccgattgacatatagcgcatcaacgacaggcaaaaggcacatcataatagaaagcttatggagaatcctttttgtggaacaggaatcgtgactagtgtttcgcagaaaaaatggaagtaatcaccaaaaataaaaaaatgttataaagagaagataaaagcaactacaaaaatcattaaactaataatcattaaaaaagagtcatcgaagcagcagcgttgaatacgataaaacacagacacacaaacacgcgtaggggagagcactgtcactcacgcggtagaacacaacactgaataattctacatgttaaaaaggagaaaagagaaaaaaataagaaagcaaagtaaaactactacaattatggaaataaagcaaaagaaaaaagtgaaaaatgaaaaagttaaaacattaatattaatattaactgattgtgatcataatgaaagaataaattgtacctttcttgtatattttgtacatattgattatgattaatgattaaaattgcaaggaataaaatatttaaaaaatcagccttagaatttttactgtgtgatgaacagaaaaagaaatgtccagccagtttcaagtgtggttttcgaattcgggagaccaacaattattttttttatgtaaggtaccgcggggcaagtgggtaaacggggtaagtgaaaataattggtatattaaactcagtatatgaattaacgttttaaactcatgcgtaaacctttgagaccatttagaatattacgataggtaagagatttctgaaatttttcagccattattgcatactagagcgaaaaatcgttaacctgtcaactatcactccgtaacaagttggcggcgtgcagtctaattttaatattttcagcagataaaaattgcggaaaataattttctgtaccacctctaagttgtcccctcggacagttttaaactgcaataaaaaaagttttagaattcattcgacgtagacctaaaaataactaaattgaaacaccgtccattttctaatcacgtggagcaagtgaaaagtttctctttaaagattgaatttgtgttttctctttaggtagctataagtatacaaggttcgcaattatcatagaacaacagaa

SEQ ID NO: 138 - DNA, 134925 bp, Aedes aegypti
  misc_feature (91310)..(91409): n is a, c, g, or t
ttgtgaactggaataaacattgatgtcattttcgatccacaaatttatcctctgtagacaaatctacccgtcatgacgtcattccaatgctttatgatccacaaatcaatgctcgccttcgccgtgccgaagaatcgtttttttttgctacagaactgcaccatctgctccgccatagcctccggttgcccatccggcgcgcgcgttcgcttttcgtgcgtttcacgacacgatcataccactgaatgccgacacgagtcgtgtaaaagtcacacaaccaaatggtggtggtgggaattttcctcgggtcgggaaaacccgatggtggtggggactcacgacgctcggctcggctcgtcccgttctatgaaggtggggcgagttcggtttcgcgtatccgtacgtgtgcccccctcggtaggctacccttgtgtaggtgtgtgctcgcgcggctttcattgtgcaacatcggcatcaggacacgcacgcagggcatcactattgcggttggggtgtattggtgcacgcggactcgactcgcgcaaaaccgtgcgccactatcaaaaaactcgcgaacgtttctcagttcgcctttaaactgtttaactcgcggattcaagtgtaagtaaatctcgtcgctgctcgaggattttctgcctgcctttgggggaactcgagagtgcgtgctttttcctttgattctgggctgatagggaatcgaactttgcgtgtacggctaaattgattgggtttgattgggattttcgaggttttaagtgacgaatttgtgattgaatcgtgttgaagtgtgaaagtggttttcgaagacctccagtgaagagttctgtggaaaagtgaccgggaaaaagaggacacgagtgcgaaaaagtgcgtcttatcggtgaagtgttgtgtttgaccagccgagaaggtgtatcagctgatcgtgcgcaacacaggacttcacgaacaggacatccgaaggattggtatcatttgacaaaacactaacactagttcgtagccgggcacaagagaccaccatagggggtgatgcatttcggtgcatcggggtgaatgaattatgcagatttcggcgttgaatgtcttactcatcgatcggcctgcggtaaatgctattggcatgcaacaagaaaacacctagatctagccattgggctgcacttacgagggtatttttaaatttacaagcaccctccgtctcgatccggtgttcgcgcgttacggttgttctgcagtgtgtgtcagaatttatgggactatttttaaatatttctctctccacacggcacacagatctttcggtcggttcgtgctcggaatgttcaatctggtgtctggtcagatgtaggtatttttttcaccgagaaaccgccaaatgctccgcatcgaaacttgagagctatttttagccgacagcccatgttctggcttcaatccccgtgattgtttaatccattcccgctcggctcggtcttgtctctcggttgttttgtgatggattataaaattgaacacaacacgctcggcttgtgttgtctcaggacatcccctggccaccccctgtagaaacattctacccatgcaaccggatcggtcttgcatcatatagcatctgagtcagcatgttgccttgaagtcgtgtaacccgtacatgacttgctcgtccgatcgtcggtggtcaactggccgcagaatttcgatacctgttgacaatcggtcggctgtatctacgatggcttcctcacatggtgggctatttttaagtttgtttcgtgtgaaacgtcttcgtttaaggaaattgcccactgcgtttgcgctgggaaaatttttcatcctacgtgcgcgcatatgggagcgaactgctccaccaccgatgttttagtgtgccattttccgaatgagttgccgtgcactcgttgctatccttcgggtgggaatgttgcttacaatttatgatcttgatattttggtcgttttttaattatatgatggagatggtacaaatttagaacacgacgatctcaatgaattgatgcggtgtcatgagtcagttcatccccagtatatattgtagtaaagaaaagttcagttgatgatcaatgttttaagccagatagatttgaacctatgcaaccattcgcgaatttttttttcgggaaaaaaaattgagagggaatccattatcattaggaatcaatacgttgagataaaacagatattttgaataaataatcttcaaactgtatcccattaaacatacatttaaatttaccccagagtattaaaaaacaaaactcatgaagcttcctgaacagtgacacattaaggtaaagataaataaagggcaaaatatggaattttcaagaccaaacatctagagaactggacaactgttagtgttgaaaatttgatcgattggtttctcactggtgattatcaatcgatcaaattttcagcgcgaatgattatctgcttttctatttttgtggtttagaatattttttctgcacaatgcatattgcattaatattactttaagattgcactttcacgaattctttagttgaaatgcaatcaacacatattaaaataagcgagctaccactgcagtggtctgcattgtactgtatgcaattgatttcaaatatcaaacaaaccatatataagtaaataaaaacccgtgctagggtgccggtaccattaatggattacctaagcacaaaaaatcataacataataaagaaacgttctataaatgatctattggtgtcaaccgaaatatttcaacataaactataatttttgagcaagaaattgctttagccactattggtacacatgttccagtagttgctctagtggtcaagtagtagactttcgtaaatgatgcaaagaatttcaaacaaaatagttgattttcacctaggtttttcagcacagtgtactacactatggtatagcacggttattcatttgcttagaggtatttcactaaacagctcgggtatttatttccatagatcttaggcgaaaaacgtgataaattaaaaggtactccaagaactctgaataaagcaagagtttttgatagaatcttcaatagaaaataaccaacatcgttttacaaagcttcaaaactattttattgaagcaatgttcaagaagatctatcattgcaaactaccatactacctatgttgctatgatagattttcatgtggtctcccgaccagtggattacaatagagttgtaacagaactcagtaagctcgttttttctaacaaaataggctataccgtgctgcctctaattgccggacgcttcgaaagccggacactggcctttttcacggtgtttttggaccaaatgcctttttttcgcctagaatccataattaagatgtcttgtacattctgcatgcattaaagttgtcggaaaaatagtttttcggtgacttaaggccgctgtccgggattcgaagcatcccgacacttcgaattattacggtatttttggctggctagtagttaaaataacaaaaaaaatattacaaaagttcctctgcattaatccaaattcaaacataacattttataatttggacaaaaatataatatataacctagcaaaaaaaacttaaaactttacatgtgataaaactgcctatttatgagcaattgctttcagattgttttcaacaaattttgttaaaatcgtgcttttaactgaaacaatattgaaacagcctttgttattaaactaattttgaaaagacgctccaagtctataattctgaataaaatatctgtaatactaaattattcaaaagctttgacaaaaagacgagatttcaacaaacaataaggtaaaccggggcaagttgaaacgggttgggcatgatggaatgctaagttttaaataggatatcaacatatgttagctgatattttacctaaaagtttgttccatgtgttgacttaatgttactgtaattgaatttctcattataatgaaaattcactatgataccttgcaatttcatcttaccccagccgtttcaacttgccccggtgtaccttacatttattcaaaagcgcatttgagcccttattagctacctttaggaccacacgtgcgtggatgtaaaattaaaccatgttgaagatgtttgggtttgatctccagtaggatacaaactattttcgagctgaaaattttatcaactttcctggaaaccgagtttcattgtgccacacgataaatgaatcgaacaatggaatcattgacacaaaaagcttttagttgatatctgtggaagtgtagaacactaagttggtattaggccagctacagaggtcagggctggaaagcgtcaatgtaaataaagagtgtcgcgtaacttttacatagatgcttcagtcactcggacggcgagacaatgacagagatttttcaaattctctttctcggctagtgacgcaatcagtaacttgataatttttagttcttcatctggtatgattgttatttgtatcgcttaaatcatagaaggatatccatttaacttatcaaacacatttagggggacatggggcaagaaggacacccggggcaaaagtgccacctctaatttcacgtagttcaaatcaattttttgatgtttaacgcaggataagtataaattgagtactaattgagggttgtgtaaatattatagttaaaaatgtttagtacaaaaaattaaaaaaatgtctttaactcaccaacgcaaaatatgcgaaatattataagaatgtaagactggaaaacaaggtttgactcccaataaatacaaaacatattgatttttccgcacagtattgatgattttcaattgtttaatatagctgtgaagaattttttttcgaaaaagtccttttgacattaaattttacatatataataacagtatgtcttacggggcaagagggacaccgcaattttctcatataaaatcaaatgattttttgtttttcttgtttaatattgcatttaatcaatgtttcctactaaataaaataaaaataaaccatcttagacattcaaaatggtttctgatttttttactattattgttaccgtcaaataagatgaaaactaaattaatttcttaaaattactttttaactataagtcaacttttatccctcaattcttatctttacttactctacaatttatcgtttaggcggggaaataataatatacaaaatttgtggcattttgctctggtggtcttcttgccccatacgagtggcacttttgccccgtgcctcgtttaaaaacctcataagaagggacattttcaaaaatctcaaatcatcatgtgtttcttatatttttgaaatctatcgataacatcatttagaacaagaggtgagcttgcccctacactggaataatcttcaaaaactgtgctaatcatccatgatttgaacctatatatcttaaggtgtccttcttgcccccagcccccctacttcccgaaattctaagaaaatagatagaaattttaatagcaaaacaacattaaaattgctctcgtgagagctctgccattgcgacgtgacgaagtgagtacagaaaatatagcttcgtctagtgacagtgagaatactcgtttcgtcagtgatgctagtcggtcatgatacttaacagccctgacagaggtgaattctccaccatttggtagatttgttctatcgccatatttttttacaattaggctcaatttacgaaaattagcctcaatattcaattgaccgaagctttgatagcagcctagctatctgaacaaaagtatattacctttccttttacgtgctttttgttgattgcactgtaaagtgagtaaaatagatgccgtcatacactgaaatgaattttattgtagaaactactgaatccatggtaaaattaagaactgcaccaacgattttcaaccgactatattaatctgttaactctaccaaaacataatcaacatcactacacaagaaaatttcttctgttgatttaaccagagttgtagtatttttgactagaaacacccttaatttgagaagtttagcatcatacttttgaccacactgtgttgtacggtgggtgtcacggattgaaatacaatgctttgtagtggatgctactatggacatagtcaaatttactgcactgctcagtgattttcaccagattatagtaaacttaacagatttttgtagtcggttgaaaatccttggtgcagttcttaattctaccatggattcggtagactatataacaaaatttgtttgcgtgtagctcacgaaaagtatataccatgcacccccgctaatttgaacggtacctcatgcaaaccattggggttcttttttaatttgaacttctcgtcaccctaaaaacgtgattctgtttgccttttttctgcgttccgttctacagagttccatttcactttgctccattccatgagctaaataacgtttgaagaaccatttttaatctggacgatgtgcaaattagcggggtacaaattaaaaagtgttcagattaaaggtggtcaaaccaacgggggtacgcggtttcacaggactggtaacaagtcatttttagtaactttttgacctggcctctaaaaagtcactatttccaacaaattgtcactaaagtaacttttttcaggaaaatggtcactaacgtccccttttccgtgatctgatgataatgaaatttagggtaggattaacttttcaaacatgaacagaataaaaataaatatttgtgattttgaaacctcaagacaaattgagactcacggctaactttctggaagaactcaggtgaatattccgtagacatttccgaactaaaaatgtataaattttctgggaaaagttttggagaaggttcttaaaaagcgactttgggataaaagttttgtccgaaatgttttgatacattttgacaaaaaccaggaccaatatctgacagacctgctaaatacattcccagtgaactttctgcagtaatcaaaaggcggttagaaacaacaattttaaaaaaaatagtcagaaaatcgtccaggatctcaaaagcgattactaattttactaaaaatcatttcagaaattccattataaggtccaacaaacactgttttctacacgactttggtcaactatttctatacaaacaatacttttctataatgaatgcttgaatattgttggatgataataatgattcaatagtgatatcagtggctatatctacctttacatgcagcaacaaatatttactgtttgctttttaatctaagtatgcaaaataagtcatttacagtgtcgtagatctgttaaaacgtgtagttacgagcaagcatgggaaaaatcactcactcacccgaacgctaccgatgaaatatctgcaaagtatctgctgccaccgattcttcaatgactgccgaacgctactagggtgagcgcaatcccgacgaatcgtaaacgattgagataaaccaaaaatgaaaagatatacggagcggagagagcacctatcctctcttaaattggagacacgaaagaacgcgttcgccataggccaggagaagtggatgaacttgtcattcatttttctgtcaattctcatacaaaatctactttttctttgacataaattcactctaggtgaaccacttcccctggcctattcgatcaatgaaagcttcctgcgaaatgtatagcttttgcgttcactgaaacatttcgccttgtgtactaccagtcagtgaacgctcttcagctctcaaatacgaatgccactcgtgcggaatcggaatgtaaagaatcattcgctacagcaatcgaatgccttcggcacaaggagtcggtagtgaatcattctgttgccgtttttgtctaacttgtcgctcggcgaacaagaagaaagcgcattggaaattgaaacactcagcttgatcggagatacggcaatctcgctcttgaccgcttgtggatgtgagcgagagaaatgcaatattcgagtgaatgtttcccatgcttggttacgagtcgccactgagtaatatgtttgatttcaaaacctaattcattccagattccagagatttgttaagaaatgcttcaagtaatttgtttttcatctctacttcaaaacgttcaatgaatttatgccagtaagttcttcatgaacaggattttttttttaaattctatcacgattgcgtttaccgtcgttcatgtatttgatgattttgttttttttctactgaaatataaaatagtaacctatatcaagctaatgttcgtctcgttgaaaaatgataagttaaatctccaatgcgccattttttgtctcatcctggacagataattatttaaaaaaaactagcattactgcaattctttacattctacattcacccaatatgtagattgtttaatttacccacagaacgtattttcatttctagcaactttaagactaatgcttgtaattttgaagtcacttctaggtcactattttaaacatgttggcactccagtcactattattttgctgtttgactgctaccagctctgatatcagaacctgctgtacctgctttagaaagtagccttaagtgtaacatactgtgttgtttgataaacttctttccggatatccagacggccactgttcacgtgatgggaactgtttggaaaatttgctataatgttttcgttactattgattcaatgtaaggtctatagaaaactctgaaaaaacgcaaattaactagcattatgctttaaaacatcaacactcttttgttgaaatgtgtatacttcatatttaacatataatctatgtgatacacatcaaaatagttcatttttttaaacacaattttggtttttaacaaagacgaaacaagtgggtccaaaaattttatgtcaaaattaagaacccactagatgtttctctcacttagcaatacacttagttatccaaagttttcgtcacaaacatgctggtttagctgttcaatgtttttggaagacgttttgaagtgatttgtgataattgtaggataattattggtcaaaaccggttgaattgtatcacaaccggtaattctggaataatttgtgaatagagcatgtcaaatcagaattggtacatgaaatattcaaaacacaatcggtattactgcttttttggtgtttgccatcagttctgaatggcttggactaacaaatatcaaatagaccttacaaactcctcaaaaatgcataaaactataatggatatagattttttgcatggatcacgttttttgaggttttttttccctaaaaatcacacatgcactctttttttctttctttattattgagacttttagccctaggttggttcatctcatatgcactctattgacagaagtacatatggtagataacatgtctcataatgccaatgaactgtgcaattgactaaatctgttcaactgcatataggccagtagtagattgaactaatatggtgctcttatgttgttcataccaaggaacaaatacaaaagcaacctttcacagtacatcgtttttatgtgacatttgatctgcaccatatttacctttgcctgcatgatcgaaattaataatatatgtgtgattttgattgcaaacaccttgaataaagtgattcatgcaatgaaatctttattcattattgttttatacgtttttgtggtttaatataaccgaaaaatcaagaaacccgtacatgtacatgcaaaggtatcgaccgtgataattatatttaatatatttattagtttccggtatattttgttcgaaataagagggagcatggagaagaaagtaatgaatactagatggatatgcaatgttgctgaacaacgatcggaaacgcgaggcacgatgaattttcgtaggcatcaaaacagaatctgcgaataaacacaaacaaccgttcgggcgcttccttcgttcgtgtttcattttcggatcgctgtttctcccgacgctatcatcaagtgattttccatcgctcggtaatgtgaacggtacgatccaagctgcctgctcttcgcgaagagcaggaaaatattcatttcgatcatcttcatgcgggctcgcaacaatcacgctaaacttgctccgctcaaaaataagtgccgagcgcacaaaattggcctcttttcatgcagcacagattatgcgcaaaggggctgtacacagttttgtgaaaacggtggtaaacaaaactgaatgagtgaaatgcgcacagagggggaacgcttggaatgcggaacttacttccattcttgttttacttctgaaaacatataaaaaaacattccaattttaaagtttttcagatattttttcatttgaacagccgaagtggaagcaaatggggaaaaaactttcgcatttgcgaccatcttccgggttttcgctagaaacatcccagaaaactccccatcttaccaacgaccaactatttgctgccgcgcgggagatcattgacagctccgtttccatcgattcccgcacagccgaaggccaacacgtcggcaactcacagaattagtgcgacctacacagaattttcactcagtcagccagttctgcatttgttgcctcattctgtgtagttttaacacatgcgatgcgtggagctggcttagcgtggagtgtttgcttgagtttacgagaagaagcaaccttgcaatgaatcacgagaattaacagcgtgtggataaatgaatcctacgagtggaaaggcttcgcgaaccacttatcggtgtgttcattttgcttgttcggcgttgcatccgttcgctttttgcgatgctcttcgtgacgcaaaaatgaaaaatgaattttggcgaatgttggatcgcgaagatgcgtcgatcattgttcacgaagaagatccatcgcaacactgtggatatttaccgtaagggaacggcgagagaaattggattagatcttgaagagggcataccatatgaaacagtattaacgtaccatatgaaacggcttggcgtgtagtacgaataacattaccatgtcagccggtacctatccatctagtattcattgctttcgtttctatgttccctcttacttcgagcaaaatagaccgatattccggtaaacaaactaaaaaaacacatatatttactcacatacgtccatcaaatcaaatggaaaactctccagaagcacttttattaatcgtgtttagattattttatataacaggactgatttcaattgttttattcacggatgtccccagtattatcgggttaagtattttttgcaccgcataacagtacaactgaatcgtttttttttaccaataattccgctaagcaattacaaatcacctcaaatgtctaattttttgtttcgtctttgtaaaaatcaaaattttttttgccggtgactgataataatgatattttaattgatgacagctcgtctcacagtaaaattcaccgaggagtggttcaaacgtgccatcagtatttattttcaacgccttctaaatgcggtttcagcacccatttgttctaaactctatttttggttccaatattaacacgaataaagaatatgtaaataactggatacaaaacaatccgatatggttagtgtatatcgaaaaattgaataactctcaaagacttcaaaccccaataaagtacagaatattcacgtgctaattagcttatgatcatccttgaaaattgaagaaactttgaagcatcttttgtaaaacttgacaagggtctccggatggacagtttgtataacaaagcccaaccataaatcgccaaacggaagatcctattttttttctgacgtaacgtccttactggacagagcctgcatctcagattagtgttcttataagcacttccacagttatcaactgagggcatccattgccagttgatcatttttacttatgtggtaagcacaaagatgttctttgccaactcgaaaagatcctcgatcgaagggattcgaacccatgaccctcagcttcgccttgctgagaagctgcacgtttaacgctatggatgtatgagccccaaaacaaactgtgtgtttaaaatttctggtgattagttcattatagcggagaaaccctcataagccgagtggttagagtccgcagcaacaaagcaaagccatgctgaaggtgtctgggttcgatttccggtcggtccaggatcttttcgtaatggaaatttctttgacttccctgggcatagagtataatcgtacttgccacacgatatacgaatgcaaaaatggcaatttgacaaagaaaactctcagttaataactgtggaagtgctcataagaacaccaagctgagaagcaggctctgtcccaatgaggacgttatgccaagaagaagaagaagcggagaaaattgccttttaacattcgaaatttgctcgatttgtgcatgggcatttagagatttttgctgttggtagctctaaatctacattgttcaccatcattcaagttaacttccagacttccaaaacattcaaacctgttgggtcagccttgtaccaatcatagccaatcatcgtcaggccaaattcgatggtgctcaccagtcctttccctacccataacactgcacaattagaaaaaaaaaacataaaaaagcagttttggaatgccgtaccgaacatggcatccttcctgtccacgaggagtgacccccaatgcttgccctggtctaagccacaaattgaattaatcaagatcaaggcaccggtcattttcggcgacccgtactcccttatagggaaaagagtcaagcatcggagtggagaagccttcgaagtcacttaagcgccaagtgccaaacgatcgacgtcggggtgaacaggctccactattggtttcactgactggggtccgaaggggtcggtttaggcttggatagtagcttcagaggcagcacaaccagtcacgcttcaagatgactgctgtctgctgctgcggatttggggagccttctacacatcgctctgaagaatgtctcagccaaagttttcaaaacaaacgtgcgtaatccgattgcataaccacaacgtaatgagactggtggttcttgctttcaaagttgacacaatcagcacgtccttccgcagtcaatgtcagcttctcagcaggaagagcggtttaaataggtccacagtctacacacaacatcacgaatagtaggtctgcccgtatcattacatagcaaaacactaaagtgctttcagtaagtaacattcaagatctgcaacgacgaggaatggacgggacgggacgaaacgcacagcccatcgcatgacccatattagtcatgtaaatcggcactcgagcgcgcgcgccaaagttgcgcccataagcagacaaaaaccaacaataacaaacggatttatcactttgtcacgactcaatccggtcggttgaccggcatccactcagtgacgatcggattcatgcgagcaatgcattgaacggatgacctccagagtacccgcttttcattttgcttccatcaattccgaagaagaggatgatgtatttattccccgctgagacttcagagaagcgctctctgatctgctaaagtattgtgctctgcaagataaatccacgtgatgcgattatctgaaaatgtcgatataccgtcgcagtgataatgaaaatcatcaaatgtttcagatttaacaaatttgaaacatttgtgtccttgaaggacgaaaaaatccaagcttacttgaattttgacgttgcgtttgaattgcgcgcatatcttctgcgcgttaccgccgccgctggatgtggatttaatataagcgccgcaatataaaagcattccttatttggatcgcggacggagggttgaatgccggagccttcttcagactagtggtaaggtttgctattacaaagcaaagccatgctgaaggggtttgggttcgatgtggaaattttgtctttggaaaaagaaaactcgcaggacataaccgtggaagtgaccttagaatactaagctgagaaattctgtactagtggggcccgtaatgccatgaagaagaagggttgaacgccaaggcggcaaagctcttttttttccttctctgtgaaagaaccgtttcaagaattgaaaccatgaaactcaaccgagcccgacacccattgaatgcaaatgagtcggaccttgtcgcctatctttgttttgtttttccaatttgggctgaccggggagtaactggagactggcctgatcgcaaaccgaagtggcggcacttgttgcaaattgtttcggttttggtgtttttgtttgcgctttctgcaaaagtgagggcctgtcatattccgcggtgcgaaatgttaagtcaattagcatgaactgcgacaaattgccatatcgggtgaatcggcagcataagttggggcttcgataaagatatgctcaagtatgtcctatatcgggtggataggtcacttcagaattgttactagagacttcgtgatggtttttatgagcactatgggagttgagtcgttatagtacaaatctccctatttgcgggaaacgtgcatttggagccggtcttctgatgttctctaaagttatctttggtgtatatgaatctcatttggatacaggtcttcataatctaagacccgatccaagggactaacgaggtagccatgaaaaccaactttcactatggtgaatatcaaataagggagagttgactgtatagcttacctacttaaaatatgaaacaactattgatcatgagattttttgcagataataaatatgtttttgtgtgtaagttattattgtcatggtcgaaatcgattgaacattgattactttttttcaattatcagccatccgtggtatttaccggacgacattccttaccttcacttctgtttacctgaatgtcataatcggtgaacacgcttgcgcgacctttcgaagcgcgaactaaatgcctcgcgttccgtccgaaaaccatccattatcctccccgtggtccttcccttctcgcaagcaatttctcctcgtttcgcaaccatcatggtccaatcagcgcgccgcgcacttatctttattcgcatcaatttgtcgccacaatcccgacgccgacggtcggacgccccttcaaggacgtgcggcacttcggaacgttcggaacaggtcctctaactaaccaaagccagtagtggcgactgacagctggcatgtgcgtcatcattgtcaccgcgcaatcgacgagccgctccgtattttcacgcactttttcgtctcaaggattcgagataccaattcggacaatttttagccatgagaaattgtcaccactttctagtccgatattattaagaaaaaaaacatcatatcatcaaatctgttggggctttccttagccgagtggttagagtccgcggctacaaagcaaagccatgctggaggtgtctgggttcgaatctcggtcggaccaggaacttttcgtaatggaaatttccttgacttccctgggcatagagtatcatcgtacctgccacacgtatacgaatgcgaaaatggcaactttagcaaagaaagctctcagttaataactttggaagtgctcataagaacactaagctgagaagcaggctctgtcctagtgaggacgtaatgccaataagaagacgatcatcaaatattatataatgtaatccagttgcatgcgtagtagtgcaatgaagacaaaattttctttgtttgctgtgagaactgtcacaacattgcttttattcgctgtgggaaagaaaatataaacagaattgctgccgagtattcacttccttcttagactgacgttaatcaaaagttcgaatgacgtcaaacaaacatcgacaagttttcgttcttaggaaatcgagatgtgtatgattggatgtgcattggtattcgtggcagtttgcttgtagacttctatggctaaattgcaggtctgggtaaactaaaaaaaacgttggacccgttttaaatttaagcccttttgatggtataagttcaataattctcgattactttttcaaatcaacgtaagtcagtttcatacggattttagaaaactaattaagaagaatcccattctatcttctaaaactgttttaaaattaatcaactttttaacatttttttaccgtgtacatcgcctcaattttgcatacaatcagctcgcattcaaaaactaaccagtttctataatttctcataaaaattttatgacaaaatgataagccgttttattcagtaacttgcgacgtttttgtatcagtgtaaaatcgactcaagtagtgttttgtttcgattcgtgtttaattcactttgtctttccatacagctgagcggcgaaaatagtggttaagttgcgaaagttgaaaatcttactttcgtcgttttgtaaatccgaaaattgaacgttctaaaagtgaaaaatcgagttggttcagagcagaacgtgtagatcctcgtctgcaaaacacgtagaatagataaagtaagtttgtgaacttttttttaacttgagtctgtttgaatactttttcgggaattcaaaggaaatcagagatacttaaagaggttatcatgattatcagatacatcatcaaaactgtagtgctgcaaacattcgacacttttcacttcctttctcacatacagcacgagcgatagaaagaacatcgagaaacataaaaaaaactgtcaattagatgtcgtctgacacgatgacaattgcttagatatcaagttttgtatagaattcaggcatatcggatcataaacaacatgaataatttgatctaacctattatgtccaatgtgacaaacatacaatgaaagatgcgcagaatgaacaatgaaagatacagaaataaacgaaatcgtaacgtttactagcgaagctatcgtggtccaaggcattcaattgacatttttttttccttcattcgtttgatcgctcgtgttgtgaatgtttaagcgaagcgctgcagaatattagcgaaaacgtgtcgaataccgtgattgcttaaaacacttatcagaaccatattcaaagttgttgtttttaagttatttgtagcttctgcatggtggtttgagtatcaaaatctttaaaattaaatgtaataaccgtgatgagttttaaatacaaattgatcaataagacgaataataaatcctctaaagcttattcaaacagccgttagttagaagagtaaagaaacctagtttatctatcctacgtgtttcgcacacgaaattctacacgttcccctctgaattccttcgattttctctttaatgacgtttaattttcggaggtgaaaaacgacgtaagtaatatttttaatttttgaaacctaactaccgtgcacccccgctaatttgaacggtaccctcatgcaaaccatcggggttcatttttaatttgaacatctagtcaccctagaatcgtgtttctggtaacctctttcactgttttgttttgatgttgcgttccgttccacagcgttccatttcactttactcagttccatgagctaaatgacgtttgaacttttttaatctgaacgatgtgcaaaatagcggggtacaaataaaaaagtgttcagaaaacctcctcatgccaaagtaaatcatggaagtgcagaaatagctctgcaccctacataggattttttttacgaaacagctgttcaatctgaagtccgaaacgaaaagacgtgacaattgggtcctaagatttttgataaaatcatgtttgtattaaataacacgacatagcatgtgctttctactgctttggaagattttcccgttcaaataacggctctatcatatttaacctattattttaaaaactggtccaaatttgaaccttgacacttttgatcatgtctgacgttcacttcgccgataaatttcccctggggttttacttttttaaaagtgcaaatactgggattattcctatctgacatttcaggagggacacggaaaacaaaatacaaccaaaatttgagtttataccaaggggacaaaatctcaaaaacaggatgcaacaacaaatatttaataattgagtattcatgtgtttctgaacaaaaactttagcgtttggttctacaattggaacagggctttagggctctatttccattgccagccacgcccattttctccgttacgagaaaaggaaaggatgatgatgatatgacacttacttaaagagaggccagccactcaccgacgccctaatagatgtcaatggtggatagggaagggaattgtgtaggattcactgtaagctagatttaagttgttgggagtggcgttgcttcgacatttaatgtcactccatgcgcgtgtcttccagagatggggcacaggtatttgcaccttgtgcctaagctaaagagctttggtttaagcgccattgctcgctctctgaaacgagaaaaaactgatcctaccctctgaaatagccctagtttcattgaaaataagtactatattggaacagactactactactactacaaagtaacttgaccacgaatcaaaacaaaacactacttctcgattactttttcaaatcgacgtaagtaacttccatacggttttgagaaaattaattcagaacaatcacaacctgtcttctaaaactgttttaaaatgaatcaccttttaaacattttttcgacgtgtacattgctcaaattttgcatacaatgagctcgcgttcaaaaactatggagttccttttatttcacacaagaattttaagacaaaatgataagccgtttcattcagttacttgcgacgtttttctaccagtgtaaaatcgactcaagtagtgttttgttttgattcgtggttaagtcactttgtcacttatgaataagttttcgagacttgagtcaatcttacactgatacataaacgttgtaagtaattgaataaaaaggtgtattgttctgccatatttttttttgttggaaaatgatagaaactcaaaatttttggacgcgtgctgcttggttcgttttgaacttctcccttacaaaagaggatttggaagcattttgtatcataaagtaataaaatccaatatctttgtggggaaagctttcaaaacgtcacctatggagtgatatcctccacaggccttgtgctggagacataaacatattttaacctaatgcgcttattctgaaaagctgtgaattaggttccagttaagtatgcaatggttccagttaagtgtgtggagtgttcgaacgaagggtgcttaggacgatctttggcggagtacaggaaaacggtgtgtggcggcggagaatgaaccacgtgctcgctaggctctacggcgaacccagtatccagaaggttgcgaaagctggaagggtgcgctgggcaggacatgttgcaagactaccggacaacaatcctgcaaagatggtgttcgcgtcgaatccggttggcagaagaaggcgaggagcacagcgagcgaggtggcttgatcaggtgcaacaagatctggaaaacgtgggccaaaatcgaagttggagagacacagccatggaccgagtaaattggcgtaacatcgttaacgaggttttatcaaattaattgatgtaacaccaactaaataaaataagtgtgcaatgcgtctttgtcttcctccttttttaagtgactgttcccatagaatggctttttctttatctaatttgtttctaaccaaatgtacaaatttattctttaaaaagttcaggcaaagactggcaaaatattttatggtgactatgaaaaacacgttctacaagatttcttccattttctgagatcgaacaaacttatattttcaataattgcgattttttaaggtggattttcattttagtcaattatttagaatagttaaatatatttatttatctattcttttcgagttttatctttttgatcaagtctaactcagacgaactgtacaattaaaatgaatataatattagagtgtgttaatggaaactgaatgaagagaaagcaacagttcatgagagatgcttataagaagtaaaaaatatctgatactatttggtttcattgagttcaaaatcgtaacacttgaagaacttgattgtacatgtcttgaccaaaattcaaaatctatctaatccaaattgaattcgtgaagtaatgagtcattacaaagtacaataactaggtcatgtagtacactggagatttttatagttcttgtttcaaatgcattcgtgtgacatttcttactttatgatacgtgaaacaatgagtggaaatggttatttcaaagtttaacgacatcttttttaattcttgttttaacaaatcatgaagtttgatgtgtcgcatggatggtttcctactagacacccatgggctgcacagactgaacataacttacgttagataacgtacacacgggacgaccagtggacctgtgaagattttttcgtttgacgaaaagttttctccgactggggcgggatttgaacccacacttcgtagtacaatacgcctaaacgactgacgccgcttaccgcacggctacgaagcccacagtgaccctttatatgttataaatatttatatcttataagggatcactagtttctacagcattgtattggcccttttcagactcacactcaaatctcagctctcccgcgagagcaaattcattggagatctgcatcaaaaattgcatgcttgagtttttcgtgcaaaattactcaattacccttaagctgtcaaaaatgatccagtcatgaagcccgtcaaaaactcgtgaaaaccgaatgttgttgttttcgttagaaaggattactatgctttcaaccagactaacaagaaatctttgttttatgtattgttgtgtgcatttgaggtgcaaatcttcactaaatgtcctacaaatgcggtaagacaaaacaatcaaaggacacctagcaacgattacacacatcactgccaacctagcatagaaaagcttactttgacatcggattgcttgtagaaaatcttaccgcgtttggtgttcccgcatttgatatttgcgtttctaacgcacacagcaatatattttcaattcaatatttgcaattaaaattctttgttttatgtgagtaaactgcgacaaaatgagacaatgagtcaaacagatgagctaaaaattccattactttttgactgctgagttgcgtgattgaaaattaacgcatgacaaatttcaattttgagttatgagaatttgagtttctcacaacatgtttaaaattaatacttataaaagcgcgtaactcaacattttgttgatcttatagaaatttcaatttctaagactgtaataaaattacgtctttcctttcctcagacatgcagtttaataattgaaaacaattagtaagcacagatttgataaagatttgtttctaacaaaaacactctagtgagcaccgtggtcacgtttcatctcacgaccagccagcgcgttggaaattcgagcgctgagccgtgaaccacaccagaggcgccatcagctcaacattcataagtcacaccactctggtgaaaaacaaatcacagggagtggcttggtcttgcttggcctgatcggtgagaactggggtgcaccacaagtgcacctcgatatctccctataaggcagatgcaagttcacattaaaacattccaaaaccggtacttatacgggcaataactaataaatctcccaggcgcaactgtcactcaccatcgcaagcattcaacctctttgggtcaaccagtttgaatttataatccacattaaccgcgcgtctgcgccatattttgcgccgaagccgagccatattgttcccggcgacctgggctaacgagagcgagcgccccgtgagaagcggttgacagtggtctcatttccttcaaaaggctgcccgaaatggcataatgtcaaattggggttttaccgctctggggggattcgaaacatggtgctgacttagatctgccaacgtgataatggtgtcccatgtcataataagtgagcacagatgcacatttaccatatacacaatgggtgaacgtgtggttaaacttggggggatccgatacccgaggagtcgaatgccagtcttgacactgactttgaaggaacacgcgagaggggcttgttatgcggtttggtggctaccggttcttgttttgattttttttcgcggagtcataactgctgcctggtggcctttctagggagggtgctggcgctgacttagtattgcatagcaagcgaaacatgattagaggtgcaatgtgaaagtaccacaccgtgcgaacttcactactcagttctgatgattggcgcaatttggaattcgcgatcttttgagttcttcgatgctattatggtactggttaaaatatttttgaaacttgcattgcggagtacttgagacatgacacgaccaactcaacaatggtagtaagccacggcagtttaaggtgaagatgaaacgaagccaaacttcaaattttcaagaacacaaatctggagaaccgaacatcggtttgagctgaaaacttaatcgattggtcaccaccagctagtgaccaatcgattgagctttaagcttaaacggatgtttggttctccagatttgtgctcttgaaaatttgaggtttggcttcgattcatcttcaccttaaatacccgttgaaagttcgttttagcggaacccttgcgatagaatgtttaatgtcattcgtttctgcatcaaattctgagtatccttcttcttcttcttggcattaacgtcctcactgggacagagcctgtttctcagcttagtgttcttatgagcacttccacagttattaactgagagctttctttgccaaattgccattttcgcattcgtatatcgtgtggcaggtagggtagaagcaccggttttggccatatgccagttgtagccatagtggattatacaccgttttacatagacaatcagcatgaaaccttttgtgttcagtagatcacattcatatgatagagctacattcatttactcgtccaaattgattcaaaacataagaaaaacaattcattttccttataattttaactcccatacacctaatttggccagggcactcctaatttggccactctcatgagaaatcaatgcaattggccaattcaggaaccgaagttaaatctctggccaaaactggttccgttggcctatattgaccaacgggattttcaaggcgaaaaaatggttttagctcagttttgatatttacacacataacatggattgaaatcttgcatttgacatatttgtagtataaatacagcttcccacttagtttttattgacattttctcttaggctggccaaaagcggtgcttttaccctacgaaatttaatggttttcatcaaattctacgtacatcaaattcttcaagtcgaaagcacaacattttaaagtcaataacagcatcgatcacgtccttgcggttatcgggaaagggaaggaatgttagttagacaaccattgttaatagagatctaagaatcttctcatctccacagttgtcatagaaaggatattttgttagtggtataaggtaagcatctgggagtgaggggatctggtgatgcgatgtttgatataattacgcttaaccggattctcgatattactcatttagaaacattcaatatcttcgaatttaagagaaaatcagtacaaaataaaacatctctttgagactatggtcacaggaaagcttccgagtaactcctcaaatcaaacagaataagaagatctctggacttcactccacctcttgaacagttcagtgatgtcttgaagttaaatgtcaaacatgaaacttagattcaatgcaataactgtgttattttttttctgatgtgctataaatcatgatctgactcaacagaccccagaggccttttgccgtgtggtacagaacatatcacaagaaataattcaaagattttgtaaagaataccaaaacgtcatacaatgatgtcatcttcaatatttggaataaatcttcgaatattttgtccagaaaactctccaaagagatttccaggaatttaaccaggtatcacacaacaaatttctctaaagattgttttacacatttctcataaatttattctgagaatccttccaaaaattcatccgaatatctatcacaaaaccttccagaaatcctcaaagaaagaattttatggatacacctcaatttttcgcaagaaagacctcaccaatattttccagaggattttttttacagatcactccaaggatcactctaaaaatttcatcaaggattctgaatgaattcattcaacatctttcaataactgactcaagaaggaatttacaaacagattccttcaaaaagggaattatcttgtagattgctcgaggaatcccctcaaggatcttcaagaatttctacccgaatctctcaaaaaatgacatatcttcttcttcttttctggcgttatgtccccactgggacagagcctgcctcgcagcttagtgttcttatgagcacttccacagttattaactgaaagcttactatgccaatgaccatttttgcatgcgtatatcgtgtggcaggtacgaagatactctatgccctgggaagtcgagaaaatttccaacccgaaaagatcctcgaccggtgggattcgaacccacgaccctcagcttggtcttgctgaatagctgcgcgtttaccgctacggcaatttgagcccctcataaaatgacatatatagcaaagaaaatatcttgaaaactaccttaaaaaacagttattgaaatgctcttgaattcatgtaataggaatactttagaattcctatcagtgatttctttaaaacttgattgtaacccattaacgcccagtgctctgatttgagatcagaagctgcgaacgtccagtgatctacttttatgcacacaggttttttgtagacacaaaggaagctggtatctttgtcaaagttgtgaaagagctcaagagcagtctaatgacaggattctcaaatcagatttcttccactaggttgcgctgaaggcatgaaatatttcaatcaattttagttgtcttgtcggcgtcaccacgctcgtcttatgttacaattagcgtggtttccaaattgaatgattcctgaaagtgtatagaatggattttggaagccggtgtggattttaagattcagaatagaattccagtggatattgggattcccgtgcaggtcctgagattcctgtgaggattctgggttttcaatgtgaatccttgtgtttcagtgtggatccttagattccagtggatcatgtggatcgtaaggtgacagtgtggatcttggtattacagtgtggatccttggattccagtacaaatattgggattccagtgtgaatgtcgggatcaccgtgtagatcctgaggttccggtgtagatcctgggactccagtgtgtatcttgggaactccagtgtggatcatgtgattccagtgtaaatttttaagttccagggtagatcttgcgatttcagtataaatcctgggattgaaacatggcttcttggtttccaagggtaatcttgggattccagtgtggatcttaggatttccggtgtggatccttggattccaatgtgaatattaggatactggtgggaatttttagtttctttgagtttggatccttcgattctagtatggatcttgggattccagctatgggttctaggattgcaatatggatactgggattctagtgtgaatcctggtaatccattgtggatcctggaactccagtgtggatcttgggactccagcgtggatacagggtcgattccaatttggatccagaaggattccaatttgaatcctggcatttcagtgtgactcctgggattctagtgtgaattttggtatttatatgtgaagttttcagtatggatattggtactccagtgtggatcctggcattccagtattgatccaagaattccagggatgatcctgggttttcaatggatcctagtgtttcattgatcttgttttgtagatcttttgattctagtggatcatgtgaatcgcaaggtaacagtgtggatcttggtattccagtgttgatcctggatctcaagtgtggatcttgggattcctgtgtagatcttgcgatttcagtatgaatcctgggattgaaacatggctcgttggttctcaaaattaatcctgaggttctagtgtagatcttgggatttccggtgtggatcctagggtttcagtttaaatattgagattccagtggggattttgagtttctagtgtggatccttggatgccaatatggatcctgggtttgcagcgtggggtttgggattgctgtgtggactatggaattctagtgtgaatcctggtaatccattgtggatcctgaaactcaagtatggatcctgagactcccgtgtggattctggaactccatgctggatccttgggtaccagtgtggatgctgggattccaatttaaatcctggcatttctttgtgaatcctgggattctagtgtgaattttggtatttttgtgtggagttttcagaatggatattggtataccagtgtggatcctgggattccaatgtgcatccggggttccagtgtgaattctagtattttattgtggattctgggatgtgtagatactacgactccagtgtggatcctgggattccagtgcggattctggggcttcagtgtggatatttgaattcttttgtggatcctgggaatccggtacggattctgggaatccagtatttattctggtattccaatgtgaacgctgggaatctagagtagatcctgggattgcaatgtttcagtctggatcctcctacactgaagatcctgggtttctagtgttgattgtgttactgcattgtagatcctagaaacctagatattgggatttcattgtggtttggtgtattgcagtgtgaattctggcactgttgtgtggttcgtagtgcgtcagtgtggatcttggaattccagtttgcccctatgatacttgtgtattttgagattccagtgtgaatcctggtattccagttttgatcctgggattgtaacgtgggtcgtggaattcttgtgttaaacttgagatttcagtgagtatcgatttcagtgcagaccttgggattctagtgtgaatcttggaattccagtgtggatcttgcgatttcagtgtggatactaaggtaaatccttgaattacaatgtgtatcctaggatttaagtgtagctattggaataccagtggaggttttgagtttctagtgtagatccttggattccaatgtgcatcctgggattacagtatggatcctcaatttctagtgtggattttggggttccagtgaggattctggcattcaagtgggaatggttaggattcctgtgagaatactgggctttcagtggcaaaaccgtgggaacctgtgaactatattttactagataaatactgtgcagatgtagtggaaatactgcgtaattttttctgaccaaatagtttgaaaatacattgggaatcttataggaatgctgggattcttgtgaatgtcttttggaaatcctctggaaattctgagaggatccgagttgagtttggaaaatcttgcgagagttgtgtggcgaataattagttttctgagagaattccatggaaatactttgggaatcatgaagtaatcccatgtgagaatactgtttgaacattaagaattctgtgggaatagtatggaaataccttagaaatcctgctgaagtggttttcattacgattacaattaccatattcgtgaaaattatataagtaatttgctttatttgctcagaaacaaaaagctgcgcacttggctaccaataactttgagagcgagattctaaatttagcgagaattaatatgtttgaagaagcttcttaccaaaagaaaaactgagaaaccacaatagaaaaccaccgtagatattcgggttggaaatttcaccgacctatccaggcagaaaagttagctgtgtcatagtttgtacgtatcttcagaaagaagaagacttcatagtcatctcactctcaacaaaattttgaattttccaagagtgacctgcatgaaactccaagaaggtcacgtgagtttccttgttttctagttatcaaattacacacgatcgacaattctccttcttcaagcctacctcacgcccaatcagactagatccgctcacgttgctcagtcatcactcatcatcgggggttgcgtgcagaaatacgatacctttttgcgtgcactttttgtttctactcacctgggacctgatttaaagtgctaaataggctctgtgctttagtttgccaacaaagtcctctctttgctctgctctgtatgacataataaggcgcaatcaaatataaaattcatgctctcgtgtctcgtctggttcagtgcatgcatcgggactgccgatgccgattcttgggggtccaaaggggtaggtacccacgattaccgatgaccgtaaatggacaaccgtcaaggccatcgtgtcgcatacgatggtgatgatgctggtgatctcccagccaccagcgcacaacaggttctctccgcatgcagaggaacttcgaaatttatggttgcttcctttgctgcggtgtttatttctatgaaatcgcgccacagcagggctgaggaacgcagagtcgtctcgcgaaaaggtggggaggaaaagtctcgcggcgacgacgacgtctcaatttccagccgcgtggtcagttcctactgttttatcgttcgcgaacggtcggtgggttgtgctcatcgaatcagctgagattggatcaatttgaattacttaattttaaggacgcaactctgggtggtctctcccggtgcgaggttttggtgaatgtgttttgcaaaccggtacgaatcgttttcggtgcatgacgccacttttccacagaacatcacttcgaaagctccagatcaaagtgtcctgtactaacgatctgattttccctttctctccccaaacaggtcacgtgcggtttcgcggtctacagtgttgttttcctaacacgttttgtcgttgtcgttgttgttgttgtttttttgagtgtagtgaagtgcccgacacagaaatccaccgaaaatggatgccatcaagaagaagatgcaggcgatgaagctggagaaggacaacgcgttggatcgcgcccttctctgcgaacagcaggcccgcgacgccaacctgcgcgcggaaaaggccgaagaagaggcccgccagctgcagaagaagatccaggctattgaaaatgacctcgatcagacccaggaggcgctgatggccgtcaacgccaagctggaggagaaggagaaggctctccagaacgtaagtagattctttctcgatatgcaatgttgtttgtaagttgtcccactgtgtgggactcgtattcacaggcacagaagtgttgccagtttgaggaacgaaataatgacaatttctgcaggagatagcgttatttgtgtgctgcgcatttctgaaaggattttcaaaaaggaaaaaaaaaaactggaatattaggaaatttagagcatttttctaatacagtgtccgtttcacacggttttgtctcacgcaccaaagtaccgctaaattaagggctgctgaatccatttccgttttgaaaaatatcatagcacgactagtttttgagatattgacagttgaaactgcaaaatttgattatttcagccaacttgaatacaagtttgccagcttgtatggcaattttttcactttgtttgccacagaacccaaaattcatgcgtataataattattatcaacaaagttcataatacttccgatgctcaaaaaatatttttggatggtttcaaaaagtattgtattgtgccatataagaaaaacaaacaattttgtatggaggctgcaagtatgttggaaaaatcgatgtcatctcaatttaatcgtgcaattcaaaagttttatctgaaatggaagataaggtcatatattgtatggatcggatcacaaagaagtttgataaatcttacttaaaattgtgcttgagcttgagcttgattggccgcccgtggatgcaactccagtatcgccagatcagctgcacttacacaaggaaccaaccgaatgactgattgggactaacagccattctcagtgtataagtgctggtgatcttctatttttaggcgacaatggtgcctacctcgtcagaatgcagaccaatgtggggggaagaaggaggaaatgatgttgcacttatactggcccactgtagaccgtggagttcgactgcatctacgactgcattacgccagattgggggaaaggcatggcagaaagttttgcttttgtggttagcagactgtctatgtatcaggcgtaaggataggcatgcgcgtggaagaatggaagcgttagagaaacggtttcttgtccgtctctggttctagcgtttgatatgaacaaatagtttgagtgtgttatatttagaatggaagatagaagcaagtgagagatatacaactacaaagtacgagaaaagggacgggcctgggattgaacccatgaccttctgcttatgaagcagaagcggtagccatcagaccaccaatcccgtcttgataaatcttacttagaatttcatgtattttatactactttgacgacctgtagctaaaaattttgacgtgctggaatatttctgagaacggcatcggatacagcaaccccaaatctactagagacacataatttgatccttgaggtacgtgaaaatatcatttttgttatgctgtgtaactggtgtattagagaggatcagttagagagcaccaacaaacagatatcaatatgaactttcaaacaaacatgttttgaatctaccgttagtttagtattatgaatgcttgtctgtgatttctctttacctttagaaaaccaagttgtttgacaaaaagtatacaagatttccacaaatagtagagtcaagtgatgcaaaagttcgagtgaggttaaagtttcttttcaagatgtctagcacaattcaaaacatatgttgtacagtcagttacaaaagttagtaaccaaatgctgttgttccatacaaatactcaagtttggggatctatatcttagcttttcgtagtccaaattggctgaaactatgactaagcttgttgaattccagtcattttcaaaagagtcagagcgttgttcaaagacaaaagtaagcaaccgagagattttttaatttaattcaaaaacgataagttgtggatgattagtttgttcgacaaagttgttcaattttgaaagttataccacagataacagatgtctatactagaacaaaaaaattcagtcaacctgtataaatattcaaattgtaactctttgcaatcactagcgctgccacacagcgaattgcgtcaatcagtggtgaatatcagtatcttgaaatatttcatattcaccactgatatcgtcatgggaacttagcgatgacagcgccaccacgatgttgccacttgtgttgccattcaaaatgaccattaattatcttacacagttttacaaccggacttcaacgtctgttatctgtggttatacaaaattgcagaattcacaaagcacttacaattactctttctaattaaataatatcacttggttgccaacttttatctttgaacaatcctcagaaattctttgaaaaattactatactgtgatgaattcactaaagacaaaattttaggttgtttgtagttcgtcatccaaattccagccaattcggactaccagaagctgagatacagatccccaagcttacgcatgcgcaaaaaaacaacatttgtttactaacttttgttactgactgtagagtaaggtggggcaaaagttcgatctccagaaaaaaacaatagcagttgaaacaaaataaataccatacagtgaaccttcaacatattggctataattttgctgaacatacttatgccaaaatagttactcaattttaattataacagtttcgaaatttatcgtcttaaacgaacttttgccccaccggtggggcaagagttcgaatctagtgtggggcaaaagttcgctagctaaaacgttaaatattgatacttttatgaaaggcatactttatactagccgtaaacttatgttcgccggaaaatacacactaaattttcatcaaaaaattggccaaaacggggttaatttgaatatacctaaaaatagcagttttttgcaaacctaagtgaaaatgtaaaattttggtaacatttttcgcacgatctggcaaatttcgctaaatttgaagataatagggtcctaaaatgtttaatgaaatcgtgttttaatttaataacacgaaaaagcatgttactgtaactactttagcaatttttcccgctcaaataacggcagcatttgttctcgcaatccgaactgaaaattcttgctaacgaatgtaaacatttcaattttacagttttttttttcatttaagtaaaattgaccttcaaaaatgccatagactacagaaattaaaaatctaaaagaacatctatttaaaaattacgtgaaatccatgattcaagttttttttattattatttattattatatataaatactttgtaaagtaatccaaatatgtcacacaaagtattttaatccacagtgatacctccatgagtcgatgttcacactcgatatagactcatggaaccatactaaaaacaaaatttcatgattactatgatggtcactagaagcagctttccaaatgattgctgttccatgactcgatatttccatgagtcatggtcccttcaatatcgactcatggaggtttcactgtattgagaaatgaaatagagtgcatctaaaataccgatgcagtctatgaaaaaaatcttaaaactcctccacaaaacgcactgtgaatcacccgctaaaattctgtgcttaccgatgacatcaccttattatccgccctgtttttcctgagatgaaaaattgttcaacaagagtccacctcacacgtcgttgattatttccggtcggtctaatggttctgatgccaattatacaccgagatgaatcaacgtcatcgtccaccgaatcaccgaaattttacgttccgttctaaatgcgattatttggctggcgatctccgtaattttttcgcgtaatttcattttgacgacgtgacagcccgtccgaaacgaaaaaatcgccgcccttgagccgaaattttcattcaaaaaagcgcgttcatttttctgttgaatcactcaccgaaatggtgacaaacatgaactgtcatacagattactccgctgcacgatggtacgtggcaagtcgtgggagctaaaattagaatgcattttttcggcgtagtgcagtcgaattcagtgcatcacatcactatcgaaggaatttcacttgcattcattatctaacacgacaccgccaacccacgcagagaatattgcataatctcttgtttgacagattgaattatggcgtgacaaatcaagatggcggcggcgaacagaaactgttttttgataaacatagcaggggcgctgcctggtaacatgatcaatatggcgatcgcacgttgctcggttgtaatatttaatttcgacggagcggattgtgcgaaaggttcgagaaaatcggcccaccgttgttgggataccattcgatgcgatgaaacttttatttttagagtttcgtggtggcattcggtgcattgcacgcataccagcgatggcggtattaaatatggcgtcatcttctcggtggtgtgccggtcagcttgctcatgcgcggtcggcttcggagatgacaaaccgccgaaagtgatcatggccggtcggtgtcatgactaaatggactttctctcgagtggacgggatgacagatgaagagccagggttgagccaagaaccaatcatcctctaattatatagaactgtttattggtaatattgactgcggcgaggaccactccgggcgacgagtcgtgatgtcgtgcaaggtttaaatggttggcgatgactacgacgggggtgttgggctagcgatcacgagtgagagcaggaaaatagattgagagcgtgaaagcgcgagggtcagccagaggaatcgtaagaatgccggcagtttttttcgctggccccacaagatcggtgcggagtttcattcatgagataagtacactatccggcacattgttggaagagacgagatgcagtgaaaaccgcatcccgtgctgctccgcagaaaaaataataataaaagaaaccagtcaatactagaagtttagttttgatgctgaaattctagaccgagtgcgtattatcgtcaaagtacaaaataacacgtagaaaaacccagtctggagtcacaaggagagctagtttagcgaatgatagtttattggttttgattggtgcagagaatgatcggagtgatatcgtatggtaatagaaaacgaggatcgagttgtttcaatagtaaaccgcgaggcaacaacggaggaaaacgtgccaaaaagacacgacattcacggcagcatgcatcggcggtggcagcagccaatcgtcgcggtaataacagtgctggccacgagagtgcgctagcgttgatcaactgtggccaagagctgacagcgaagaagagccgagcgaaaacggtggcgaaaaagaagcgccaccgaacagcgaaaccagcaagtagcagacgtagctcagtgtcagtgacaggagcagtgtgtaaaaaacaagaacaagtacgatcgacgagttcggcaagtttggccgatggtggtgctgctagtacaatgtgcgaaaataatcccgttccgtctggaggatcgggtagaaaacggggtcaccagcatcacccgagattcagcggcagcaggaaatccaacgtaccggccgaggacgtgattgcagcgctgagaggagctttcgactgcggcggaacaattacgacgacgtcgacgggaggaggaggcagtcttagcagcagctcgtcgtcgtcgtcactgctgattggcaacagtatagtaaacacagacataatcattggcaacgacgagaatgcaaatccccagaaaaatgtcaccgtcaaagcgggggtggaggcagaagaagaaaaacaaatgattctgatggcgatcgatgctgctgatgatggtggtgttgattctgttgatgatgatgatgttgtaaataataatagccacaacctaggccaggatctcaacccggaagtggaactgtatcaagatatcagtaacaatatattagaagacgacgaaaggctgacagaacaaagtgatgaattgattaatcaacaacaaagcaagagcagcaacagcaactgcaatagtctagttagtagcgatataagcaatagcacggctagtaatgtaatagtgatagacgatgacgaagatgacgatgggagaggcagcactgctagtggggaaccgttggagatcaccaagctggaggaagttcccagcggtcaggagctagtcaagcaaattagcaaaaagctaaaacgcagcaaaaagagtccgtcctcggatgattccagtactgctagcgcaacgcggaaaaagtccagtactggtagcaaaaaatcttccaaaaattccgatggcagcagcagtaccagcaacggcaagcaacggaaaaagatccgggcttcaacgggtgatatttccaaactggagcgggcgttaggagatggagcaccatgcgaggatggaacagcggcggacgagaatgatccggatgcggcagagtgggccaagctgcggtgcaccagcgagcggactgaggtcatcgccgaaagggaacatcgacggcagaagcgatgcgcggactatccagggctggctttcggacggtccatattcagctcggatacaatgatgaagttcaacatcatccggaatgagctgcacaacatcatgaagacgcaattgaaacgggtaaatatgatccaactttctacatatattgactagatcactgggttccgaatagcgatcgtccggatcgaattctggaacgatcgcaatttttggcccaaatgtattcacaaagtgatccaaccgaagtcggtttctctagtttgtaagcagaagaaagaaacgatttgtgcacaaactcgcacggacacgattggccgcacgatcgccgcacaaagttctcccagcgcgccgtgagaaagaaagagcaagggtgagcaaaattcaagaatgtgttatttttagaggtggaaaattttccaaaaaatatttttcctcgcgatcgcggatcgcagctgaacggtaaaatttttagcccacacacaaaacgtccgaaaagttgcgagaaaatcgagtgaaaacgaaacgagaaaccgatggtgttcagtgctttgcgttcaaaggggaacgaggtctaatatgagcctcttgatggaagattgagagtttgtgcgaaagtttatcgcctccaaagattgaagataaggcgattagctttggaaagtgtaacttcaatgttaatagacgcattttgtcatttcgtttccacagtcgggcaagtgctcggtacacgatcgctaaacggtgagagtgtacgagtgcgcgtgcttgatcattattattccctcttcgggcagcctagcgcgttcgcattcgcatcgcgatcgttcgtttgtgtattttagaacgatcgtaaaacaacactgtttatattccggaaattttactcgtgcaatcggttgcggtgatcgcgcagtttttcacgatttttgaacaaagacctacattgtggtggcgttcggctctgcgccaagggacctagatttttgtctacgtttcgtgaccatgacatgtctgtccgatcctcgttaggagggccttccacctactacctcccctcgcaacacctgatcccacatcatttttgtacgataataattcaccgtggctctttcaccgccaaatttgaaaagcgaatcagttgaaagcctccgtcgattgttgagctgctgctggtggtggtttttgcttgaggaaaatccaaattatcacaaaattgaagcagcgtaaaacggaaaaccgagcacgttgtgtaatttatgcttttcgtttgctcgctgcctcgaaacaatgggatatcgtcgttggttggtacggttcgctgaagttcgcctatcggccagacgcttgatcaggttgaaaagtggtgaaaaatcaaaaaacaacaacaacgatgctaacaggggtcctccctagcttagtgatagagtccgcggctacaaagcaaagccgtgcttaaggtttctgggttcgattctcggtcggtcgaggatcttttcgtaatgcaattttcttgacttgtctgaacatagagcattatcgtgactacacggcacaacaaacgaatgcgagaatgacaaattttactaagaagtcaataactgtggaaatgctctcagaacactcagctgagaagcatgctttgtcccagtggggacgtaatgccaagacgaagaacgacgttaacaatggcaactcagaaacgaacgactccatcatagcttttgctgttgaatggggttttgtagtcggtggccgaagaaaattttgatgacggccgaagacgacttcaccacgactacggcgaatgtgttgtttttttggctgtacatacgtgcgaatcaaacgaaatgagatcaacacgaaaacggttaattggcacttgccgtacggtctctctgcgggcgcggaactggttggcagatcagctgcagtgagaagcgatcgcgaagaagattggtgtatgatgagggtatggttgctttctagggtaaaggggtttatttttgaactacaaagctagagctaactcgagagcgatcgtattcaagacgtcaattcttctttgctctattctgatccaacactcagttcacgatacgaaaagatcagaagccagtgatcggttgaaatttgtcgactctaccctatactgaagacagggagaggcagatgcaaaagttaccaaatgaatattgattatttgatcgtatgtaaatcagaggaaagggtctgcagtataccaacgtgaagacataaggtttctttgacagattccgtactttttggtatacttgtaaaccatcccttcagaagggcatttggttgtgatgtaccgttttgtctcaaattctgaacaagcctcatgttatgacaccccaccttttatagcattttttcaagaaaaataccgttttgtatcaaactccgaacatgacttatattccgagcagtggcaccaataattcattttaaatcggatacttctcaaactttcaaggattaagtaactatatattatctatgtatcggcataatttattaattgaatttcctaccccaagctcgtacatttctataaacattggtcatgagatcatgggcgaggctttgtgtacctatcttacacaatttctcacagtttttcttcaaagcttcatcggatttaaccgtttatggtgccggttgtaacgaacggcttgccaatcgcctgctacaacagatacttcttcgcgattttgttcatctttctcttccggaacttttccggaatctccatgcggagcgtgccgacaaaatattgaaggccagggacttgtttggtgtctgctttgtttcgtcatccatgacgagacagccttgcttgaccagccactcacggtacagcttccacgcacgcaatttggccaccgtgttttgcttgtcagtccggattggcgccttcctgaccttaaaaacacgtagcccagcctgcttcatggtttgctggacgaaccacttggacgaattgacatttttggccacctttcggatgggaaggtttgggttattcttgaagtactgccctatcttcgcgccttctcagggtatttcgttttcgattttcgaccgcttccaacgcgccgctcgaaggtcttcgtctcctggaacatcttcacaacgcggaacacggtggaatggtggattccaagcattttaccgatccatctgtgcgactgacatgattatcgatcaccgctccaaagatctgctggcgtagctcttcttgtttcgaatgcatcatgaaaactacctgacacatcgcgataaaattttgcacacataaaaataacactctacactagtattacccaatatttcattcattttacccacgcgatagaaaattacacccagaacaaagtttcgcattttttccgagtccagtctttatgtaaaatttattcattgtagaaaaaattgtagctgtcttcgatttttataggttctatctgaaatgtcagttatttttggaaatatcctcaaaaaacacaaacgaatgtgttcacatggattcaaagtttaaatttcttctttttatgggctcacaatctaatcaggtttaacgtcaaggtatgtctataagactggaagaagaataaatgtggttttcgccactgagacactgaggtcctgatttttggcccttcaatgactgaattcaaggcaaagtttgagccgcatttgacttccttctcacatacttcaaagtagtttttaagctgaaaaattagcgccgtccaagccttcgtaagcgtcgcatgtggccgacttatcgcagtttcgaaaccattgttgtaactcaagagcagcaaaccattttgttggaatcttcactttcgcccagaaatgaatctcccaggacatgtttctagtaatatactcacttgatacttgatgggtaacaattccttgctattgcgttgaatgcgtcgaatgaagaagccttctccataagtttagcttgacgtacctccgacatgtgagccacatgtccagctcaccgaagcctgccgtgttttttacgtttaacaatatccattcctctatagacttggataactcgtgattcatgcaacgccgccagatgctattgtccaaattaccgccgagtattgttcgcagcactttaagttcaaagactccaaaagctctccggtcgacctcttttaacgtccaagattcgtggccgtacagagcaaccggaacaattagagtcttgtacaacgcgagtttggtcttcgtctgtaagctgcgggactaaggttacgaaggatgctgaaatctcatcagcaacccgtatacttgatttcgatcctaccaacgttgcacgaatcagtctaatcagcttcgtcggaaaaccatgttccatcattttttttcacaactcgtttcttttcactggatcgtacgccgtcttgaaatctatgaacagatgagggaagattcaaatatgacgtctatcgtttttcgggatttttagacccccttcacccttctgtcacgctttttccaataccttataaatgcactgtcacactttcatagatccccctccctcccccaaatgatggacgtcattgttgacccctgatgagtctgcaagttgaactcctggaatttatcgaggatctgtcacatggtaaaatttgatccgacatagatcggctgttgaacagaatacgtgacaatatcactatacgccgaattgaggagcgttattcctcggcaattggcgcactacaatctataccctttttaagagaaggcaaatgaggcaatcctcgaggccgtgtttgagaagttcggccgtgagctcatccttgccagcagccttgtttacttcagctccttaatcgccttcttaacctcatctagtgatggaggctccacagcttgcccatcgttgtcgatgaatattctgctctccgatggagggaacgatagactccatttggtaacgtttcgaagtgctctctccacctgacagccaccatcgttttatctgtcagcaaattaccttcacggtcgttgcacatgatggagacggcactgactgcctccgcacgccattgacagtttcatagaatcgtcgcatatcgttctgttctgtgtgttcttttcggttgagcttgcttccttgtaccgctctctgttcagcctgatacctggacactaccatccgacgtccggctacgtacttctcatccgtcaccctctggcactcctcgtcaaaacatccgcctcttaggcgtcttcgagcaatacttatcacttctcgcgcatcccacagagtgttgaggttttcgctcacagtgatctcacttatcagctcgtccagcttttgatggtattcagttgtaacaccgtctgatgagaagcgctgcatattgaatcgcattgttcgcttcagttttgaattcgttacagttgaaaatcaaactcgaattttactgacaacgaggtagtgatccgagccaatgttaggactcctgcaacatcgatgacatctgagaagtgtggtatacttcaagtcatatatcgaggaatttcgaaaaaaagttcaagtgcaaaaattctgtgaggtcggtgaggaacattttttgattattttcgggggcggtttccagagaataactttaaattgaattgaacttgtagaaagttttaaggtgatatttttttacagaattcctgattaagcccatgatggaatacctacttagagttttgtgaacgactttcattgagtttttttttcaagtaatcattccgaaacatttttttatctgttcctcagcagtgtaaatcaagcttggtaacactcctcaacatcattggagttctgtagcatgctctagagaagcgagctgtatttgcctatttgtgggagagcgaaaaaatactaagcagagaaaaatgagcgagaaatatacgacattaaacacaatccatcaaaaatgagtgccatcacaagtccgcgaggcctgttttgttcgggcgggtcactcgagagcgtgagtaagggtgagcatagaagcgtaccagaaaaaaatcctcgcatttcgatgcactctcactcgaattgattgagaattcattttgtaaaagttgagttcaatttttactcctcagaaaaatcgaaatcgcttaattttcgcatcgcagaggagtttctgtcaagcctgatgtaaattgtcaattgcaacaagaaatcatctaaaaatcacttcacactccttcaattctctgggtaattacagctgcatttgcctcggggataatttaacaaagttctcatgggtgtctgtcaagaattctatcaaagtttacagattttcgttggtttgttttccagaaatatctcccagggttcttccgagaaattcgcttgaattgaatctgtcattgtagaggtaattatacaagaagatcttttcttctcggcttgaattccttctgtaattacgagagaatttatttttgttaatcagtaaaaatcgctaaagttttagcagaaatcctctgagccccgcttgttcaccttggctttcgttgtgtctcagtttatcgcagtatcgcattatggtcacaagaatacacaaatagatacatattcaactcaagttcctaaaatatctgacagaattacgcaattcccactcgaatatcacttcggagtgtttttttttaaagaattccttaaattgtcatctgtggaacttgattacaatgaattgtcttaaaaacatccatgaagatcaaaattgtgtgcttgctgtgaacgaaagctcaccatccactgcacaattcttcaaaaaattagacatttcgtggcaatggttcatatctatgcggccttccttagccgagtggttagagtcagcaacttcaaagcacagccatgatgaaggtgtctgggttcgattcccgatcggaccaggatcttttcgtaaaggaaatttccttgaattccctgggcatacagtataatcgtatctgccacacgatatacgaatgcgaaaatgacaacattggcaaagaaagctctcagttaagaactgtggaagtgctcataagaacactacgctgagaatcaggctctgtcccagtgaggacgttaatgcaaagaagaagaaaaaggcaatgattgatatctgttttgtggttcggcttatccacacaataaaaatgtgaaattgtagatactgatgctcattgaattaacctctgcctccgaacaacacaaccaaaacaaacggacaaagcagcggtgaaatttccgaacccgccaatgcatgacaattgccatgagtagtttcctcagtttctttatttccagatgactatcgctatccaacgaaaaccgtcaatcttcttttcaccatcgcgataatctatgacgggtgaaaaagaggctgatgataatcgaataataataatcatttccaaattttcctcgctaatctgccgggctaacacgcgtgcaatcgttgctgcatgtcgtcatcgtgctcatccatcaaacgttacatgcttctttcgtacgctagtgaagtacaaatatagctacatgaagatagatgatgtgcgaacgagattttcgattgataacaaatcgaatgaactcgaatcgatatcatcacgcctgaaacaatcgattcgattctcgatccagaagcaacggcaaaccccaaacgtggaagctatccacacgtcttcgtcagtgttcaatgaagcttcttcactcgttgaactcatctatcacctgttatgcaattcgcattacccctttgcattcgaataaattcactcagactggtggcgagtcgagtgatccacacagctgacgatcatataaaaaattactcgcatcgcgcgcattgattttgtgtgtgcgatgaagaaaacctatcttcgacgcaagcgtgttcgcgcattcatagccttctctgatcgacgcaaaaatggatttacccgtctgctgttacccttcttacggcttctatcaagctttcactatcagtggaagaatggttcaggtgaattattacacggtaaaaaatcagcacgttcgattgaaaccaagtgcagaactattgatagcatggtgcttattttttaccgtgtattcttctttttggcattaacgaaccaactggggcagagcctgcttcgcagcttagtgctctaagagcacctccacagttattgactgagagctttctttgcttaagttgcaatttttgcaggcttagaaaaaaccccaggtgaattaatctcacttactatttgaagcccgcttataaaagcacctctcgtaccgaaatgaggcgcacttttgcccgtaacggtaccctcgttctgctttatgacgacccgacttacaatgctagaaactgcgaaatttgtgtgtaaatatttatttatacttacaatataattaattactatgctttggcgcagccggcagttaccgaacaccgaccgtagcgatagtgcgctctttagcactcggtaccgtttcattttttttattccagcaaagcaaatttggactttgatggccttccaatagggtgtccaaaaaaaaaatgttgtccgcgaagtcattgtgttgaactctaaaacgaaaaatatgcttatttatagctattttgtcgaacaaaataactttgtagaaaatcgtttagagcagtgcttccaaaacttttttcgcgttatcgccccctggatgccatcaatttttgatattccctcttggaaccaaatttttctcgtttgtcttcaatactatcgagtattgatttatcgagttcattgaattcgtacttcaataatatgataagaaagataaaaatatgttagcctgtagtttattccgaaaatgccaacgtattgagcattgatcagtgagaacctgcattttttcagtattgcagtgaatgatgctgatacgaaccgataccaaacaattccctaagatggcttttgcattgtggaataagattttgataaatcatgatcgtttattacaaataattcaatggaattattacttaccgttgtctctattcgtcgtatcattttcatttctgtcgcaatttgctttaagattcgtctcacaacgaacgggtcattgtgataaagtgagtggtcaaaatacaccgcttcaactttataaaactattcaactagattatttagatcttcgggcatccctcttcatttccacttaaaaatgtattgtcccatcaaaatacagcccaaacatagaagcacaattacttttcatcgaagaaatgcatgacggctcaccgtgtagcgcagactatcataaaatttcgtgaattataggagttttacggcgtgtgaatggaatgaaatccttcagtgtacaagtacgaacgatttccataaaagaggttttgtaaataagttcccggtgaagaactcacacaggaggcgggaagaaatgtgaaccttaatgtggcgtagcccgttcgatcgctaatcagaatcgctcggtacgtattcgtccatgcgatttcggtgaaaaagtgcaacgtggataattgaactgaagttatttatcaaaatacagtagtttttttttctgtgtaagtggacgaaccataacaactttcaaaaaatatacttggaaagtaaatctctgttgctggttagtttaaatattcgccggagtggaacattttaagtttgatacgacgaataatagcgcttgcgacgaagtaaatcggaatcctactgggcaaatcaagctgttttgcaaactgtgggttgctatcctaggcaagtcataaaattttgttcaaatcaatgaatcagaaaagtagatttgagtaaatctttgaattccgccctaattggtcatattttgacagatacgttgcatattgtttgctttgaaaatacttctaaagccacaactttcacagatgtatgctactcgttatctctcatccgagtaattttgctttattggctaccatacaatgtagagagcctactaaaagggtggaagattttttatgaggaagagctagttaaatgtttatttcattcaacttaactgtcattcaaaaaaatacattctcagtataaagacagtttggtgattttttgaaaactaaatgataatttttatcatgcgttatactgcccttaaaagcatcatttttgacaaaatttgtcatattttgacgttctctgaaattattttcaaagttcactattttttaaatattttcctattttctcatgagtatttttgggtattgtacgatataaattttgaatgataaagtaaaagtttgtatattttgttatttacaaagctacctataaaaatgtttttaggtcatttgttggtaaatgtacaacttaaaatatatgtactattctttatttcaaagcttgtaagcactatccaatataactagggttcttgtattttcggcagcttaattctcttcgtcatgggtggtataaataagcttaaagctactgatagcaagagttgaacaaaccactctaaaggttattttagctgaataaattcctattcagctaatttagttacttgggaacaagccctcatgacaaataacttaaacctcatgacgtgttaaaaaaatttacacgaatcaccgtgatgagaaaacgttggaactaaatgttcaagcagctggttctcagcgatctctgaaccgaatttcgattgactttcaatcatctttgactcatcatgtttacatgattctgggtgaattccatgtttctagtgatgttcaatttttccccagagtagcttcactcaggacagtttttatcgcacggtcgaccaacttcacagcaattagttggctaggttcaccctgctgtatttcgttcaaaaatcgtccgttcgatttttcataggtttttaaaagtttttaaatacatttgaacaaatgccaaaacatacctatagtcaattacgaaaatatttaaaatagtaaacggaaaacatctgttgtcatttgttctactaatatgctctaaataagccctagaatggttgagcactatgataattgaaaattgattttttttcgggacaccctaccttccaagcaattctaagctagatcggagccggctgaactcccaaatgagaaccgatttaaggtgaagcctaacctcaaattttccagaacacatatctgaagaaccagacaaccgtttacgtttaaaaattgcaagtaatcgatcaagttttcagcttgaatcgatatctggttcttcaaatttgttctcttgaaaatttgatgtgtggattcgatttatcttcacctctaccatgttcgatcaaattgacactgtcgaacagaccacacagtctcgcccagtgtgatcccactttcgacacattcacctcacatcgactctccagcgttgatggtatgaataatttatacgggcaggtcttcaacccgaggctgctaccattaagtattttatctgtgctcctccggcaacgaaaagttggcaaatgtccagaaagaagaacgtttattgcagcagtagcagctcgattccccctcgaagttcgtttgattgtttcaacggttaagttctaaaaatacttacatttcttcctcatgtgaaacggaaactgattcacacccaggaaaatgtccatcctcgcgtttgcgacggagaaccactgtgccaccagcaatctttccgatgcccatggcaccatctattggtcagctttggaagcattgatgccatgactgaccgggacggagttgcattgcgatttcgcccgatttatgcgcgattttaaaaagcgaaagcctcccctcgtctttgcgtgggactgacggtttttcagcagcttttcccgcaagcgtttcattgcggggtttataagcgggtttttttatgtgagtaagtgaatgcggtagagcgattttcctttcgatggcttagcataaattaattcttcgcgtgacttaccacattgtggaagcagaatgcgttctcattttaaatggaatttttgaaactatttattaagtgaaggcgctttattggcagcattgttcgctgcatgttaatcagaagtagcccactgttttagttttactggttttacttattggtctcaatcctcagccgagtggttagagttcgcggctacaaagcaaaccacgattcccagtcggttcaggatcttttcgtaaaggaaattcccttgatctccctgggcatagagtatcatcgtacctgccacacgatatacgaatgcgaaaattgcaactttagcaaagaaagctctcagttaataactgtgaaagggctcataagaacaccaagttgagaagcaggctcttcccagtgataacgtaatgccaaaaaaagaagaagaagaaatgaaaaataccacatgatttgctgcaggaacattcacagagatttttctagaatttcttccagaagaagaattctttttttcagggattctcacaagaattcagtcggtgattctcctagaaattccttcaaagattctcaaggaattcctccaggtagcttcaggttccttacagaattgtttcaagcaatcaactaagaattagctgtaattatttccagaattccttcaatatattcttcatgcattcctccaggaatcctttcaagaattcctcaggaattgttccatgaatttctcttgggactctacagtgattcctgtaaaaatttctccagggaatgcttcagcaattccatcagaaatttaaccaggaatttatctagaagtatatttgtattacttctataataccttcacggttctttctctcagtaattctttcagggagtaatttcttcagaaattcatcgacatattccttcaggaatccctgcatgagttttcccaatggatttgtgtagagatttctgaagaaatatgtctagaaactgcgctaggggtaattccaggacttactacaatgattttctagaaattctttctatgattttccttggatttttgaggaatttcttcagaaattccttcaggaatttcaaggatttctcacagtcattttccaggacgttttccattaacttctgtagtagtaatagttcaagttttatcctcagcaactcgtccttccgacttttagcaaggttcgcgatgcgatttttgcatagaataccctagtgaaatccttcacgtttggatcacgattggaagaccgctgataactctcgaaagattattatcagatttcttgcaagattactaagattctcgacataaaagatgccttaaaatctctgttagtgtcatcatagcgagattcttgagaatatgctgatcaaattttcaacgtataattggcaaggctttcaactaggtgtttagcatattccaagtggaattctcggtgaatttctcaggtgatttttgttagactccgaactctataacttttacagttgatgggcatagcattggatggcgttttatataccaattttgagggctggttgattttttcgttcattaaaagctttacattcaacaacattttattgaagccttgtcgttttttttttgtatgtctgagtttgatttttgtgaatttctgtcctgattcttcgctagattccattgttaacgatgtttttatcatgaaaacctagcgataccagcgcttatgttacgctgctacttatattgccatttggaaacttcgactttactcagatggattcttgaagaaatccttgcatagattcccaggaactatcctgccaaaaatttaaagaaactatagttcaattaaggtgattatgtgtcttctcctttgatacttactcttcttaagatttaatgatacttcttcaaagattctctttgaaacattttctcaagatataagaacctggagacttaataaaaaaaatcatcctcagatgcatatggggacttttccaaaagtcctctttaagactgtaaaaaatacatccaatttgctaatttccttgaattcatctaaaaattatactagctttagaaggttcctaagcaataccagcattttcataaaaaacccgatttattcttttaactaggatactaggataactcatctaagacaacaacaaatatagagataataataagcttccaacagtttaaggtcatttcttgactttgtcaaaggcttttgcaaaaaaaaaaatacttttaatttgaataacaataataatcatcttccaacagtttaagaacaactctttaatttgccatagcctttcgcaaaaatgtgctttgaatttcatcaagaacaccgccaagaactgttttaagaagggattccgctaaaatacaaaatacatttttgctttgtatggtattcatgcagtcacgttggccatttttccaggacttctaagactaaggagctatcttcagaaaaatgttaaactaaatcctctagagaatcatgagaatagaacgagaatcataagaaagaaacttctttgattctatagataccaagtcacatcagggatcctgtgaaatctataggcacattttatcaaaattcttcagaaaaaaattctcaggaaaggcatttatggaaatcattttggtggaatttgaggaatatttcataaattgccaaaagaaactttttgaggatttctcaagaaaagatattcttgaaaatccctgcaaagcgaaaagaagtaactctgaagtaatccacaaaggaattcccggtgtaatttctgaaggtatttaagaggaaatatctaaaggaatttgttgagaaatttctggtgatggcattggtagaatccttagtagaatgcttgaaaaccccttgccgtacttttgatggaattgctgggaaaaccgtacagcagttaaaagtacctgaaataatttgtgggggattcacttcagaaactgtaaggaaattttgtagaatgtagaacagtcgaacctcaatatctcgatgttctacatcttgatatcttttccaatgtttctgcggtctcttcattctacaatcaatttatttttgggtatctcgacatctccagatctcgatgtgttcctgttgtttttattcctgatgttgttcaaacattttttaaataattattgattggaaaattattgttttttttttgtgcaaatcgaatgtgacaaagagacaacaaactgaatgcaattatgttctcaaaatttatcacaaaatctgttctagaacaaaattccataattctacgttagccgccaacactgctattccagctgcttgacccatctctcagtgtcagcttcgtttcgccgcagtaggccaccgcttgagatttgcattttccagtgttgtgctttgtctagttcataattttgtcgcacctttcctcgattcccgctcacctcaccgctccacactgcactgggtgaacttgagacgttctgcaaggttcagcaacagaaagatgactttgatatgcgcgtgtttgcctgtgatatacatgtgtacctcaacacccctattcattttttttttccgttgctattatggcgcccatttagcgcacctagcggaggccccataaagcagtgcccgatcgagtgccatattgccgggttgcgattttctccttttaaggaattgtttttctctgtctctcgccccaacgacccccaatatagtcgaccatcatcatcgaagtagtagtcgccgtcgtctgcttggcgctgagagctgcgaggaggacgggaagcgtgttgcactgcctgcttgtggtgacttacaaaaaacattcattacgactttgacataagcctggtggcgccgcggcgcgtcacgtgaaggtcagctcttggtggttgatggtcggtcgatacgtgaggagcgcagatcctgatattttacatcgaaccgggtcaagcgaatacgaaggtgggttattgttccatattgcttttaatgcaagctgtctgtgggggagccacagacaaacagacacttccagtttgacgaaatactgtttcctgcaactagatctgcagattgcagtagtttgaaacgtcaaacatgtacaaagacgatgttcgttctggttagtgttacatctgtttgtctgttctgtggaatgcaacctctttgtcgcacatctgtcacattgtggaccgaattgatcgcgctctgcggactgaccgttgaatggatcgcaactattgaagcgtaacgcgtggttgtttgctgaacaatggcgcgttccctctcaaatcggagttttggatcttccgcacatgcggaaaaccatagcgaacgaggctgcagttcagaatcaagcgcgtcacagcctacttcgatgtgcccactaatagttcgtgatgcgctttaccaacaacaacgggaacaatgcgaactgctgccgaagttgaggggagagactacaaaaatgctttatagttggactgctgttgttcgaaatgtagaacctgcggacgggaggtgggagaggaactgtacgaataacaaataaaacggaagcgccacccttctacaggtgtttccactttggagcgcttttgtttggtggaaccgaattacgcccgttctgttgcagtcgaataactgtcagcatgaagatattgtacaaaccactacgcagaaaggtctctagttgcttgtataagttatatttatagtcataacataataagtcatgaagcatttacaagaatcaagtagaatctcaatattaactagataacgaaggctctttcgctgccctttcaatcagagattaatatcaacagctctctcacgttggtcactgtagcgtagcgttgtccaatgcgaaaaaagttgcagggaaatccagtaggaatggtgttcacagccaacccaactcgaggtgagtgcttttcatcagcactcgcttttttcgttcgcccgattttgtttttgctgcactgaagcctccatttgcgtaattcgtcttgggcacgtcaatagagttttaagtaaatggaatcataacgtaaatagaatttattttacataaaggtatttctcatcctagaaaattagtttgtacaaaatatagcaaacagttcgaaaataggactaatgtgctaatgtgactttatgttctacgttagccacgaactcgttggaaaacatgtcttcatatctacaagcgtctttgggaggattaagaacaagtttgatacccttccaggattaattaatcatattcgatgaagttttgagtacaacaactgctaatctatatctaccagcgtaaccagtgatatttcagcgccttttgaacgaggttaacacccaagcaggcgcatttactcttatcctatcatgttttatgtaaaactatcatttaagttttccaacaatccctttgagtacagtaattcagatctacacatgttaccagtaatatcttgtagatttcagaacaatatctatctacgtatataaataaaagtggaatggtgtttgcatgttataagttggcttgaggacaaatcaacggattttccaaaattccttcctaattgtatttttctaaggctccggcgtgttcgtttggaataaagtttatggagatcgtttggaataaagtttcaaagagattttcaatagcctacttaaaaaccttgggatatgggccatcaaatctacacgtgcaacgagttagcttacgaaagcttgccaacaaggatatacatgagacgcagactaattacgtataaacttgtctaattttgggaccagcgttgccagaaataatgatttttgttccttaatatctgcacattatgtcctctgctctagatagcattgtggttaagctagtagatttgatggcttgtgttcaaaagtgcttctggttacccgtaaatcttttcagttcaaacttgatgattgactattgatatgatctacctaagcttgcttgttaaacgcggttaaaccttcgagagcccgctggttttccacatattttatttcataggcatttttcgttgaccgtgaagaaatcactagttatgcttacatatctgaagaccttcattcaaaagatttcattggtaatctgaaagtgtagttggaatcgattatgcagtaacatacttgtaggagcttgcatgagtgtaaactttatcgatttctttacaaaagattactgcttaagtttgttgatctgaagcctagttctcaacggatttattggatttctctagacagcccctagactcaagactgaatagagcacgtttgtttgagtctgcttgagtacgaatctttataattaacctctgaaagatcgttcgttatcattgagcagaaggtcttttctcaaaagagtttctaactctaaccataaacaatagttgcgctcaaaaatagacaggacatatttttattaaatctgttgtgtctaaaccatattcgttaatgtcggataggtcactaggtagcgcttgtagagctcatagtctatttttcaatgagtttttagatagcttgagataggcattgaagtcaaatcatagcagatcatagttatttggtcgtgtatgcctttgaacaaaacaaaacggagtttgatgggaccactagtgaaaactacttgacagatcgcgataaaaattttatcacttctagattttgctctattaccttatgtgccataaaattttaggcaattgcaagagacatggaggcttctatttatctctgactatagtatactatgtctctattcgtcactgtaatttccctttaagattttcccttgttttggcaaatggttcaatgtttcgagtttaaaaaaacattcatgattatgtatcggataaattcttgtgaaacttgtgaactcagcctaaaagccaatggtaaccgagtgtgtagcttgttgttaccgagcaaacgaatggatttatacgttattcaaccatgctaccatgaagagaagatcctcctctatctcccagtggtgatagttttcgtcctggtcatttgcttagaaacatggagaataagatcacaagttatgtgagataatgatgtctagccctcgtaaacataactcacgcaaatagaggcttcagtgtactgcagtgcatgtgagtaacgcaaagacttctcttgcacccattgatcaaaactgaaattgcgtggatgtggtgagttgactggcaaaccgtggtgagttttgcttcagtgctggagcttcccaaaaattcaacataaaacacttttttggcaactctgttctgacttgagttccctcacaagtgtgccacataaaatcatacgtccccgtaaggtggtttccgtgaatgaaatacaccttctgatctaccagcaaaaaaaaaaagtatgaaagtcggatcatacgggcaaggttctctctcaaatgcttatctttggcacacatgacacggttgcgttacgatgtgacgacatcgtttctatccgtgtacgaatggccaatcactcacacgattggtcctcttgtttggggtcccccgttaccgactgaatagaaggcacacatgctcaacggcacacagtgggtcaagaccatctggccaattactgccacaatgccgtaaccgtggcgaaggcgattgcaattttgtccttttttggactagcttttataggaggcataaagtacctcgattgagcggatggttccagtgttcacactggacagtgttgtgtagtgagaccattgaaccggatgacggcagatgggggcactcacttacggcttccagcatagaaccatcacacacgtatacagacgcacgaaggtgggcacgggacgatgacgagggttactatgggcgcgccgccatcttggaatctggcactactgggctacttggatggatgtcagtcggttcgattcgcggtgggctcacgatagtcagtattgtagtagttgttgacgaagtgagtactacttttcgcgtagaaccgtgtgcctgcgactgtgctgtgtgatctgtggccactgtctagctcttttgggacttttactcgtgttttactgtttgtgaatgggtttaggctgaaatttcgggactggaggattacagtaacattcgctgggtggagcactgcttagggttttctgtggatgcgggtgtaatcagagtgagggtgtgggctattcaagtgacctagtactggtggtgcgttagtgcatttagtgcgatatctatttgctcgtgatcgaattattgggaagggaataggttattgatcgtaggaagagagcacaattcttatttttttgggaatatttcttggatacacggaaaaagtttgacggtgcccttgcgtacatcggtgcatgtgatatgtggtgccattgagtgtgtggttgtgattgaattttttcattcgcaagaagtttcctcggataaacttcttacgaatttgaaaataagcaatttggtgatatttttcctgtagaagatcgcgcaacaatagtgttcctctgccgtcgaagaagcgcaaaaagagaaaaaacggaattcattccacttagcatttagtgaatttagttcatatctacttaagcgaaaagcaaatacaaatagcgaagagtcatggctgcgaatttgcaacaaagtggcaccctgttggatgtgctgaaaaagaagatgcgacagaccaaggaggagatggaaaagtacaaggatgaatgcgaggaattccacaaaaagctgcaaggcgaagtcatgcgacgtgaggaagtaagtgttcgaagcttagtcaaagatttcctggacagcttgaggctttgaggtcttcggtcaaacgaaacacaggaaacgcattattgcagtgtttctccgtctcagcagaagcagacgtgattaatcagcaaatagataacagttgctcggtgcgcgaatgacagttgcgtcacctcaccttccctgcttatttctgttcgtcttcgttgtctttgtcgcttcgaccaaggttctgtcaaaggttgtctgatatttaaccacttttcgtccatggaaagcgtccttgccaggtctgtatttggacacaagactcgattagagaatttcggtaagtggctacgcaccactacagccgtattcggtggaaactgaaattgtcgccactgtggaagatcagattccttttttgatggtgttcgtttcacaatttgccacatcaaacctcgaacactggccaattgagaccgaccatcaagctcgaagaatgaaagtttaactaaattaaccgggttaccacttttcccctactaacaagtggttgacccttccaagaagcaaaaaaaccgttctcagtcaaccaccttgcatgggaagttcggaagaatcgaaagccgctccccttgggatggtattcgtgttctggctctggccacttttcgttgttggtagatgagaaaaaaaagtacggcatttggaatttggaatgatacccaccaccttcatcgcgcgagagagagcatcaatacacaagataattatgggctggctccgttttgcgcatgccttctgcgcccgtttgttgtgttgaagtgtcaaagtcataaaaatgcgctcacttctccatggttgggaggcaccaccaccaccaccaatactatcgcagtgggcttttggttgctgcagtgctggtgagtgacgatggctggtggcttcaccctatagcatgcgggaccgaccgaccgatgatggtaaatcgctttccggcgactctgagtcgtgatatgtgtgtgcacattcgataaaaacggcatattgtgccacattgtatgggtgggtactttacggtggtgaacgtatctgcgttgagtagcgtattaatgagtgggtacttttgtgttgttcttcttttgagtatcgaatttatttattggagcttcgtggtgatttggtgaggcagtgcgggttgagagcccgggtagggttgggcttctttctttccactttcggcacaagttgagttgttttcgtttcgggcgagcgacaagcattagacgggattgtttgtctttctggaaattgttgcaatgaggagctaacgaaaagagaatagttacgatcttgtgatttacgcggaatatctccgttattaggaatcaacaactattcaaagaaaattattgcaaaacgagtactgttggagaatctactgtttcttttcaagttggattgtaactccaggaagaagaaactcatcaaatgtctcacaaacaagtgtaggagtctattttgccgtattgaggttgagcgccaaaatacttgtttccacttttttgggattgagttcaactggttcgagctcaaataacggtaacgattatatccttttaaggacaaggttgcaataattcaaagatgaccatattgttaactccttgaacagattgctttatccagttgtttgcgaattcgctacaaacaaaaagtagtatttttagtctgatgtaatagacggattacatgatctttccttaaaaaaaaattcaagatctttaccttaacaaggtcaaattcatcttaactaacttactgttaaaaaaaattaatgaaaatggattagtttcgtggatggttactatcaagatcattatggttattacaaaaataattagaagatgaacccgaagtgttttggcagatattgagtgttacaatctgatgctataagttataaccaaagtaggggtacaagtcggccattgtgagtgcctttttaatttcgggatgtcctccaatattctatcagagatacaaagatatgaacaccgtagctgaaaacgtgttcagaaatttcaagatgtttctattaaagataaatttctggtactagtttcttaaccttctatggtataatatatatgacattgaaatcctactttaatagcattctaataagaattgtagagatgaaaatatagcataaccacatagattacaattcttgctaccaggtcaaagattcttgtctcactaccctcctcagacgattgtagagatgcacaggtatagttggtgatatgatctataataccatcgaatccagatatattctcaaaaaatcatgaaagatatttttatatcagaccagggacttttttctcactattccattttatccctcctcagacgattatagagatacagaggtacaatcagtggcatgattaacacagaattttacaaaatcctagcaagcaataccattgactccaggtgttattctccttaacctttcagtcgtcgcgtggtttaccaccgtaagaaccaccacgctgctgttgtgaacgaaaagcgaggatttttcaacactgacaaaatacaacaacgcgacgactgaagtgttaaaccatggacgggatttttatataatccgaagagaatttcaggacagaactcagaacaggattcttatcaatttctggagcgttttccagattccagtcttggattttaaaataactcgagagctatgctctcccaacatcggggacataattttcaaataccttgaggatgaattttcagatgatatcaggtaacggtttatcaaaatctcaagtggatttatgacataaatctgggaaggacttatacaagatcctgaacataactttcttagggtctaaggtcaggcttttcaaaagaattttgggctaaatcctgacgttatctgaacgaatccaggaagggatttttgaggaccctgaaattgtctcttttcattaaatgactttcgtttgacaacattgtttctgacatttgaccagctgttcttagcctcgaacttaggaaacacaaatcgaccaataacctcatttctttaaaagatattgagttagggtgcggccagagttgacgcgaaacgcgaagcgaagcaaaaatagcatgggaaggaataacagttatttcgaaagaaatgtcaaactccaaaagattttcacttcgcgtgacgcgtctatgctgtctgccaccttatgctgctaagaagaaacgagagtctaactataatgtgcacaatatttttagactttttaagttttcctatactgccgtgaatcgcaagtcagtcccatctgtaaaaagtaggcattgggaaaataggctgtgatgttttcaaacttattttgcatacgaatattcaaaaaaatccagaggataggaacatgttgaaatcttaatgaaactttcacaatttgctttttactacgatatattttcgagaaaaatataaagatgaacaaaacacggttcatttttgtgttacacggtgcggaaatctgtactgggactgatatgcgattacttttcattatgagacaatttgacttgctgttttttcctattttttccacacaattcttattattttattagttcagctgaaaaagcattggaagatatgttgaaaactgaactcaactcaattttgacgaaaatgcagatgggactgacttgcgattcacggcagtatagttctgcaaagtaggcacatcaaataatgtgtttttgctgaatatccaaaccctttatcttgtaaagtgaagaaattattgatgaacttgtgtttcccaaggatatcttttttatgataaaacgaataaaactcttttttatatcaaatttggaatcgtttcactcttaagcctgattcgctgctgacaagtaatttcttggcctttcttgatgcatgggaaattcatgcaaggaatcgatcaaggaagcgctttttttttctgatagcagtatgcagttgaaaaaagatgccagttcaaacgggagtcgcagtagaaaatttctgcaaggaatcggcgagaaatttctttagcgattcctgctcagcagcaaatcaggctttagctacggtgccttactacgcctacttgtccgacttaccttatggaccgcgggacaaccatgcgtagaacggcagtacgtttagttaagctctaaaattctggaagaccttatctcgtgaattgaaatactcgtctggttttcattgaataaattttccccaactcataagtattacaaagagcatcagtgtaatttgatagatcaagattcttccagtaggtttcaaatatgaggaaaaatcaactaagttttggtggaatctaaagtaatacaccaaaagtgtcaatgctctggttgtaactgtagattgtgacagtacactcggacattgagaaagcttgttcactgtttgatccttgatcattacataaaacctatatcagttatgtcctataatattaagaaagttttactggcataagatttgtatgaagaaaacaccgaaaatggttaaggctaagtagcccgtcattttgcagtaatgttgaccctgcagctttcaatctcaaatcaagaaaacttaatatttaatatttattcggaaaagaattactgtaattttctgcatatgtagaaagtgtgctgatgcttttcttagttagtcaatggaaaaaactacttctgaaacatgttgtgatacttcaattcaaaactgttagactgctccttggtaaagccagattcttataatgggcagacatgaaccagcttttggctaaaaatctcactaataaagataaaataaataaatgattcttataagaaacctcatgattcactctagaatgtttattccttgaggaaaaattctacttattagcttaaagataaacttattagctgaaaatatacagtgaaagttctacttatgaaaaacattttcacacgcctactacttcatatctttctatttacggaaacatgtgggaacgaaagtattctccagtatgtagaacttgtaattcccctgttaattacatcccacaactccgcaaacacgatgttctgcagatcgcacatgaaccgtaaacagatgaatggttaatttactcttaccctttataaaggaaggcaaaaatcccacatactttctcatcactcttttttgcgaatattaaaaaaaaaaaaaaacaagaaaaaacctgcccccatccaagtaggcatcctcgatctcgatcttaatagcagagagaccacctttcgcctcgtcccatatttgtcttcttcgcgtcgcacatttcattctacctacaccgcgcgcgccaccgccctgtgcacgacaatatttcgctgatatcacgcttttagcattcattgctactgtctccgcgccggaccggccgccccctcgcattaactcgcgaagaagagttaccgagatattctctggactaacatgtggaatgggcggaaaagtctttgaaaaccgatgcggctatcagcggtccaaggtgagaatttgttgatatgagcctggactggacggcagaagcttcggtttgcaaagcctgtttcgcccttttcaaatgctagtctagtaccactcataccaccatgcgcacacggtgtagcggttggcaccttgccaccttgaagagtagccggctttctgactcagcgcagtgctagatgatagatgtgatggtgaggtgttcatgccatgccgagcgaatcgctcgtccggattctccggtgagcaacttgaaccttcttcttcgacgatttcttatgggtgccaagagccaccgtcaccgtcagcaaccttgatggggacgactgatctcgtcatgagatgatggtgcgatccgttattgtccagggtggagaaaattgatttgcctcaaacgattcaatcccgggacgtcccgtttcgggttcgggacggaactgactcattccgcggactttgacaacgtggtggtggctaccacgccccggcttttagccggcagttgcctctctctctctctgcttgcatgtgtgttgtggtgccgaaggaagcttttcgcaatttgaagccaattggtctaatgttttatttatgcggttgggtgaattttccaccggattcgttcggcaaccggcaagcgagttattcatcgggttgaaggctgcatatggcgctctcgaacggcattagaggtttggcgatttggcggtcgggattcaagcgttcgctgaccttgagcataatgaaggcatcgtattgcggtgttggccgatgatgtcagagagggttcgcagtatctgattttttgatgcgcgttttgttctgttgagtaatatataatatagcatttattcttcttcttacgagtattacgtcttcactaggacagagcctgctcagcagcttagtgttctaagagcacttccacaattatcaacaaagtggcaattttcgcattcgcatatcgtgtggaaggtatacatttctggagaaactaattgataaatttatgatagaattattgtaggaatttctggtggaatcagtgaggagtttcatacctcaaagttggaaagatttttttgcaaaactcaaagcaaatagtggtaatttgtaggagattttagtgcagttcttggaggaatgtctgtggttatccattgaggtgttgttgacatgttttgagtgattctgtgcataacttttgacgacttcaatataaatacctgaaagttgcactacctagataaccagtaagcatatgaataagccattaatcagttcttgcattgcatatgcttactgctctgatatagcagctgctctagattgcttagctgccttaaattagtagaggataaaagggaaagatatatttttgttttgctccacgtgagacgttacattctgacgttatcatttttgacagccggatacggaacttctgaaagctaagcattcaagcagccatgtatcgggccaaaaactgcattgtagtagcatttaaggcacatacactgctgaataaaacagtagaaccagtacgcacttaatcacaggttacctcggtacataatgctattgaagttttgagagaagttttggcataacttctgaaatcatttctggaaattatagtatattctgacataccatccaaaatatattctgacatactttgaagaatagcgtaaaagagattaacaaaagattcaattgagaatgcctccaaaagttcagcccagttataccatgagggttatctcttgtcttttcgttgtttagagatagaataatctatggctcttagccaagattgacgtatccttcaacattcgagacctgctctggctacatcattgctgcagttgcgagagatcgggaaaggagcatcaatcgtgtcttagtcaatcatagttcgaacctgttatttagattaccaacgaagttgacctcaaaaacaggataggttttttttgcattattacgcacattatagggaacagtggcacaagaagtgagtaggacagaacacacgatttaacaaaaaaaaaacaagaccagcagaaagcttgaaaaacataattaactttttatcatctgtgcaatatatcaatgtcgtacttattcttatggagaattgaagacacgataaggttttccattgtttcctcatgcctattgaaccgtaactcagtttgtgcatgactcccaaaaagttcggactcgtgtgaagaacgattgagaatatctatagtgaaagtcttgggaaactaactgtaagaattgttacaagtaatttctctatgcctgatttactgctgaaaaggaatcgctaaagaaattttggatgattcttgaaaaatgattggataaaattcccattgttattttttggcattattcataaacatacttagaaaagtttatgaagattttctgaaagattttgttttgaaaaatgtttcaataatctccagtttctcatgaaaacttttgcgaataatcaggtcgcttcgataccaagaaaggttgtataggccagcaatttgttctatttttgtccgatttgattaaagcattggttggaaagggtttacatataaaatatactctgtttttgaatctctttgttccttataatgcaatgcaagaatcctgttgcaaacttgttcatgctccagagacaatgacgggttcaagaggctcgtcaagaatttcgtctcagattcctcaaggagtaatttcaggaattgccatattgattttatttagaatacttgcagggcctcctaaaggcgatttggtgaaggatgattagaaaaatttctctagaatttgccccggaaatcatggctaactccaaagctactacttctagttattttctcagaaattataatgattttttttttccaaaacttgcctagaatttcctccagttttttttaaaccctgcaaaatttcctacgcctgttcatgtggattccttcaagaattcatccacgtttccttccagaaatccaaattttcttgaggtgttcttcgaacaactctattttttgcccctgcagttttcccaaacatttttacaaaagtttctcaaaaaagttccatgcaatattcaaaattttatttaagtttttacaccagttaatactacataaatttttccaaaaatttcttcgatcagtctcgcacaaaatttcttctgtccaatatttttcgagaaatttctttagaaaatcctgcgtaatactatcccaaaattcgattaattttatctataaaagatttacggattttatctatgaaatcttcataaactttttcgaaagctaaggagttgcttcagaggttttataagaggttacttcagatgttctttagaaataccccacggattttcttttctaaaaaaagcatttctctgggcacattcctagaagaattcgtgaagtaaatcttcaaaaacttacttcaaataatctcctagaactagtggaggaatttctgtagaaatctaagacagaatctctggaacaattactgaagatatctccagagaaatatttagttgaaatcatagaaaagcgctttaaatttctggggatgttattgattgaattttagaagatgttttacccaagaatcttggaggatgtcccagcgaaatcgatggatgaatctttggatacaatcttgaaggagttaagattacctcttaaacaattcgaaaagaatttttgaaggaactccaatgatttctgaaagaatcttaggagaaattccatatctgtggtactactcggaaaattctaggttgaatttttgaggtatcttcaacgaaattctttgagaaattccctaggaagatttgtggagaaattccttgggaaataataacttaatgtactcctttagaaatttccagagaaatatttgaacataccaatgaagtttctagagaagtttataaaaagaaacatacacaatacttatcgtaatgttacaaggaattctgaaaaaaaaagacttagatctcagagaaatatctgctctgatggtatgaataatcaaactcttatcccctggcttctattttgtgtttttttgttcctgtttggtcttttcaatgcctcttttcttttccttttgggtttcattttccaggcaagaggtctctaatttcctatttttaaggtcctcagtcgctaccagccctgtaacgtcgaaaaactttcttagtcttgtggtaacgactgacaccctttgtgtttgagtccctttatagtaaatttcaatttgctgccaaggattttataaagtttaaatttttctttgcttcggtgttccaataattcatctcctcaatcctgtattcatcctattgatcactaacgatttaagcgttatttgctttgtctcttagtttttgcatttgtgttaaacgaagatatgcataattgcaaaaaaaaaaaacgatttcaacgggtttctaatctctttgtttccaatacaattgggtattttaggattttgaatgaaatcttgttgttattcaataacacgaaagagcatgttattgcaactactttaacaatttctcccgctcaaataacggctatatcatattcaaactttaatttaaacattggtttcattaatgatccttgacagttttgatcatcgacaaaaacaccacaggggttttagttctaacactggggttgttcctatatctgatatttcacaagggacacggaaaacaaaatacacccaaaatttgagtttaagccaaggggtgtgacagatacataagaaaatgttttttggacttaaacaaactattgaacagttatcctactacagattctaagtcttcttccaatcggtgattacgttgcattttgtgcatttttctatgaagttaggcaaaataagatgtaacaagtgatttgctaggaaacgacgtctcatgttttgtcttacatctttcctctagtttgaatgtgaatttcagcggaacatacaagtaatttgtttgatttgattttattgatattgattttatgttgtatcagatatcatctcttgatcagcttttaatttttcacacaaaatgaacattggtagcttatatttcaactgattatagacagcatgcaatttttatttctttcgtcattgtttttgaactcgtaattggaaaaatcgctcaaaagtatatgcaaaaattcaagttatgcctgacgtgctatgatgatttttttatgataactcggttgaaaaattttataaatttataaataactgagatttaagcctctaaaattaaccgttttgtatggttaatcgatagcggtttttcaataaatccacacattttttcacagggtgagcattttctctatgattcaagtcctctacacataaaaatatcaatttttaccgctgtttacatactttctcttaatcgtttttctggtaaaacgctagccaaggacattctcttttgatgtatagtaaaaactttccaaaaactttagtgttgcactgtcataatcgaaaaagagcgatataggagggaatatctcattgttacatagattcttttgaaaagctacgcgtggatttttaatgagaacttaatgagtcgcagtgtcgtacctgctgaatctgcaacaacaaagactctcgggtcctggtttactccgttttggatatttttgtcggtcagaagtcgctgaaattcagccatcagatggcacttttgtacagataaagttgatcatcaaaaagtgcagagaatggcaaacgtttctctaacgttagtcttttgacttcgctctgtccaccaaacttgttccaaaactattttctcgttttgatcgcttcaagatgtgacaccgttcggatcgatttccctcgcagtcccctcagaaaggctacgagctgtgcaaattttatggcgtactcatgtgagatacaaatcgcacaaaagttaatgcaaatcactttctccgcagcatgtggagtgccttgtttgtgtgaaatatgccatttttgtcccattcccaccgagtgtggaatactcgatccgaacaccagaatgacatcattcgaggaaagcgaaagcaccctgaaccggccggaacagtggactgcctttattttgccattcgtcatggaggtctgtggcgacatcccgccgccttttccccgcacctctcagaccctcaagacgtgtacttcctaaccatgcacaacaaatccgcgtgaaccataaggagcgggattactcaccacgttcgacactctcgaaccttatttgaacaatgctcgccaatttgacagctgctcaaatagcatccccagacgctgttgacgccgtgccggttcaagactccggaggccacggtcggtaactcacacgcatcgccatataagaccatccttttcttgtggtccttttagggagggtgttttgcagtgcgcggccgaagcccatcgacgcacagtggggtaaaactgggcaaaattcaaaaacattagttatcaaattcttttactggtgtttttgttttgataaatttggtattgactaacaattagctaaagtttaaggccaactggtgtgcattttgatttttctgaaatttaaactatagaaatttgtcagcaaaaatgaccatttttttcaaattttctaattttttggattttgttccatcgagattgcaatttctatactgaatcgcaacaaccaatttcattcaactgtactctttgatttgaagatgtttcgtatcgtatttaacatgttaacaatgttaacaagtagataatatgagactccaccaaaaattttcactttttctgaagcttgcgtaacttcaaaatgaccatctatccctcaatattacgaatgaacaatagtattcgattgaattaacgacattatgcgccacatatactggatacaccgacttattgtttcagtcaccatcttcgttcaattacttaaaaaaatattggttttatcaagaaacaagaattttcaaacggtttaagttagatttgttcttgtgatcagcatttgtatggagcgcggtcactgtgcgccaagccggacgatcgtcaaatcagcaagatgatgtcatgtatgagctgcgcatacgattccgatttgtgtcgatatgagtcgtcgtcactgtcgccgtagtcagcagacaaggtcaccggataattgctaccaaaacgccgaatcaatcaccagcggaattcaggtttcctttttccgatttcggaattgcgatctccccgccaaaggatacgagcattttaatgactttattaaattaattaaggtgatcgcgctcggttgatcgcacactagatctctcgcgatcacggcaaaggtctccccattaggcatgtgagaaaaatttcaataaggtactcacctcactcacttcaggtctcaggctcgttgaacatggaccggccaatgggtcattctcactgcgaaatgtcgacctttggttgcgatttgatcaaacacaccggataagacggactgtttctgtagaaacgtgcccttgtagagtgtgtgaccgccttgtttgcacttgggagggagcagattggctcaacttatcagcagtttgcattccatcgaggtgagagtgaaatttccagcgccataccggttgcgattggatgtcgtcattgcgagtaaaaatcagcgagtcatatctgtatccgctgcaattgctaaatatgagtcgtggttaggagggacaatttgatcacactttccacataattttgtctgattgggctggacacaaaatcgaaattcttgaagagtattgcagcaacaagtctgaagattcaattagttgctgtcttactgactgacgattttactatggtcagttaaagctcggagattaacttgagcattactgtacaatgacttcaaacagctcctacaaaaaaatgttaaacaaattccattaatatttcttttagaattaatgcctgttttgagttgcgtaatgaatcattacacaaccatttttcagaaattgtaaaataatggtgaatgcattccaatatgatttctgatgccctcaaggggtcttcaacgaaattgcaaaaaatgttgtacgtaattcgttgcagaactcgatttctacagcactcgtcgtaattatcctactcggcaagccttgtaggataaatttaccactcgtgctgtaaaaatcatcattctgcaacttgttccataaactaatatttacgaattcttcaaagatctgtagaagggatgttatgtgaatttgaaatgcctatggaatggaataaactcttcgtctctagaccaaaacttcgattttacaggtaacaaaaactgaatcgatccagtttttcacacaagagtcagaacaaacaacaggaaataggctttcagtcgaacgcaaaattctgttttgttccgcatcatcgagtgcattttcactcatttcccatggactccagcagataaaatcgatgattctgttccgatgcagagcaaggtagtccagtctatacaactggtctacctatcatcactccagctctgttcaaccggaacgaaacaagaattctattccaactcgatggtgataggagatgcattcatcgatcggcattcaaatccagctatccgacggcgactatacggtagcgatgacgcccttcagaaactatttcagggtttctcactacgctctgcggtgggatagcccatcaaatcgtaatgcttaatatcaatcaaactgaacggaacgggtcgcatcgcctctggaagttatgcaacacaccccgtgcactttattgttattgtgagccgtccaattgagcagtatgttttattccccatatacaacatggtgatcaccgcttcgtccgagtgagctttgtccaaccatttgccacgcgtcggtcgttccatcgattggcgctgaccatgatgcccctctcgttgttgagctggatattttgttacacggaatcacagccaaacaatgtggtcaccatcgacttgattgtttcagctaaataagttaggattacgattcccttgaaactggcaacacttcccatcatctgtcaaatcaccattttgcaaatcacctgttaacagtcatctaatcaaatctttcttttttccattccaggccgaatccgaagtcgctgccctgaaccgtcgtattcagctgttggaggaagatctggaacgttcggaagaacgtctggcttccgccacggctaaactgtcagaggcttcggcggctgctgatgagagcgaacggtaagtggtcacggccagcggggtctcaatcgtcggaagtcgtgttatttcttgcgggtggatgatgcgctccacttccactactgtgtaaaaagctggcgcggttgcgagcgggccaagaactgcgacgttctgctttttatttccctagggattattggtttatttgtagttctctctttttttgagtttgtgtcatgtgagggcggaggatcaacatcaacaaacagaattgaggctgcttgaaagctggatataacggaataattcgttgttttagtacaaaaagggttatagtactaaagcgatatcagacttaaaaagtcgctgtaaaaagcctaaaatgtaatcacaataaaattaggagccggatcctattcttggcacttttggttcacttcggcagtggggttttttgaaagctacggggctaatatttggctacaatatgcgtcgtactgaagcgcttcttgttggaaagtttcaggtaattcggccgagaaaaacccccatgccaaagttaatgatggaagtgcccaagtagctctgcactatgagatgtggatgattttttgtgtaatctcagcttgatagtgacaaaataatacaatttgttcatgatcaagtactcaatcaaatattactcatttgcttgatttttaacatgtgtagaataaactccaaatttgaaaccatcgattaacattggaaggttttggttttagattgaaacttgattttgttttgatttagtgtttttagtattaattagttttagtacatagcacatatttttggatgtaatgtatgatatttttgcaaacatccttaaatctcttcatgacatgacttttagtcagtctgacaaaatttcctttttttgcgttatataatatagtacagttgaattaaagtagaaagattcatcttcttataaattattcacactcgttcaactctttatccagtacaggaaaccaagcaagggatcaacttatagtacaaagtgttatgatatatacgcctaaacgatgttatacaaaattgatgtgtgtgatatcaaactattctgaaaagtgggtccttagctgatatcttctttttttcgcaaagtatttgccacacaaagatgcttcgtaatactaatcagcacaaaacaggattttttagatttttgatccaaatatggtcatagtgattcccaatttcgacataagctttagttcagcaatttttaaaatttgaaccattttgtgtaacttgtaactagtaaaatatcaaaaatttcatggtttaaaaatattcaaaagactgaaaatgtaaaaagtcatattttagtactacttttaaaaggaacacatgaatgaatcaaactgccggagtatataaccggtgttccagttatggtcatagtagttcccacataagctattgtttcgacataagcgattgttaaataatttttaaattttgaactattttgttggcttaactaataaaagttcaaatatctcatggttcgaaaatattcaaaaacattaaaaatgtaaaaaatcacattttagtactacttttatgaagtacacaggaataaatcaaactaccaaagatatgttgataaataaaaagaacatcaatctctcatttggtgccaatgtttactccactgttaagaagtgaactgttgacgacaatccagctaaatgttgacgacaatccggttaattgttgacgacaatgcaggtgccactgcttcataacggattgaaatgtgtaagaaatttatctgtaaataattaacatcttccttgcttggaatcgtgcaacatgtattgaaaaggtataatcaaatgctatgaattctgtttgtttatgtcatcttgctcgtccacatgaacacagttacatcccatcgccatttgttagacaacaagctgattgaggtgcataataatttattgtaagatcatccattcagggaagattcacaggactccttatggcagctccgcagggctctttgcggcagctctacagatctacttacagtagctctacagaactccttacggaagctctacagaactccttacggcagctctacgaagttccttacggcagctttaaagagctccttacggcagctctagagagctccgtactgcagcactatagagttccttacggatggtctagagagcttcttgcggcagctctagagagctctttacggcagctatagagagctccttacggcagctctacacagctccttacggcagctctagagagctgcttacgacagttgtaaagaactccttacggcagctctacatagctccgtactgcagttctatagagctccttacggaaggtctagagagcttcttgcggctattctagggagctacggaagctctatctagagagctcctcggcagctctctttccagctaactggggtcaatgctgtttcctgatctaggtgaccatcctagcacagggggatcgatcctctagagatccttacggaaggtctatagagcatcttgcggctattctagggagctccttacggaagctctatctagagagctccttacgcctgctctaaaaagcttcttactgcagcgctaaagagcttcttacggcagctctagagagctccctacggcagctttagagagttactaatggcagctttatatagccccttacgcagctctagagagctccttgcggcagctctagggagctccttgcggtagctctagagagctccttacggcagctctagaaagatccttactgcagctctagagaaatccttacggaagctctagagagctccttacgacagctctaaaatatccttactgcagctctagagagatccttacggaagctctagagagcttcttacggcagctctagagagatcctaatggcagctctagagagcttcttacgaaaggtctagagagctccttacggcagctctagagagttactaatggcagctttatatagccccttacgcagctctaaagagctccttgcggcagttctagagagctccttgcggcagctctagagagctccttgcggcagctctagagagctccttgcggcagctctttagagctccttgtggcagctctgtagagctcctaacggcagctctagagaattccttatggcagctctagagagctccttgtagcagctctatagtgctccttgcggcagctctagcgagttccttacggtagctcttgagagctccttacggtagctacagagagcttcttagggcagttcttgggagttctttatggcagctctgcagagatcctcacggcagctctatagaagcttcttgcggcagctctactgagctccttacggaagctctagagagcttcttacggtagctctacaggacttcttacagcagctctagagagctcttctacagagctccttactgcagctgtaaagagctccttacggcagttttagagagctccttacgacagctctagagaactcctcacggcagctctagagagcttcttatggtagatctagaacgcttcttatggtagatctagaacgcttcttacggcagctctacagagctctttacggcagctctagaaagcttcttacggcagctctacaggacttcttacagcagctctagaaaacttcttacggcagctctagagagctccttacggtagctctagagagcttcttacggcagctctagagagatccttatggcagctctagagagcttcttacgaaaggtctagagagctccttacggcaactctagcgagtaccttacggcagctctagagagctccttacggcagttctagagagctccttacggcaactattgagagctcctttcggcagctttacacagccccttaaggcaactctacagagctccttacggctactctgcagagctccttgtggctgctctgcagagatccttacggcagcttcacagagcttcttacggcagctctagaaagctcctcacggcagctctagaacgctccttacggcagctctacagggctccttactgcagttctagagaactccttacggcttctctagagagctccttacggaagctctagatagctccttatggaaggtctagaaagcttcttgcggcagtttacagagcttcttacggcagttctaaagagctccttgcggccttcacagagctccttacggaaactctattgctccgtttatgggagatctacagagcctcttacagcagttctactgtacaaattagttttagtacaatgatgctactggactacatatattctgtatgtgtacagattctctccttttaaaacacctctttcagctggttcgtcttcttagcaatataatgtcctcaaaaatttatcaagctcctcaaagagctcattcatcccacatttcccccccaaatactgttctcaccattttactcatcacggtgctcaccgtttcccatccacgcacaggattagaaaagcccttgaaaaccgtacaaacatggaagacgatagagtagcgatactggaagcacaattatcccaggcaaaactaatagcagaagaagcagacaaaaaatacgaagaggtacactcaatacttcctacgctacttggttgaacgaccatcgttaaggttaggaggaaccgtcaaacggttccgttggctaggagaaagaactagggccgttagggaaccataaatcttaactttacaggttttcagcagccatcgttccagtcgtcgtcgtcgtcgtcagcgccgcagccgccaccgcaaccaccatatttttacagaacctttaacttttcagccgccaatcgaaccaatcgccactaacaaatgatattcttttgtgttttcttcttctctgtcaaactgtgtaactgttcaacacaacactcatacgtgctaaacaaaaccccccttcaaaatcacaacgacaacgacaatcccaaatcgatcactaaaacaacgcgcttcacagtgcacgcaaggttcttgagaaccgtgccctggccgatgaagagcgtatggatgctcttgagaaccagctgaaggaagcccgcttcatggctgaggaagctgacaagaaatacgatgaggtgcaaaagccagacattacttgagttttttttccgttgttgtttttgttttctccattattctttgtctcacgtctttcgttgtgtttttccgattgtttgttttacccatcccatgttatccattttcatccattgtggacgcatgtggcgcaaactcatcacgaaaagttcactcattctcgcgacattctcattcagtaatcatcaacacacacacatacgaatgcactgaaactttttgtttgctcgatcatctaacgattcagttgatgagattgttttgaggcgctcttcgagcgttgcctcaaaagagcaggacagtgagccttgtcgaggttagatggagctcagacacaggatttctgacgaaatgattaattttagacatgttctaaagacaagtgcgtaatggtcttatccactgatgtactaaactgactcggtcgaataattttgacactagagcgggtccaaatcacgtggggatcatacgggagcgtgccccgctcaagtgtcacaattctcagaccgagtgaatttagtacactggtggattagaccattgatgtatcgatatcgaaacttcagggggttcattcagaattttagtactgactcacaagcatgcaaaacttcgaaagtttgaaaattttagtacatctttagaacatgtttatcacaattcactgacttggataaattgtatctgaagtttcatttagcaagtgctgtaggtaaacgataaatcaggaagatttgatagatataaatttcccataatttgaagtcatcggttgtctacggaaacttcaatatttcgtacgataataaaaccgaatgacttttaaaaataatattgatagctatttatattttagaactgccaaatcatgcctcaattggaaacagaacatttgttttgattactactgttaacatacccttttttattatttaaatccgacaaaatatcaaattttagtacatcagtgtaatcctagaaaatattaggccaaacaatttgttctcacagaagtcttttgtgtttgattggatttatttcctgtttcgagtatgacaccggatcgcttctagagtaggaaaaatccaaagaaaatcagtccatcaaataattaggttttggaatgatttttcttgatcgattaaaagttcagattgctgaatttcatcgaaagcaattcaaaatgaactttaggctaatttcggtttgttcaggaaaaaaatgaatctaaattatatttatgtttttgtttactcaatgttgaaccaatgttatctggtcttagaccacgcgttgctttgtgttcaacacaaaatgataggaatcatcaagagatttaggtagataatgaaagtgtgttatgagaattattactcatgtgattggattttagaacatcccaacataaattctgttctgtgtgtaacattttcaggtttaagtgattgttaattaattattaaatataaataataataatcccttttaaactgtgcacgataaaccaaaaaggctaaaattagagctacaaggcgtgctgtcactcttttatctgcctttcaaagaatgaaattctatgtattttaatgatgtctcgccatttagagatgcaaaaaaatatcagaaaatttaatgttttgtcgtgtagaaatgatatttggtaatttaaaaaataagttgaatcagagaaaaattattaacaaaaattgcacaaatcagtttaaaatttaattacttattttagtccttcgacttttttcttgttccatttacataaaaagctatttactaattgatagtctgcaccagtgatctataaagcataaaataaagcatcttcagggagaatagttttcgtgacttcatgaatttccaatgaataatcaacattaggctcttgatactcatcacttcatcagttgtaaacgattactacatttgtaatgttgcatacagagcagaatttcacctttcaaccaactttatctcaccccaattcacctcatttcaatcaataagtgtcggtaacaaacctcatcatcacgtttgcacttcattttgctttttatttcgtgctttatgttactcataaatgacatccgaaagtaaaaacggtactaactgatgtgtgtaattgaactcgaagcccaggatgaatatgatgacgatatactttgaacactttttattaccatatacacccatatgaataatatttgcaaaccaatgaagagcaattctaccaccactaatattaaacctaggccagtgcctccaatgaatcgttgccacctgcgcaacggttcccaatcataagtgtctcaacctttgactcaacccgtaaatcttaagccacaatttgccttattagaacagaaaaaaaacaccaaattaagaagcaacgaaatcgtccaactacagacaggtagcaagattaagtgcgatcagagccagtaatactgtcggtataagtgcagctactaattagagttcaatcgacaggtgaacaactttaatgagatagcttcccctcaagccccctcatacgggggctagaaagtagataatgtcagaaaatggcaggaatgatgcggtgaacaaatagcgaatcagcgaaaactggaacaggtgcaagtgaggtgtgaaatgtatggatattagtagcaattgctaacagcgaattagagggttcagtcagtatcaagaggggagaagatgaggggaagtcagatataggaagaaagctatactgttgtaaggtaactggaagcaaattgtgcaacaattttgccagtaaccacttagtcgaagcaagcaagcaaggtagagaaacatgagtttataatgtaacatgaaacgtgttgttataataatccaatcttgaaacaatgattgagaagaatgatgtggaaaaaatgctatctatacaatgattgatgaagaaattatatatgaattatactattttaaaacattgaaaactatttaataaactagtgattatcgtgaaaaaaacgttactttggttgttttatttgatatcatctcttgcgttcacaggttgtccagcgattcctctctcaaatggttgcggtattttcggttactttcagtatgtttgagggcctatctggatttatctatgaaaaatagatgttatatagtcagaaagtcatagcctaggtggatttcttgatgtatggtagtttgattgtaattgtgtgtgctaatgagcatttttgaaattattattattcatattgaacagattatattaatttattttgcgcatttctttcaccactggactattgcagaaggttttataactgcggaaatgctaataaaagtgcgcgattgtatcaaatcgggtcggtgtcttcagcagggttattcctcgcagtccaaagaataagtgctcttaagacatttgcatgattagatgcaataccgcactttcattcgcattttcgctcttatgaagccgcacttcgcagtctagtcaagaaacaaatacaaaatatctattactttcaatttttatattgtaacgactaagctagtaatgttttttttataatttatgtatttcttcgacaaactgtcatgagagtttatgaattctttcaaaaatgctgatttgagtatgtgtagtacgtatgatagagaaagggaaatttcatacacttttggtaatagtaatactgcatagagtatgattctctcgaaatctgatatagaagtgggagcacacaaacacaatccgtggtcagcatatttagctttgcttctagggctggcattattcattaaggtgtaattagcgttcgattcgtattattttagttatgctcaatacctcttattgtagacatttttgagaactgatttcaaacgcttcaacatattgagcaatgatgtaagtttacacgatttttcctaattagtaggtacctagtttgccatcgagttctccaacgagttgtagaagaccacttgagactatcagaaattatatctgaatgcgtccatcattttacaatttttaaaaaatgttgtgtaatgattcattacgcaactcaaaacagttgcataatgagaaagcgttgcataatgaattattacagcactggtttcagttgcgtaatgactattctcacactgtgtacttcagtgcaggaaagtaggccgtttcatgacagattggcgtgatgaaaaacagcctattacgatgagaaattgtaaaaaatcatttacggaaacattcctttacgtttgtaattttaatgtattgatcgttcagataattaaggtttacaaaaaatcagttttttaagattcacaatgaagaaaaaaaaatttagtaaagttttttttttagaatttgatttatttacatgctgaagcaatgtgaactacaaagattttccatagaatatagagaagaactgtgtatcaaaatgccataaaagtcttaaaaaatgacaaattttcttggagtagaaattaattaagaaatgtaaggcgaagtttatggacgcactccaagtgtagacttaagaggtaagttgcatagtttgcatcgttttataatcaacttcttgcaccaaaatcaaagaaatttcaatggaaatgaattgctgtatttcatataccagattacagcgaacgccttttaaaaatctatttatttctagattttcatcgaaaagtacttgtttgaacttgtgataatgattcattgaactttctgttctctcgatcttctatctatggtatcaaatgattactttaagcatggaacttatgacagtttctcctagttattcttcgagaatttcgtcaacaattcttacaggcacttccagagggattccttcagaaacgcaattcctctgggatcacaaagtagtttaaaacgatctttcaggaatcctccaaaaactttttcagcaatcacactaggaatttatttatgagtttctcaaggagattctctgaaaatttctcagggcttttttttctagagactggtctagaaaaggcatcaattattcttctgagtattcctaaagggtaaacttttaaaatttctcgtgaaattgttcatttaatgcagcgttcgtaatttgtggacggcggataagtttaaataatacagtaatttctcgattatatcacggtcccaaaaaatgttggcgtgatattctgaaacgagcgtgacaaaatgaagcgcgataaaactgagcagtgatataatcgagaaactactgtaattcaaatctttacattgaagattgcgattcaatcgatttcagtttatgaaaatgcagagaaaagttactagtgataaatcttctcgacgaagacaacctggttctaatgttagcagatcgatggaattggcaaaactccctacaaggcggggatgcggggtattagtacaatgggtaacgcttcctctcccgaagctagaggtcgtgagttcaatctcccatcatcaaacatagatggaaaaatgcgaaagcattggataaaacattgataacagcaatctttcaacaaaataaagaacatcgaactaccaatgctcaaaacgaggtttttttaggatgcttgaatacttttagaaatagaagccatgtgtacacttttactgtaaatgtataagtggaggaatttcttaaaacaaattccgcagagattgagttatgaatttctctagtcaataaaaacttcaactcaatcgtaaatttgaatagtgttttacatatgctgaatacttttaaacagtgatgtcagaacatgtttattgcactgtgactacacacttaaagtattctaccgtaatccgtgaatttcaccgtaatcttaacaatttagcttcggtaaaataatgtaccataattccgtcgaaattcaacggatgggggtgacattttaccaaaaattgtaaaaattaaccgtactctgttaatttatttcaccaaacttttcagttgttgagattacggtgaaattcatggattcctgtaaaataaattaagtgtgtaccaagaccaagttttggtatggacgccagagtctaaagaacaactcgagcagaagaaaattgttgcagaataccaaacttaggcattccatccaagataattttaaatacttaccacttgaatgaggtacgaaagagccttgcatgagagatgacatactttaaatactatcttatgcactttctatgaatacaacattaatcagttattgtagttcttcaatgatacacagatttttatatagaagtggtatttttcaatagttgttcaattcctcaagcagtcctcagttgttttccagtacctcaataagatatttttaattgttttgagctattttttttcaacactataatgttccaaattgaggaatggttaataccttgactactgtaaaatacctaattgaggcattataccaaaatataatatgcacgagttattcgttcctgctcgggtttactgcaaaattagatatgcaatagtttatcggttttgctgtagtgatatgctataatactcgttcatcaaattaaagtgatagaaacatacttacgttaacacatagtgaattattgttagttattataattaaaaatttactaaaaaaatactactgatttcctaaattactaagagaacttcaatttttgcgtgaaatttataaaatttacgtaatgtgtaagagggattccacggagacatgcaagtcgattctgatcgaccatttcaaaaatatctgaaactttgcacagtttttcagttccatctaaatcgtcattttccgatatcaaatcttcaagttgagtcacgactaacttttcaaaagggtgtatgtgaaaatggttcaaaaatattcaaaaagctgcacagcaaaaacggttcgattgttagacaactaaagaaacaaagctagacaactaaataaagattccaaaaaaaatacacacagtaaaaaaaattttttttttgcattaaaaaacatcatttttgtcacaaaaactcaaatatctcaaaaccctatcggaataccaacgtaattttttgagggaaaacggtccattacattagctatctaccataaaaatttggtgatggtaagccaataaacaaaaaagttatgacatttcaaatatttcacaaatttgacacttagtgaaaaaaaaattttttttttcattgttaattttttttaggaccgcagtttgttgctgaattttttgttaagggtaccacatgaggttaacaagttgttttcatgatattttatttaattattcataactattatagcatctattagaaagttagacgcgatccagtgttgtgatctaaagtcttgatagtgtcatatcttttattgtacgtaactgaagaaaaagtctctcaatagtgttgaaaccttttgataaaagaaacctataagaaatctaatattgaagacaaaagctacaaaaaaagttttctatacaggtatacgactagtttacctgcaaaaagtttacttcgtagagaacaaggcgggtctatacccaggtgatctagtatacgtaaagcaggtcggttttctcggcgctggttttctccacaaagttaaaatctgattacacctgggtatagatccgccttggtagagaatagactttgttaatcatatttgggagaaagcgagtaaccacggataggtgtgacctagaaactattgtaaaacctgtagatgagtttgtgtcattttttttgcttgaaattagaaagtttaattcctcacgactttactaaaacagagcaatcccgctttttaaaaaatacgaaaaatacattacaagatggtgaatttttagtcatttgtgatttttctgaaaactatagctttgtattgcaagatgaagtgcagtcccatcactggaacgtacaacaagctacaattcatccattcgttatttatttcaatggaagtacgcaaattgaacattttagttttattgtaatttccgaagatttaagacacgactcagtatctgtaaatttgttcattgccaaaattattaactttttacgcgttgacaaggataaagaaatcagaaagatatatttcatgtctgatggagcagcatcgcagtacaaaaaccgtaagaatttttcgagcctatgtcaatttaaatcaaagtacggaattgatgcagaatgacatttctttgctacgtcacatggcaaaggtccttgtgatgctattggaggaaccataaagcgcatggccacaagagcaagtttagccaaagaacgtgagcatccaattaaaactgcaaaagaactatttgattgggcgaatcgcagaaaagaagaagatttaacaaaattatcattttgttttactactactgaagagtacgaattaacggcatcagagctcagcgagcaatataataacgcgaaaacgatccatttttatggtagatagctaatataatggaccgttttccctcaaaaaattacattggtattccgatagggttttgagatatttgagtttttgtgtcaaaaattatgtttttaatgcaaaaaaaaaaaaatttttcactgtgtttattttttttggaatctttatttagttgtctaactttgtttctttagttgtctaacaatcgaacgaaccgtttttgctgtgcagctttttgaatatttttgaaccattttcacatacacccttttgaaaagttagtcgtgactcaacttgaagatttgatatcggaaaatgacgatttagatggaactggaaaactgtgcaaagtttcagctcaatagaaaaaaatgaattaaaaaatttaccaaattttggtgctgttgcttggaatcactcgtaaggattataataaacttaaaaaaacaaagctcaatagatttctgatctgattgggattagccaaataaccctcgttcatcgatcaaacttttttagacgtgatactgacttgtgacaatttttgtcgggcttatgataccacagttcaatgtaattcacgattaacctttctatcaacagcatcattttttactacaaaaaatattgaaatcgctgtaatattttgtttatttttttaaatattttaccaccgtttttccacaagttctcaaaaaactcttcaattttaagaatctgcatcgattttgatcatcggaaatatggtttcggatatattctgaaaaaaaaattaagcaattttatgcaactgtttttggattggcaactgggcttcttcttcttggcattaacgttcccactggaacaagagccggctactcagcttagtgttcttatgagcacttccacagttcaagcgtgtgctagaataagggcgtaagtcgcatgatcgatttctcttcgtcgatcctctcttctattaataaaggtgacacttctattaataaaggtgacaagacgcgcgtttgtcagcatttttttttacctcaggacgcaagattgcatcgctgtctagcgttctgaagtgaaaaaaatgctagcaaaccagcatcttgtcacatctattcacagaagagaagatcgatgaagagaaatcgatcatgcgacttacgcccttattctagcacacgcttgagttattaactgagagctttcttagcctaagtttttttttatctttattaacgagatttttagccctgggctagtttatctcgggaccaacggttttacttcccttccgaaggaagacgtgactgaatttttaatgactatctcggagatgggattcgatcccaggtcctcggcgtgagaggcgtgtgttctaaccactacaccaggtccgtccccttttgcctaagttgccattttcgcattcgtatatcgtgaggcaggtacgatgatactctatgcccagagaagtcaaggaaattcccattacgaaaagatcctggaccgaccgggaatcgaacccagacaccttcagtatggctttgctctgtaggcgcggactctaaccactcggctaaggaaggccctggcaactggtgcaatgagtactgctgtcgtacaaatatctcgaaaattacaataaaataattttattattttcagatgttttggagacatctcaaccgatctctatgatttttttttctcaaagaagctttttaataactgacattgtgcagccctggtgacgactaaccaaaatctcatacgagactcacagacggtcttgtgatatctgagttttttttattccactttgtgtttacgtcaattatgcgcaatgcgttcaaaccccttacatggaaatctcagcaaaaaaatattgcgtttgcattataccgaagcttcaatagccttttgagtgaaagcaaacgtagcagacattagaaataactagtcttgtgcctagtagatttatcagcatttctggagaactgctccgctgactgacgttcttaataacagttttgttttagtaggtttagaaccaaatcaattatatgcatatcaggtccatcatggatgtagttacatgatagatatatttaaaaaaaaacatgtatgtaccgcaaaaataagacagtgactagtgggctagagacgaaaccagcagaaaatcattcgattctgttgatatgtttttgaatcgttacataaagtaacccattaattatctctatagatatgcccaaagtaaaataaactgtgtaagtaccgtgcagtatgattagctagaagggagcataacttcaatgctcgaatattgtatggcattgaatgtatactgaatgtgataaaatatatgattttagctaaatcgcaatcataggacagtcttatcgcaataataagtcgaaacaccgcattaatgggacagagcttcagatttatgttaataaatgtatgtttgatttaaaaatttattttatttacctcactatacgacagaaggatggttttaacacttcacattgcaaaatactacaatatttagtttttggacactgaaatacgatgtaaatttcaacaccgtgcataggtcctccataatagcatggaggactatatcatatttaaactttattttcaatatttgggttcaaatttgaaccttgacacttttgatcatgtttgtcgttcaggtagtcgacaaaaatgccacagaagaacaatttttaatactggggttgttcttatctgacattttggaagggacacggaaaataccaaatttgagtttaagctaagggacaaagtgacaaaatctgcgtattcgaacataaaataaagaagatacttgggtagcaagtttgtaaagtaacattgacttgactttgtggagcactgagcactccacaacagtacacgaaaaaaaaaattggttaacactagcaaattttaatcattttcaaactaaagtttgggtttaattttgcacaagcaaaatcttagtttgatgcaatcatacggtggttgaaacaaacaaaaatcttcgttgttttttccacaaattttcatttagatttaaccaaaatttttttgaatcaaataagaaaatggttgtttcgtttgacagttgtgaaaacgaccaacgatttagtttgttttaaatgagaaatattagtttgaagttgccaatctttagtttgttttcaatcgatccattgtttaaaataaacattttattgattgttgttaggtttattgttttgctttattttcgttttcattgatttaaagatttaacataaacacaatataatatttctttattttttccgcaaaactattaggttgcagattcatacagtgtaaggtttatctgctatttttaaaatacaattaatagcagcaccggatttctattatgcttttttttaatatggccgccaaagctctagattaccgaaaaggattttgattttcaccatatatgtaatggagttttcaaatgatgttgatctacaaccgaaacttgaaaatggctatcagatcatggactagatatgtggtgatgtacaatataaatacctttctacattgtgcatgaagttcaagttggtgttctgatcgtttctgtaaagaaaacatggcgttgacacgagcttttaacaattcatttatcatgatgcaaatttgtaaggtaaggttctgaaatcaaaatcttatttgtattaattcctcaaaactacacattgcagatcaatcttacttgatttatactttcatacaatggcaataattaattaaatagatgccatcgaaatacgaagaattaattaaccggactgtcctactcaaataaacaaggttttggtggtggtaaacatcaacccaaattttgcttaaagcaaagtaaacctttgttgaaaacaagttacgtgttagttaaaaagaaacaattttttgaatagaaataacaatgtttttaaggttaatattgactaaatatcaagttagctttaacaaaaaaatcagcttagtttcaacaaaaatacaagttgattcaaccaaattcttagcttaaatttcaaccaaagaaatggttgttttaaacttatgacgtttttctgcgtgtaccaaatagttgtagttttgaagccttttctttgaataattttgaaaacccggaatttgacttgagcataaattttgaaattaaaactgctgcaatgcagtgctgcatagctggaaagtatcagcatatctatatttttagaactgagtattatcagcgaagaattaagtggtttttcatcgttttgtcccgaatatccgtttttaagtatcgaaatcagtttaaaacctataaccgctgtgtatgtatccgaaaacgagccattgagaaaggaatcgcgaacaactgtaagcttgaattgtggtagctgcatcttcccattggtaaagtgttcaaagtatgatcgtcaactatttcgtcggctatatttcgtccttaatcaaagtgcttccagctccttgcgagtaactcccgaatcatcgcttttctctcaagacaaccctaactaattcgccagcgtgatcttttcgagtgtgattgccctcatcgcatgacctggttttctccgtgttcagattatcgttccgaaatcggattctaaatatcttttatttctcaatttccacacaatttccccacttccgaaaacgacgaattacacctcgatcgaatgaaaatcgccaccgttaccaatattgtaggtcgctcgtaaattggccatggttgaagccgatctggagcgcgctgaagagcgcgccgaagccggtgaagggtacgttgtcgcattgcggcgccactgatgattggtgtgacaaataacgtttgtgttcgagtgttttttgctttgtgttcagcgccttgaaaaagccaatcgtattaacaaattaattatgctcaaaatgaggattgtttcaaaaatagtgtgcatccaatggagtctgtttaagaggtacatccaccagaaagtgattgatattctttctgaccctggcgttttatgtagacatattatggtcatatcgagtaattgtttctataactggcattctctggttgggtgtagccggtttgggaaacccgtcaatcatccaccggctgaaaaaaactggaaaattatcctaaaatagaatgatggaatcaaattttggcgtaggtggatgatgacttgctcgagattggcgtttgctccgattggagcacattaagaaatgagaaacgaaagaaatgtttgatttgagtgtgttttgtcttttcttctcttcaggtgaatacagcgcgacgcttataataggcgaagtgggtcggtttattgataatatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcgcgtggacgtcatcagcacttggttactggccagaagctgagcaaatcggagtgagaatttgatgattgattggtgataacatacatcaaaatggaccgttgactggtgattgctgcttttgtttcgagcattggatggattggctttatttgttttgtgattttgtcagaaatttactgggtttaaaaattgatacagccaaaaaaatagaaaggacataaatggaagaaaggacaaaaatggaagaaaggacgttttatctttcttccaaggttgaaatggataatattgataattgcatcgaaatgagcatcatcatatcaaagcatcctctagctcaggctctttgattcaagtgaggaagcaaagagcgccgcctgtcgtggtcagttgttccgaatttgggggatttaggcaggagatcttgaactccattaagggaattaaggtttccttccaaatcgcaaagaaatgagactgtcgcgttttgccggaaactcttcaagatctcgaacttcttctcaaacatcttgaagagaagaagcacaattggtttacttatgacgacaaaactgaacgtttgttcaaagtcgtcttgaaaggtgtcacttgagagataagtcacctgagaggatcaaaaatggaataagtgatttacttggattttacccagtccaagtaatcattatgaaaaagagaacccaatctgacattgttcagaaagggccttctaaagaatattatttagttcactttaacaaaaaagatctaaataatattaaagctttagaaaaagctaagcttatgttcgatgtccgtgtgacatgggaacatttccagaaacttggaggaaattacccgaaccccacgcagtgccgtcagtgtcaaaagtggggtcatggtacaaaaaaatgtcgcatggatgctaaatgcatgatttgtggaagttctactcatgccaaggacgtctgtccagtgaaagaagataccaccaagtttatatgctcgaattgcgggggcaatcataagtccaatttttaggcttgcccttcgcgaaggagagtcgtcgaggctcgtcgaaggtagatgaaagataatattcgttacgataacggtcgtttccggaatttgcctggtagagtttccaacaatgctcaattttcagttaacgatcatttgattaagaatcatacccatcaggaagatcataatcatgctcatacacaaactaattttaatccgtcgggtagccgttaaaatcttttaatttcgagtgtatctacccaagtaaaatcctttgccgatatcgtagcaggtaatttgaaccctttcccttttcatactacgagtacccattctacttgtttcaaatcaaatgaaaaaaaaaaccctgccgccacaggaaacttctactccgcgtcatcgtctaccgaaaattctaacggaaaatcatcagataatgtacccacttcaagtgatatgtctgctctgaaattaattttctaactgaacaattgaatctaatgattgatgcaatgtccaaaggcaccactatgactgaagcagtccaagttggtgtaaaatttactaatcaaactgttattggattacgtttgtctaatggatctaataaataataatttaaatatttaaaattggaatgctcgttccttgaatggtaaagaggacgagctgttgaatttttttacagctaataacgtacatatagcaattattactgaaacatatttaaaacctggatccaaaaaagatcccaacgtttttgtttatcgtaatgatcaagttgacggagcatgtggggaagttgcaatcatcattaggcgtataaaacatcaactgttttcgtcatttgaaactaaagtttttgaaactttgggtgtttctgttggaacacagcttggtaaataaactttcatagctgcctatttgcctttttaatgccctgggcagtaagttaatttgttccaaactgacttgcgaaaatagactcgcaattagtcaattttttttgtcattggtgactttaatgccaaacatcggtcatggaataattctcaaagtaattccaacggcagaattttatttgatgagtgtttttcaggatatttctcagttcaataccctgatagccccacttatttttcaattctagaaacccttctacgactaatttggtcttacccgactctagtagactctttgtagccaactggtttctcatactgattttgattctgatcatgtccctgttacatttcatctatcccatgaagcgattctcaatcctatcagctccactttcaattattttcgagccgactggaatacatatgaaacatatatagatagtaattttgatgttaacattcctctgcaaacaaaacttgatattgacaatgctcttgaaacattgacaaattccattgttgaagccaaggactttgcaattccaaaatgtgaagttaaatttgaaaatttgacgagaagacaacttcaacgcactcgcgatccagctatggaaattatatggcaggatctgcaaaaataaattaaaaaacgattttcacaataaggaaacaattttaaaaataaaatttctcaattgaaccctggctataagcccttttggaaattatctaaaattttgaagaaaccacagaaagccaatttcggttttaaaaaaggaaaacaaattattactaatcaattgccgaaaagctcaaaagcatgcttggcagtgagtactgttattgaaacattcaaaaatatgaaacctctggcgatgatggaaatttcacatcctcatcaaaaaacttccagaaagtagcttatcattcttagttgatatatttaacaaatgttttcagtttacatattttcctgacaaatggaaaaatgacaaagttgtaccaattttaaaaccagacaaaattcctgccgaagtgcaaattccgaagaaatgttctcaaagttcgtcacgtttgacgaccttttttgaaatgtcgccctaattccttcaaattttctgtagcgtccacgctttgtataaattttctccaaaatcaataccaccgcccgcctaatcgcctgagcactgtattcgcctgaaagaaagagttgtttacaggttcttccatccctgcagtagccatccatcagtaccagagcccgccagcggaattcttcgacgtacattcaacgattcctcgatggattataatgatatttgttctaatattgttgttatataatttctaatacaaatgccaaacctaccagctagctagaagagattttgcattaacccttagtctttaagatgcaagcggagcttcgttttgaattcgcgcccaaaataccccaaaacttggcactttttcaaagcgaatctcgtcccaaagtgtgaattatttgctaacctcgattttgtttttatctccctggtttgaaccattcggctgtgcctcgccttccgaatggtttgaatcgggatttttcatgcttctactccgatcgatgttgtgaaccgctgcaaaaccaactaaccaacaacgataacttaaaaactactgcgatacacccacaactacacactccaccaacgaacaatacaacaacgctccaacacttttaccgctaaccctcgacgtgaaacccgcgtttgtgtgcgtgtgtgattgcttctgcgctccatctaatgaccgaccgcctggatgccctgctggatgacctggaccaacaggtggcccggaagctagtactcatggaacaggacctggaacgttccgaagagaaggtcgaaatgaacgaaaggtttgtccagctccgtatgcttcttgtcctaacgattttgaactaatgatgttacctaagatgatcctttgtggttgaggtaatcgatggcgaaaaatggttgagccgacttgtggataaggtcgaaacgtccatcggtttcctcaaagcaattcttgagtattacattgaaatctaattctgatttttatcttctttcatcccataattgaaaaccaacagcaagatcgtcgagcttgaggaggagctgcgcgttgtcggtaacaacctgaagtcgctggaagtctcagaagaaaaggtatggtctttcttgtaccgcttaatgtacgaaatgtgcaaaaactaccgatccaaatctgtaagcgaattgacgagtgttctctgttgcccaagctttgggcgattattgagctgctcattcccttacaggtttgagtctttccagattacccattcgctgtaacgaaactacgaactctgactcccaactcagtacatacactcaactacagacacaatcttcagttttgacctcaattctaacaaaaatgacactttatgattgatacaatttcttcttgatttaatttcgaccaccacttttgttcttcaaaaaaccgtaaatcgaccttgccccgcaattaggctaaccaacgtgaagaggagtacaagaaccagatcaagaccctcactacccgtctaaaggaggtacacactcagagaaatgctcataacgattcgcagtgtgtcagttttctttagtgtgtcgcttttcaaaccaagatctaaacgtgtgtgcctcgatcgcgaataaccctcggagattcagacccgaacttctccacagatcgtccaatttccgggactcattcccgtcccttttaaagctaatcgaatgaactttgcgctgatgattgtcgttttctttttcttctcacgaccatattaaaccctgactcgaatgggcggaaacacgatcgctaaccgtggatcctccattcgctgctcgatgtgttgttgttgtggtttgccgttgactcgatcctaacgtgacttacattgctgtgtactaacaacaacgacgccatctaccgaatcgcaacaaatatcgaacgaaatcgatatcccgcattggttcggtggaccccttcacttttcggctgcaggcgacgcaaagagaggaaacgttcggcggccaagtgagaatactggatcaacgtctgaaggaggtattgtcttacgcgcgtctcgatcacgatattgcacgcaaaacttagaggttatagaaccagtcagcgaacgattagattacattctacatgtgttacctctgaatctgtctggaatttggatcctgtctgtctccgtaactgtcctgtgctgtcacactgttcaccactgccttcttacagttgtcttctatcagaaaaccgtattgtagtcttgggtggcctggttcctgtttctgtgtattccatctgtaattgttcgtttttcattttttcctctctgtgtagtaattagtagaagtagacatttcatttcaaaataattttctattttaaataacattatttcaatagggtcctaaagccctgtcccaattttagtactaaacgctcaagtttaggccagaaacacgtagggtgatcaaagtattttggacagaccgttgcatatatcatttggccatttacggcaaattcaaatggaagtggccaaattatatacgcgtaacgctctgtccaaaatacataaaacaccctatttactaaatttcaaaatgttttccgttggtccaataattttgttccgattattgagatttcgtcgaactttttggtttaaactcaagttttgtgtgtattttgttttacgtgtccctcctgaaatgtcagataagaacaaccccagtgttaaaaagataaacccctgtggcgtttttgtcgactaagtgaacgtcaaacatgaccaaaagtgtcaaagtttaaatttggacgcagtttttaattaaaatttaaatatgatatagccgttatttgagaggtaacatttgccaaagtagtagcaagaacacactctattgtattatttaataaaacatggattttgtaaaaaagattggttccttttgctataaacttatacttttgatgatggcatagcaaaattctattaatttaaactaaattccaataaatttggcacaattcctcttcttcttcttggcattacgtcctcactgggacagtccttgcttctgcgcttagtgttcaaagagcacttctgcagttattagctaagagctttctttgccaaagttaccatttccgcattcgtatatcgtgtggaaagtacgatgatactctatgcccagggaagtcaaggaaattttcattgcgaaaagatcctgcactgaacatgaatcgatcccagataccttcagcacggctttgctttgtaaccgcggacttgcatagttgtaaattctaaaaaaaaaatcaggagcattctttccctgatgaaatcgtcagaatttctagcattgcgggagatttttatgacggaacagagaatttctgcaatgttgcttggaaatttcgtgtgggcatttccggagaagttccaaatatgcttttaagaaaacttaactgtaagactttctaacgacagtagtttctagaaaaaactcgaggagtttctccataaaaaacctatagtaatttatctgaggttccaccaaatatttctttatggacttcatcagaagtccatcatagtttatatttttacacctttcaagtgtagagaacttgaatcatataacaattgattatcccatgaagaaattggagtggttatcttggaaaatcgctatcaaaaggcgagttttcggaatttgggttatgttcggaatttggacgctggattttctcataacaacatcccaagtctcctgtcaattgacgccgtaacaacgatcagttgttctgagatgtctcttaaaatggtttattgaactgaacctattggggatttccctctccaaaagactcacacttaaataatttgttacagcaaaatattgtcacattatgtttgccatatattggagggcatctcagctatctaaactaacatgtaacgcactagtaacgcacactgttggattgtgcattgaatgcaaggtgcgtacttcggctaaactgcaaaaatcctctttctagtaagttgattagaatttcattatattttttattttattttccaggatgcctccattaggattaggagttttatttcataattctgtcaaaagagctactattaaactacatattcatccggaattgacaaacagtttttcagatttctaaatttctttaaaaatagttctaaaaagttttttttaagaatcttaaaaaaatacttctgtagttgcttctgaaatttttaaaacaaaaatcccttgagaaatggtttaaatctacaaaattttctgttcgattttctgtgcatatgtaacatacaatcttcgacaaaacttgtgaaaatatatccggcaatctgggaaaaattacgaacgagatttttaacaaaatgtgtaatcgatctcctgaaacaactgtatatggaatttcggcgagatctctgagttgtactgtaggcctttaatgaagttcatgaagagctttcttatggaatttgttggaagaatacggaggagctgggatcgactctcacccccgcgcttcgtttctgtaccagtgtaccacgcctagcccggtacatgtgcacctaggttcaaacttaggctcaaataatggcacatagcagaagacagagaacggttgaaatccacgcggataaattactacgatcatatatggaacttcctggcataaatcgcaagacccttaaggattgaataaatgttttatttaagcagatcaattaagatcagtattttaaggaacatttactggtaactttatgaaaaaaaaacaaggattgtgctatatcatacaacaagacacgataagtagaaattgataagcgtggatataaattgttttctggctgtccgttttgtgtaatcgttctgaattgaacctcggattcaaccgaagatttgcaccaacatttgaaccgccggtgcaatcgatgtaggtataaatggagcgtatccttgaggaattattcagctgattcgtttccaattttgtatattatttgtaatgaaatccttgactaactaatggagtgtgattcaatctatagaacacctattacgaatatttccttgcaagaaatcccaaaaactccactgatttctaaactacaaaaaattctcgaagcttattaatagcaacaaaagtatttaaagcaaggaggtccattcaatacttagggttttcgtatatttttcaacaccagtattagccagtctttgaaaagttactaattcggagttttgaaaccctcttcacaacttgtatcaaattaagcctcggctgtacgtcaagtattaaaagtccaagtacaaactatcttcaaaataaggtttttaatccagagactatcagtagaaaataaaaagcaaaatacaacaaatcctcaaaataccagaacaaaatcccttctagctcttcgtcgtgttctcaaaatcttttgttcttggcaagaccataaatagattcttattgagattttcgatgaatgcttggaaaacattttgagttaattttgaaaaagtgcttgttacaaatttgaattttcgtaagaagagcttgcggaataagatgtcggaagacgaaaggtctaaagaataaaaggtcgacaatatcgtaactgctgtgtaacacacgttaacgttgcacgttaacattatacatgtctgctgataattgaatgatggattcttgagccttaaatagactggaatttgttcgctttatgacttgttctctgcaagacgtgtgattcactcatttacatttgtgagcgaaaaactcgaagatccatgaaccagaatcaatacaaattaattagttcaacttattaccaattaccaaaataggctttcgacatgccattatagatacttctgtcgctaatccacctgtttgtcgtatatattgattagtagccctccaggcgatgaaatctaagtacagtgaataaatggcgggcacacgttttcgatcgatatctgccactcgctcacaagtctttgatctttctgccatcgaatatagttgctggatcaaacttacttgaactttacgatacctttacgctgctgtgcgagcgacgtattccacaattcgagatttgttatcacttcgttcacgttcaagtgagcaagcactgataaaaatatatgtcttaatatcttatctttttttgctggtttgcgtacgcacgctcgtttcataccaaacgttgatggctgtcttcttctggcgctgagccaggtataaaatgctatttattgtgcaatacgaagcgaagcggcgatttcatttatctgcaagatttgatttgatactcgatccgtttgtagtaggcgacaatttttttttcgattgaagtgaagaaatcgtttttttcaattcctcatcgtaataggctgtttttttatatcgtcagtgtggtatgaatcccatttgcgatatcgacccagtaaacacaaaatcgtatacgatagtgcataagagtacaaaaatggaggcgtacatgtgccataaggctgcatgcaaaatgtacgtataacgccttcacttttgtactcttataaactatcataaacgatcgtgtgtttactgtggagttaccgatcgagttaaagtggtcttccgcgaaattactaaaaaaattgtatggaaatcattgtagaactaaatttttacagcactcgtcgcaattagaaaactcggcaagcaccgttgaacaacttatttgtttcaagatgatctcaacaggacacgttcacagcgagctgccttcggcaaaaaataccttactttctttagaacactttgagaaagtcattccttccatatttgtctacttctacatttttacatcacattccgtgtaaatacattgggttgtaagtttctcgccatgcatcatccggttgtgggatctcttctttttccagtatggtaatgtaaatagtaagcacgctcggtgatagaatgttgccaggactatcaacttttgacttacgaacgaccgttatgacccccagaaaaccctgttgcaatttgtgcgatatggaagcgaatgtgtactaccttcatcctctatattactcatttactaaaagagtttaacaaatcgcatttttccctccgtgtgtgcaaataccgatcactcgggagtaggccatggcatcacgtgattcagtcgaagataaaatccatcaattgaacgataaattgaccaatgtaagtttctctttttcttcgctagatgccacctttcgcactatttgccgtcgtcgagttcgatgacgacagggtgatgagtggcgttcagaactataatttccattattgtcaccttttgatcacaaaagctgacgtaaacgccgttgacagtttagacactgtcattcaataacgcagcacatgaaataatttctcaaaaatgttggtatttacgtcatctttgtaatcacgagtggattctgcttggttaagaattcgggctagtaaaagtaaagccccaagcacaatgtgagcggcagcgcggtacaacggcaaaacggcaagcccatcttgagctacactctacttgtcaagtcaatgttgaaaaggatttagtcaacactggattgataagtaaagtgtagatcaagatgggcatgccgttttgccgttgtgccgcgttgccgttcacattgtgcttggggcctaactcacttgtggtaaaaattagagaaaataagcgatttggataaaaataagctttagaatggctagttccagataaagggttcggttaaatgacaaattacacggtcacggcaataaatgctatgtcggttgatacacagatatttagatatttttaaaatatgttttttggcttaaagtcacggttcttataaataaatcgtccaattcagattttgaatgcagtgtagcacttttctacaaacactagggaaattttttagtttaatctactgttgtggtggaggtaagcaattggtgttggttttacgtttcgtttatgtcagttcctaacccacaaaattgaactattagctaaaagagaatttgcatgctagttttaagagaaagtttgctgcttataaatggtttagtgcttcacaatgtgaacaattctttcgatggaaaaaatcattcgaaaggatcgtccaccccaaactgtttttattgtaaatcacaaatctaatatatttatttcttttcgtgacatcccatactcgaatcgtatccgatcttgcaacccggaaggctgaagctcgtgctgaattcgctgaacgttccgttcagaagttgcagaaggaagtcgacagactcgagggtaagtttttcgatcgacattcaatggtctccatagttgaagctaacccgattagtcaccgaattttccaaagtttatatttgcgctaaccatatttcaagcgaagaaaaacacatgagtctgattaaaaaataaaattgctgtgatttaaaagagcttttagttgaaccttgtgtgaaactataaaatttaggtcaaatgttaacctttattttgatatgatttcataaccttattttatccataacatttttcttttattttcatgtttgatttttcgttaacccttaaaacccaatacaacctgaattcaaatgccgtttttcgatgttgtgtgccataacaaccgctgcgctgctataaatttctgcgtgcgtgcccctttgtgtgaattgtatcgctaaacaaaaaacaacgcaaactcgtcaacacaaatccaatctacactaataaagacgaactaatgcacgagcgtgccaagaacaaaatgctccaggaagagatggaagcaaccctgcacgacattcagaacatgtaacggtggtaactgatgtcaaccgtgttactattacgcctactacgactacaaacaaactaccaacagcaaacaacacatcaacccaatcgaagatggcggaaaagatgctgaaaactaaacaaaaatgttatgggcccactagtcctcgggtgccgtgaaacaattcttccgcagacagctcagttgttctacgttgcgcatcgctgctgttactcatcgcgttttattcgcagctgtcacatctactttttgtcttgctggaaaaggagacacacttaacatactactacacccacaagtataacgttaaggaaggatctgtcacaaaacaatacacacacacacaaaaacatttaccaacgcacatacaaacaaaacattctcacgcggacacagcaaaagtcagagatatgccactggagcgagtgccatctaccggacgtaaaaccggtagcgtgcgacttgccttcgattaggtctattgtacatttacatgccaagtggacgaacattccgcgcatacattcacattcgagtttttttttcgaggccaatcaaaaaagacatttttctcttgttaagtagcaagtaggctgaacagcttaaagtttagtaggattatgaataaaaaaaactgttactgccccataactttaacattagcaattgcgcctttcaatctttctcgcgattcattattgtttatccttcaagatgcctattttcccttatttttttaatttgtcttccggttgttttgtagaattaaaaagaagtcgcgcatttaatgtcaaccaaatgcatttatttgctatatatcattttgaaacgcgaaaaacgaccactccaagtttagcgtgtatgtgtcaccgcagaattaaagcgatttttgaaatgttttcaatgataataaattgcacaaaaatacattgcaaactaccccattaagattgcacccgtagagtatttaagtagttcgaagatgccgtggaatcgatgatacgtatttgtaaaagttaaatctggaattaaagttggaataacggttcggttaggaaacgtacatcctctctcgtctccctgcgttcgtttcgttaggattttacactcgagtcctcttcttaattttagcctatttttcgtttcattctgcaataagttatcactattttttagaaccgaaaggaacagattaaatgcagagtaatttatgaaagagcagttctttttataaatagttttaaggaacaacatgagatatttctgataatgaggaaaaactttgaaatcggcggaaaatcgatcggaagatccggattggaactctgtttagttaacattttgatgtgccttcaatccgtcagttctggcaagcgattgctttttccgattgatttttcgagccgaacagaagagaagaacgtggcaaagccatttcagcgagtatttttgtcttctcttgcgtcgtatacatatactaagcgcagttaaatggtaaggaccgtgtacattatattccgtcaagtccattccatagcgattacacaaaaacacagacaggaaaaagaccagaaagagatcgaaaaatgtacacgtcaacttcacgatcaatactgttagcatttagggaacaaaagcattcatttcaacattttgccaataaaccaacaaacccaacaacaacaaaacaacagcaactataaaatgatatcatatttgagtgtttataataatatattattttatttaaagccgagtttgcctgtgttttattctctgtaaatgcgtttccaccggtttgaaaactatgtgttctgtcctataagttctatctcttatatttatcgcttctgttgtgcttctttcttctcttaatttgcgtaacacattcgttgaaatccaatcctaaacctaaaccaccaaaatgcgcatcaaattaaccgacaacaccgacgccctgggctccgcgcacacagacgaactgattatcgaaaagattcgcttcgccgagatcggagacgatctggactttgccttcgtcgatctcattccgggtgtcgatcccatctggaccgagcgtcgtccgaagccgaagactccaccaccaccaccaaagctgccaaccccaccaccagcaccgaaggaggctccgaaagaggatgctccggccggcgaagcacctgccgaaggagctgcagcggcagccccagaagaggccaagcctcgcactccgagcccgttcgagctgcagaagcacttcccaccggagggagccgaagtgccatacgtccgctcggctactggaacgactccgccacgagacattgccgccgaaacggccgctgaagcagaagcacaagcggctgcaccagcggaaggaggcgatgcagcaccaccagcagagggcgctccggctcccgctgaaggtgaagctgctgctgctcctgccgagggtgaagctgcgccggcggaagctgcccctgccgatgccgccccagctgaagccgaagcagctcctgcggaagctgccccagcggaagccgccccagcagaggaagcgcccgcgtcctaagccataccatcaaaaagtcgcttactccttctttcctgtatctctttttttatggtttccgtttaactttcatttaacgcgtggatggcacgctggcttgaacatctaaacaatctctaaacaaaagtaaacaagatgtgatggttctcaattttgtctcacttgttagaccagcttcaaaaacgttaactgttaactagattctatctcacatttacttttattttccactgaataaactcaataattgcttgatttattttgtaatgtgcttgagttcgttatttttttttctttacgacgcgcttgattcattaaactattatggttagagagacgaacagaaaagaaatgcgtcccgcaccaacactgtcaagatcgattggtaagaggaaaggtgttacttgcttcaacaattcccacaaatagtgtcgtagtaagaattgagttgttcccatggcgtaaaagattccataaataaaatgataagactcccatttatagacatccgcaagtattcaatttccggttttctgcttgacgcaataattagaaaaaaatgtcaggtttaaattacagaactgaaaaggctatcatcacgaacaactggagcggagccaaaaatttgatactggcaaaagtgcggattagacagatcgtcaaaaaaaaaaagattaagcacgaaacacactcgtttacgaatgcgactttaatttttcgcttacctttctggtgttaagtgctattatttttttcattattctgtaatttcaaaataattaagccacattttagtaggcacaatgatcaacaattattcatagtattgatttttttctcatgcgtcatttgtagataccgtgcggggatgataaattagtttactgaccactagcgccacgcagctggtgcgtggcttcaaggactagcgcttcttcaggagattgggttaaacatttgatgaatccatttggtcatctttgtagacagccagtgactccgtgaaaagtaggcaccttcactatcacccaggctttccaaatgtacagcctcgacacgacagcagccgaaaacaccctgccgacattcgctgtgtgttttcactgcctcttgctgctgtacgtttcgcaacaaacattgaacgtaatggcaaccagacacacacgcatgaatgttggctgtattggaacagtcgctaccaaacgaactcagctgacagcattcgtgatcatgtcgtagtgagccgaacgggctgtttcacattacaaccaccgaagggctgtgacagtcttcggctactcaagccagctgtcgcgagaatgctgtcgtgggctgtcatgaaacttgagattcacgctaaacattttacacataagaatacaatgttgtacaaaaaggaggatatgaacgtattttcagtaatatgatttgaaaatcattgataatatgataatgttcaaaactatgttcgtcttgtaggtgcatagtctagtggttgcagagcaaacattttaaagatttaaaaaatacgtgtgaaaatgcttaagcgtgaagtatcacattgcgcaaaatacagaacacgagaggccccgactgcatattcattttgccagtacgacgctcgggtgtacaagacatgttatgaatgaacaaccgagcttgtcatcggcaaacgaacacactacaggcagtgtgaccaaactgccgtgtgctgtacaagacggcttcgttacatgtcgcacgaccacctcatggtaggctgtcatggatagttcattcgaaaggctgtcatggaaagcagttgatgacagccgtcgaaatactgtcgtgaggcggtacatttgggaagcctgcaccaaagtaagatgtcttttgatcgaatgctctcttgatatcatatacagtcagtgacaaaagttagtaatcaaatgctgtttttccatagaaaatgcccaggtttggggatctgcttgtcagcttctagtaattcgaattggttgaaatttggatgatatacttagcaacactgttaagtgcccattgaattcctattctgtagttatgatactgcgagctggcgccagagactcgtagccacacaaaaagatttttggttcatccgcagatgctaagaccgtaaatccgagaaagttggcatagaaaaaacattctgaaactacttcatcagaaggaatgttggtagactcgtactcaaatctcaatcattgagttctcacgcgagagaaagctcatttgagatcaacttcgcaaagctcacgcatatctcactcacgcatcatctcatgatgcaaaatcgcttatgtcgccaaaaatgattcaatcataaaactcatcggaaatctgtcgagacccaatgtcgttgtttacattaaacaagtttcttatatttctagcagagaaacaaagagaaacaaagaaaaaaatggtatttcacgtaaccccattttacatgaatacataagcgtagtcagcaactgacaagaaaagtgctcatgaaacaaattctacttttgagccaagtaatttttaaaaactgattttctttgagctaaatgtcacttttacttgcggaataaagggtggtacgctgttcataagtaatttggcacttccatgattcactttggcacgtggggtttttctcgactgaattgtctgaaatttagcaaaaagaagcattttgatacgacgcataatgtggtcaaacatgagctcagtagcttaaaaaaaaacctactgctgaagtgaatcaaaagtgccaagactgtgatccgcctccctactgtgcaaagaatagaaatattagtagtggaacgctagtggcgttgttgtcacaaaactgattttaattactattaccttaaattatgggttttcattgtttgttcaataccatgacgttgttttggttttaaaatctgatactttgaggccccccctcacgctgttagttcgtggcaaactagatgttggtaacacgaacagcagcgacattagcattcttaggttaatgtttctactgtgcaaaataataagaaacagttatggaatggttctgctaacgaaattacttgagctgtatgctgctcgtaagtagagctggagtcggtaacgcctgcattgtaaattaaataaagctctcacttttccgaacggaaaaatgttccgttcaagtatttcgtaagtaaaagtaacatttcgcatctacagcattagttgtcaaaattattttggtaattagaggaaacttcactggagtgctttactttcgatgtccgtacttcgcttttttgaacttttttccgcactgaaaagtgacagctccttttgacttacacggcaggcgttactgacgttacgaaattatctctacttatcagctacggactgctcaaggaatttcggtaggggaatcaatccttggtcgtttcttgtcctatatttctgcacagtacttttcagctgcggactccgctataggattctcagttgcaccgtatagatttgccgtcgtaatggagaataaatttatttgttaacgatgtcttcctcgttatcttcacagcaaatcctgttacacaagtttagaagctccagagataccttcagagactcttacgcgattattctcaagaattttatttgctgattcctcgaggcaaagcttacggaattctttaagtgaattcttcagagatttttctggaaatactttcaggaacttctacatgcaccttaccaggaattcccttgagatttccgaaaaactcttctagaaatttgaccaatgattccagaattccagaaaagaaatctaaagcaactacctttcgtaatttccacaggaattatcctgaaaattttcccagttactattacaggattttcttcagagatctgccatcaattcttctaccgctttcttaagtaatttttttagcagatcttttaacgcttttcacagttctcacaataaaattatcaagaagtcattttcgtgtttttgaaaagtacgttaggagattttttttccagaaaaccttactagaattcttcaagaaattcctacgacgattttttcagttcttttttttagtcattatcatatggattcctacacgaattcatcaacggtttatttcaggaattactccaaaattcctccagggattatttgagaaaatctagtaggagctcttttaagaactcatcaatttttcacattaagggttttatcctggaatgtctccaaaattgtgctcataaactgctcttgcagttcttgcaaacatttttcgagtaaatgttcaaatataaaatctccattggtagccaccagcaaatatgacaacattttttcagataattcctttacaaatttcttacgagatgataagcacatgatggtttttccgcattttttttccagaaggaactatagaatataattaaggtgaagatgcaactaagccaaatatcgagtttcaagagcacgaatgtggaaaaccatgcatgctctgaaattttatcgattgctcacgcgctaatgataatttactgatcaaattttcatcgcagagcgtggcttgtttctccagatttgtgattttgaaaatttatattgtggcttctattaatcttcaccttcagggattcgattggttctttcatttaataaataccttagcaatttatctaaaaaatgcaccatgatttccttgagtttttgagtttcttttagagatcctttcaagatttcttcagggatttcagcaaaagattcataagagattaaaataggagttgttttagaaatgcccataggattaatgaaagaatttttttaacaatttctaaaacaagtccttaaaaatttgcaagcattcttcatttatctctttgaatgtttttttgggaaacttctcaatgattttcttttagagtagtgcttacctggttaaaatcttaataatatcctgtacagaggaatcactcaaactactggggaaattactagcagaattcttgaagatgtactgagcggaaatcttggtcaaaatattaaagaaatttatacaaaaatcacttcatgaactcctggaagactttgtatttgcttgaaaaatttgcgaaagaaaatttggaagaatttctaataaaaaatgaatggagtcaaactttaaaaatacaggttgaattattaaaggtatcttaaacgaagtaaactttgggcaaatacctaatactacattcagactaaagctgatattaagtaatacgagctatcttgatatcaaacgtcatacctcttatttccagggaaagatagatgtatggtttctgatatcaagaaagcttatattacgttatatcagctgtagtctgaacgtagtatgaattagttttcaaaacaattcctgcaaaaaacatgcatattacttgtcgtaatgtgacgagcaggcattgcagaattcgttctcatattatttggaatcacaattaaagcaaaacgaagaaacacattccatctatagcagtttgtgatcggcaatgcatcgtaagttgtaacaagtttgacaaataattgcagcgaacgagagccccaaagaaagagagagcgaagattaaaacctttttcactcttgtttacctttgggttaggtgttctatatgactggcacgataaacaatccccgaacattcgatagcaatagtgtcctccaggtttggtgcttatttaaatggggtttgtccccccaatcttataagagctgtagcagtatacgatgaaaacgctaccatgatgtgctgcaaactatgattgttacagagattctcccaatttaataagcattaaatccttggtcacgagtgataaatacttgtcgcaatcaataataaatatctggtcagatttcctaaaacaaacttgtaatacattcattttctggttaccgtatggtctctattaaattcttgtttggtctcttttgggctccaaatcggtttcttttttctctaaagttcccatttttatgacactcagtcgccaccagccctggatatctatataaataaaaatgaagtggtgtttgtatgtcacgaaatggcttgagaacgggctatcggattttgaaaattcttccataattatgttcacaaagagttccgacgtgtttgtgtacataaaaagtacagtaaatgtcgagaaatacggaggtgaacggaactgccattttgtacgggacgtttcatggcgtttttcaacagcctacttgatggcaagacgaagtttgccgggcccactagtttcacataaaactgtttgtttttgcttaacacatgttttgtgaaacgtctaactgcagtttgaacgtttggcaacatacctagaattttaccaggtattactctttttgttcaattgttagaagcagattcaagaaaagttaacatttaaccgataggagtgggtaagggagttcattatcttatgtcattagttatgtggtgatatctagtctagtcttatgtttatggtcataaatctcgaaaatatatctgatgttctgctaaatatgttaaatgtcctaattaagtaagaagcaactttcctcttccgatgtattgatcactatcactaaataccaaagaagtaggtataccgcgatcctacaccacgtggtaggatacataaacccctccaatattacgtaccccctggtacgaatccaactaaagggaccaaacaacaaccctgcgaatcttttttggaatggcttcaaactttattaccgttcacttccaagctagagttgtgcttacctaacctcaccgccgccactaggtaacgttacaaatttattttaatttatcatatttatttccaaccgttaatttttcggatctgttcattaattattattctgttctgtatttcttattttttcaatccttgttatccccaatcccatcctaaaccttactcgaaaccacgcccacttaacaaccaaacagacgaactcgtcatggagaaggagaagtacagggaaatcggagacgacctggacaccgccttcgtcgaactcatcctcaaggaatagaggccgcccgcgatgggcactcgacgtgcggtggccctggaggcccttcgtggcttccagaacggttcaccattcccatcaacaccacctacaacacctgcaaatccgcgacaaccatcatcgtaatcatacaccaacggaaacacgatcgaaaaacgccatccgatcgatcgaactgcttttgacaatgaacttgcaaaatggctgcaacaacatcatctatttagcgcagcgctgcgatgtggcaaccgttcgaaactacaccattgcttaccggcagtggacgaaccagtcgaatgcttccgcaggggaccaccatctgtaccaatccatcaccatccggaaggagaaatccgcgagaaaggcgcgcattcggctgttgctgggcggtttccccatctaaaccgtttcaatttctgttgcactcgtatatcgagagatgtgtttctttagttttgttctttcgaatattggatttatttttgtttaacttataattttggaagatcaaattgttgctgttgtaaaattgaagaagaaaagaacacgagtaataaagaatatgaaagatgttaaatcggatgcaacactactgggagcaaagaatggttccacactgtgacgctgcggatttgtcactatcttcttatatttcgatgtattatgatatttatttattagaaaagatttaaaataataataaaacaaagtaaaaacgcaatgctaaacgctttaagacggatttgttatcgtattgtttcttttaatttcatgtttcgaaaatcctttcgtagataacgccttccaatatgttttttttttttgttatgagttctagtcttgttatgtttcatttggttttaattgatcactttatttttcgactacaatgtagaggagtttattgtcctctaaactgatgcatttttaagctctatggtttgattcattcgatactctcatccattgttttttcaaacccagttaaggtaaaacagtttagaatctaacttctaagattgccctaaaacatcaaaggcactaaccttacaaaggaagcatccaacaacagtgcactttttattttggctttgtgcactaaaagagagcttaaaataagaagatccggaacgttcgcctactatttctccagtttagtgcctttgaaaacgcgagtagggtcacaagtcggtcattgtgacggccatctttggatggaaaaagtacaagcattttcaaaaactcagacatggtcgtagggaatcattggaagaatattggtcacctatacgttatgtctagtgacttaattgtgaaccaggtttattataaaatgggaaaatttcaagttacagaaggccggcccaaaggcacattccacgccaattggaagttttgtgccatgaattatttgaaatattactagatggttaagaaaatgatccttctaaatcagctcagagctgctttttcaaaatgatgctgtttaaaacctaaatttgccagttcagaagaaacatcttcttcttggcatttactcttctgctaagtgttcttatgagcacttctacagttattaactgagagctttctttgccaaagttgccattttcgcattcgtatatcgtttggcaagaatgatgtcaccctatttccagggaagtcaaggaaattttcattacgaaaagatcctggaacgaccgggaatcgaacccagacaccttcagcatggctttgctttgtagccgcggactctaaccactcggctaatgaacatccccaagaagaaacataaatttgttcaattagatgccggttcctcattacggtcccataatgaaccgaaaaaatacccaaagccaaacctgattcgattgtctaatttagttgcctcgtgacgtcctataaaaacaagttgagttggtgttgaatttatactaataagttgagtaaaagttgattgaaaaggaagttgagatcattttcacccgacttgacccagtgtcctatcgttataactccacaccggtggatatttccaagaaaatgaatagataatttttcgttcgatctaaaacgaaggcaatccttcaagaattgccgaaatggccgcaatttgcacgtttgttccatttgctgaacgggtataggttaattatcgaatacccttagatattttaagaagcttttatgatggtcctaaacttctccatctcaataagcccccaaaatgcgtggatcgctttgttgcactcttttgcttaaatgtagttggactcaatagatcagggctgcccaacgtacggcccgcgggccacatccggcccgcgacgtcgttttgtgcggcccgcgaagagcttgaagattattctcatatatggcccgttgactgttgactgttgtgcctatttgaagttagatttaatttcaaattttaagaatactggagagcttggtagcacatttttggaagtgaataagcgttaaaattaaactacacaaaaatcttgcttacgagaaccttaatgagaaataacatttttctaaaattaagcattatttttattaagattttgcgcttgtttaatattaagattgcacttgttaattttacaagactttcgttaatttttgaaaaagactgttgaagttcagttcacacctaaataaaataagatggttaaagcttacactagttgaacagtataccactgcaaagttttgatttttaaaataatctgtacattaattttacggaaaacttgggcaaaattttcacaaaaccattagcagggtttctaagaatcattacagtcaaatttccacaaaactctgggcagagtctcacattttcctgggtggatttctattagaattctggattcatataaaatcatggacagatatatttcacacattccagtacagtatattatagtgaagtttctgatggtatcctagtaacatttttattacagaatcttgcgttggagtgtcgcaaaatgtcacgcaggactctcacataatcttaggttaaattttcaaataatgttgggtgtgattgtgattgtgagtaggtttcttataacatctttcacatgattctcaaaaaataatagcaggatttcttatgattccttaacgaaattctgacgtaatcatgaacacaaatctttcgcaaaatcatgataagaagaagtagttcttactgaatctttactgaatttttctaaaatatattttgcttttcttatttgtttaacaaaaatgtaggaaatgttttggcccgccgtgcaattatatttatgagatttggcccgcggttcaaaaaggttgggcaggcctgcaatagatcaatagagtcccaaagccctatcctatattttttgtttccactgtttatgccacatctttagttttaactccgattttgggttgattgtgtttcccgtgcgccatcagaaatgtcagactggaacaaccccagtgttaaaaaacagaacctctgtgttgttttttggcggccaagtgaacgtcaaacatagtcaaaagtgtcaaggttaagtttattattgttacttatgaattagctgttatttgagcgtgaaaatatccgtaaagtatttgcaagaacatgctcttttatgttatcgaataaatataagatttcatacaaaaaaattaggaccttattctcaaaaacggttttatgcatcccaaatgcagccacaaaaattaggatgacgctggccaataaaaatacatgactggaaatgtagcgtacatttcatatgccaccagttcataagaatgcataatagggtaacggtcgtattttgtaccccctaagaaagtaattttagttttttgtcccaattaattaattacacaacataatcaagtcaaagaatatgccaaattatagagaaaaacttcctctacgagataaaaatgcccatacggtcatgcaggatccaaaaaacgtcgtaaattatttaattgtgaagcactgttttccattattttggacacaccaatacattttggaccctcaaagtatatattttggacccccggcattttttatcgtttggcgacaaactccacaacactgtttgtataatatgcttgcccatagtctaatcaatcgattgacagtggaaaaccgaagagatcgtacgcttttagttcagaaatgtaaaaaagtttttgtttacatttgaaaaatttctgacggcttcaatttctgtgaatagcccggaatagtcctatctttccaaatggcatgcaaattgaggtggtcttttgattcaaactggaaaatttgcaggaaaatggcccagggggtccaaaatatattggttaccctacagtatggctggctgagctacaatgatgtgacatttaacccatacgttttctggcaaagcctgccgcgcggcgttgcccctcacgtcattgtagctcagccttaagtattccgatctaacatgggaccttcttaagcgacaataatcacttgaccatttgacatgttcagatataggagaacgaaactttcagtaagcgattaatatatacagacaactctcccttactctcccttactcgatattccatatcttgatatcgagttagagaaccatagtaaaagttggcaacctcgatggtatcttgcaacgcatttgcactggttttgtattctataactcaatacctcccacacttgatggtcccttcaatatcaagttagggagagtttactgtaattgtatcacatttaacatttaagatgcccatcagatgcaaatctgttcattatgaatacatgttaccatttttgggtcagtttttgttgacccgtttttcggttcaaaagatcaagttttatcactagaaaatacgaaacatgaaaagcactgtttcagcaaattaaaactattggaggcatagttggaacattgtgggcattccattctaagtttgttttattagctccggtatttggggggagttggattgcagctttttagatacggtcgatgattaagccgaaactttgttttttaaagttttataacttgatttcgggagaacacggtttaatttttgatatatctgattcccttaaattcctgactggaagggtttttgtgagaattcccgaaagattcttatgagaatcctggaacgattcttataagaatgctgggacgatgatgagaatccttgaaggtttcttatgagatccctggaaggttagtgataagaatcatggaaggtttctgataagaatcctggaacaagtcctaagagaatcctgaaaaaatcgcgatgcgaatattgaaaggatggtaatgaaaatcccgatttctgatgagatcactacaaggtttcgaataagaaacatgaatggtttggatgagaatattggaacaattgtgataagaatccagaaaagaatattcggtaatattctgatgagaatagccagagaggatactaatcagaattcagagaggattctgatgtgaactcagagaggattcatgataaattgtcgaggattctcataagaaaccttccagaattcttattaaaaacaaaatttggaaaataaagtttttttttttttttttttttttttaatttctttattagtatcattccaaacattacattcatttcttatatctaggtgttctgtgttatttgacaacactatcatcctaatttggtaaaacaaatttacgatttaattaacattttgttaacaacatattacatttcatttgccgtagcagttcagtttttttacaggtgagttgatttcacctgcttataagagaaaaaaaaacgtttttaatatacttaacctaacttaacctaaacatataacgcactaatcgtggcaatagaagattgtaacgatttttgcctgaaattattaatgattgtatttgacatttgttccaatgtttcaacattggatattctatgtaactcattggtactataccagggaggaagcctcagaatcattttcaaaattttattttgaattctctgcagagctttcttcctggtattacaacagctagtccatattggtacagcatacaacatggctggcctgaaaatttgtttgaatatcaacagcttgttcttaagacaaagttttgattttctattaataaggggatagagacattttacatatttattacatttggcttgaatgccctcaatgtgatttttgaaagttaaattcttatctagcatgagccctagatacttaacttcatctgaccaatttattggaacccctctcatcgtgacaacatgtctacttgaaggtttcaaataaagagcttttggtttatgtgggaatattattagttgagttttggaagcattaggagaaatcttccatttttgcaagtatgaagaaaaaatatccaaacttttttgcaatcgactacagatgacacgcaggcttcgtcctttggcggagaggcctgtgtcatccgcaaacaaagatttttgacatccctgaggtagctcaggtaagtcagatgtgaaaatattgtataatattggtcccaaaatgctgccttgaggaacaccagctcttacaggaagtctttcagatctggagttctgataattaacctgaagtgtacgatttgacagataactttgaattattctaacaatgtatgttggaaaattaaaattttttaattttacaatcaaaccttcatgccaaacactgtcgaatgctttttctatgtctagaagagcaagaccagtagaatagccttcagatttgttggaacggatcaaatttgttacacgtaaaagttgatgagtggtcgaatgtccatggcggaatccgaactgttcattggcaaaaattgaattttcgttgatgtgggccatcattctgttcaaaataaccttttcaaaaagtttactgatggaggaaagcaaactgattggacgatagctagaagcttctgcaggatttttgtctggttttaaaattggaacaaccttagcatttttccatttgtcaggaaaatatgctaattgaaaacatttgttaaatatatcaactaaaaatgataagctactttctggaagtttcttgatgaggatgtagaaaattccatcatcgccaggagctttcatatttttgaattttttaataatagttctcacttcttccaaatcagtctcccaggcattttcgaaaacgttctcttgattgagaatattttcgaactcctgagtaacttcattttcaattggactagtaagtcctaaattaaaattgtgcgcactttcaaactgcatagcaagtttttgagctttttcgcaattagttagtaataatttgttttcctctttcaatgccggtattggcttctgaggttttttcaagattttagataatttccaaaagggcttagagccagggtccaattgagaaattttattttcaaaatttttgtttcttaattgagcaaaacgtttcttgatttctttctgcaaatcctgccatataattttcatagcaggatcgcgagtgcgttgaaattgccttctcctcacgtttttaagacggatcaagagtttaagatcatcgtctataatcacggattcaaattttacttcacattttggaattgcaatgctccgggcttcaacaatggaatttgttaaagtttcaagagcattgtcaatatcaagtttagtttctaaagaaatgttaacatcaagattggaatcaacatacgttttatatatattccagtcggctcgtaaataattgaaagtggagctgataggattgagaatcgcttcttgggatatttgaaatgtaacagggacatgatcagaatcaaaatcagcatgagttatcagttggctacaaagatgactagagtcggttaagaccaaatcaatcgtagatggattttagaagaggaaaaacatgtggggctatcagggtattgaattgaaaaatatcctgaagagcactcatcaaataaaattctgccgttggaattactttgagaattattccatgaccgatgtttggcattaaagtcaccaatgacaaaaaattttgacttattgcgagtcaatttacgcaagtcagtttggagcaaattaacttgctgcccagagcattgaaaaggcaaataggcagctatgaaagtatatttaccaaactgtgtttcaacagaaacacctaaagtttcaaaaactttagtttcaagtgatgaaaacagttgatgttttatacgcctatgaatgatgattgcaactcccccacatgccccatcaagtcgatcattacgataaacaaaaaagttaggatctcttttgagtttagatccaggttttaaatacgtttcggtaataactgctatatgcacgttattaaccgtaagaaaattaaacagctcgtcctctttaccattcagagaacgagcattccaatttaaaatatttaaattattatttggatccattagaaaaacgtaatccaataacaatttgatttgtaaattttacacctacttggactgcttcagtcatagtggtggctttgaacattgcatcaatcattagattcaattgttcagttagaaaattaaaatcagaggcagacatgtcatgtgatttcccattggaatttccggtagacgaagaagcggagttacctgtggcggtagtgttttttccatttgatttgaaacaagtagaattggtacccatggaacgaacaggggaggagttcgaatttcctgctacgatatcggcaaaggatttaccgtgggtagatacattcgaaatagaaagattcgaacggctacccgacggattaaaattagtttgtaaatgagcatgattatgatcttcctgatgggtatgattcatgatcaagcgatcgttaactgaaaaatgagcattgttcgatactctaccaggcaaattccggaaacgaccgttatcgtaacggatattatctttcatctgcctggcacgagcctcaatgacctttttgcgtgaaggacaattccaaaaattggacttatggttagccccgcaattacagcatatgaatttggtggtatcttccttcactggacagacgtctttggcgtgagaagaacctccgcaaatcatgcatttagcatccatgcgacaattttttgtaccatgaccccacttttggcaccgacggcactgagtggggttctggtaatttcctccaggtttctggaaatgttcccatgtcacacggacatcaaacaaaagttttgctttttctaaagctttaatagtatttagttcttttttgttaaagtgaactaaataaaattcttgagaaagccctttccgaacaatgccagattgggttctctttttcataatgattacttggactggggaaaatccaattaattcttttattccatttttgatctcttcaggtgacttatagtcacttgagagacctttcaagacaactttgaacaaacgttcagttttgtcgtcataagtaaaaaatttgtgcttcttctcttcaagatatctgagaagaagttcgcgatctttaagagtttccggcaaaacgcgacagtctcctttctttgcgatttggaaggaaaccttgattcccctaatggagttcaagatctcctgcctaaatcccgcaaattcggacaaactgaccacgattggcggcactctttgcttcctcacttgaatcaaagagcctgggctagaggctgcttcgatttggttttcggaaaatttgtctagagcatcgaactgattgctcatttcgatacaattattcatttcacccttggaagaaacttcgcattccggggaagcgtcctttcttccattctgccacgtgtagtgacagttttaaaacccacttttttggaaggaagtagtgaattcagagattcacccttccttttgtttgtttttgataccatgtttaattaataaacgaaagaagacgtgaccttcgaaaggttttttcccaagacggtgtccaagaaggattaccaccgctagctttcgccaacgggtccaacgaaaaatcgaaggcacgggtccaaacaaggatcgtaaagggatcaatagtagaaaaaatagtactgaaaagtactgttttagtagcactgaaaagtaccgtttttaattttagcactgaaaagtactgtttttgtagcactgaaaagtactgttttattgctttaggtagtttttaagaaaacttccaagagcagagagaattcgtgtacgcacagcacgaaggtacgatgcgcactctggaaaataaagttttgattttacgaaacctagaagtgaaactaataatgattcagcataaggattgacctaagctcaaaatactccaacttagctcccgattagtttacttgtacgaacagttggaattaatattttcatgatggaaatttctttcaaacttgcattgatgtgccacaaaattatttatgctatgttaccaaataccgatagtactgaacaaaacattgaagcacaagtcagtcccatctgtaaaaagtaggcattgataagttaaaaagtaagctgtgaagtttccaaaatcgtttaccatacaaatattcaaaaaaaaatcaagaggattggaacatgttcaaatctcaataaaactttagcaatttgcttttcattacgatattcgagaaaaatataaagatgatcaaagcatgattatttattgtgttacaccaggtccgtcccactcgggctcagattgggtaccacttctagtactgcatttggtccctcggtagtgcaaaaggtacccaagtttgacagatcgcagtacacttttcaccgcattctagattacctaatgagccataaaattttgggcaactgcaagggacatggaggtctttaatttgtctttggttacacggtgctaaaaactgtagtgggaccagtgaatcaattgtcacccaacacacagcaacaaagatattgtcatctcctgttcttgtcgcaacaatttcattccgcaacataagtttatcatcacttgaacagaatatgacaatgatcggtccctacgtacgcagcgattttctgggcttcgcattgaaattttcgagaactttctccatgttgctaaacattgacacattaacgaacagtattcataaaacaaatttggttttgtgtttaaaataactcaattatcgcgagttgaaaaggttgcaataatgttgcgctctgtgattgtcatgatagttttgcttttgatccttatccgcaacagttgggacaaacggttgtgagcaagcttgctttgttatttgtttttcgtctgttttgatgacaatttgatacactgagtgggactgatatacgattacttttaattatggttgctgttttttcctaatttttccgaacaaatcattttatctcattgatttagccgaaagatttgaagatattttgagctctgaacttaactcaattttgacgaaaatgcagatggtactgactgagatagttttgcgttgaaacaatccagatttgagtagattcgcgttgccgtgtatagttctacatcggagatttctccgtagtaaccgagtactacatccaacgccagagcctgtgttggtcgaacgaccgccgtggccgttgtcatgcctcggagtggcccagagtccattagcgtgccactccgaaggccaccattacgattcgcaagaccatgtaaaagaagctgaagtactcgccgcccgtccagccggagcgtgaaagagttgagagtcgattaggaagaagacgaggtgaaatagcgggacgaggagaaggggccccgccgatagtgacgaagtagtagagaaagtgaggtaggagattgtccttaagaaagtgggagcaataagggtacctgattgtgcaaatattgaaaaaagtgggtttgtgtttagtaaaggtagtttagtgtagtcttgatcacgatagtaaagtgcgcacgccgagggtgactcagggagagaggggactctcatctgcagggatgccaggtgatgttttccaatgtcttccaattgcatggaaaaatgtcttccacttaaaacttttcaataatcatggtaactttataaacttcataaattttcgggttaaggcccaagtaaaaatggaacaaatgtcaaaaccgcaaaaaaaaaaacagttttctgcttcaaaattcccaattctgaaaaaataaatacacacatatgttttgctttcaaacaaaaactgctgtttttttatttgttgatttttgagttgtgaaatttgctccatttttagttaagcctggtaagtcagaaaattaggctctcttttatcatgcttaacattgttgttgtggaattcattcaaagaaattctagcatactgttttaaaaccatgcttgtcaggcaatagctaacctgtacatggttttattttcaaccagattttaatttaatcggaagtctcctttgttatgaataattattcttgagaattcatcagaagttcaaccagaaactcgtctaagaataccttcacagattgctacatgaattcctaaaaataaatctacatttatttatatagagtatagagtaagtcccggaggaaaaataaaggaatattcagtgaaactttagaggatttcctggaagaaccccggatgaatttctggagaaactacgaagaaattactggaggaatttttgaaagtaaggaatccatagagtaaggtggggcaaaagttcgaccttagtggtataatcaaagtttccaggaaaacaatagcagttaaaacaaaacaaataccatacagtgaaccttcaacatattggctatagttttgctgaacaaacttttgtcaaaatttttgcccatttttagttataacagtttaaaattgattgtcttaaacgaacttttgccccaccggtggggcaagagttcgaatctagtgtggggcaaaagttcgctggctaaaacacaaaatattgatagttttatgacaggcatactttacaccagccgaaaacttaagtttgccgaaacaaacacactaaattttcatcaaaaaattgccaagaacagggttaattgtagtatgctcaaaaatagcagtttttcgaaaacctaagtggaaatgtaaaattttggtgacagtttccacacgatcagacaaatttaacttaatttgaagaaaatatgtggattttaggcgatttgaaaatttttccgtgagtttatacatgggtcgaacatttgccccgctgattagaacttttgccccactatgggccaaaaattgtttccaagcatctatgcaaaaactaaaacacttcgaaccttatgataggcctagaaacgcccttacataaaatattgaaaaagattttatcttcaattggttccatgcaacgaaagtttgaccaaaaattatattattcacgtcgaaaacgaactaatagccataacttttccaaatctcaatcgatttttatgatatttgaagtgaaagtctcttacttgaatagcattcgaaccaccatgacatttataagatttgttttgaattcagctagaaatcttaaaaagaaactcttaccccactcgaacttttgccccactttactctaggtattctagatggaactctgaagaaattctaggagaaactggtgagaaattcctcgacgaattttagagaatttcttgttgaaactctggagaatttaccgaggaaatctagaggaatactcggagtaattccagaaggatccctagtggagcttcgaaggatttccgaggcatttctagtggattccttgagaaactccaattaaattcatggaggtactatggcaaaacagccgatggtattcccggtggagctctaaaggaatttccggaggagctttcagtggaattcccggttgagccatccagaaattcctcgggagattttttccaagacttcccccggagatttcccccaagaactcctccgggattttttccaggaatttcgcatgtgatttccaatagcaattcttccgtggatttcgtccaggatttgcacctggaattcctcagaggattttggatagcaatttctacggggatttggtccaagattttctatggggacttcgtccagaatttcattaaggaattcctctgaggattctccaaaatttctttcggggtttttttcagcagatttcctctatgaatttctctaaggatttaaaccaggaatttctccgattattttctccaggaattcctccggggtttccttcgggaatctcaaggatgcctccagcgatatccttcggaactcttccggaaatattctccaggaatttctcaggggatttttaaaagtaattactctagggattttgtgtagaaattcttccgaggattttcttcaagaatttctctggggatttcctcaagaagaacttcaaaggatttcctcccgaaacttctcctgggattttctccataaattgttctggggattttgtccagaaattcctacagagatttcgccaagaaattcctctgagaatttccttcagaaacttctctggcaatttgctccaggtattcctccgtagattttctccagaaatttctccggagattttttccaagaattctgccggtgatttcctcgaagaactcctccgggattttctccagaaattttaaaagagatttagaacagcaaatctttcgaggattttgttcaagaattcctctgtggatccagcaattcttccggtaatttactctagaagtacgtccaaaagatttcattaataattaccatcggggattcaattagaaattcctccggggattctctccagaaattccttcagggatttttcagagaattaatccggagatttcctctaggaatctggggatttgcaccaggaattttacgggagattttttccagaaattccttcggagatttgctgcaggatttcgtccgaaaattcactgagaaattcattcggagatttttcagtgaatttctcttgagatttcttctgggaattcctccagaaattcttccagggatttcgtccagaaattccttcgaggaattcatccaggaattcttccgaggatatcatctgacaatttgctttaaaaatcctccggagattttttaaagaatacctccggggattttccccaagaactcctccggtaattttctccagaaattcctcaagggatcttaaatagcaattcctccagaaaactacgccagcaataattccccggacgacctcaaggagattttctccataaatttatccagcatatcctccgaagttcctcctggagctttggaggaacttcggaagatatgctggaaaaaatccaaaagaattgctgaaagaactccggaggaataaccggtgaagctccgaaggaattcccgaaggacctttaaaggaattcctgccgaaactctaggacaaaatcctagagaatctccaaaagaaatcctggaggaactacgaagcaatttctgagtgaactcaggaggcgttgctggagacactccggatgtgtttctggaggaattccggaggcgttactagtgcaattccggagaaaatgcttgacgaactccggagaaattcctgaaggaactaaggggggaattcgaagcaattcccactgttgggaaggaacaccgcaggaaccttccaacaattacggaggaactttcggagaatcgctggaggaactccagaggaatttctaatttctaggaatttggaagaaatctagaagaattgcctgtggaaacccagaggacgtttcaaggaattgctggacgaaatccataagaattgtcagaaaacatgaatgttgtgatttatttgaagcaatttcagaagaactcctagaggaatatagtatcatcataatggagctccaaaagtattccaggaggcattctaggaaaaaatctccggataaattcctggtggaaattcccgaaggaattcctgtagcaaatctccggaaaatccctcgagaaatttcttttgagaatcccttgagtaattcctggagaaaatccccggaataaatgttgggggatatcccgcagtaatccttgaaatccccggaggaattcctggagcaataatcctgggataactcgaaataattggagaaaaagggtaataagcgcgattaaactacgaacaatgatttattaacgtgttactcgtacaaaggaaaacgaacgaatgaaaaatggatttgctctctatcatcatcgtactgccggtagcaacgaggtagaacttcctggaggaaatcttttgcaaaattctctggaaaaatcgccgaaacaatatctggagaaaatccccggaggaggagttaatgaatcaatggatgaaatactcagaagaaatcgtggacgaaatgtccggaaaaatttctggaggaaatcttaggagtaattcctggtgcaaatcctcagagatattcctggaagaaatcttcggataaattctctgaaaaagtctccgaatgaatttctggagaaaatctaaatggatttctaaacgaaatccccagaagaattcctctgggagcagttcttggaaaaatcttcggaggaatttctgaaaaaaaaaatccccggaggaatttttggaacaaatttccagaaaaatcgcctgggtaattcttggactaaaactccgaaaaaaaatcgtggtgcaaatccccagagaaatctgttctgaagaaaattctaaaagggattcctggagaaaatccccggaggaatttctggacgatacccatggagaaaagtttctgaaggaaaaacatacccgaagagattcctggagcaaatcccaaattctgttgtacaaatcggaggaacttcaatagaatccctgaaagagctcctagagttatctgtgggcaaacttcgttgtggaatatataaatacattcccgtaaaaattcgtggtggaatccttggacaaattcctaaagaatatcccagataaataccatgaagactcctagaggtgtcctgtatgagctcctgaaggattctctgaaggaatagtcgaattaattgccggaggaattgctagaagaagaaaaaaaatattgttttaaaacagctgcgatgaaatattgttcctgtttttacttacttgaaatgagtaagaactagagacggtggcagtattatcgagatcaaatcgaactgataatcaaacatcccaagtaaccacaagcattataacattgcacgtattctactgcatatcaacaccattgatgcaacattgcttttattcaacaaatttcaagagctgtcaagcaataaagcattatccctacattacaaatgtattaacgcactaggctccatcccattaccccgaacgccattaccccgaacgccactaccccgaatagttcactaccccgaaagccattaccccgaatgagtcattaccccgaacgccactaccccgaatgagccattaccccgaatagtatgagatatactgcagtatcttattttgcgggcaaaaatgcgtctctaatgaaagctggtaattaatggcgcgtaaaattcgtctgtaaattatacatcaaatattttcccttcttttatatgtcagttattctttcaaaatatcttgttggcaactatcttcctctcattctttctgagacagtgcctgtttatcagctcagtgggcactttcgtagttcaagggttcattcacaaatttcataacgccaaaaattgccatttttgacacctacccaccccctcatactattttttgtattgtatggaaattctacatattgtgtatgggctgtaacattttgaagacaaccacccacaacattttttgcctccttcagggttatgaaatttgtgaatgggctttttataaaataggccttttattgactgagagcattccttgtcaatttaccattcttgtacatgtacctctatgcccagggacgccaaggaaatgttcaatgcatatgatccgccaccggaggaattcgaacccgtaaccctcaatatggtcttgctgaacagctgcgtgatcactggtatttggacttcttggtggtgctcataattcaattttgtttttaaacaaatatcttcctttcttatgaatataggttgtgccatatcatcacgttgttacagtgatcattcacgtcatagttgctaacatttcaccagatgtttgcccttcttttttaaataggctgttctttcaagtattcttttgataagctagtcactagtatttccacttagaacagcttttttaaaggaatgtatgctgaaggcattcactaaagttaatcctgctataattctaagaaattttcccttcgccatcgtttacgaaacaaaatctttatggagatcttaatgctagtagcctgacacctacaaaaatgagtaaaataagtgggtaccgatttccaataagagactttactacatcttaattttgtacatattatagctatccttttcataataaattcactcttcttttttgaaaaggctgttcttcaagttctttgcaatgtggctgtgcgaatctcaccaaaattagaggacaaatccaaagaaaacttagtatgaaaaaaatatttgctaaaaaactagctgcttttttatcttctgatatttcaaaaatacatagttgagctaaactccttaaatactcataaggaatcgtacaattatctccccactctctaactagcataagcctcaaaatgttatgcattcggggtaatggcgttcggggtagtgacccattcggggtagtggcgttcggggtaatgacccattcggggtaatggctttcggggtaatggcgttcggggtagtgacattcggggtagtggcgttcggggtagtgtcatagagtcaatgcactaacatcactttataaattgtactgctgcattaatattactttataatttgcttcattgctttatcgtcctttttgcattaatttgactgtaaaagtgcccttttccacttttaaactacttgaatggtaagcttacggcaatgcagctgcattatatatgcaattatataatgctccatggttacttgggatgtatcgaaccagttttagaacagttcaaatcttgttccaaattcgatcaaaaactagcctgtttcaaaaaagagaccagaaaactggtataaaataaaatttgaaaatatttgcaacaccggtgcaagctccaatttataacatagttcaacaatttgaaccaccagtgaagttgcccattgtttacggaattctgaaggagtttcaggagaaacgagtgaaaaacaacttgacagatttcccaaagatgggataatttcaatagcaacaattgtagcaatctcaagaaaaaaatcatacaagaatctgttaacttattttatgaattcgtaaaaaaacacgagaatttctgaaacagatttcaaaaagtctttgtaacaatccttgattaacttagatgattctatggaattatacttaaatacattactagaatgtcatgataaatctctgcaagagatcctataagaaactttgaaagaatcttcgtcagaattctcagatcaatatctgatgggatccttagagaatttccaacggaatttggagagggatcgctatagcttaatttagacgtgcaataatctttgagaattgctacttgtaatttccaacttatatgtttttttcaaatctaggaattttaaaaatgctaataatttaaaattttcttccaaatgtcttcacaaattctgaaaagtcttccaaaaatcttccatcttctaaatgtcttccacactactcaaatgtcttccaatggaagacatgtcttccaacctggcatccctgctcatctgtgctggacagggatcgccccattagttacagctgcttgttttgctatttccggcgaaccgacatttctaccgaagcggcgtattggccatctaccatatagagtaacggtcgtattttgaacgctttaaggaagtggttttgggtttttgtaccaatcaattatcgacacagcgtaaccatgtcaatgaacatgctaaaatgtagagaaaagctttctctgtgaaataaaaatgctcatacggtgatatatagtgcaaaatacgttgagagtaattaaattatgaagcattatttttttacagttttggcacctcaaactattttggaaagtatatattttgaacccccggcatattcatatagttggaaactaagtcaaagaaactgttgattatcaatcgattaacaatgggaaacgcaaagaatttacgctttttattccagcaatctgaaaaactgttttgtttacgcgaatcaactgttaaaatgattgtctgtggaaacagagtttgcgctcaaatttatgaattttaatctgcacctacatttaatgtacattttacacttatgataaatctgtatgcttctgggctatatttgataggtaacgcaagaaagatctgaagaaaactaagataagatctaattatcgattagaacaaggattaaattccaatagaggttgagactagtgcgactacatttattcatatttttactaatttttggttatcaattatgttagtgtttagacgaaatctacgcaggtctcttggtcagaccatagaagatcaatttgtcagataattcatattgatgtcaattttaaaaataattatagaatatctcagattattaaattgattgttagacaacatgatattccaaatactcattctcgtcatatttcatatcatcatttcagaggaggtcaccaaggaaaaatcaaagtacaaagcaatcgcagctgaattggatctaacctttgctgatctgtctggatactaaccatgctaactcgaagatggtcctgcaaaaactaacaaaccattaagcatcatggatcaccaccaacagctagatcgctacaagactaacagtccaattaaacctctttgggacggatctggatgctcgaacgcgattgatgataggagaccaaacaattcagaaaaaaaaacccacattccaaacatccacttaacttatatatagtataattgtattcgcggaaatgctgttaacgaaaaattactaaaattttgcagagagatctatcgcttctttatcacgcatattagagaagttgaaatcaatcgatttgttcgccaccctttcggattttattaaatatgcactctatttcgaacaatcttctaaagattggtatcgacagatgaaccaatatgtattgcctaactgcctttgattataattccattttacctttaatcattttgcttatggaatctcgtgacatgttccagccaaatatattttccctcataaataatctcgaattgatatcagtgttaaggcttagcaagcagagcaggaactttaacagaaccagcgccgaagtgatgagaacaatttctattatcgtgaagctttttgtgattttattgatgacaactgataggagacctagaggaacctgagtggaatcaaacgcgccagatggagtaaagtgagttaaggtttttggttgagtacattccaatgaagaagatgaaaataaacgaaacctgagtcacactgtgtaattcat

SEQ ID NO: 139 - DNA, 37534 bp, Aedes aegypti
  misc_feature (32721)..(32853): n is a, c, g, or t
aacaggcccaaggacctcattcagcaatagcacatggtgtctatgcaacatgctttttaatctatccatgtaaaacttagttctgcaggtgtggaagattttatgttatctactggtaacatcaaccatggaaaccgagtagaaacatgccaagaaagtgaagtgaacgtcatcactaacaaaaatgtgatcagcgccattcatatgtcaagctagtttttcgaacaataacaataggcctattcacatgacgtctcaaatcagctgatcgggaagcactttgacagttcttctatgaaaatgacaggcccgtgttagcaccagtcctccactgatgtaaacaaatgcatagacggatctgtcacatgaaaaggcctatgagcggcccgccagacaacgtcatccgaacgtctcgtagaatggcttttacccgcattatagttatagttgacagtcgtatatccaccctgggacgaactgaagctgcttcaattttgcttggtttgtggttccgtgtggggacaacgtttttcttacccttttgtacgaaccttggaattgattttttggatgcggtcgtcgcccattttctcaccccttgttaaaatgtcatagccatcgccgagtttgctgctgtcgtatccgtgaagtgaaaatattatggatcgagataaatttggtcaaattcagtgaattttcgcgtaaaagtggattaaaaggttacatatattgatcataacgtgtaattggtttaaagacagcgacaggaattgataaataacgttgaattttatgtaaggattgtcatttttttttcctttctaagtgcactggtttctggaaaatacaaaccattcaagatggatgacgaatcagtagtataattaatgttattttctcgtttttcgtttgttttcgtgacataaaatatattgttggacttttaaattgaatttcattgttacttcttaaatttcactgatccaattaacggtactctcttctatgtgccgcaagtgtgcatttaaattgcttttcgccttaattttccgtcgcgtttgatttctacgcatatcaaagtgcagtttttatttacagctggcagatgattgttaataaactgaaattcatgttaaatctcggcttttatcctataaagtatgtaacatcgggcatattcatacgtgatttttcatttattttatattttttgcattatggaaacacacacattacacttgacatccataaacaataccaatacattctaaatggtgcgtaatcaactcgtaaatatttatttacacatcccaatgattagatcatacaccgcaattttgtctctctagtgacacccacaacatcaatgtctgaaacaaaaaaaaaacacgttccttgaatcaaactgatttctttttttctttttctcattgcaggttgaaattttaacttgtgtagagtgtttggtgatctatacaaagatgccatcagtgaaaagtgtgtgctgatataaaatagcagtaaatgcagtatattcataaaaagtgcaagaatacatcaaaagacattccaaataatcccagtcataaaatcatacaaaaaataagtgagcaaggatggcctatcataagccaacggatatcgatggattcatcacacagatggccaaagcggacatgcgagtaaaagcacaacttgcggaagatcttgtgctatatctcaacgattcggagaactcgatagaatgcgttgatctaggacttctcatagatggattaatcccctggatgataggaagtcatttcaaggtatggagttatcttatattctctcatcacttttggttgtacatttgtgccgtgtcgtttatgctttacctctaactgcatgcttgggtggtgccgatcctagtctaccttccatctgtctgttcgaacgatacactgacttattatttccaaagcaattcagatttagggcgttggccaaagcatctgtttgaagttatcaacgaaatatatgatgcgctatggtaatatttagaaaggtcagacaaacgtccattcatagaggaagacgggttgaggcggaccaccccttcagtttggcatgaaaatgactttccttgaaaaatattgctgattattctacttagctgcagttcgaagcattttcagtgatgtgcttggtgatgttaatttgattgatttgaataatattgggctaaacatgtacatacatacttttggcatgtaagctcattttactaccgtatttcagaaggtatggtcgacgaaccgtctcatgacgaaaagaacaaaacgactgaaaatatataagttctagcataacttacgatcttgctctaaaagccattggtaaccgagaatgtagcttgttactgaacatacaaatggagttccacattatttaacagagatttatcgaatagcattattcggctttcggccgaataccgaatagttgaaatgtcattattcggccaaacgaatattgggccgaataaccactcaatattcggtcaaataaaacctttaaatttaatcgaataacacccatatgttcgttcaatttcacgaaaacaacattttttatattaactgaaacaaaaaagctagtattttttcaatagggaaagctttcacggtgaagaattgattggaataatcgtgagctttcaaacccatttggaaaaattgcaaaaattgtaagttctgaggatttctatttcttaagttagggagttgtatcttattgatggcatttttatccattttattttttaagaaactagtgaaaatacgtcgcttgattcctcatagaacttctggaagtgctttatataatataggagcaaatataccacagaaagaatgtgaatggtgtcgtaaaaatatcaaaagtgaggaaagtcccaagataattgatgtagtttaaaggagtatatatttacaagctgtaccttacaacccatgcaagatgaaatgatttgcagagaatggcttatgtattaagcagtctagtcaccgtaattccgaagaacgaaattcgcacaaccaataggaaaatttaatgtacattacttgaatgaattaattgattttattttaattttccttcgtgtgaaacataatgttttattacaatttagcttgttttgttattattcggtaactatttcggcaaaccgaatattcggcaaaatcaaaataatcgagatattcggaccgaatatttggccagccgtatattcgatacatctctatttaacaatgctacgataaaaaaaatgctctttaaaacacatagctatataatttttggtgacatgaataattttgtcaaatgagcagcataattacgcaagagctgtacttttgatcctatagtttttatgtgtctttgcttttttgcttttcttatgattttttgctgtttttgttatgcgatacataaccgtcaaacgggggaacttgcaacgcttttaaacttcaatcatctaaaaccaagatctaagtaacaccttaaactataaattccttctaaaatttttaatggccagcccgcctacagaataagatgataaaggcttgaatcgactaagtcttccatatcgaaaatccggaaatagatttttttctaaatgccttgctgcgccttgtcctcgatgttaatttagctttttacaacaaaatgtcgaaattttcatatgtcgcactcgatgagtaactacatttaactctccataattcgatatttaagggactatcgagttatagaacacaaacccacacgcaaaaaaaaaaaaaattgtgcggtaaaattaccattttaggcggttaacttaagagcaattttcagcagaccagaattgcgcttgattttacaacgtctgtagttggaatcatatggttgtaaattatttctatcaaatgtaccagtaatgtggtgggatgtatcgtaaacatagtaaagtggtctgatattccatggtattttcaagaaggggcgtagtcagctaaaatagtaatttctaccacagcattttttcccgtgcagtgcaaatgcggtccaagggaccatcgaggcaaccatgaaaacaaccttctatggttctctaacccgatagcgggatacgaaatatcgagtaaggaagagttgactgtaatacaagaatcttttgattatttatttttctaagaaacttaatgacttaaatattaatattatttaataacttaaatcatcaacgtcttatatctttgttaaataatatattcaccgtttttttactgattgataaattgttattacagggggattccgtttttggcatgctccgtttttggcatgctccattattggcaccccccgattttggcaacaaaagggatccttttttggcaacatttttgaataccattgaaatttgtaaatatttgtgaatattattgtatctgctgatttagtcatttgaatagcaagtcaattacacaccgactacattccagagctctattttcgtcgatattccctcaaatcccaccaactgctaagggatctcgtacgcgcctatttacttcggggtggtcattggtcatgcattcgcaatgttccatgaggccattaatctccatcagtatctcaacaagagtaaaacctcttttttaggcattcgtacggaatgacctgcccacaatggtctgccagtaggtgatacactaaataaaacaacttttcttcagatttggaacacttgaacaaagcacaagcactgacacaagagcaacatgaggtctatgactcacacacagttttaatcataaatttcgtctcactatttaatatattcatatttttttcatattattacgaagtgccgttcaataccgccaccatgacaattgtgtacacagtccaaacaacattttattgtcaataacatcagtgaaacgtgcgataaatacgattaagagtgtttaaatagtttgtatgtagtaatagtgagtatattgatctttctgcggcaactatttagagctacgttccatattcattatagattaagtaagacgatcctacatcctaaacaatattttaaatcgagaatatggggctcataaaataatcattaggatccttacgaactgggtctatgagtttcctaacttaccctggggacggacctggtgtagtggttagaacacacgcctctcacgccgaggacctgggatcgaatcccatccccgagatagtcactaaaaatttcagtgacaacttccttcggaagggaagtaaagccgttggtcccgagatgaactagcccagggctaaaaatctcgttaataaagacagaaaaaaaaacttaccctggagaaaccttaggggattcttggttttagggaacttctcagaaatttcaacgtattctcgaagatgtctgcatgttcctaacggacactgagggttttgcggaatcctgagaatgtatacatataagcaacacacatgttataattgagcagttgattcagttgataatgctcaattctaacatgtgtgttgctcaggtataattggtcattgaagattatgtccaatatctgatgcccaataaactcttaagatttctagggcgtactgtgaaatcctagcgagataatggatttctagtggtattttgtgtagttctggcgaaatgttgtagattttgaaaaggtggtttcctgaggaattcagtaagtgataatggtagcctaagaataatgatttttcgtaaattctcatcggagacctgagaattttcagcaatatcgaggctaaaccctaagcaagatcttgggaattctatgcgggatcctgcggattcttaccaagatgcttcagagtcctagcgtagatttcttacaagcacctgatgattcctatcaggctcttgagatttcaaagcagtatcctgtaatgtgcttgtttatgtttgcgcttttgactgctgtaaatcattccttatgagatgatttgctttattagaaaaataagtttattctaaactcaccaatgtttgtcaaattttacgcaagagcctaaaagttgaactgatttttaattttcattaaatgcagttttgtaatacccatcggctctgttttgtaagtaagtctttgaaagaatacggtaacacatttcttttttgttttgtattctcacaaagtttcaaggaaaagtcaaattcttgaacaaaggtcgcttatgcgattatttatttaacatgacccacatttacaaacagcgtagataaagcttttaaaaaatcattgatgcgataaaaactatgtagaacgtttgccacaatcaacattacggggttatagattcatagcatagtccacccctctggaaacctgcttcgaacagaaccgttccgatgtctcgatgccttatgattccataaagatgatgtaataacattctaatgatgttttcaaaaataatagcagaaaaataatattaaaaaaatgggttccgattttggcatggttccgtttttggcaactaaaagtttcgactttgttgccaaaaacggaatcccactgtatttagattataaaatagacatacagaaaagatatggaccaatgtacgtgttcacgaatttgacgtttgagcggtgccgaatttactcgtttccatggtcacataaagaacacggcaccgctcaaatgtcatcgaagttaaaatggtttagaaaataagtgttgcaattcaccccgcgcaggagcacttttgaataacatattgttggggcaggttcgcgatttccgttggaattggaacggtgaataaaactgtaacttgctgtagcttactaactatgcccgacgggagtggcgataccggctactgcactagcacaaagctcacggaggtgctgctaacagccactaggagtctttcttctgctcgaatggaaacggctaatacttttaacttcactttatttggaggataacttgggagattacaaattttggatttcttgcttatcttagagcttgatttgaaataatttcatttcagtattttctaaagcaaattatggaaaaaaatcatttcgacaaatgggttaaatttaagggagaatttgtagagaaatctctcgaagaatttctggagagatcccggtaaaagaccctgaaagcactctaaaaacactttttgattatttttgaagcttattcacagggaatctgagacgaaatttttgaagagcctgctgagtccattatagccttttttaaagcaattttattgaacaaattttccaaaaaactagatcaaactgcttgcctttacagccagtgaggttaatcttatttcttcacctaccgtaaagtactcatatttcgcgcgcgctcctaatttcgctcactgacatttgaaacatgttttgcgaaaaaaaattttgttggatagtattttgaacaattccaattcagccatggttacataacatgcaattataaagtacaatatgtatcaacaaatatgaataaaatggcagtgagcgaaattaggagcgcgcgtgaaatatggtagcatcacggtatattgaaataacaaatggattaacagcaaaaaaatctgcgtgtttttttttttctttgcaccgaaagtgaccccgcaaaagttttcagggggaaactgaagatgttttaaaaatgtttcatcgcgcagaaactccatcaaatatttcgctgaagttcaacaattctacaaaaaaacttccaaaaaatcgtcatttgatctaaatatttttatgaatggtgtcacaaaatatcagaacttctagagaatgtgctgtgggagttctttaggaattgctttgaaaatcgtcaagagattcagcaatactttgatagattatatcaagtgtgatcgcacgttcagaagtcgctagcaccatcacgctcgtgttgtgtataacaggatgcggtattagattgatccattacttcatccaaagagtcttcaataatcttttgataattctctatgaatgttccagaaacttctcaagaattactttcaggaacgctcaaggcaatttgtcatacaggctgtagttgttttttcaataaaccatacatttattcattcagaaatgccatagaggattgcttcgtttgtttttctaacggttaaagaagtttcttacagttagtttcccagtatttccactataggtatctcaatcgttcatctcacgattttgtatcgattttatcattggtcatctggatgcggagatattctaaagttcctaaggggaccgacgggggaatgtcggttccccaagaaacatccgaatatcttcaaaaccagatgatcaattatcaataccgtaaaatggggcgaatagaaacaagtattagcatatatctggacaaaaatttgaaaagggcccaaaaggtcttgagccttttttcagaaacgttgctgatgagcccttcttagcccgcccacgcaaactaacactgctatcagaaagattggtgttagcttttcccggtagtggtattagtgagcgtgaccaagttgaattgggctcaacagcttcttgcaaagccaatgtttaccaatgtcgatgtgcccttttgaaatgtttgtccagatatgtgaaagtagcaagtattagcatatatgcattggaaaataatttaatcagtcacaagtatgggtggcaccatcctgcatcattgttgttaatgtttaaaaactttgactaaatcctatttttttgtagttaaaagatcgattttctattcgcctttcgatggagcgaatgaaaaccaggatcatttaaatatattagtttccaattttgataaacaagatcaatacttataagcacaaaaaaaaacttcaaaatgtatcgcaaagatagcaataattttgaaacgtacacatgttctattggatattttttgtcataggataacctcaaaaaaggataaatcatctcatccttctcaacattggtggttcaaaatcctccgaaataatatttgtgaccccggaaacgtttttccctggtagaacttggatgtttgatcttttttttctgatagcagacgtttttgtagttccatatcgagcatcacataacagagaaattaagctttcgtatagtttctcagcgtctcctggactaggcactgcaggtaacatacgtgacacgggtatactgttcacagggacagtgccacgtttcttgaatccagcttgaacatttttcggtccttgaagtttaatgttatccatccatctgttgtttcaatagtttgggaaatttatccttcggcagggatagctcgtatttaccttgagtgaacaaaatttgcggatctgctttttctacggttttaagcgttgtggcttgtaatttctcaccatagtcatcctgtaaacaaattgttagtatcatgcaagcgattgataactcaaatctcagattttgtaattattgtgttattgtaattttgacgataacatcttaattatcttggaatgatcaaaaattttactgtgcaaattagaaaaactcaataaatcaacgaatacactaaggagaccagctaaaaatcaaatcaaaggtatgtttaaagacaaagtattggatgatcacacaaacctcgtgtttacaatttttacttacaagaatttatagaaaaatgacagctatattcttaacaaacgcacgaagaaactgggtctgtatgtaggtaataagaaaaatatttccgtatgcttattcaatgcatttctagtataacggaagtaatttcaagaataaaaaaaaattgtttatcaccccattgtttctattcgccccattttacggtaccgaggcagattctgaaaatacacactacgaaaaaatcatgtgatttacgtcttttaggatgcacataaaagaagcgagccgaatgacataaatttgtgtcgaatttaaaacacgtttgtgtctgattcgggaaatgtcgatcacagttctatcgttttcgtgtctcttagcatgtaaaattacattttttgttcaataaatcttcatggacacatctttgtgtcgttccatcaattacatcatgtgtcattcagtcataaccagaattacgtccacagtaattttcattatttttaagagtgtagaagagttttatgagaacttgtggaaatatggtgcatacatatccacaaacaaaaaagttatcgcgatttgatttttttttttgtggtaaaaaataaagctgctttgacggtgccaaagtagaaggtgcaccatgacaataaccgtctgtgaaacatatcaccttcccaataatttggtacacatctaacggttcatgatttgtcatgaaacagctgcattcaggcggaggaccaattgatatgtttcggcatattctcaggctctcttcgaacggagggaccgcgagggcatttgatggttcagttcgtttacacgagctgtagcatcctttgtattacccacacagttacggatcactttggagttcaacatcggataaatcgctcaaaacatagacgttgacgtaaaacatatgtttgccaagtcatactatttgtcttctaccatatgtaatgttaacggtgtttttgctatcattatatggtcggtttctgtaagaagtgccgtcagcattcataagctcccacaggtggtaaaattcaacatagcatacaaaatgctctttcgcttactgcccataaaggcataactgtcccatattaaaaaattaggcattgagaaaacaccgctcaaaggttgaagtttgacttctcataccaatgttcatgattttctagtacatttctacttgccatattcattcagcacaaccttacaggtaactcattttgctcctattgatcatcaagaaatataaacttgaacacaattcatgtttcgcagttgctatttcgattgaaagtacatatagagaccgttatgcctttatttttcaatatgggactgcacaaacttcatatttttccacaacattttcaaacaaagtgtgtaaatttttatgtgcatagtcaaatacatattagaacatggatgttgcgacgaaaaaaggtgttggttcgaaaatccatataggacagttatgcttttatgggcagcttagatttagtacgaattaatctttggaaaacatttttcttgattgttgtttctaaatactgcatattagctgttctaactagtgatctataatatgggcaactacaatgcataaaatttgagcagcatcttatttagagatgaaatatgcacagaaaaaaatccgttctggtatccgtgaatagcagacgtgaactcgtcaacaagcaaaaatacaccgtgaactagatcatgtatctgtgaccaatggaccaatgcacgagttcactaatttgacgtttgagcgatgccgaattcacttgttgccatcgtcacgtaaataacacggcaccgctcaaacgtcaaatagtgaactcgtgcatcggtccatgatggtagttcacggtgtatttttgacagttcacgttttccagaacgcttttttgagcgtgtgcttccaaacaagcacaattatcatggttgaataatcatagcagagtacctcaaaagttaaactgtttgtaaagcgccttcaattcaaacgtctgtgtaatgaacgcgatagaggcttataaaaacaaatctcgcgtaacttttcaaaaggtcctaagtaacaaatgtaaacaaatcgagattatcattgcaaatcatttgcattgcaccacttagcagcacactagaacactcgttctgatatattaacaacaaattaatctattcaaagctaaacaaaatgaccaatgttcaaaactgcatcgcttttaatcaattgttacattggacctttgatcagagaaccaaccacatgtcctatgtaacatttatgaataaacacgattctaatgttacattggacattcctgaataaagctttgaaatggagtttaaaaggtagaatgatttgtagaagcgtgtctgagacactacttagatgcatagaatgccataataactgcttctcaatcatttgagtcgatattttcagagtcgcactgcctcgcaaaattgaaaacgctcaagtgacaaaaagagaatgagttacacaaaactgtattttggtctttttgccaaaccatgttttaccgtttcgctggattggatcagctgcaacatctcttttcatattattagcgcattgcgtgcatgtaggggaatgatattgagcacaagattgagcatcatgatgtcattgtatcaatctgattcagatgcatggtcgatcaagcatataaatatgcttcccggcagcaacacgagcaacgtacatgcgcgacttgctcacacatatttgcagagcgatcaatcaccgaagagaggagaagctgtatgtatttgttagacgtgggctcttttctcgagttcctacaacaagatggacggcgtcgtcatcgtcatcattccccaccgcaatttctggtttcaatcgacggctggtgctgattgcaacacagccgtcaccaccaccacgtcatgcagtgggaaactctcacatgggcgaaaccgtcataaaaacggggggaaaattgagggagaatcagagagagagcaaaatgtcctacatacagctcaactttcccctccttctgttgttacataggaaacatagacggatgggaagaagtgacgtcgtgggattgaatgaatcaaaacaaagcacagctggtgtctccgattagcacaccgcaacaaaatgtcgattatcagcgtattgagtgcatgtagggaaatgatattcagcatcatgatcttattgtatcaatccgattcagatccatggtcgatgaagcatatacatatgcttcacggcagcaatacgagcaacgtgcatgcgcgacttgcgcacatatatttgcagagcaatcattcaccgaagagcggagaagctgtatgtatttgtttggcattggtttcctacaacacaatcgacggcgccgtcatcgtcatcatttcccaccgctatttcttgtttgcgccgacggctggtgccgaatgcaacacagtcatcaccacccgtcgtgcagtgggtaactcacacacgaacaagtgtgggcgaaaccagcattgaaacggggggaatattgagagagaaactgtgagaaagcaaaaagtcccaaatacagctcaacgtttcccctccttctgttgttacataggacacatagactggagggaaaaagtgacggcatggcattgaatgaatcaaattgttgttgttcgtgagagactttaacccgaaggtcattcgtctcttcttcaaatgaataaaaacaaagcacagctggtgcctgcgattatcacaccgcaacaaaatgagcagttcaacttgaatgttgaagcagttcaacgcacgtggatacaaaatgaaataaaacatgattgttgtgtgctcaaatcaaaatatccgatgttactataactgaaacaaaatgacagaaatgaatgtccaatgtaacaattgttgagacagaacgacctatgtgatttatcctatgtacatatttttggtcaaaacgtcctatctgatgtttttatagatttcagtgtaatttccaaacaaattgacaaaatttcatttcatacgttgaactctattacactgcttccctctacaagcaacacagtggggaaaaattgtttcattttgatacagtttcaaaatatattttcacaaccttcaagctcgatttactcgaaatgtgtgaattgttagataggccgttttgaaaagttacgcgagaaatgtttggaaggagcttagggcagattgaaagtcccagtatcgctacaaaaaaaataaaaataaaaagtaagctgctggtagaagaatcaatgactgtgattgataattaagctaaagtatgattaatgaagacattcaaatattaggtgattaatgatttgtttgtgattagacaacacaaggtctattatgattattgattccttgtgtcaaatttgatcgaaattttcaatttcaaaataatgattctcagtcgtcttgtaaggctagagaatccatcattctgatcaaaaaaataaaaaccagtgttttcgttcaaatttacaagaatatggttattttcctcttaataaaattacgtcaatatttcagattcagaatgtttctagtttttagaacaagaaaatttagtaggtaataaaatatgagatcgctgtaatttttttatgtaaacgccatttttataaaaacgtgtggaatggacaataatgcagccaaaaaataattcaaaattgctttcgcgaggtgcgtattagtatcacaaagtaacagaatcaaccaaaatattcagcctcttctaaccttcagtctaatgtacgattttttttcaatgcatcatttttcctcccaaaccccttattgtttttaaaataaaaattgaaaatatttgttttgaattgtaccaatacttgttattgtttgaattatattacgaaacatacaaatacttgaattaaaaaaaaaacaacattatttttaacattatctttctttaccacaaaaagtgtgtactttgggtaaccttagtctcttattgtttcacaaatacttcaaactgataaacgaaatcattctctcatattttcagattgctcaacgtgctttggaggcattcacagaactgatcgtgcgccttggtcaagactttaacgcgtatacgtcaacaatcctgccacatgttgtggatcgattaggagacagtcgtgacactgttcgagagaaagcacagttgctgttgcataagctgatggaatgtcgagtggtttcaccacaatcattacttgataagttgactgtttgcttcaaacataagaatgctaaagttagggaggagtttttgcaaaccattgtcaacgctcttaatgaatatggcactcaatcattgtctgtaaaaacgtacatacagcccattgtcttacttcttggagatccggctcctactgtaagagatgcagcagtgcaaacattggttgaaatctacaagcatgtcggcgataaactacggatcgatctacggaaaagagacgtgccggctgcaaagtttatcattcttgaacaaaaatttgacgaaacgaaaaacgatggattacttctcccttcagcaatcagttcagccaatacgaatgatgatgtggacaacgccattgttgcaagaccaaccagactggtaaagagaactccatcagcaactccacgcaagccgctattcgaaacgcaaggatcgggggatttgttagcagctggtgctgtatcagtggaaatatttgaaaattcgttcgaaaatgtccctcaattgacaatattttcacaacgagatatggatgaacatatgaaatccattaatacaattgtaggtgacaaaaatatggactgggaaaagcgagtcgatgcgctgaaaaaaatacgatctcttctaatgatcaacgtgcaaaattcgccaacattcactcaacagcttaaagacttgtcaattgcattccttgacatactgaaagaactgagatcacaagttattcgggaagcctgcataactttggcttatatgagcaagctactgaaaaatcgattagatcagtttgtgatatacattttgcaagagttaataaatttaatacaaaactctgcgaaagtcatatcatcggcaggaataatcgccctcaaatatgtgatcaagcatacacatgctccaaaaatagtgccaatcatcactcagaatctcatgcaatccaagtcgaaggatatccgcagtacattgtgcgaaataatgatcctgctgttcgacgaatggccaacaaaaacattagaaaaaaatagttcactacttagagatgctctacgcaaaggaatatcggatgcagatagtgaagcaaggaggcatagtcgatggtagataatataatataatataatcaaataattcatttaaacatgattcgtttttcgtttcagcgccttctggagttttcgacggcattttccggaccttgctgataatttgtattcatcgttagaccccgcaacgcaacgtatgatggagagagaccgagataatttaggaacaaatggtaccaattctatgagtgttagtttacgaggcagcaatagtagcttgaattctgtccctggtggcgtgataagtatgtgtttagtttctgtcctgcatttataacgtgtgtatttgttggtgctcgtgtcttaaaaaagctaacaaatctaacgtcaacattcatgtttctatattttgagtaacagtttatgtttgtcgtgatgtttaatagaattatcctattttgtattttctttgttactctatgctaacctccagaacgtagacaatcttcaggactgagaagtcccgcttctacacaacccccaggtaattattttgtttaaacaatgataatccgactgtgcagaagcttgccaaataccacatagcttgttctacattttttgcgagtaatgtaccatccaaacgatgagaaattcatgaaacctagtcaaatatgaaattgtttttaccttcttacgcacgcttactttcggaaatggtttcgtacaatacttggcaatttcggaacaggcaatgcaacaagtgttagtaccgaaaacctttcatgtgggcaatccagttcttcaaagttgctaagaactccgtcgctacctaggacatattcacgtaatcgtagtggaattccagttgcgcatcgagataatacagtgccagcgagaggtgttttttattgaatttatatttttattgtaaattacactagtctattaaattgcatatataattggtgtgcaatcaccctttttcaaaatcctaattccgttcacacaattcaaaaattgcggctagaacggaaacatgcgcaacaaaaatgtgattgtattagcagattagattagtacctgtaatattatttattattagtacctataattagtttttttaatggtcttaattccaataatctttttgacggttcttaattccattcctcagttcgttttgtatgcacggaattatgaactgtaaagggtcttgtcgcacatgccgtggttccagaacatcatccacacggaagtttaaccctctctttcccatcatagtgatttttttgccgattttgtgatcgaaatagaatagcgtctaaactgtggttttagcgaaaaagtttgttcagggaagtttcttgatttgtaaaagtgcttcttttgatactagccaccaggtgattaaatcacctaaaagtgagataaaaaaatattttttttatctgttgaagatagacggtcggtgtcttcagcaaagttgtaacacatgttaattcaagacactttgtcgaagacaccaaatttctatctcttatacattacaatattatgtcattttttcttaaaatgacccttgaaaatcaaaattttagtataacttttttctaacatttttgacattttttgtgccttctacaaagttgttcaactaccaaaaatacatgtttttgctgaacattgcaacttgctatctcttatggtaaaatagttatttttaaataatcgatttttatggggcttttttggactaatagcattagtttggacgcaaattgacgcacttagcgatttgtgattttgaaagggctattttatgactttcaaatgacactaagaacttttggccagaagcggtctattgattgttttgttttaactagttaaaccataaaaatgcatttaattgcagtttcacgacttttttctcattttcattgcgttatttcatatgacacatgctgcatttggtacattatggtcatttcattatttttaatttataccctcacctacagacttcatttagcatggaaatgtttttcttttttatttttgttttggtcataacgtttgacccaactttttactctccatagagcgttacgtaatttgtgaacgatgtcatttgtttgtcacgcaacttttatttttgttgctaccatgtaatgtcattgttcctttaaaaatctcgcgacacgcaacatagctaataaaaatcgttttcgtattatacaaattcttctattctatttgttcctacacaaaatttaaacaaaacttatcgtgaataacatgtgtgccgacatttcacttacactaatgcagacaaagtatttgctgatttaaaataaaactgtaccagtgagcctgcacatgaatcagaacttgaagtagaagggaacgtggaaaagaaagcagtgaggattgtttatcagccatgttgcgtatcgcgagattttgaaatgagcatgtttgttacgctcttccactaacaaataatagttgcatgacaaacaaatggcatcgttcacaaattacgtaacgctctatgaagatgcaaaagttggtgaaacgttatgactcaaacaataataaaaaagaaaaacatttccatgccaaatgaagtctgtagttgagggagttaataaaaatatattgaaaatgaccataacgtatcaaatgcaacatgtttcatatgaaataacgtaatgaaaacgataaaatgtcgtgaaaccgcaattaaatgcatttttatggtttaaatagttaaaacataacaatcaatagacagcttctggccaaaagttcttagtgtcatttgaaagtcataaaatagccctttcaaaatcgcaaatcgccaagtgcttcaatctgcgtccaaactaatgcttttagtccaaaaaagccccataaaaatcgattatttaaaaataactattttgcactaagagatagcaagttgcaatgttcagcaaaaacatgtatttttggtagttgaacaactttgtagaaggcacaaaaaatgtcaaaaatgttagaaaaaggttatactgaaattttgattttcaagggtcattttaagaaaaaatgacatatattgtaatgtataagagatagaaatttggttgtcgaagacactaacatgtgctacaactttgctgaagacaccgaccgtctatcttcaacagataaaaaaatatttttttatctcacttttaggtgatttaatcacctgaccgctagtatcaaaagaagcgcttttacaaatcaagaaacttccccgaacaaactttttcgctaaaaccaacggtttagacgctattctatttcgatcacaaaatcgtcaaaaaaaatcactgtgatggtagcacgatccaccgattttcaacgaacgcgggctaaaccgatttggtacgagtagctcaataataattgaaataaatttatacgctcatttgtcttatcaaacatcgaaataagtgacctaagggtcaaactattaaaaaaacaatcaactattgaaaaacattaccttaccttaccagtcaggctaaggcctgggtggcctctgctgtacgtaggagacgtctccattcgactcggtccatggctgcccgttgccagccacgcattctgcgaagggtccgcagatcgtcctcaacttgatcgacccatcttgctcgctgcgcaccacgtcgtcttgtgccggtcggattgttttcgagaaccattttcaccgggttggtatccgacattctggtgacatgcccggcccaccgcagcctcccaatttttgcgaggtggacaatggttggttctcccagcagctggtgcaattcatggttcatccgccttctccacgttccgtcatccatctgcactccgccgtagatggtccgcaacaccttccgttcgaaaacaccaagggcgcgttgatcctctgcacgtagggtccatgtttcgtgcccatagaggagtaccggtctaatcagcgtcttgtagatggtcaacttcgtgcgatggcgaactttgctcgatcggagcgtactgcggagtccaaagtaggcacgatttccagcaacgatgcgtctctggatttctctgctggtgtcgttgtcggcggtcaccagtgagcccaagtacacgaattcttcgacaacctcgatttcatcaccgtcaatatgaactcgaggtggggggcgtgccgtgtcttctcttgagcccctcgctatcatgtacttcgtctttgacacattgatgttcagtccgattcgcctagcttcagcccttagtcggatgtacgtatccgccatcgtctcaaagttccgtgctacgatatcaatgtcgtcggcgaaaccaagtaactgaacggactttctgaaaatcgtgccactcgtgtctatccccgctcttcttatcacaccctctaaagcaatgttgaacagtaaacacgaaaggccatcaccttgccgtaaccctctgcgagattcgaagggactcgagagtgtccctgatactcggactacgcacatcactcgctccatcgtcgccttgatcaatcttatcagtttgtccgggaaaccgtattcgtgcataatctgccatagctgttctcgatcgattgtatcataggccgatttaaaatcgatgaataaatgatgtgtgggtacattgtattcgcggcatttctgcaacacctggcggatggcgaatatctggtccgttgttgctcgttcgcccataaatcctgcctgatattgtccaacgaattctctagcaattggtgatagacggcggcatagaatttgggagagtaccttgtaggcggcgctcaaaattgtgatcgcacgataattggcgcaatccaacttgtcgccctttttgtagatgggacacacgacaccttccatccactcctccggcaatacttcctcctcccaaatcttggaaataacccagtgcagcgctcttgccagtgcatcaccaccgtattttagcaactcgctaggaagttggtccactccagcggctttgttgtttttcaaccgtctaatctccgtttctacctcttggagatctggaggcggaagtctttcgtcgtccgcgcgtgctcccaaagttatttccgtgccacctccgctactggccacatcaccattaaggtgctcgtcgtagtgctgccgccacctttcgaccacctcacgttcgttcgtgagaagatttccgtcaaagtctctgcacatgtcggcttgtggcacaaagcctttgcgcgaacggttaagcttctcgtagaacttccgtgtgtctttagcgcggaacagctcttccatcgcttcgcgatctcgttcttcttgatggcgcttttttcttcggaagatcgagttttgtctgttccgcgcctttttataccgtgcctcgttcgctctcgtgcggtgttgcagcattctcgcccatgctgcattcttctcattcttcaactgctcgcattcgccgtcgtaccagtcatttctctgattcggggtcgctggacctagtgctgctgttgcggtgctacctatggcggatcttatgtgcctccagccatcttcaagagtggcggcgccgagctgctcttccgttggtagggccacttccaactgctgcgcgtattcttgggctacttctgagtcccgtagccgctcgatgttaagccgcggcgttcggcttcgacgcgagtttgtcaccgtcgaaagttttgagcgcatgcatatagcaactaggtagtgatccgaatctatattcgcactgcggtatgtgcgaacattggtaatgtcagagaagaattttccgtcgattagaacgtggtcgatttggttctcggttaggttatcgggtgatctccaggtggtcttatggatatctttacgggggaagaaggtgcttcggactaccataccacgagaggctgcaaagttgacacatcgttggccgttgtcgttagatacggcgtgcagactgttccgcccgatcaccggtctgtacatctcctctcgtcctacctgtgcgttcatgtcgccaacaacgattttcacgtcacgcggcgagcatccgtcataaatctgctccagctgcgcgtaaaacgtctccttctcgtcgtcgggtctcccttcgtgtgggcagtgtacgttgatgatgctgtagttgaagaaacggccttttatcctcatcttgcacatccttgcgttgatcggctgccacccgataacgcgttgtcgcatcttgcccaacactatgaagccagttcctagctcatttgtggtgccacagctttggtagaaggtagccgctcgatgcccgcttttccacaccttctgtccagtccaacaaagttcctgcagcgctacgatatcgaagttacggggatgtagttcgtcatagattacctgtcgcaacctgcgaaaccaagtgacttgcagttccatgttccaagtttccaatcgtaatccttatttcgtcgcgtgggtctttgccgattgttccgggtcgtattatctcctatgttattcgcaataaggttttttacgggtggcttattgggcctacgccaacactcctgtctcgccggagcgccatcgtgccagctctgtttaacgtcccaactaacactaggacgatcgcgctgatggggctaccttggatttagctgtgcgcgattcagcatttcttgctcagccgctggataccagaacagaccctgtttgagccgcacctcctggtgaacagacgctcgagacgtacctcctcaatctagctgatgtcagaaggacaacagtgcccaggctgcactaccagctaagtacgcaactcttagctggcggtctttgtcatcgtttgacccgtggaagcgtgaggtagaaacttgtgatgaccagagctgtgttgaacgctccttccttgttgtcgactcaccgttttgcagcccctattgaaaaaaaaaaaaaaaaacaatcacttttttattgtggttttgaataatatagcttatttgaaacaacttttgttcaagcacttatttttgaaacgccattttgatagctaaattgtcgaataaagctgtgggaaagaaagggttaaattatccctttttatttgatgctaaatcagaaatgatctgtcataaaattccatacatacgcggcatgttgcgctttaaaaagtttgcctggaattggggcacatcacagtagatcaatttatcttggcaccaaaaggaaggagccagtcattttgttttgttcttgtttgaaaaaaaaaaacgaagttcttgtataaaacacagtgtagtagttaaacaatcaattttatgatagtgtattgctttgtaggttttcgaaaacatgtaatttaaaacagaaactccgggaaatggattttcgggacatatttttccgataaatgaaacacaactaaacaatgcagtgtaaacgtaaagatttgctgttcattttgcttggctacaacgttgtttagattttcatcaaactttgttcttcttatgtgttatatgtggtttcttattctatgtccaaatgttttgtgtccaacatttcacattaagatacacatgaatcataaatgtatcaattatagttattgtgcgatgattgtggatgattggattcatattttgtgaattataaagttttcattagatgaatattgaactcgccaagggcgaaaagctactataatgaagtaaatagacttattgtatttccctctccctatacttggtacaactttataactttgtctcttattttgatgttttgtttattctgagttaaatgtgtacattttaaacaagacatccacattacattacattaaaacttttgattttttttcttacactacagtttgaacaacacactttttaaaataccaaaaaaaaacgctgtatacatacagtgtcaagcatgtcgtacgacaataatttaactaaacacgttaaaggagtacattttttttttgaataatgtgttatacaatgtaatgaatgctcaaagccttgtactacaaatatataaatttctttcaatttagctggcttacgtagcgtttctgcggttgatactgctgcagcccaacgagctcgtgcaagagcccagtactccaatatggcacgtatgaaaatatcatcaggatcagcatcactgcgtaagtacattcgatttatgattttattgttgttgtaagtaaatgtaacattaaattcgacggttattgcattgaattcgtgaagaacaaattcacaattgaatttcacattaaggcgaagtagaccgccattgaaatttgtacgtgtcgttgatgattgttgcttattcatcttacaatttcgaattaataaaaaataataagttttgcactgacatagctgtaaaagtatcagcataatttctgcatataagcgcacacagtgatactttttcaaatcaatatgaactatgagagataagtttttattattttggaattgtaagctgttaagtcagcatggctgccaaaatgaatggcaagctacttagtctcaataaagacaaaaaaaatgcttccataagcttgaaaaagaaaccaattggaattaatattattaaaatcaacatgtatggttcaacaattcggtagaatttgagatgatagtttgaactgcaaaatttgatccaataaatcaaatcattatttaaatgtgcagtccgcctaatgatgcacatcacaaaatagttgttttcaaactaaatgataataattcttttttatcattatctattcatatattcatctaccacgcagaaggccaatacgctcagcaaggtaagtattggaaaacaatattttcaacatattctcatttctatttttaagactattagacgaaaaaacgagcatctgtttgagctttgtgttagttttaaataccgcagtctgtcctagttttgtgctttaaaatatagtatacacgctccccaccaagagtatgaaatcgcttgcaataccgttggaccgatttcacactttcgaaaatttaaatacctatacttacatccaaatgacgcattagaagtacttacctacccaaacccccctattgtgcgattatcttattatcccatatggtgaatgaatccaaaaaaaaggcaaaaaacataaaaggatcaattaattgcaaatcaaatttagttttatatttttgcagttttgccattgaaatttacagagctttgtttaactatttttggtggaataatggaaacttaaaaatgcatgactcaatatagcagagattgataaaactcagtgatagatgtatcgtttgttagttctgctttcgttttcattgaaggctttctttccgcccaataattatgattgttttgtttttatttcagcgcgggctaaaaagataccactttcgaacactccacagcagcctccaactcccgatcgaaaaattcgctctagatctggcgtttcccagtctcaacgtaagcataaatgttaatatattattaaggtgtatatgtcttataattccattttgttttcagcaacttcgagaagtacatccccctcaagtaaactgcgtgacaactttggcattgcttcaatttataaacagaccggtactattccaaagaaacattctggcattcctcgctctttggttaattcacgtgaaacaagtcctacaaggtgagacgaggttacattttttatgagtacaatagttaaacattacgaaagaaacataaaaatcaaatcaagaatcaagtaaataaaaatcaatgaattatatttcccatttgtatatttttccagaggaacacaatttggatcgctgcgccgtaacgcatacggaacaaatagtcccagaagattagatagacctccggtgaatccagctcgtcctgttttagcacagaagatattacaacaaagcagagaagccgagagtgctttagcagacgcactttcgccggatgatcatgatttatctacggacttttctcgtttaggactgcataggaaaatatcacgtgacgaatcggatgaaagtgaagcctcatctgtttgttctgagagaagttttgactcctacagaagaggaaatgatgtatgtataattgtttaaaatttttatccttgtcccttttttaatagactgttttcaatattattccatttttgtataattttgcctttcgtaaaaatgcacttttcaagaattagtgcccttcgaaacgttacacgttcatattttgacctttcaaactctcttctcaaagaatctacctttaccttctaccctggtttaagccgtaatagacatgacaaccctagttgagtaatctaccttttgttttttgttctttcaaatcttgcatctgatttgaacatgttgaaatcaaatcttaatttagatgttgtaaatgtgtgaatttaacttaacaaaaatgcattttgagttcattataatttttgtttctgaatttcagtcgttttcgtggaatggctcacgaactcgtttggacagctcacgaactatgattgaggatatcgacacaattatccagttatgtgcatccacacattggtccgagcgcaaagacggtcttataaacctcacacaatatctgagtgaaggaaaaatgctaacttcacagcaactacaagtataatgagctaaaaaatcacattccaaactcgttacattttatttattttttcagtgtgtgttggatttgtttagaaaaatgtttatggatccacacatcaaagtgtatgcactattcttggatacagtaaatgaattgattctatcccattcaaatgatttgcacgactggctgttcatactacttacgcgactattccaaaagcttggtggagacttattaggatcaatgcacgggaaaatctggaaaactctacagttgatctacgaatattttccagcagaacttcaaatgcaatgtgtctttaggtatgtagacaattgaagaggctatgaaggtgtacaatattttatggtaaagtaagtgcattttatgatgtttcctatttttgatcttgttcatcccattgaagaaaaggtcatagagataaaaaaaaatcaaagacctaatcatctaaaagatttaactcgtatctttcacactcgccgaaaacactgagtaacatattcaacgtaacacttgtgctctaaaaaacgggatggaaaacaagctttgtagaataagtggacgcagtgaaaaattacactatatataagtattgcatttttgtagcgtagtagataattgttgaatattgcgttcgattaaaagagaacatcttttccattgtacggccaaacagccgactggtaatttgtaatttgtgatcctgaagaaacgatgcgaattttttttttctaaagtcattgcaacgttaaattttaatcaaagaactttttcaaatttcgtaaaatgttgtacacttctagcgtatatttctcagagcaatttttaatgttttactgtttttttcttcaagaattcttattgatgctgcccagactccaaataccaaaacacgacaagcgacgttaaaatttttgactacgttagcaactacatattgcactgcggcacagtttgtaacacatagtcagacacaacagttagtcgatagagcaatcttaaagattgtccaaacttctcttgatcaaaaaagtctcgaattaaaatcacaggctcgatcctgcatcgtagctttgtataattgcaatccatcacaggtaagttatcagatcttgttttttttccgtaccttatatcattttctttttagatgacaatgacattagcgaatcttcctaaacaatatcaggacacggcaaaggcaatcatacagcaccatatgagacgaagtacctcaggtatttaaaactttttttttgcaaatcagtaaaactacttttaggtaaggcacagtggagtgagcgaaaagtgaacgacagatacgggttttcaccctagctttttctcttaatttcccaagactagttttgcattaaaaaccttgaagtatatgccatgcttcagatcacgttgatgaaaaagctatcaatttcgaattcaaaattgtcatctattattcgaccatcattttttttttattttcaacttaagggtaatggagaagtattgaatttgcgtcttgaattgatacaattttataactatacccatcaacagtgaaacagatctacaaaataaaaatttcaacaaattcttcaggctgccagcaacgttttgcttaaagtcagcaaattgtgctgaaattccagcttttcaaaagtcgtcagcttggcaaaaatcagcgaaatattgcttaatgggtttaacgtgtaatgataataacaacgaagtaataatgacctttgaaaaggaatgtcaatattgtttgttggtttgttgttaaatcgatcaaaatattatattttagagttatctataacgatgatatcacaacaccaaaaaaaagttttcaattggctatctactaattcaaataaggttatttattattataaaatcaatggatagaaatggcgctgtggataccatggtatacggtagttgtcgtatgaaatagatttaatctttttccacaaccaagtttgaaattcataattttaaccgaaactctgtcagtgcccacaactaacattcttatagaacaatctaagaactgtctatctgtctgtctactaactgaagagtataagaactggctccctaataaattttacaaacgatttctcctacaactgaacgatgttataaagggctagatcaatcgtagagaaaattacatgtaaataccgctcaaattttgaatctttcaaaagatttgcacttttttttgtgatgtgaaaacatagatgatccgacttttgcccctttttcaaaacattgttgggctgtccctagaaatgcaaacaatttatcagtgttatttacagacttctttgttgtcaagtgctcgttaaaatgttaaatccaatacagcttgttttttaataattaagattatttcaaattacgacgttattttctagtgatgtcgttaaaatataaatacagtcagttttttacgcggtccaaataaaataaatcaaaatggtcttatgttttgatgattcttcgagaacaaccgagacttttttcaagcggttgaaccgagttttttactcgatacttgtcccccgcgttaaaaaaacctgactgtaaacgccacatttaatttgaactatctgctatttgttttacaggaactgacagtccgtcgtcgccgctttcatcatcaagtccaaaacctctactgagtccgcaacaggggttgtatagtttacaaggcggttgtagtaagtgtttatttttttaaatcattcaataattacatttaagtacataaatttgcattttttatctgtaacaacgccagtgcccatacaatcttcaaccctacagtttgcctttctttactaacgttgattaaaatttgtaaatttatgtttaacctatttgactcgtttttttcattacaactttgatgatggtcacatttatgaagcattacctttccaccagatatagtgtgttcccaatacttatgaacattttttcattctcgttcttgaacttctttcatgataacccaatcgcacccgattcagtttctgcacggattttttttaaactgccgtgcaaaaaagtttccatacatatttttccgccaaaaaccttatttttgcatgaaacgccgagaaatggcgttactttttttgcacggtttttgaaattttgaaccgaaaactttttttgcacggtacgcacgtacttgcacccgtgcaaaaacataatcgggtgtaatgtttctatttttatacctccaacctctttttacgtccgtttttttaccgacggttctttttccgatcacttttttacgaccgaaattcagattaatgaccgtttttataaattattatcattatcttaaaaagtattcaaaatagaggatcatgatgttcaacaaaattgatcagtagttcaagggctaacatatggtggtcattgaattgtgaaattctgccactaggcggcgttagtgagcatagaaattttgttttgcggatatcttaggatcctggccacttagaaacatggcgccttcgacaaagttgttcagtagctcaaggaccatcattataaaggatatgaggttcaaaatgttgccaccaggcggcgctagtgggcatgaaacttttgttttgcggctatcttaggatcctggccacttagaaagatgacgccttcggcaaatttgttcagtagctcaagcgctatcattataaaagctatgagattcaaaattccgccaccaggcggcgctagtgagcatagaacttttgttttgcggatagctcagggtcctgaccaattagagatatggcgtcttcggcaaagttgttcagtagctcaagtagcggaatttggggcaagtgtgccatagggacaagtgtgccacccctgattgttataaaaaatacaaactatattttttatttgagctcaacaatatgttcccttatagttcataatacaatggtcaaaatatgacgaaaattgctttatttttcacgtatttacatcggcttttgtggaaatcattaaatttcagtgattttttataacatttcgttgtttttaaatagcatggtgagaggtaaattaataacgaatttttcaaacgtactgtacatcgtgaagctatacaaacgtgtaaataattgtggtatttgaacgaaaaaaatatttagttttacatacgaaatctattttagttgaaatctatactttttggggcaagtatgccacctatttggtaaacaaaaatggttgaggtaaaattcataaaaatataaacatcatcaacaaaatcataatattgaaccaaaatgaggcaccagtagtggtttctgaagtgtagaaggggaatagcgaacatttttgctcccacagtgatttttttctaaaaatattccataataatatggttttaggcgttttaagaactattttacttattttcatcaaaattttaccgttattcagtgctgatctagtgtaatattatacagatcccccgtaatgaaagagttattcatatattatattgtattgaatggagacaaaaataacgattttagttattcgaattgactagtagagagttccgcatgtgatgaaccttgtagtaaagcatcccctcatgacggtaaacataaaaatatttttaaaattatcaattaggctctgttttgttagcaacattaacaggaaataaagaaaatttcattacaagtagaattacatgaatgtttattcgatggccgtcttgccccataagggtggcacacttgccccatagtgttgaaaatcaggttattttgaatgatatttgaggagctccaaaactaatactattttaaattattttctttttcaatatcacagtgcttatgaaaagatgtgaaactaacatcatgaggctgaattggtggtttttttagctttagacaaagttagagaacaatttgcttaaggtggcacacttgccccaaatcccgctagctcaagcgctatcaaaatgcttgacgtcaaatgaataaaaaaaaatataaaaaaaaaacaattgttcagtagctcaaggactatcattataaacgctatgaggttcaaaattttgccaccaggcagcgctagtgggcatgaaacttttgttttgcggttatcttaggatcctggccacttagaaagatggcgccttcggcaaagttgtttagtagctcaagcgctatcattataaaagttatgagatcgaaattttgccaccaggcggcgttattgagcatagaatttttgttttgcgtatagctcaggctccagaccacttagaaagataccgtcttcggcaaagttgttcagtagctcaagcgctatcattataaaagttatgtgattcgaaattttaccaccaggcaacgctagtggatcctggccactttgaatgatggcgccttcggcaaatttgttcagtagctcaagcgctatcattataaaagctatgagattcaaaattccgccaccaggcggcgctagtgagcatagaatttttgttttgcggatagctcaggatccagaccacttagaaagatggtgtcttcggcaaagttgttcagtagctcaaggactatcattataaatgttatgagattcgaaattttgccaccaggcgacgttagtgggcatagaatttttgttttgcgtatagctcaggatccagaccacttagaaagatgccgtcttcggcaaagttgttcagtagctcaagcactatcattataaaagttatgtgattcgaaattttgccatcaggtggcgttagtgagcatgaaacttttgttttgcggatatctcaggatcctggccacttagaaagatggcgctttcggcaaagttgttcagtagctcaagcgctatcagtataaaatttatgagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcttgagctactgacactttgccgaaggcgccatctttctaagtggccaggatcctgagatatccgcaaaacaaaagtttcatgctcactagcgccgcctggtggcaaaattttgaacctcatagcgtttatgatgatagtccttaagctactgaacaactttgccgaagacgccatctttataagcggtcaggatcctgagctatccgcaaaacaaaagttctatactcactagcgccgcctggtggcggaattttgaatctcatagcttttataatgatagcgcttgagctactgaacaaatttgccgaaggcgccatcattcaaagtggccaggatcctaagatatttgcaaaacaaaagtttcatgcccactagcgccgcctgggggcaaaatttttaacctcatacactgagagcagcattgcagtaaaaattaccatgttgatggtttaaattaaatacatcgcaccacttgatttgtgcagactacgttacacattcatctcaaacgggatgtgtggtcttttttaccatgccgacgatattcgaagcatgagttaaaactaccatgctacatggtaatattgagaacgaattattgtcaatttttttaccatgcgatgcgtttaaaaagacagctatcggatagtaaatttgaatactctttatatttattccaactttttttaaatcaatatacctattccattactaaaatcataatcgtttatttaataataatgtctataataatttattgctctttaatccataaaaagcgaatcttaaatatgaaggcggcgcttgtagtgaagtcctgtaatgaatttaatgtccgtatttcctttcaccgatctctgatccacgattatggcggctaatttaacttatgctccacatcgcacgagttatctgttaaaaacaatgtgcacgattaatatcccgtcaatttacaaaaagtaacaaatcgatgattggtagaatactcaccaagaaacatagtataaattaatcttaattataatttggataacttaattgggcctggaaattgaatggtatctcctgcaacataaaaaaagaacttgttgagcgaattgtttgttttgtgtattaaatttcaatatttcttacaaactccagatcaacagcaacatggatgcaatattatgaaaaataaacaaaactttgttcaatattacgcccaaaacactgaaaataatactttttctgtccacacttgtgttaacttttcacaaacggagaaaaacagccatgttcaagggggcattattacttcgcttttgttgtttaaattaccatgcacatggtaaaaatgataacattgttcattaaaaattacggatctttacctccaatacatgacaatagtgcacttgactgcacatggtagtaaattttatccattgctggcatagtaatttcaacaacatttcagtaattataaagacaaacacattaaatttcaacataattctgaatagtaattttaagaaccatgaagtggttgtagttactccaacattaatttcagtgtagcgtttataatgatggtccttgagctactgaacaactttgccgaaggcgccatctttctaagtggccaggatccggttatctgcaaaacaaaattttcatgctcactagcgccgcctggtggcaaaattttgaatctcatagctgagctactgaacaactttgccgaagacgccatctttctaagtggtcaggatcctgagatatccgcaaaacaatagttgcatgcacacttgtactgcctggtggcgcaatttcacttaagcagtgttgccagctacgataaaaaattttgaacccttcatgaaaaactggattacagttgaagagtattgctatgttgctaagcattatatttttctgttccgttcaagtttgatggttttgatctttactttatcattcttaaacagtgttgccagccacatgaacatttgtgattcggccgactgtatggcacgcaacacttccttcaactttggtgaacattcggtatcgttatctttaaatttttttggtatttgcatatcacacccccataaaattggctcttttgataacaatcgagcagtgttgccatctattaccaaaatatgagaacttgagcggccattttggaaagttctcaacccatgcttcaactttgccgaatatctcgaatcagtatttccgcatctagacgttgcatttttcaaaaatataattataaccctgatttttttacgaccgatttttttacgaccccccgataacggtcgtaaaaagaggttggggtgtatctctatcaccttgctttctggtaagaaagtgattgcagtcataaagattatggcaaattggctcctattatattgcattcacgatgaatgttttctttttaaatttaattcaaacaatggatgtttacgttatttttttttcagattctagatccagacaaatttcaattgatgtggcagattccatgaattcagaggaggtttataaaaacctacgtaaaactactgccgagatacaaaattacagttttgaggcaaaacttgacagagatgctaacagtaaagattcaggaataagtcaaatgggagaagtacaaatacaaaacaatgagaattatatattgggatcgaatggtctaaacggacatgttgggtaatttatatcgacgtaattcaatgtatacgtgataattatatcgaaatattcacagtattgacaaggatgactcgtgtaatggatctaaaacgcaatcagctactaccactgagtccaatactccagaaaacacagtgcgtctagatagtatcgacctgaatcaaaaaccaacaattcattcgcagcgacagcatcaatataccttaacagacacgggagaacttattgtagaaggtgagtaaaatgtcttttaaactaaatggctcaataacaattatcattatgattaaatttcattcacaggtggcattaaagagaatgacgtcattaaggcagcgatagttctgtcgcacgaaaccagtcctgaaacatgtgtacaagttttagagaatttgcaaacttgcattaaacatggaaactgtgaattgccaatcaaaaattttaagtatgcagttatttcagttaatcatttccctatcgtaaccgttcatttttgtattattttagagctattatgaaaatgttactcaatctcatggaatcgcaaaatttcgcagtattgatcgtagctttgcatacgctcggtcggatcgttcgtagtgctgaaatgaagtcgtgttggagtaattttttggagttaattttattaaaaataatcgactgttataaaatcagcaaagaggtacatttattgtatattgtaaaatattcgataattattatttgttgtttcacaggtatcacgagaaatcgacataattgtagtcaaaattgcaagtgttttaccgttagatatttctgtaaatatcctcaatccggttatcgcaactggggactttcctgcaaacctatgcgcattgaaaattttaaaagaattagcgcacaaacagggcaaagatttaacagataatcatctggacagcataatgccaaacatagctagggtatggtttataaatttgtagttttgcaattatccgaatttaacattcaatattcattacattccagttagctgacgacagtcaatccatggtacgaaaagcagcagtattttgcatggttgagttatatattgtgatgggcgaggagaaggttaaaccgaaatttgcacttcttaatgctagtaaaataaggtacgtttttaaattgcaaagttttacccataaaacattacttttgtatttgtaggttgcttaacgtttatattgcgaaatcgatgagcagtaataagggatcgagctcatgatcaaaacaggccatgtgatttctgttcaaaggacgcaaaatcgcaaaaattctatgtaaatttggtagaaatatttcgattattcatgaataatatttatttgacatttaccacttgaagttttgctatttgtatggaaaatatcattaatactataatataaagtaggtcatctagtgttgagggtcacaaaaagtggggtgcaaaaagataccttctcttcatcttgaataactgaagataatgtatcgttttgattcatattacggaaagcttcatattccgtacactacacgaagcgtttcaatttttgccgttcaaaagttctctttcgaggctcgttttactaagcatatatccggcgtgtatatgggaaaggtttatcactaaaaataggcatcgctaaatctttcaccattcaaaaatataggtttttagctttcatttgacgtgttccccaaaaaatccaccgagggatcccgaacatttttttttttcaaatttaaagttttgttccttagagtacattatttttaaatgttacgaggtcgaatgttatggagtggtcacggagcacaatttgactcgcgcagacatcatttcgggagctggtgggtttaaaaatcgtgccgttccgctggctcctgttcttgatgccaatcaaatgaacaaagtgttgcctgatggctcaaaacagccttcaaattcgttccatgt

SEQ ID NO: 140 - DNA, 2820 bp, Aedes aegypti
actttcccacctaaattgtataagtctatggtttcattatcgtatcaccctctctcaatattcccatcaagacaatttgatgacggctgtcctcaccaattcatacctttttcattcctagccatcctcctgttcctctaaaaataagtatcatttgtccattgacttacccaaacgtcctcttcgcacctgattatgaccgaaccgaacaccttgaacgcgacggaaaaaatgccccaaaatccgtgtcgtttattattaattttaccgcattacacccggattagtgcaggcattagtgtcgattttctccggtcctctcaaaacggaacaacaaaactgttgcgtcgacgactccatggtatcagatttcacacaccgccaataaagctgcttcttcgaaaatcacctgaccgggctcgattgccatcctgctcctcctaatccaataaacagcttagcggctcggcttccactcgataataaagttttcttttctcgtcttccatttcagactatgatcgttgcgaggtgctgagcgcccaacacccaacccggaatactacgcttaagaagaattcatcacaaatttgtgaaaaaatgcttcgcactaccgcatctaggtcggtccacatgggcctaataatggtgctgctgcttggaatcctggttccggtggttcccatgtggtcagcttgtcccccaccatgtcaatgcgacgacgacacactggaggttgtgtgtggcgaaggactcctggacgtgctgccgattgtgcttaatccatcgctaaagcggctcaccatcaggaacaataaaatcaggggacttgattcgtcgatacagttctatacggagctgagatttttggatttgagctacaatcatgtgttcaacatgccaccgaaaacgtttatgtatcagagaaggctatcggagctgcacctgaatcacaacaaggttggatcgatttcgaacaagacgctcacgggcttggactcgttgacgatactgaatttgagagggaattttctggatgagttaacggagggaatattcgtggacttgaagaagttggaggagctgaacttgggtcagaatcggatagggaagattgacccgaaggctttcgacgggttggtgaacctgaaggtgctgtatctggacgataatacgctgagcgcggtgccgtcgccggcgtttggaccgcttgtggctctggcggagctgtacttggggattaattctttttctacgattgctaaggatgcatttgtgcagctggataagttgagtagattggatttgaggggagctgcactagtgaatgttacccgagagacattcagtggattggatgctctgagagtgttggatctttcggacaatcgtctaaaccgaattccaaccacggagatggccgatttgatgcggttagaagagttgtcattgggacagaacgatttcgatagtattccgatgggagcttttgctgggttggcaaacttgagaaagattgacatatcagggtctttgaaactgagcagaatcgagacgggagcgttttcggctaatgccaacctggaagaaatcgtgatagcatcgaataaggctctgacagagattcaggagggagcgttgagtgggttgccacatctgaagagactgatgctgaaagacaacgcattgacgacgctatcggatggtttgttcacgtggaatgaattgatcgatttggacctgtcagagaatccaattgcttgtgactgcaggattttgtggttgcggaacgtgttggtgaataagagcaacagtagccagaatcagaaccctgtggtttgcgcttcaccggatagactgagagagcaaactttgcaagcattatcgcctgaattgctcggctgttcacatacagacccccaacaacaagcgattatttgcgctatactggttgcagctgctgcattcattacaacattggcactggtaatctacaaatgtcgaaggcgaatccgagaggcggtgaaaggcagatggggaaacagtgccatcggtcgaaaggagcgtgaataccagaagaccttctccgaggaggactacatgggtagattgccgaatccgtgcacgatgggaggggtgcatacaacaacgttgaacaactatcaaatcaacaaccaccactcgcatggaatccggcacataccggtaacggaactatagctagaggctccccctccaccgcctcggaggggaggttcacagcatcaaatctgtcctggcggcagtgccaactgtaacggaatggcaacgaccttcctgcagctaagtcaggaccatctgaagcaaccgggaatgaaactgttccccaattacaccccaccgattccaccccatcacaacaacagcaacagtagcagtagcgcaacgacagcaacgacgacagcttccggcaacttctcgacaatgtccaacaatgtcaacaaccatcactaccatcaaatcacctaccagacgcaaaccctcgcaccgcttcggctaaaccaggaccatttcagcagttcgaaaacgaacactcttggtggagtcgtcggcccaaacggccttcccaatggccgaccaaaatatcagacccatcatcatcaccatcaccaccaccacgatggactgcaccacgagcagcagcagcaccaacatccaccccatcatcccctatcctcggaccacgagctggacgtcgatgggtgcagtcgcagtgccagcatcagtgcggccagtggctgcgataatgaggatgacagcaatagtgcgaccacatcgcct

SEQ ID NO: 141 - DNA, 40149 bp, Aedes aegypti
tcaaagcatcgaaaactggagtatcatttttattagttttcagatttcccttacacagccacccactgatttagacaaaaaaaaacactcacactttgactagcgcgcgagtttcattctcacattaataaaaaaaaaacttttttttaaattaaacacagaaaaactcccacgcagtcatcgtcatgatgcaggcagcggcggctccaataataataaaatcaaattttacggggagccgacgattgtttggacgcttttgattccccccagccattaccattcatctgaatcgaattttcaaaagcgaacactcacacaaaaaactgcatcggggatatcagattttccgcggaggcaatccacggtggcaatttttaattaaaatccaaattaaaaatctcttatcgcccggtttggattttgacgaaccggcgaacagccggagtcctgtcttccgagagtttatcgaattcaaattacacattactttgagaccgttgcaagtgcatccaagcatgccgagcgcgtgggtgcacgatctcccctcaaccaactcgcatcgacatctcgtcttcgatgatggaattattgaaatttatggcttctggtattgttattctacgagtcgcgcgctcgcccgcacagtcaattcagttcgatatcatgggaaaataaacatgttttacacaaacacaaacggtccctccctactcgccccagcttctcgctcacttgctttgagagtgtagtttttctttagtttttctatgtcgttggaaccagagaatttgtttgcattagagaagcatgaagactccaaaagaatcgttcaacaagtgaataggccttttcgttcaacgtttatgtgcacatacacatggcatgcaattattgggtcttttcatgtaacaaatctgtgtcaaagcagctgatatgaaacgcttttgaaaaatcctatctattacataggctttttcgctttcaaaacagcatattataggccttatcatgtgacaggttcttctatgccttttttttacatcggtggatgacccacacatacacttagggttcattcatttatttcataacgctgaatttggccattttgggcacccaccccttctaacgctttttgtatgaatgttattcaatttttgtatgggccgtaacatcgctaggacacaccccctctagcgttgtgaatgggcccttagctgcctttgccgtagaaatgtttaagagcgaaaatatttttctaatgcattcgaaaggtgaagaggttttggtttctcatgaacgactcttggaatgacactctcacataatccatgaattgatcgttattgtgattattcttatcgatcacacgcttctctagtgaacaccttctctgcctggaacattgcggagcgctttttaatgtgttccccttttgttcttgctctcttttgtatcgccctcgttacaggatcaccatcgagcggtcagccgaagcccgcttcgtcgccagcgacgagcagctgcagcaccgctacgaacgtcccccatgctattaacgcttgtcacgctagtaacgacccgccaaacaatagcactgctaccagcgcctctagcacttgcaacaatgacagtcaaaatctcaccaccacctgtagtagcactagtagtaatgaaatcaactcggctccgagccgaccggtatcgagtccaactatcgtgccgccatctccgcaatcgatcccagccgccccaactccgactccaactcccaccggcggcaacagtcttgctcagctcaactccttcctttcgcctgccttggcaaatgttgaacagtttggttcgtttttgggtgaagaaatcgtcagcacctggcgacgtggtctggagttaccgccacctccaccgggcctggccgctgcagccgcagccgctgccgccgccgcagctgcccgcggtcatccacagctactaatgaaccatcatcctcccacagatctgacccatcacgagcaggacaaagctagctcccatcatgataactcctccagcgctagtacaccaattctgcaagacacctcccgccacgaagaacacatgaacggcggaggctacacgccgatgcgaatgtccaagagtccactagaggacaataacaacaccttgggtccactctcgcacccaggtcctggcctaatacaaggcttacccttccaattccaagagcgagggcattttcgctttgccgaagatctacaactgccaccggggtcgatggctggacgccttggcgattcgctcatccccaagggagacccgatggaggccaagctacaggaaatgcttcgctacaatatggacaagtacgccaatcagaatttagacacgttgcacatctcgcggcgggttcgtgaactactctccgtacacaacatcggtcaacggctgttcgccaagtacgtgctcggcctgtcacaaggaaccgtatccgaactgctctccaaaccgaagccatgggataagctcaccgaaaaaggccgtgacagttaccgaaagatgcacgcctgggcgtgcgacgaaaacgctgtcctcctgctcaagtcgctgatcccgaaaaaaggtaagtcatcgtcttgccaatcatttttcatattagggaccttcccccttctttacattgtatccaaacgaagtccagacttttgctcgcgtcatcgtgcctcgcggagaaattcactcgacccgagcactgttattatataatttttattattatcttcattaggaatcggcccccggggaacgaccgtcgaaacaattgccatttcctatccctcccaaaaaaaaacccgcaacaacaaagcaaaccgggtgcaattaaaaattcgccattttttgtttggtactcttcgcacctgcactcgcgtatcgtggccaactattctgaaagacgattttaatattcgaagctcaatgatacacccctcgtttccaccgcctgacgtcaattccacacgaggggtacgagagtgattgcatctcgttcgaaatgcgccctcggaagcataaataatattttattaaaaaagtttcgcccggcgcaagaagacgatccgcgagcgaagcgcattcccgacgatggtttgaggggcatctcaatacaaagtagcttttctgccgcggtacactttcctatcccccacgccgtccatggcgaccgcctacttcctgtcttaccaggaaagcgatctctgatatggcagtgtctatgcgcgtttttcgggcacgatgctattcaaacagatcctcttgactcggcgaacgttgcagttttttgccacggcttgagaaactcttgctcctcccgtgtgtatggaaaagggtttctggtatttatctttcgtcgaagaaccttcaattgcaacggatgcgctccgactttgccgacgagcaagattaatatcaaaaattcaccaaattggcagattttcctccgaagtagaaacagagactaatgagtgaatgaaggtctgattgctgactgcaacataacctcgaaagcagtcgaagcaatccactcggaagtgcttcggacgactttgatcccgttgctcaaaagaatcaaaaaatgctctccacttgacttttgtacggtgcacaactgcgaaagggcaatcatatccggaccccttccagctatgatttgtgcgggattttctgaacagcaaatctcgactggtaaccgaaccggaacagctattgattcataattaaaatttcattgttttcctacgcccggatggtaggtaactcttcccacgccaacgcagccgtcacaaacgtcaatctacgcgggaatccgtactctgcagacgaccgatggatggaaagaagtctttgattaatcataaaaatcggttccgcgtcgttgggtccatcatcgtcatcctcgtcgtcggtcgtcgacgttttcaaagtgagggcgaaacaacaataataactgtttgaaaacaagtggcaatgttcctctcgtccgcagccaccttcctccaccttagctgccgcagcccattgtgaatgtcacttttttcaccacgaacgcaaccattgttatttgcgtgggtaattattgaacggttgctttgatcggatttccgatttgaacgattactcgctcccacttttcagtccttcgctggatgattaatagtcggtccgattaagtgagtttttcgggaatgacagccgccagtatagagctgtcaaattacccggccaaattggaaaagaactttgcaacattttcacaccttcttgcgattaaatattcactacagtacggagaacgaggccaagactgcaagggggcaaggggtgaatccttttgtgttgaacatagactacaatcaaactcatctattattcaccgaaaacaaaggaaggaaccacaaattcacatgtgctgctgctcatcactgtctagtcttgcgttttcgtggagcgataattattgtcttgaataaattatagataaaggcaatttatagcgcaatcaagacggtcccggaatccttcggcaagtttttctccgctcgacgcggcaagcgcaaaaaatcgattaccccctaatccgctcattaaacttgtttcctatgccccccgtcaactcgttcgagaataaaaactcaaacattttcctttcgagacgcctgttttgtcccacccctgcccaatcccaagtgcttacatatgaaaatgagctcaactcgaggaacgcgataccgaaatttcggaaaaagctgatttcacgccgcctttggatcgttgcgagattaaaaactttgccttcgttcgtctcaggatccatcgtttcctctgtcagtgcaggggccatcaattaattgacgtgagcgagtgcgagtgtttgtgcaagctcacacccctgcaaatgaaaacaaaaaacccaaaacagttcgaaacacgggagaatctaattactttcctcccaaataaaagggctaaaattttccggaaaaagtacgaatcattcccgtttgccgccaccgtcgctgcataccaaatgaatcgtttaagacatgtgtgtggtgccttacccctcgacgacaagaaaagggctgaatcgtctgcagcgtctaacgagtcgtttaatgattagtaaatatttttattctctccgtgtggtgctgccctctctcccttagttcgaacagtttcgcatcgagtttgagggatctaaagctttcaaaagcagaaaattaatgcgaatgtatcagaattttaatgacgacacgggaacgaagtaagaaagaatcacaaaaactcgcatcccacccctgatactaccgcggaatgacatttaccgtttcctatcccccgaaagcattcacattgtcagctcatcagcaatcgtttgacacacagtcacaatcgaagatatttaaaagtttttgataacttttacgctactgggtagatcgagaaatcttcattgccagaataacttgatgcattggaaaaccaaacaatcagctcaggaaaatctaagagcaaatttgctctaaattgatgtaaaaacagagctgagaaaccagttcatcatgatagccaccgcaccgttgctgatcccccattgctgggacataactttaaatcgaaagaaaaacgagaaaaattttcataatcagattactatcattactgttcgcttctctcgtcatctctccattgcagctcattgttggcagccctgacctgacagctcgctgcttcgtggatgcaatatgccgttgctactctgttgccgtggcaaccgccaatgttcaatcgaatgacagcagaacaatagctgccaactggttttgaacgagcgcagcgcagcaaccaattcccaagctcggtattacctttccacctagcgcagtgctgccagcaagcgaaatgtcatttatttaaatttctccacctccatccgagccttcgtcggtcggtccaccgtcattatgtggcgagcttttgattgaggtacaacgatctatgaatggagcgaaagcaagataaagcccgacagtaggagagatgagggaaagaaaaacatgacaagatcacataataattgcacgaatccgtcatttatctctcgtcgggacggccatcatggccgcagatcgccattttgcattcaaccttccagaggcagccatctgtcaaactagtttaatccgattaggtacggtcgccattgaacggaataaaactctcgaaaagaaatagatttatcgatcaatcggacagttccggaccgtcactatttaatggcactcggtacggtcgttaattgcagtaatagttcaacctcttaagccgggatcggcccttgaaaagttgaggatttatcttccgataattcaaaattaattgcgttcgataatttttccggacacttgggcagctccggaacggggtgcaattacaagtggaaattcctatcccccaacactggaccccatacgatttacgatagtgggttaaacctttcgacctctcggcattacactctcttctcgttacaaactatcatcctgcttcccatccccctaatctccgagcacagataaagatgtacacaccgaaagttgtacgacacaggaaggtcagtgtcccaccccttcgccgactgcttctggctgttcacttctcggtggcagcagtttaaaaagttgctcctttttggggactggccatgtaccctgtcttcccgcttctccaaatacaaataccggagggagccaaggttaccaccgaccgctggagagcactttccagtgtcattttcataatgacgatgatgtttcctatccccctcttttctgtcagcgcgggcggatggtcactttggcatttaacctcttctctttagaatgaagacatcactcgtcgcttccgaacagacgaggggagacggatagacggcagaggttgaagcgtttagtctggctccagtccaggagttaattgcacgataataaatcatccagtagcctatccctcttcgatgttcgacaggagtgcgagtgctcatatcgattgctctttgattttcgccttcctttacctttccatgaccccgcaaaaaattcagctaaaaattattattacgggaactcccgaaacgatcaaacaattttcaagttcaatgaaaatttgcctaccccccaaaattggatttatttgatttttattaaacttcgtacggttccacacatcggacgaatggagtttttttttcctcctcttgctctgattaatcacattcgcatttgtttccccttcaatgcttcggaaccggttccgatggaaaaccagcaaaaataaaagcatatttcttcccccggagggctctcgaattatgaccaattactcataacctctttctttgttgcggcggccgaacccgtcatcatcattcttcacgtttcatcgtagagtaggtgcgcgcgatcacccatcagcgttagcgttagtagcgtcaggtgccgctgacggctagagttcaaagatggccgctcgatcaacagctgatttgctgttgtttcggccttttcagcacaaaagcaatccatgaatcaaatggaacgattatggccgcgccgttttaataatagttaaacgatgaaaatgaaagtgatttcgtctcgaaagtgagctgcctgagttaagtcgctggaagacgggcgtaggtggtggtgacctccgcgcgaacaagtccgatgctcccgattcgacgtggacaggtccacgcgcaaaatgtacgatccgctccaactccggcacaacaacggcgagagtggacacgacagtgatgatgatgatttttatattgtcacgatgtggcggacattagccttaatcaaacggaaacgtaaagcgtttaaagccgcccaaggataccgatggacggggcgatcgtttgccgtttgatgtttgaccacactcggcggcgacgcagaaaatggcgatcaaacgacggcgcccactttaattcggaacgtgtgttattgccaggtttctcgagtgtcttacccctcggtcacaaaaatgtcacaaatcggctgttagtttgcggaacgaattcaacatgcggagataggccttttcatgtgacaggtttgtgtgtgcatttgtttacatcgatagaagaactgtcaaagtgctccaggatcagctgatttgaaaggtctcaagaaaaggccttttcaacgaataggcctttgcatgagacgtttcaaatcagctaatctcgaagcactttgacagttattctatgggaaagacaggcccgagttggcactggccctccactttacatcatgcatacacggacttcttcttcttctttctggcgttacgtccccactgggacagaccctgcttctcaccttagtgttcttatgagcactttcacagttattaactgagagcttactatgccaatgaccatttttacatgcgtatatcgtgtggcaggtacgaagatactctatgccctgggaagtcgagaaaattttcaacccgaaaagatcctcgaccggtgggattcgaacccacgatcctcagcttggtcatactgaatagctgcgcgtttaccgctacggctatctgggcccctaatgcatacacggacccgtcacatgaaaaggtttatggcctttggtacaaaaccctcctgaaataacataaagaagatagagcattgttatcagaggatcatatgttcaacgccaggtccttcttcatcatcctacttcatagttgtattttttttttatctttttttcctttcagttttctgcgaagtagtacgcgcttccgcttattaatacacgatgactaatgcgaacttgtgtcgtggaacaatcttttgtacgactcatgtgcgatttgcccacttaaatggctaatgcgtagctttgactttagcaaacttattgtaatattctatcctcgatagcctagagttccaaaaaaagccacaagaagttctccgctgaatacctactaattttgcaacttttgctttcgacattcgctctaagtgaccagcccactaaagtttgtcatattttattcgcttaatatttgttcgcttctctattcatatgacacatcttcttctcctttcttcttcctggcgttacgttcaaactggaacagggcctgcttctcagcttagtcttcttatgagcacttgcatagttactaactgaaagcctgctttgtcattttaggttggtttaatttatcaaatttgttggcaaatcagcttgaaaaagctgattttccaaaacgattttcagaaaatgtccttagcaaaaatttaggattgagaaatttgttgttttgaatctggcaaaacctaacattttactttaggtattgtctaatttgtgtaggattattaaataaaatgcaaaatatttgccataaaacaaggattgctgaaaaatttcttagaaatcataagaaattcaaaacagtctagaggtttaagccattgtagaacaggagagtagccttccataagcactttataccactaaattttccttactagttgctcataaccccaaacaattaaaatattctgcaagagttctagtattctgatgaaataattcgtaacaattttcattattcctgaagaatatacagaattgcatcttgttttcataatatggatccaagtaggtgaaatgttattacgcgtattcgttctaaattaattcgaaagaaaataaattctctgttgattcacaacaatgtttcaatgttggaaatcactaaacttaatccgagttattcccaaacatcttataagcccctaccttgaaccaaagataaacgccgtggcctactgctcgcaaattaggcaatcgattacgccttcatcggaacacgaaaccggaaaagaattgatttttctttccgaactcgaatgactttgaaactttcctcgccacccctcctacctattccttttccaatcaaaactataagtatttattttaaatactgtcgaacttgtttccggtttcccaaaaccccccataccttccatccccaaccgaaactagaacaaaacattcgggcccatatttgggttaagattgccacatcgaatgaaaaccggcaaagtttgccattccaccaaacgccgagcgcgagcaaccgaaacagcaaatgtcaaactgacatttacttgggcgaaccgcttgctagattgttgcaaaaccgctctcgattaaattatcggtgaccaatcggggtgggatttggttttggctgcgatcccactatccccaaccaagccaccgaaatcaacatgacatgaacattgtgtgggggtgggaaaagggggacgcatcacaaatcgcaaaatttcgattcccgcctctatcggtggggagtttgtttgttcgcggatgacattatttacgacacgcgctcggacggttcagtgcctcgtccctcccctctttgaattcgttggtgggtgcgagagaacaaatggcagggaaccttcttgagggaagctaaggttcccatatttgctctaatatgaaagagtaccaaagttcgtcgaaaaaaagctctttatttttatccatttgctaattatgacgaagaaaactactttgttagtttttatactacactgaaatttgacggcaacaagaaattatcgcccacattatgcaaaagttaatcaaataaatccttgcgtaacttttcaaaaggacttatctaacatcgagagactctctttgtttactttctctttaatcaataacaaagccatattacccaaaatcattagtgttgcacagttatagtcaaaaaaaagcgagagaggagagaatctcaaattggtgcatagatccttttgaaaagtaacgtgagaattgatttcagacgagctgattagtataatcaatactctcgttgataccgttcgttctccgcacagaaaaatttgaaagagtgagacaagcctattcctgaaaaaaatgtcaaccattttctttgactaaagattcacatcagttggtgttctgaaaatatatttcatatttttctactttattctataaatttcgacaatccagagcgatatttagaaatgtgcacacttcatccaatttagcaaaaaagaatagaacctaattttgtattgtttttaggcaacaaatgagtacatgtactttaaaaagagtaagtctggtaaccctaaagcgagcctaattttagaaccgaatatcgcgcgcgcgttgtgttgtaagtgaattgtagtcacatagtcggcggtgcggcgaagaatgtattaattagagtaaagatcagcgctaatgtgtaattattttcggtttcggcggggcggtctgaggtggtggcacagggcgaaacggttgatcttttgcaaaatgacagctgcaatgggcgagggaccttaatataatctagaagccgttgcgaaacggattgctaagacttccttgccttgaggggacactaattaaaagttgtcccccccccttctctttaagaaaccgggaacgtaagacggtgcatggatgcacctggaatttttcattatgcgcctcgggaaccggaaaagtgcaaccggatcggaaaacgatggaaaatgtgacaaaagctcggattgtaccgggaaacttccggtggggcttcgttcttcgtcttaaatgacggaagaaacctgtgcactgttccatcttctgccgaccggaagaaatgcgtgacagggttcgattcgccttcgcccggctgtggatcagcgaagaaaccgttctgcacttgttaataaattaattttccagcgacaagaactcgagagaaacttgatccgttcccggttccccccgacagttagtgcaataaataatttccataaatgtgcaataatacttactgtactggttggccggccatccaacccggataacagaaagaactgggcgatatagtttttagcgaacaatttgcatgcattaataagtgcttctgccggaggttaggaaaacaaatacgcccccaacgacgacggcgcgaggttttcttcgtctcgcatgtggaaatcgaacggcacatacttcggcgcggtgctccccagattggtattatcagaaaaaataaaatcaaatcaaatctgtgcttattattcgatttctagagcttagcatatctgagcaaaacttaaataaaaaaaatgtaaggtccattttgaagataagcccttttgctggcattagtcctcaaaatctaagcaaaacaaagttatattgttactatcagatgaaatacatcatcaaagcttgatttgtattggtattctttagttctggacggatttgtgaaataggatatcaacaaaatgttgaactacgccctttttggaactatattaatattgactcttagtacacggaaaaatatttttacctaattttttagtttactttacttaaaattaggtatatcgattatagtttcaacccaaaatctctcggttttctctttctcccacacgaatgttgtcaaaaatagagagagctgcatctacccaatgggggtactttggcccaataagccaaatttgggtaaatgcaacttttcttatgtttgggtcgaaagaactcaaatttgcgttaaatcaacccaaaattgagtatatttttctaatggaattaaagccaaactacgtagtggggaccttggaaatttagtaaaaattgagttattgggctcaactacgcaattgcgttgaaacaacccaaaattgagttgaattccgtctccgtgtaggtttacgtagcatttgaataccgtcaatcgttattgaacgtgttcaatgatcaactgcgattacaagcgatagagattcatactaattaaccgttgctttgaaggctcatgcgctatgaggcattattgagccaattgcatcatgtgcttatttgcactcactcccggtctgtattctgaaaagaatacgttcaaattttcaacttacaatgtttttctccgatgaatttttcagtccggcttcatgtttttgatcgagttttgctctggtctgtttaatgacaaaatcaaattgttatttgacaccacttacgatgtgtgaatgaacgaaaattgaaggggaattgagtatcaaagattgttattttatttttatttatttcgtcaatcaattgtagactacatgtttgcttattactatgttgtgttatatctcagggaattgaaatattgtcttagtttcgttcgcgacatggtcaaatcaatttctggtcaatgctgattataaaaagacatcatttgatttattgggccgaatttggcataattatgaaaagtataaatcaactactattttttgttacattttacacaaacccgtaacgtatgcagattgattttaaatgtctaatttagtaatgaaaagcttatcagtttaattaacaatccgttgaattttcaatttttccatagtacttattagcaaaaagttatatgtttcttgacttaggaacaggggatcagaggaattttggatgataataagtacagtcaactctccctaactcgatgttgaacagatcagtcggtgagtcgctttaagtaggtttcatatcgtcattatccttacctttcatcgtaacggagaatatgagcgtggcctgcaacggaaattgtcatgtattttcatctctgacttccgattaaacagctatttcatccaaagtagtttttcatgagtaaattggattaggtacgcaatctaagaaatactccgttaccacgcaacgcattaagtacgtagacgaccttcttgaaaaaattgtaaaggaatttttaaagcattctctgtcggaattttccatagatttttcaaagaaatgtgatagagattcttcaagaaattttctggtaagatcagaaagtctaaagaagtttaaggaaaaatctgttgaataagaactacaaatcccatgatttttcatggatattccaggagaaactcagtgcaaactggtaaagaagttattgaagaaggcattgaaatagtaggtaaataattcgtgaaggaatccccgtgggaattctctcttccaaatattgtcacttttctttctaattaatactccgaaaaatgtttcaattgcacgacgatattcgctctgtacggaaaaaaataatcatacagggtatctcctggaatttttgggcttataccttaaaaaggcgtaacttcataacggaaactccattttttttttgtttttaatttttgctgtataaatctgatcagcacacattcgaactattttttttctggtaatgacggtctagagagcaccttgttctgggtttgccaaagggagagacacggcgaaatggttattaatttgtttattgtcctcattattcccaatttatttacggctgccaccgacagtcagaaccaagttttccttcctccagaggcagaggcgggggcgggggcgggggcgactaagggcggctatgatttatgaccaatcggctatcgtttcttttgctggttgtaattatgctttatggcactgcagcccgtcgtgttgtacgatggcataaaattaaatcgcgctgcgattattatttgctttgctctaagtcagttgtaaggcgaaagaggggggcgacactgtggaataccaataatcaaacacagaccctggcggtttgacaagcgccgatccataatggcgccccggaacatttaatcattccatcaaattaccgcacgccgcatgtcaacctctatacagaggagcccaattatcagatggaatgacgtttggtggacgccatcttggacgccgcggaggtgcgatttccgataatcagagcaaccgttgaaacaaattcacaattgcgggaatctcctcccaaaccaaggccatctgcgcttccaccaagaggaccgatggttggtttggtcagctcatcgcgactttgcacgcgattgttgttttatttgttattattgtttatttattcactacggcggcggcgacgactttcggaccccgcgcggttgacacttctatagcgtgcttgcccccggtactcataaacagaaggcagacaaagccagacaaacagttgccgcctgtttatcactccgtcaccttcgtcaccgtcatcatcggtggttgttttcatatttaaatacttacagaagtggtgatgtaaaggggggtccgagaaacggacgcgttaactcggtgaggtccagcagctaatgggtctcggtaacggaatcggatcgttttcccgagccactaattgatcggtctcggtggttacaagctgattaggagctttcggcaccgcaccagttagtaaagagaagaatggattgttaatgtgagctggacggatgttcttgcggaaggccaacagatagcgccagcttcgtatctcgtataaaccttctgcaatgacgtcattgttgtaatgcagtgcattttacgcaaggagtggttcagaaattttgttcattttttagattttcagacttttatactctctatatctattgtttgcacgtcaggagttaattatcaatattaacttccttttcccgatcagcgaagcctgtagagtaccagagtgccctccatagtgttgtgcgtcgccaaagtcgtaaaagcatagaatacactgcactttgtataatgcgaaaatatgtgtcaacctaagttacccaacagcacttctatttaggcaactttgtggacccagtttttactacttccaacaaacataaactcgctttccatgcttcgagcattcatttatttctgagttaactaccagagatgtatgtgctgtcacagttgatatttcttttgttgacctaaataggaaaatatctattttttggtttatttaccacatgatgaatcacaaaggcatgataaattacaaaaggctttatgctgattgtgggcagtgattctacatcatctgcagcagctaagatatcaatttgagaggcattttaaacattagatgttacttcgcagactttgcgcttcaggaatccctggtcaataaactgggaactctgtattgaattgattgtaaccaaatttcatagataatctccgtcaatttaaaatcaaagtgatttacaaactgctatacaagcctcgaatccatggaagatcgtacatgctgagctgagaagtgttacgtctgttggtctatgtttcaaaaaactcaccaagaatcttccgaagttattttcaacttttaaactgaggatattgtcaagaattaaccgaagatctacaaagatttctggataaattcatccgtcatttcgggtcaatatgtctaaaactctcaaacttcttagtttagcaaagtttcgagaagaacaagataaataacctgtcaaccttgccttacgttctgtcatagtaggcgttgcggcgttcacaggaaaaagttgcatcgcaccaccaccgaaatgcaaaatactccgaaacaacgccgaatgctgcaccgtcgtcatcctattcgaaaagaaaatgtaactcattttaattaacgacaataatgtgaaaggacagatttttaatctttgatcttatttgctactgtcgctactgttactgctcctaccacggtggcggcggcgatggctgaggctgaatatttgcaaacctcagcaatgtgatccccggcctgcctcgatcgacctgacggtattccacagtcagccccagcaaacccaagtgtcaacgcacagaagaaaacattccattgtgaatacttttatcgcacgtcgcgcgccatcgtcgtgacatttgcgtcccgcgcctcgaaagtcgatgtttttttttttttttgcgaagcgacgcgtcgagagggatatagtttatttataacattgatacaaaatttataacagagtaacggcgtgttcttcgtttgcgaatgccaataagtaccagaagagtagttgccggtgtgtttaggccgctgcagaagagagagagtgacatttgatgtgtcacacgggttgacgatgggtgggacataaaatatcgaaaataatttggccaagtagcaagaatccgatggttggcgcgattgtttagaacgacgagcggttcttaaagtggtgcgctgtaaatctcgactcaaacaagcaagtgctcttcgtacggcacatggttcttgttcggcatgcataaaatgggtctattaagcgctctgctcgtttgatacgcacatttcaataaaaatagtattataaatatattgtcacatttgcgtttcgatgtcaatttcgtgtctcgtgttcggtggcaccgttccaggctctttgtgcgagcgcttctcatcagaagagatgaacccgatgcgtcgtcttgcacattcctatcccccttgccggatccgtcaaatgacagcttcgtcgaagagtcaccgccgccgccgcagttcgcagtcgaattaattattcccgacatgcatttataaattcgattttgtctgtttgtgctcggtcgctatgaagcgatccgtttgttcactcgtcgtttcgccacatcaggaaaattcgatattaattttccgattttcgcatgcttcgtggctataaccgagcgtcttcgtcttgtgtgtgcgtcgcagtcgcaggttaataacatttcgatgaaatcagtccttggatatttgcgcactaattaaaatcgaaatcgcgatcgtgtcaacgaacacgactgacggacgagtgtctttcccctcacctgtcaaaacacgaccgcctggcggtgaaatatgacgtactctagcgtcattggcacactccataaatcagaatccacgctttttcgtcaaattcggcgcagatcacacgggagcgccaaatttcaaagaccgatgtaatgataattgattacatggcattaatcattgattagggcaaagtgcggcctttgataacggaccagagcgggaagaccgctgtttacatttcaataaacatcgccgaagaacatgaaaaatcaaataaattcaccccctgctctctcggtcacgggtattagtataaatattgagaatatttcatctttcctttcggcgtacgtcgattccgtcaatttttgcgtgcaccccctgagtagggtgacattcctacccctcgcagcgagctgtcacatcccgcaatggcaaagtacaaaataaataacgtgtatcccgcgcaatatttataacttcctgccgcatggtcccgcgtcgcccttttgccagcgctttattagattgagactgagacactttcggaaatttccgaggattttattgccgatgaaaggcgaatattagcatacatgtgagcgcgaacgcacgcacaatgaaccgcggagttcgagggaattttccgggtgaaaggtgcattcctgcctttacgccctagcgtagttctggggaaggggccaaaaaactttgaggtaataaacagcccgctcggtacaagattaataataatattcgcgttcctatccctctgacatggaggcgcaggcaatatcaaagaaagtggataaatatgataaatagaaatgaggagaaatttaattcggttttcgcccacataagggggggcggccgaagagcttcgttgtcaataagaaatttatgagattttttcccatcggcgtgtaataaattcttccgggatgacaggtggaggatttccgggcgcctgaaggcgcttattgtcttattgtcgcgcgctttactctcctcgaggggcgaataaatccatccagatccgcccaattaccatagctcaagaccgattcgaagaattcggtgcgtgcgattcgggaaaaataccaaactgtctcgccccttgcttgccgatttcaggttgctaattaaagcgaagcgccacctagcgtcactaatctcagcagactgcgggagtccggggtccgacattgcacttaagcgggccgtttaattgcaaccgacattcgatacgagccattgccagctgcgccggtgcaactgcagccgaaatcagttttaattattacaaaattctaaattatttcatcatcgccataattaaaagctgctgattgcctacgcctaaaaccctccgctcattattaatggcgagagcacgttctcgcacctcgttgtcactaaatttgcaaattatgaacaaactttggcagcgtccggggccgtggcaggtgatgaccgctgtcccggcaataaaaataatttagtaataatcaccatttgtgcgatgcctcccaaactggcggtgcactactttcacctcatgagaggagaggaaaaaacggaaacctacgataaaacttaatgaggtgtcaattcgaaatgatcattgcatttcaaaaatttacaatttatattaatatcatccggcgattggcgcccaatcgaatcgagcgtcccgagtgactgatggacagctcgccgtaaagtttgacagctgatgcggaccaccttcttcgattgcatgcgggacgcgtctcattaaactcaccaaacgaagcgcctacttggatttggatgtgtgacgatggcttgtcaattggtgagtaattacaccatttcacctccagcgtcaaggcatacttgatgcgatcggttaataggaaatttttttcgacgatttgctaattaaatgagagctccgtatcggtccaaggaggcgcgggcacgtgtgcaaacatcaatcaataatggcgaagcgcaaagatttaaaatcggtcgccttggggcgctgctgtcgccgattcaatctcgtcgcaggtcggtcgcttggtcggtcgtcgtaccgcacaacaacaaatggcgtgtaatttttcttccatccagtttggttcctttcggctgcctgcgtggtcgcgcgcaagagatgaggagcctgcgggtgtattaatagcaaataaatctgcgttgcccgcgtggtggtggtggttgatggtgccgccaatagcaggcgttctgacagttcggttcgcggcgcggtgattatcgatgacgacgagggcaaatggacggcaacgcggttgcccgaaggcctacttggatgaactgttttttacttggacgccaccaccgccgtcgataattgcgtttgacgagttaatcaaattgcggggattcgtttctaatttggtattgacgatgccgatggaaaataacatttgaggttgagtgtttcaatctctcagttccaatcgaagcagcagaattgggagagtactttgattttgtgaataagttattcgtgatcatggtagatctattagcagcacaaaagagattcggctccgtaatttttcgtaactcaatgaccttgtgagttttacaggacaacaaaacttcctcttcctccttttgaattctaaaatactgtgattctacaaaaaaaaatagtggatagccaggaacgcatttatggagagccttgtccccagagtcttcatattttagggcccccacaaaccatgagtaaaaactactaattgtactttaacacttcactatttgcaaaaaataaaatactaaaatcactagtaaggcgagcaaatatctgtaaactctactatgtgttgcttatcttgacagataggcctatttcgtctgcgacttacagacctcttcagttctcgagcacatatattaggctttcaaagcagtttgaaactgacttcaagttcattttaaaaccactttctaaaaagtattctgcgaaaagaacccccgcaagactgtggccctgggtacccacatttgtaaatgcggccctgtggatagctaatgaaggattttcagctacatctttggtagattgccgaccttgccagaaatcaatgaaaattcaaagtaaaattacatctagagattatccttaagtaccaacaagtatctttttaagagaacctatcaagcattgagagctacataaatttctcgtccattcctagcatgaattttctacagggactcccgttcaaactgacttttttttattttctttattagtatcattccaaacaattacattcatttcttatatctaggtgttctgtgttattagacaacactatcatcctaatttggtaaaacaaatttaagattttataaatgttaataacaacatattacatttcatttgccgtagcagttcatattttttacaggtgagttgatttcacctgcttataagagaaaaaaacacgttttcaatttacttaacctaacttaacctaaacatataacgcattaatcgtggcaataaaagattgtaacgatttttgcctgaaattattaattattttatttgacatttgttccaatgtttcaacattggatattctatgtaactcataccacagagaacagacgttcatcttttttctggtgaatgtgtaaagatttgaaacggtcatttcaaatgtaggtagttatgtttcaggtaggcggcgctagtgttccataacactgacgtttgacgtttatcaacttcacaaacaaaacagcgacataacctgtaaacagaaagtattttaatttttgcaaagcagatgttgtatatctgctgcatgcagattatcgttgaaaactaaggattttcccattttcatccttgatcattgattttttcataaagaaaatgggtagaaaatgtgagttttactggtgcggcaaccaacaaggaaccggagtatcatttcatcagtttccagttgatagagcaatgtaagtttatcatttctgtttcaaatgtaaataatgatctatctctacctatatgctatattgtttgcatttaggtgctttgcctgggtggaacgctgtaattcatttgaagctaccgaaaagtttgcatccgaaggaccgcaagcattcagaaataaacgactatgctcggatcactttcccttgaatgcattcaaggaacctactaggaaagagaaagggtaaatgaaacggtatcattgttgattattttattattttattgaaattttcaaacaggcttattcccaatgcactgcctttcatgtgtcccaatacatcaagtaaatacaacgaggaatatcttgaagaatctcttgcatgtaccgcaacagggtaagttcaggcgtgtgtgtttactctattcttttcttgtaactccatattttgccttagttcatcttttcagtacacggaagaagaacctgtagagttcatagaagacgacttggactatgcggagtgggagcggcatgctaaaatatccactactctgaacagttgttctcaatcagaagacagttatcagattgaatggctcgacgattcaatgagtacaagggaacatcatctttctatagcgaaatcagttgatgatccgacaacagatcatagcccccggtgcaatcggtcactcacgattgagccgtggctgagcgattcgtcaatagtaaacgttttcagtaccgataatccggaaataataccatcgaccagcgctcatcaaaggcagcccacacgtaatggtactgcagaacttcagatagataacttgtcggatgacttcaaaacttcgatgcaccaaaccctcagcacaggtaacctacaggttgaccatgacttcagtactcgcatacccccattgagtgacacacaatatcatgcgaatgatctgcatttcaaaggagcgccaaattcgacatacacattacgaacacattcgaacaaaaacgattcaccaattttgtcgtcaaacccactccatagcggtagccggccggaagaagaaaatcatgtccagttgaacaattcagccgatccggcaacttctgatactcgactaataagtttattagatttttcttctgtaactcactctgaaagttataaaacgcaggttaaggtgcaaggcgctttaataaaatccatgaaagaaaagctgaaacacgttaaacgaaaactattcgtttcacaacaagcagggcaacgacgtctcaaaagtgctttaaaagccaaaaaagaaaataaaattcttaagaaggagctaaaatctgcacgtaagcagagaagtgagaatgaagttttaggcgcacaagcaagaaaaaacccagttatttttgattttctaaaaaattcgactcgtaagccaaaaggaaggagatataatgctagcacgatgaagttcgcagctggtacatatttaagcgggccccgggcatacaggtatgtccgaaattctaaacacatcacacttccacataaaagttcagtatacaagcacaacaagcacgtgcgtatacagcctggaattaactcatcacttctcagtgccgttaaaagaaaagttcgagaaataaagcataaaaagaataaaatcgtaacaataacgtgcgatggcatgtccattaaaaaggatcttgcatacagcgcaaaggccgatatttttcatggattccctgatgatggaatcagaaggcgtatcgagaagaatgatcctagcgttctggctacagaggcagttgttgttatggcgtcaggaatgtatatgaacttcaagcaggtaagctaaattgttatttttgtttttaaatttcaaaaactattgcttattgtagccaatcggatattatttagcccacaacagccttggaagctttggcctatacaagttattagaggagtctgtccgagctgtcgctaagtgtggattgaatccactaattataaccatggatcaatgtagcacaaatgtaaaaatggttcacgagcatcaatcatcggcagatccccccagaataactatagatgaccgggaaatactaatcatgtatgacaccccacatttgctgaaaaacacacggaactgcattttcaaacacaatgctgtatttgagaagaaaatcgcttcctataaacatattcgaaatctgtatgacgcggacatatcctcgacgttgcgacttgttccaaaactccagaaaaagtgtatcgacctcccgccatttgcagcaatgaatgttgctttatcagcccgcactctcagcgaatcttgtgcagtcggcatgcgtcattatgcttcaacaggtgaactttcagataaagcactggacacagcagacttcatcgagatgtttgataaattgttcgacgtattcaattcaaaagaaaaattctcggcttcagttgggaaggtaaatatatttcagttaacccttgtgtcaaccatatttagatttttaattgaattcatacagcagactttcacataactatctcaagtaacattaagcaatgttctccaccatatggaagcgtccatttattacgtaacgacaaaaatgacaacttcgaccaaccccccgaccccactgtgactcactttgtattaattatgagccgtaacgcttgagcctccccctccccatagaccgtaacgtaatttgtggacggcttctatactttttgcatatggtgtgcattcagtacacgatatctccgctcttgaggtaattctttcattcagactataagcattccacgatttccattactcacttgactcacggtaccttaaacaaaattcgaaaaaataatattttgtaataacaaaacatataaaataagattattttttcaaatgagccattgagagaagattgcaaaacatgtgtcaaaaaaactaatttaaaaaagagattcaacaaaaagttcaatccaaaattctgtgttgtattgtattgtgtgataaaaactaatatctgagtataccataataactgatagaacaaaacatatttacagattaacagaacgccgataacaacaggttctggtcatttccagtatctagataaagtggagtctattttggaagacatgtattttaccaagagttcttgcttagactatgagaaggtaaattttattttttatattttttcctaacatcacataatcacataatcttatatggtctatgaaatttttatcttcttaggcgcgtaaagaatctacgtacttaaaagcatgccaaaaacgaccgccgttcctcaaaggttggattagcaatataaaagctctgcgatggctatgggaagtattacgaaatgaatacttgtgttcatatctatgcacgaacgtgctttgccaagactgcctggagaactttttttctgaaataagaaggcggtgtggtttcaacgatgctccaaacgcattccagtttggcagtgctttcaaatacgccatgatcgccgctttagaaaaaggttttggtgaaggaacgaactgtcagcacgattcagcaaggccgttactcgaggaaaacgacgtggatgatttgcaacccaatacgtatgaaccatgtaattacgattatgaagctcttgacttggagtcaccattcgaagcgttgaaaaaagagctaaatgcattggtgtatgtaattggtgcagcggcaagcaagctgccgcacaagaaatgcaagcagaagctaacggcggaacaagatgatgaatgtctccaaaatgaggattattcatttatcaaattgaaggcttcatgtgcttcgaaaaatgtgactattcctaacagctgcttgtacaatattggaatacttgcttttctctgtttcaagcagaaatttaaaagatttttataccaaaacagacggaacgtgaagactcgtttgaaagcatatctgaagtatgaatcgtttgattatggagcctgtgaatcctgctttcataaacttgtagatatcatctttaatacattaatccaaggctttcttcgcgatgtacgggttcagcaaaaaatagctgaaaataacaaacgttatcgaaaacgtaataggaaagccgtacgtatgaatctcccagaacagtgatgaaatacatttgttatactttatgcaactcataaatatggttattatttaaattgtattggaagcttagctggcggcgttttctagatcatgacatacaattatcagtattggacttaagaacatataggccaactgcgacgaacaatacatttgaagtatctgagttgaaatatcttgtgtcaggtaaaacaagaaaacttaacttgttcatctttgttctagccaagtgaatcgtctcacttgcttcaacttaactaccctgtcgaaaccaagcgtaaggctgaggaaagttggccgctgtccacaaattacgtaacgctttaaggggaagggggtaggctcaaacattacgactcatacataatttcgaaaattttaatgcgaaaagctttacggagagtaaatgaatgctgccttccggaatgtgaaacaatttaaattattgaatggcttcaccatagttttcttgttcaaacgaatcgtaacgaactagatgatcgacagtgactctacaagttcaattcatcataaactcaaatgccaaaatgtttcaccttaataccgtcaacgtaccagaatccgctcatgttccagtagcccgctcacgagttaaaaaagtaagttaatttgagtaaatacacaaaaatatgtccatagtgtgattcaacttgtcgatttgaaccgtatagcggttatagttttcaaattacctttgtgtaaacttaccttttttcagtgtgagcgggctactggaacatgagcggatactggtgcactgatggtactccacccacaacatttggttctcgttccccaacgcgaaacagtagggtaacgaactacttggccacttccaaaattatctttagcttggggggttttcttggcattattctacctacacaaatccagctggatgaatcaatgggccattatttcctgaaggtgttcttcaactctgggtacactagcaatatggatgataaatctgcctaactactcatttccctgtaccggaaactttccctttcctgctttgggtgtgaaatgcttgagcaagcttagtagctggagcgaattccgatgccagagactgccggcgagcaaaaaaaggatggatttatcgatcgacacttcgccttggtccaatgaaatgttttggctagcacttcctggaacgtgctgttatttgtcttttcatcagtgggaactttctgtaaaattgttacagcatctagaagattgcttctaatgataatactaaatggaaaaaaggacttacctggataaatagttttttgtaagaccgtgaatccgtcgatacttaaatgacccaggtaatcacccctacgatattgcgtacggcgatcggttcgcaacagagaaacgtagagcagcaaggcagcaaaatttagcactattagctggctgaaaaagaaaagaatcttatagctatattgttatatccttagtatttatacataccttcatttcttggcgaaaataatgataattttacgttgtttattacggtaatctgaaacattttcaatctcatcgaaaattttgcagctatcaaccgaaaccgacacagatgttttgttttgatttatttgacagcagtgcagccagtggtcacatatcttatgggaaaaaatatggtttgggaacaatgataagctcaacttgggtagtctgcaatagatggcggtagtgtaccaacgttttttggttcaaattcttacacatggtttctgatgagaaaagtacttgcatgaatgtctgttctctgtgctcatactataccagggaggaagcttcagtaccattttcaaaattttactagatacttaacttcatctgaccaatggaccattaaaataaccaaaacggccgctatggaaagcatagatagcgccaccgtagccttgtgtgtttgacagaaccgcaatgctgtcacaatgttaaatcccatatacagtggcgcctttgttttgatgcggtgagcactgacaaaaactaccttcaatgatccatttccaactgacatttcttctcaactgcgtactgcgatcaaaaagaagcgcttcctgatcgattccttgcaggaatttcccatgctccggtataacccaagaaattacttttcagcagcaaatcagcctttataatggaaaaaagagcgagagaggagagaatctttcattgtttcataggtccttttggaaataataatagtgatacaagagggaatctacgcgaattcactttggttttagacaatatcttgtcaggatttccccaattatctgctgaaaatccgtgtggtattttgggagaactcattcagtcatatcaaatggcatgttttcctgcaaatgattgatgtgtgtcactgtcaaggtatccactcaagatgttgaagactatctcttcttttttcgatgtagaagaggaacctcacgagaatgaagtcaataattcactgcgtattacccatttaccattttaccaaatatcttgccaaaaatctatcccaattgaaaccttggcatcctttaagaaattcggctagaattttgaaagactatctcttaagaatctctccaaaaacaaggatctttctaagaactggccagagatgttgcaaagcatttaagggccttaccatgaataaattagagatcctgaaaaagtttgccataacaaggcagtgagttcaagaaatacctttttttttgttaagattcagactcttgatttcttcaaggcatttcttggaacactgtagtgttgtaccgacaagatttgttgtggattctcagggaacctcttgcgtctatgatgcatatgattcagttgaaatttttaagaaagtgtctgtcaaaattaaaagaaattttcgtagaactatccggttaataccataaagtaatatttgaaataacggtcggatagaattttcaaaatttttaaataaaattcgctccagatcctgacgtaaacatttcgcagagcctccaaaagtatttaagtttttaagcgattaacaagttacagtttttcgcagcttagtcgaaaaagcacatttttctaaataaacacaatttattgcgcttcggtatcttcattattacatttgaaattaatgaagatttcgatttaaagacaggtcaatttacatagtgacagctcgtcatgtaataacatttgatgattcaaaagtgatttctataatatattcaaacgcgttgcaagaataattccagggcgcggaaaattataaaactttgtattcgaactcaatttaaaacgaagaactgaaaaaaaattggatgtctcttaacaagcaaattttttaataattcaaactggcatagacctcaccaaatgcccatttcatttttctccgaggacccgaaaattataacgttgctgcaaattccttcaattaagctacatgaacgttatagtattttacatagacgttataaaatatacacagaataatattttatgtttttctttcatgaaaaattcaaaaataaaacataaattttataatacacaaaaaacaatttctcgcataatctgatataacgccctaaaagccattggtaaccacgtgtgtagctcattgtttctgagcaaatgaatgaataagcatccaaacaaccggcaagtagataatgatcctttcttcataatagagttgttaaataacatgaaaatctattcaaatgctcagaaacaacgagctacacacatggttaccaatggctttagatggtctgatcataaataatgcgagattttgaatatttttcaattttcatcatagaatcttgataggaaacagatgtttgggacaacattttatgatggagaaactctcaatttttttctaattacactcaggcaaatcgactatcgataaacataggaacccctcatgaaaattcgccacaagaaatcgggttgaaattcataaatttgccttatgaaaccagaatttgaaaacaaaaaacgttttcgcggcaacctggaatcgaaccaagaaccttgcgatcgataggcccgagtgtacaccacgcgcctatcgacgccttgatgaggagtgatgttaaaacgatgtataaagcgttcgtattgcaataatcgttccacctttcataaggcaaaatgtatgaaattcgatagtccagttcgctgtgtgtacaacttttggttgatatatcaatttttttttctaaataaatgcgttttgataatgttgaaattattctaaaccaatatgattaatatgatcacttctctagaagtatccattttcgaaatatgtgaagttccatgcaaaataataatgtttttatgataaaataggccattttcattagctgttcgtgattctccatcaagaacaatacgattttgagagtatatgctatacttatctccactcacttatttttcttgatggagaatcgtgaaaatgtaataataatggcctatttaattattaaataattatttttttgctttacactcaatataatctgaaaatgactacttctagagaaattattatgataattataatggtttaaaatcatttcaagattattattgtaacatcataacgcatttatgttgacaaaaagaaaacaaatatcgaaaattgaccaaaagatgttctttggaaaactttactttttgtttcctaaaaaaattttggtgaaaattaaaaaaactacaactttttctaggtttgcgcgtatttatccagaaattctctcatattttctatttacatttccccttagaatttcagctcagttacatgttttccgtaataaattccctgacaagttttccagtattttgttcatgagtttttccaaaaaatgcttcatggattccttctgaaaataaagagatttggacagaaaatatactcggaatttctttggataattgattattgtattaatgattctctcatcaattccacttcaagttttttccaaatcttctacaagaaaaccattatcatgcttttcaagagattcattcaggaactctcatttgattcgtatcaaatatattttatacgaaattattctaccaattccccccaaattttcttaaacatttcaaccagaaacttcgagagcagcttctccaagaactcccccaatgattccgcgataaccgcatagacacctctaaaatatggccttttagcatcaatgaataatatcgcctgaatcattgagacattggtaaaaaacattctggaaggtttgcccatattcatccataggtaaattctctcaaatgatttcccaagatttccccttaaaatttcacctccaatagattcatggtttccacgaaaattcaagtttttccagtcatttttccatgagttcacccaaaaaatgcttggtctgaaaatgactccttcagaaaattgaaagataagaacagataatatgcttgggtttgttttgcatttataattctgtattgtttttttcatcgatttctctttatcgttgctctttttgcgttattgcagaaaacagattatcttttcgtaacataattttgtgctgtagaatgaagaatcactatatcttgcttcataaacaagaaatattacagatttatctaattaagcgaagttcttagcgaaagagaggatcgattaagggaaattaagaaaaaagttaggccctattgaagtaacagcacagaatatatttgtaataataatcgaaaatacttcagatatagttcatcaatagatagattagagaaaaaaaaacctacaatattccgtcaaaaatttctcaagaaatgtaaactgctcatgtctcgtctgaatcagtttcaacattgacatcatcgttttgggtcttaaatttcatcgtaaactcgaaaggatattccacttgacattcttcggaaacttttgccaggaacagagttataaatttttcaagagatttattctggatttcctcttacgatttgtgtagaacatatggtttggaatatcctcaacaaatccagcgttgatttttccagaatgttcccagaattgctcaatatttaactgggatcctcttggagtacgctctatattcttttgaaattttctcattaattcaattacaaattcacctagaaatattctcaaagtttcctctgagagttagctgtagattgtccgcatttgacagttgctttttatttctggtgaagtgagatttttgtgagaggatttttattacccaatctactttttctcaacgataagttcatcttctttcatttcaaatgaacctttttccctaaactggaaaaaaatctgtggtaaaaataactgtatcagctgactactcccattcttgcaactaccatgaaatttcagaccaatttactatgtttatagtgcgtcccaccacattactggtacatttgacagaaataatttacaacaacctgattacgactacggacatggtaaaatcaaacgcatttctggtctgctgaaaattgccggtgcgagtgctcaagttaaccccctaaaatggtagtgtttaccgcacaattttttttttttgcgtgtagcatattcagtgaaagttagtacacggagacggaatttaactcaattttgggttgtttcaacgcaattccgtagttgagcccaataactcaattttggctaaatttccaaggtccccactaggtagtttggctttaattccattagaaaaatatactcaattttgggttgatttaacgcaaaattgagttctttcgacccaacataagaaaagttgcatttacccaaatttggcttattgggccaaagtacccccattgggtagatgcagctctctctatttttgacaacatccgtgtgggagaaagagaaaaccgagagattttgggttgaaactataatcgatatacttaattttgggtaaagtaaactcaaaaattaggtaaaaatatttctccgtgtaggatctagaacatttatttttggcaccactgctttccttatttttggcatcattgctgtcagaatgatttaaatgctctcagtaaggcactatatgtagactcatttgaaacatatgtagtccacaatgcttaactatcatgctgaaaattagatacttctttggtaatcggttcaatccaaatgaatagataggtaccaaaatttacatccttgaacaacagtactctgagtttgccctaaaacccatcactcgaagaaaacaacaatacaaatcactgctccagcattcataatcaatcaaaagaatcgcactattagcctctgcgcgtgccataaattcttttgttctcttgacttttactgtgcgccgtgtgttggtgctgtctcgctctctctcacgggaaacttgaaaacagggcgcacagtaaaagtcaaacgttttatagcatgcataggctcataggccttttaatgtgacaggtccgtctatgcatttgtttacattggtggagtaccggtgcatacacgaggctgtcattttcatagaagaactgtcaaagagcttcccgatcagctgttttgaaacgtcatgtgaataggcctatatgtagactcatttgaaacatatgtagtctacaatgcttaactatcatgctgaaaattagatacttctttggtaatcggttcaatccaaatgaatagataggtaccaacatttacatccttaaacaacagtactctgagtttgccctaaaacccatcactcgaagaaaacaacaatacaaatcactgctccagcattcataatcaatcaaaagaatcgaaaagggcatcatcgcaaaaccaaccgtcaaaaagcggaatcccacagccaacttgaacccaatcttgacaaacaaaacaagccctacaacatttcaacccgcctcaggagacggaaaaaaagaactctccgttacggatcaatagcgcggagatccaaaccgcaggaaaaagagcatccacaaatgacagacatttgtagtaattacttcctcccacttgttctcttgtactcttcctcccatccaaaatccgccacaccatccatctccatcggggtaaatctataagagattgtccttcaatcatttctctaaccaccatcgaagcaggcactggcgaaaaacacgagatttttttgaatggaaaccgtcgcacttcgtccacctcttccccacaactcggtgaaataccggaatctcttcgcctgacctctcatcctctgcttcatccccgcaatccaaaatcacgaaccgattgtgctaggaagcacttgtgcgatttttgagaaccgtgtaggctgcgagaaaaaaacgcaaacttccaatcaaactgtcgttccccgttccccgccgttcggcgagattaggatgcccggattcttcggaaaccgaatccggtcagctagtcgtcggctaccgtttaatgacaactccggcccgggatgtttggattgcgtgattcgatcgtcatcataataatcttctatcgcccaatcgcgtgcactaatgactaaattttcccttcgattcgaatcgcagcatgctctccgtttcccccaccgaacttgatcgattctaagaaggcgaagcttcttgcgtcgacgacgactcaaggcctacttggggtattgtggaggtacgttccgtagagcgatgacatttcacgacgactgactccgctacgggatcatagcgtgctgtgtgtgtgtcatttgccattgtgggtcctaattcatcggaaaatcggattttgacttggggtaaattggtcggaacgggagcgttgacagcaacctcttccatcacttcggcgactttggacgagggaagaattaacaacaaccgaaacgttttaccaaacgtggtttgtttacattagttccgaaaaaaaaacagctaaccagcttagagcgcctgcaggggaatccgggtcgggtgggggtgaggaaaattgcattgcaattttccacaaaaggtgtctttttcaccttgtgacagcgtcgtggttgcccctttaaatgccaattagttccgcacgctcgtgcttttttttatttctgctggctgactgtcgcttcttgcgggttccatccagagagctttgttggccggctctttgatggcttgctgcgatgatgacgatgacggtggaaaaaaaaagaagtacctcagcaaccgagcgaagcatcccatttgttgtttggccctttttgcgcgtcgtcatccgccattgccatcattcaccatgcttcagttcgaagtgcttgcgaggcggcagcggccaaagagaaaagagatgtaaagtcgttttatataaattttataaaagctgaaacatataaatatagatcgagacttgagattgcacatcgtcgggctcttcgcttttttttttcatttgcaacattctccattgctccttctgctagcgctggtgcctcttcctgaccagcctccggattgggtttgatggtcgtctcctcctttctgacaatttgagtaacaaccacgacgacgatgatgatggtgatatgctcgttggtatagaatgtagatctcaagtagtggttttcatccatttctgggccgaccgaagaggcgaaagacagagacaggcgagatacgagataaaagcgacgcccattcccttggagatgccctctaactgtcgtgaagtgggcttctacacacatgcacacggatccaccagagggatacagtgggttgggatcgatttggatgcgcgttttttttttcttcgtgacgtagcctcgggactttcttttgacggatatgcagcgagcaaagtctggctttgtattcctctccatccataaaaatccctcccgaaatgccgatctgagatgctccgttttttgccaaatgacagatttgtattaattgtaggttcagagcccggaatgccttcgtttggacgacccgagggctcggacatgaatgacgaccgcatccatcacatcctgtccgaggctcaatcgatgatcaagcgagactcgcaggatctcgtgacgcctcaacatccgtcgcagcagatgcaccaccaacagctccagctccagcaatcgctactggacgactcgcagcacagtgataatgactcgaagtctccgcatcatcgggacgtccagtcgccattcgccaaagattaccttaaccgacgtgctggttcgaggaataacgattacatcccccaggacaagatcgctaagatctaccaggaggagttctccaaactgatgcgaagtccgcgggagtttccaaagtaagttatggtctctcaattatccgtgtaacacattaattaatgctcttctctgtgcagtttccttttccctcatttccttggcggcggtatgccaccgatcgaacgcctccaggacgacaacatccgcatggccttggaagcctatcaccgagagctggccaagttgcagcaaaatgcttcctccggagccggacttcccaacatgccgaacatctccaatttgccgaacttccttgccctccatcaacagcagcaagctcaacagcacgctgcccaacagcaacagcagcagcaacaaaatcaacagattggacttaacggatcggtccaggacctttcactcccgaaagagaaacaaccctccaaactcaacggatcgatgacggacttggaaagcgagatcgatgctgccaacaaggaagtagacgaaaccatgaagcacagcgctttcagtttagtcaagccaaaaccggaaccaggcacttgcactccaaccaccaccgcctcgtctgccccaagtccgatcagcaacagcatcctgccaccggtcatcccgccatcggaagacatgtctgtcacagtcagtcccctacaaaggatggcctccatcacaaactccctcatcactcagcctccagtcacaccacatcactcgtcccagcagcgaccactcaaagccatccttccacccatcactcagcaacagttcgacctgtacaacaatctcaacaccgaagacatcgtccgacgtgtcaaggaatccctctcgcaatactccattagtcaacgactctttggcgaatccgtactcggtctatcgcagggctccgtcagtgacctgcttgcgcgacccaaaccttggcacatgctcacccaaaaaggccgagaacccttcatccgcatgaagatgttcttggaagacgacaatgccgtacacaagctagtcgccagtcagtacaagattgccccggagaaactcatgcgaaccggcaactacagcggttctcctcaaatccccggtatgatggtcaaacagatgcctcctctgccgaagatgctaagcgactccatcaacaagctccagcaagaccaaaagacgctcctccagctgcaaatgtcccaaatgcaacagatgcccccaacgtcacaagcacagcaactccagcagcatcaacagcaactccaccaacaacaaatggcagccgcggcagcagctgcccagcaccacgctcaacaagaagctgccgcccgccaacaacagcagcaacctccctcatcacagccatcccccatccctcccccgccgcaatctctccaacaacaagccaaccaccagcgacagcaaccatccccccaaacgatgctgctgacaccgcccggcattccaccgcaacacgccattcctctgcaaacgtccggtccactggacaagaagccacccctcatgctcggcatccattccccgcagcaaacgtccactcccgcaagccaccaaccaggtccaccccctggcgtcaactccatgcgtggagccctccatcagcacatctcacccaccgtgtacgagatggcagccctaacgcaggacttggacacccaaacgatcaccaccaagatcaaggaagcgttgctcgccaacaacatcggtcagaaggtatgttttggcactcttcaacctcgattaccatttctaattcaatgtcaaactttccttctccatccacagatcttcggcgaagccgttctcggtctctcgcagggttcggtctctgagctcctgtctaagccgaaaccgtggcacatgctcagcatcaagggccgagaaccgttcatccggatgcaactctggctcagcgacgccaacaacgtcgaacggttgcagatgctcaagaacgagcgccgtgaagcgagcaaacggcgacgttctaccgggcccggagctcaggacaacagctccgacaccagcagtaacgacacctccgaattttatcactccaattcgcccggaccgggatcggtcggttccggtgccgctccgcccaacaagaaacaacgtgtgctcttctccgaagagcaaaaagaagcacttcgcctagcgttcgccttggacccgtacccgaacgtacaaactatcgaattcttggcgactgaactcggcctctccactcgtaccatcaccaactggttccacaatcaccgaatgcgactaaaacagcaagtccctcatggtcaacccagcgaaccaattccctcgcgggagaaccaatctggagcgcccttcgaccctgttcaattccgagtactgctgagccaacggttaatggaaatccagaaggaacgcatgggcctcagtggagttcccttgccctacccgccgtactttgctgccaacccgaacctggcggccctcatcggacgaggattcattcccggggacgtggacctagcagctttgaacaaagcagtcagtgaacagatgagcggattggatctgtcgatgccttcatcggtcaaacgggaaggcgaagaggacttcgatgaggacggtgaaagtggtcatatgagcgattctgaatcggtggatggtggagcgcgaagaggagatggcgacgagcactctgcagcaagtttgtcgctagctcaagctatgagtgcaatgtcgaggataaaccggcgaaaaccggctgctccacagtgggtcaacccagactggcaggacgacaagaatccgggcattccaggcggtgagaagaaagacggcgatctcctcaacggagtttgcatgatgcaatctgaaggagtccaatcggttcagcaaaggtttgtggctgcaatggctgcggcagcggcagcagtcgcggcggctgcgtccggtgcaagtgataatgaacaggatgatgccaagtcgacgcattccaaacagtcgattgacgaccagcagcaacaggaagaagaggaagaggctcgtgaagataaggacgaatctgcggtgagtgtggcgtcgacggcaggcggtgaaaatggcggggaggggtccgacaaggacaaggatctggttcaggtcaaaacggaactgatggaggaaaccgaacggtgggagtattgaacggaaagaccggttatgaaccgatccgagtaggcggcggcgaaggtaagctgtcaaaaagtcagtgcaatcgataatagctaaacaaaagaacgcaaacaaaaaaatgcgacaaataagcatggaaaaagtccgatccgaatggacaaaaatgtgattttaaaacaaatatgagaagaacatttcgatgaactcttctgttttatctttgttatacaatttgttttacgtgaatggatgctcgtactattttcttcttttcctaaggtaagctctaaactctttaaaaaatctctgactgcgatccaacttcctcagttgtaaacaaatgtttatatattttaaaccttggttttctgttccattgtacatattttaccttgagccgatagggataagttttttccttcttttgaactatcaatataagaagactgttgaaacaagttttaaatataatatcgatgattataaagtgaatgaaatagcgtagattttaagccactagtgtaacttttaagagagggataacacatttttacattaggattatcgaacggaatcgaacaaacccttctacttttctgttttagttgtatg

SEQ ID NO: 142 - DNA, 63820 bp, Aedes aegypti
gaacaaaatttatctgaatcggtttgtcttgagctcatccaaaatcaatgcagttcaagagctaggatagaaaaaggactaacggcatcgtcccacctacgtataactaatgatctcacataaaatagatagcccaaaaatgttgattaactaaacaaactgtaagcaatacattttattttatttacagaatcgcaaaccggaccgagtgtggactacatcgcaaatgtagccaatcagcaaagtcaatctctctcggaaccgccgtcgctgtcggacggtttgtcctccgtgggtggttccagtgattcaacaagcatcattacaaatgtacgcaattcgataaacctgaccagcacccctaagctgagctcggatcgaaactcgaaaaacgattcgcaacttcagctggcagcgtcccaaacgaatgccaatgcaccctgttccctgtccgggcccgggcctggtggtggtggcgggaatagcggcgataacgtaacggtggacgaaggagatacggttacgattatcgaaaatccttccaacgtggacgttgaatccattaaatcacccctggcaaacaatgccaatacttcagtaagactaagtctgcttccttggaatacacataaccggtcatctgtagtcgttccaccgagtgtatctgcgtctatcgacatgatggctgcaagcgacggaactttgcgacctggggagattgtaatgcgaacattattcgccgattttacagtgcaagcagagaagaaaatagaaacggttatgcttgagagcactgataaaacattggccaaactgctacaacgtggggaggattatcaatttgaccagctcctacaggctctgggatcagtggctgagcattgtctgccctcgctattgaaagctttgctcgcctggcagtggcaccaaatctgtgatggcgatatcaaacgtgatttgaaacggatggagactgaacgccaatccggaacggctaaaccgggcaacgatttagaatctcaactgcaacgacgggaagcggcagtggaatttatcttctgcttggctttgattgaaatcctgcggcagttcccattccatccgggacatgacgatatcgtaaaaaatatcgaaaatctcgccttccgtcagttcaagtacaaagaaggagtccaggggtcaccgaatgcactgtacaaccacataattgcagatttatatgcagaagttatcggtgtgctggctcaaagtcgattcgcttccgtgcggaaacggttcatgacggagctgaaagaattgcggaacaaagagccgagtccgcacaccacgcacagtattattagtttgttgatgggaatgaagtttttccgagtgaaaatggctccgatcgaggagtttgaagcgtccttccaatttatgcatgagtgcgcccagtattttctcgaggttaaggataaagacattaaacatgcgatggccggcctgtttgtggagattctagttccagttgcggcggtgagtacccatgtgaattaaaaaataacaaacatatgattttaattgtacaaacagtgggggtgacttcttaattctgaaaccgatgttttattcaatccaaatagtgtaatcttctttttctttctggcgtcacgtttcaactgtgacagagtctgctttcagcttaattttttttataagcactgccacagttatgacaattttcatttttgcccatagcaagcacggaaatactctgtgtcctaggaaatcgaggaaatttccaaacaggatcctcgatcggcgttattcaaatccgcaaccctcagcatagtcttgctgaatagcattgcctttaccgctaagggtaggggcaatgggggcaaaatgaacatacggggcaatatgagccaccccggttttgacctcaaaaacagtgttttaatatctagtgtcattatgatctgctaaaggatgcctcaaatagccaccacaataaaaaccttaagaatatttgtttgaacactcaagatatttacaaaaatgtacaattttgtccttcgtcatgaaaagcttataattttggcagcttttaattaggcctatatgacaattctatttataattctggtaaatttaccagtccattgaaacttctgatcataatgaacagttcgtaagcgaaattagatttgttcgcaaacaaaattattgaaaaacgatatattattttcaagatgaaggggcggggcaaaatgagccaccaagatttaagcaaaacaaacgatgatttgaacataaaaatgcattgcctaaatataccagaatatttttttactgcatagtcatctttatgcaccattacaagtggaacactgctagaaaataggttgaaccaagtatcgcaatttagtactagtagacacggtctgtttactatgtattatcccgcatagaaaattacggtttatcatacatttaaaacaacaaatatcttgtagcggttaaggttaacgttccatgaacagtttttaatatgttgaacaatatgatagttacagacttatactataaggaatggtatgaataacctacagcaaactgtaacaatatattaaagtgttcagatattgtaaaacattttgagaagggaattggtatcacaatatatcgttcgggaactgatgcaaattgaacacgcttaaaaaacaagcaacaccaaactgtgtacaagtcgcaaatccgtgatgaaaagtttctgttttttaacgtaaggtctggatttataactttcgataatttctgaatcgcaaaattaatatcatcaacatttgttgatcaagttatgtgaaaatactaaggtcgcaatttaaagatttagtctaccttttgtgttaattttttctagcgtgcaggttgttgtgtttattttgctagtgaaaaaaagtaaaaaaaaatcttccaaactgcctattttttgttcccgtttcatcaccgtcagacaaaagccgttccggtagtgttggacagtgccaactagaacaaactatccgtcggaagatactccgctgatcataaaggtgctatggacgaaattgatcggtaagcgtttttaacttcacgatattctcgtattctaaatttgtttcttttcttccagtaggaagagtaaaaggccatccgtgagcggatacagaagcaccaaagtcgccggatgtcgttccactcgtgataaacaagttccggtgttagttcagacgaaagtgatgacgacaacaaggaaggagggattctcgattacaggcgacggggacaaaacaaattttctgaacatcgttgatagctgtttgttcaaagaactacaaaactttcacaaatcttgtataatacagaaaattctgaaatttcttctacaatttattgattgcctctagaccaatttaaagacaatgcttcaattgtaagatataaaaataaacatttttttaaacattttttatgtttttcaaagaacgacaacattttcgcaaaactgtgaataatacaggaaaaatacgatcataacaacaatttgaatttttttttgcgatgatccatgggttttgtgattttaaaatattctcatatttagggttgtcaagtttgcacaacataatcgatgaattcttattgaaataactacaatattttcataaattaccgtataatacaaaaatattcggttgctaccgaaggttgaacattttatcatctgtataattttctaaattgttgttatttttcaataaaaataagtgtgctcaaaaatcatgtataataaagaaacatttaaaatttctcctgtaattttgaaattgccgcattggcttataatctcctgggtttagattttttcagattcatatataaattgacagaacctatcaaaacacaacaaacgttgaatgccaaaacgtcgaaagaaataacacatcgtatagaaaaaaatattgaattatttattctttcggaagagaataattcttctgagatcatttcgttcccttccaattcccacctttcgacgttttgtcagccaacagcaaatcactgattgcctccagtccgtatcattttaagggtttggagcatacttatatacaaaagtaaatatatctacagaacatttttggtgatttcttatgaactaaaacagttccacaaatttgtggaagataccagaaaagttggatcgtaaaaacaacctgaaattgaccacaatgttccatcgattttatgatttaaaaatgttaagtaaaatgttatcatttagagttggcaagcttgtataaattaaacgatgaaatttcgttagaaaacttcaatatattcacaaaataccatgttatacataaatatactatttctgttcttgtttcatacttttcaagatgactaattgtttttatttttcaaaacgttataacggttatttagttttgaaaaaaaaaaaaaattctcaacaattataatggctatttgctctaagaactacaatattttcacaaacacggataatacataatagtccctgactatggttgcgttttcatagtagttttgtttacgatttgaaattttctcaacgtaataaatataaaaaatagagcagttattgtttctgtattcaaagcacgacaaacagtttacaaaattggtaatataataatttctatttattgataatatttgcacaaatcatatctatatattattacgtagtataacagaaatatatcagatttccgttgcaatataataattgtggcaaagagttatctatttcatgattttattatattttttcatattataaaccataaattaactgagcaaattttaagtttcttcacagcattaaaccattctcaaaaaattgcaaataatacacaacaaatacctttaacaatcttacttcatatttaccgcaacgacgcatggattttgtggttttaaactattctcatatttgagacttacaactacaaattgtagcttatccattattgtcgcaatgacatcattttttaatttacttataataacacaattaatcatattttacttacatggataacggtgttaaaaaaagtggatcgcttcaaccctagtttgtcctcatttgtagactcatgtgtttgatttgtagtactacaaacactggagctagtctaaaaaaaaatagcgtttgtttgtacacaacttgaaacttatctaacaatggagttcgaatttatattaccaaacatttttcgtagtaatttgtacatttaacgaattacatcatatatattgaactgcgtagcatatggcagaaaaaaaaactgtttccgctataatttaaaataacactgttcgacaaaaaattttttttggctggatcagggacgcgtttatatgggtcttgaagtgcaagaaaagtgtagaaagaggccgttttcaaataatttgcagcacccttggattattttttgacaaagtttgaaaattttgtattttttatcaaaaaaaagcgtaataagcaaaatattaatatattttcaaattcaattattcaagcattgaattattcaaatcaatattttttagcactagatcgcttcagggaaacgtacaccatttcagaagaatattggtatcatttttatatatgaatttggaatgttgacgatcattaagcaagtagagtaaggtggggcaaaagttcgaccttagtggtataatcaaagtttccagagaaataatagcagttgaaactaaataaataccatgcaatgaaccttcaacatattggctataatattgctaaacatacctgtgtcaaaatatttacccatttttagttataacagtttcaaaattgattgtcttaaacgaacttttgccccaccggtgggacaagagttcgaatcaagtgtggggcaaaagtttgctggctaaaacacttaatattgatacttttataacagacattgtttataccagccgtaaacttatgtttgccggaaaatacacattaaattttcatcaaaaaattgcccaaaacaggttcaattttaatttacccaaaaaaaaaagcagtttttcgcaaaactaagtgcaaatgtaaaattttggtaacttttttcgtacggtcaggctaatttagctaaatttgaaggtaatatgtggattttgggtaatttgaatttttcgccgtgattttatgaatgggtcgaacttttaccccgctgattcgaacttttgccccactatgggccaaaaattgtttccgagcatttctgcaagaactaatacacctcaaagcatccttatggtaggcctagaaacgcccttacatacaatattgaaaaagattttatctctattcggttccgtgaagcgaaagtttgatcaaaaattacaatattcacgccaaaaaacatcaaatagttataacttttccaaatctcaacagattatgatatttggagtgaaagtctcctacttgaatagcattcgaaccaccacgacatttataagttttgtttcgttcccttcgaaatcttaaaaagaaactcttaccccactcgaacttttgccccactttactctatgtgaggatgtgcaccatataaatactacttatttttctatttcacacatctggttcattatataataactattatatgttcaagaagacgcttgattaggatttgattctttgctccattagataaagcacatgcctgcttcttacttgtaatatgaaacaatttctggttaaaccatttccgatatattttttttatttttcggttctaaatttcacatgtttttcggcaattttaatcaaacttcagttttgagatttggaatgaatttcacaaataattgcgatgtattgcgatcacttaattgaaaatcatttttactcgtttcgaagatataggaatggggtctcataaatggacacgtttgtccttatatgggagacgagtttaaacttaaccttaatggtcgacttctttatgtttccaatatgcttacctctaaacccatttgaagaaaacatcccattgaacaagaaactaacgctccatttgaaagtttgattaaaattgccgaaaaatatgtaaaatgtagaatcaacaaaaaaaaaataatcggaaatggtttaacaggaaattgtatcatcttacaagcaagaagcaggcatgttaccactaaatcagttttcacaaatgatcagcattgtgcataaactgaatcaaaaagatctcatgcctgcctgagtggctgtcaaatggtgcaaaatgtggaaatgttgattactgaattatttgttgctaatttacgttagtctgtaatttctagggatattctgataacaaatggacctcacgataggtaatctattcttaatgagtacccatcaaaatctttggaaatcgcaaataacattattatcacatttttcacagacttcgccatcggctcctgataaaccgactagctcatgtaagaccacttacatgtccgtgtccaacctaattttgtattgttgccaagagtttattagaccaaccagcccatataaacataacagatacatcaattttccgtagtcgtatccttgttgaaatcaaatgttactggattgcattgcttattgctttatctaatggagcataaaatcaaatcctaatcaagcgtcttcttgaacctataataattattatataatgaaccagatgtgtggaatagaaaaataaatagtatttatatggtgcacatcctcatatgcttgtttaatgatcgttaacattccaaattcatatataaaaatgatgccaatattcttttgaaatgatgcacgtttccctgaagcgatctagggctaagaaatattgatttgacaaattaaatgattgaataattgaatttgaaaatatattaatattttgcttattacgcttttttgatgaaaaatgcaaaattttcaaactttgccaaaaaataatccaagggtgctgcaaatcatttgaaaacggcctctttctacactttccttgcacttcaagacccatataaccgcgtccctgatccagccaaaaaaaattttttgtcgaacagtgtaatcgccattacccatgaattttacaatttataaattttctcatatctagtgtagtttgatattcattgcgatgacgcattgattttattaattcaaaccatttccatgattacgagaaaagaatttaaaatgaaaattgatacgtgttagttcaaagaactaaaatattttcatgaaataatttattcaaaactaagaactcttttgtaatttaataattttcgcaatgacctttattttatggttcaaaactttcttataaaaaaacaagaacattttttatgccatctatcaaataacctataataagaattaagaataaaaatataaggtacatatttcaaatatacagttttccaaatcactgtctcagccattttcataacactttttcaaatccatttttattttgtactgatggcatatacttataactaccatgtagtaagtagaacggtaagaatcgattcaaccagctttactttaataaatgtttgagcatgacacatcttaaaacatctgctccaaaatactatcattttattcttaaaagaactacaatcacaataggatgttgagtgcagtaaaaaactttcttttcctattgctatggagaacttacagatattttaatgtttaaccacatcgtactgtttactatcaccgtagttttcctatttcgcagggaaaagaaatagagtaccatctgtgcaccatattcccctcatttaagggaagttaggtgttaggtttattttaaaataactattgagtcgatcaatactttttttatgtcacaatgtagcttcaggtgtagatgatcagcgttaacatagaaattatgtgaaaaacactcataataaatatttaattggaattgttactgcatccatgtgttcctattccgcacacgataaacagatttcgtgacgaacatactggataaaaagcattgcataattagaatttcgttatcttgctattttttatggtcaaattatacctttttcagcaaaaagaattagtatacataataataaattttttgaatgagcgattattgaaacataccaaatacctactgatccaatagccgctcacgatgtcttgtgtttttaatataaagaataattttatcacataaaaataaagtcagacgacttcatttggaagttgttaatattgctagaatatatcacgctatgctcaaatcagcagattatgcaaatcgcaacctcggatttatttccgctacagttcagtaattgagttatgttttcataattataaagttttacaatattccctccccttggttatgcgaccttgccgcgatgggagggcataatccattagtccatatgatggaaaccagaggcgtaacctgtagtggtggtatcacattttggcattttttgcttaaagccgcgtcataattcatatggcatagacgcaataatatctcggatgtgattcaacggacattctgcgtcattgatagaattgatgcccatttcaaatagttaatctattcgaagtggacattaatactattggtgacgttcagtttgccttttgctagccagaatgatccgtaggcactcttactattagctagctagacacatcgttatcatattcgacgtagggaatattactctaaggaaaatgactagtagattcactgagtagaaataagtggcgacaatcttattttaatatggtttttacattgccataataagaaatacctcttttgtaacagcggtataaataatctaattccagcttcattttcgcaaaatttacaagtagaaagtaggcgttgtgaagcattgcatttgccaccgaaaagtgaatcttgtaggagactgtaatagaagcctagggtaactttactcttcaatattcactataaaaatgactatggaaagtaagacgctgagatcgatcattagggtacacttgctagtttcgaaaaattgttgaacagacaaggaaagcgacttttttctttaaggatatatgaacgtaatgaccaataaatacttttaacaacaaaaaatgaaattaactagaactactactaaacagcctaattttgttaagacttgacgacacttgacatttaagactctaatcttacgtaaaagacaggagtaatcagaatagcacttgaatgacaaattattcaaaaccatttcgactagacagtattagtaatgcactactatttaaaacaaattctacactactatttcaaacaaattctaatggagctgctgattttcataatgcttccttttctcagaagcaagggaatatgggtacttttcaaaaactaccacgtcacaatactaataaaaaacagtgttcatgtgggcgccattgcctagtccgtctgagtattggtcctggtagaggggaaacttggcaaaagccagatcgagggttcagcctagacaaggtaaggtgtcaggcagctccaactgaataccatacaaaaaaaaagaaaattagggcggtgaaaactggattacctgcaccagtattcgccatgtttttaatttcggtttctgaattcgccacctcctacgttgatttcttatggagggttgcgaattcaagaacaccatggcgaaataaggtgctaagaagcaaaaattttagtgaaaaacttttttcgataattttttcagaacatattgaggtttttgagaatgttgtcacatcattgcgtagtaatacagtggggattcgctcgttggggatccgctacatggaatgactcgatgattggatgttcgctggttggaaaatatgccaactaaaaagcactccaatgtcaagagaagatgtcaaactggcattgaagtctctatatatagaacaaatgtgtatgtatatgtgcgtttagtgacgatttgctctccagatgcgttagtctggagcattttcgtcagctgtcagtcgttccaacgaacgggtcagattcgctagatggaaggcagtcgtgttccaaccagcgaatccccgctgtataatgaacattaaacaatttatgtctgtatgtgtcgtaaaacgctgtattatccaaggtggagaaaattggtaccatggcggataccaatacgacacttcgtttgaaaacatccgtagttagatgattcgtatgattcgtcatgttaaacataaatagaaaagtagatcatttattcaatcgcatctattagcggtatccattttaagagtcaacaaaagcgtaaaagcacagaatacactgtgtaagagtgagtaatttgaaatggtggagtcggattaaaggtatgctaaaagtgtttttttaattgttgggtagctgaaattttgtctttttgataataacattaggagaagtcggtagtcaaatgcttgacgtttctccttctgaagcaagtgatcaacgtttttatatagacacctaccggaaaaaaaacatttgaagtaactttttcaactgcaccctgaagaaatatctaaattaatttgtttagcaaagaaaaaataaaaataaaataaaattattaaaaacaatttcagtttttgatgttcctgttcctgttagttttttttatagatcctatttggtttttaaagattgtttattttataaagtggataccttgtgcatgctatctttctaatttattaatgaaatcacaattggttttctgtaatcgttcgattaatattgcacgatgttgtagtattaaaaaatccaaaataattaaatttcacacgaatgagtaacattcgatttttgaaggttatcaaaatcaattattagaaattggctcaaaccgtcgataatatatatttttttcaaaaaagggcatgtcccgggtagaagtgaataacaaaataatgataaaataagaacaaattttgcaatcatatctagtttaaccattattaatatattaatatactagtggttccggcaaacttcgtcttgccatcaagtaggctgttgaaaaacgctatgtatcgtcccatataaaatgacagttccatttcgtttttccctacttttacggtgaatatccaaaatatacaagcattgttaaatttgttatttgtgctaaaatactaaaaaaacattaaatatctaaagaataacaaacttcgccatcacagtaaaatatataacttggatatttgaaaactgtatttaaaaaaattatgagaacaaaccaatatcaaatttttccataatagctcattttactatttgtatgatattcattgaaggttcaaaaatgcaaaaggtttttacaggaaagcaatcatgtgaaaaaactaaaggagattgggcaaatctgggcccggaatgtacacagatgagtcatatatcatttggaagatctagatgagactagagaaagtttgtatggggtcaaaaacatccgtcgtgggagaaaaaagttatttcgcatgatttgagatggatttacgatgtatttcgctatataattatttgactaacaataaaaaaaaatatttattcggcacctaaataatgatgaaaagctctatgttttaagtaagtgaattgagattttgattcagagatgaaatcattgcaaggtgatgttaaacggcaaaatattaagaattgtataaacatatatgtataataagtaaagatttctaccagattctgcaattcatcaaaccaaccactatttttcaattgttttgtaaccgatttattggatattttttgtgagcattaagctaatagcatgtctgaactttgaaaaaatcagttttatccgtcgagaaacaacagagaaacgttgggtgaaatgtgggtggcatctaataagatgattttgataaggtacatattattccagatgggttttaacaaagagtttaataaagccatcggctcaatatttatgaagaacatcatcagcaccagtggggacgttaatgccaagtagaagaagattatcagcaccagacaatgccgttgaatatgaattgaaatggtcatttgaacttatcagtaacatatacgaagtgttatgatttcatctggttaaatcaaaagtaatctagatccagaccatcgttgacataatcctactcgcgatgtatattgcatacgtagttgtttagtctcgcatggctcctacatacaaccggtcttaagttaagaacagtgtcgttaagttgagcatttagtaaagaaatcattatcgtcttacgagttagtatgcgatcgtcgtggcgaccagtggtcatatttttctaacgagggcctatcttatattatcacttagttttgctcttcttctatcactttccatcaatttatctgctaggccttgacatcttctatatctacgagcattacatattgaggaatatacggaccactcgccttttttgtaggtaggtcatatagccccttgacttcactccctcggtagctgttatgtctctttgattttgactctctactgatgcagacaaatgaccagcttctacgggcctttgttgatgagttccactcataccatcctttaaaactgccttgttattctttaactggtgaacggcatcctaaacttccctcaaagtggttactgtagaccaatattttctccactgccatgaacctccgtgactgtgccctcagcactattcaaatgttcctcgtaatgcttcttccaccttttaatcacctcgcctccgtccgacgaaaagctctcatcttcaaccctgtatatttcagcacgcgctatgaagccttgcgagattttgttagtcgtgatgatactgacaccaataacaaacggaaatagttctgatagagctattggcagtttgttaatagcaaatactacaattacttttaatttaaatcattgatgttgaagatataagtgcgctaacagtagcgcggttttccatcgctagaacctgcacgctaatgctgagtacgaccagtgaggtttttctaccagcgttgcgtagaatacaacaacgaaatgacagtagtgttaaaacggatataatctggaaattcattactgagtaaactgaaggtttatataatcataacatactacaacaggaaaatacgatctggccttggtgtccaaccaatagtttacctatagtgagctgtttttcaaacacacatgccttgcctatacctttatttcctatctccgcatgtcaaagtattcacattataggaattccaaacattcagaaaactgtgtaaaatcactagtcttttaaaatacctacgattaaaatatgaacatacataagcacccttacgcacgaacccaaaacaagtgagcaaaacacctgatttaataaaaaaaaaatacccaaaacatgcccttccttacattattccagcacacgtaacttttttctcccacgttgaatatttttggcccaatatcaactttttcttgtcccatttagatctttctaatgatatatgactcatctgtgtacattccgggaccaaactccatacaattttgcccaatctcctttaccattttttagttattattttgttatcaatatctaaataataatatattttgttatttacagttgcttatatttttattatcattttgttattacaatggcaaatacaatgttatttagtttttaaaccatacaaacatagttatcatttttgttattttaacttttatttcaaacaaacaaataacaaattttgacattcaaatattctattttaagtgtgttattcatttgcaattatcggatccttaaaaagcatcatcaataaaaagcgtcctaaaaacaatcaaatttgtggagtaacaatttttcgatatcataaaaacaatttacacagatattttttgaaaaaaaaaaattaaagggaactgaaatgattaggctttgtaggtttaaaatacgtcccgacggaagtacttatatagagttgcatattcagtccccacgcacgtcatgtgtgaatcacgatattttactttactttttgctgggaataaaatgacggtatttcaataagtttagccattaatggatacattactaaagtgacctagtgtcagtgattgttggaatattagtggttttgaagctctacaatcggtagaatagtaaaagataccatcatacaatttgttcataaatgtgaggatcttgttttgcgataaacagtgttcaactttaaagaacaggttttcttaggagttattgaataactatttagttcttagaccataagcattttgttagatgttatatgttcatagcatagtaaattagtggctgaaagacccacagaaaaccgattacgatctcagtattaaataaaacatatgtataacataaacaaggtgtcctctttataaaatgaacagtccttgagtcttttcttggttcctgcttggactctatttctacttttgctactagccctgaagtatatagcaattacgaataagggaattgctgttaatcgttgaattcaatatattttttatcactctcccattccgctgtatataatttctaaactcaatttctttttctgttcttttttcaggccgtcaaaaacgaagtcaacgtaccgtgtgtgaagaatttcgttgatctgctgtactcccaaacgctggacgcgtgcaccaaatcaaagcacaagctggctctcttcccgctggtcacctgtctgctgtgcgtgtcccaaaagtccttctttctcagcaattggcactgctttttggccatgtgcctgagcaacctgaagaataaagacccaaaaatgagccgagttgctctggaatcgctctaccggttgctgtgggtgtatatgattcgcataaagtgtgagtccaattcggcaacccattcgcggcttcagagtatagtgaattcgttgtttcctcgtgggtcgaaagcggtagtgccaagggatacccctctgaatatatttgtgaaaattattcagttcatagcgcaggaaaggctggatttcgccatgagagatattgtatttgagttgctttgcgtgggtcgaccaattaagattattatgacaccagaacgtatgagtattggcctgcgtgcgtttttggttgtggccgattctttgcagcaaaaggatggtgagccaccaatgccaaggacggttggcgtattaccatctggtaacactctccgcgtgaagaagacgtatttgaataaaatgctaacagaagacaccgcacgcagcataggtatgtccaattatttcccacacgttagaagagtcttcgtagacattctacgagctcttgatatccactgcggaagaccgctcatgatgacaataaatcaaaatcagaacaaagaaccggacgaaatgctgacaggggagcggaaaccgcgcatagatttgttccggacatgtgttgccgcagtgccaagaattatccccgacaacatgaccggccatgagctggtagacatgctttccagactaacaattcacatggatgaagagctacgaatattagctcaccaatcgctacaaactttggtagtcgacttccccgattggcgtcaggatgtgatacagggatttacgcagttcctagctcgggatgttgtcgatacattccctcacctactagacaatggattgcgaatgctatttgcgtttctaacggtttggaaaaacgcactcaataacagtgggaccagtaatagcaacagcaataccctgaattctaaatcctgttccaatactgccggccagaggtttgctccgcagcaacaggttatccagcagacacaacaacaggactccagcaaattacatcccctgcagacggcttcgtcgttgaatgcggctacgataaattccaattcaagtgccagctctggaatttcgtccattacacaaacaactacaatcccagcggcggtcaatagcaatgattccagtgggcatggatcggcatcgtccggcggtaagaaggggcacgaaatcccccttgccaccactatgcacatggtcgaaggctttgccttggtcatgttgtgcaattgtcggccagctccgcggaaatttgccgttagcattctgaaagaggtaggtgtatgaattttgattggatttggggattgggtatatttgcaaaacatttctatattttgcctaaccagaatttatatggccactagacatatactgttttcaccgaatttataaatatctactatagtaatttgcatagaaacttgatagaagtcttcgagactggggggtctgtagccttgaggttacgctttcgcttcataagcggaaggtcatgggttcgattcccagcccctccacaaaaaaacccgtccagccaccagaagacgcctcacggaggaccgtgctttggggagcacatccatcctccgtcagtatcagatggtggctgagacaaaaaagccatctagcctcactaacagcagagctctctcctacctgctcggtgtgaaagtaaaagagtaggagagagtgtagatgtaaatatagataagttgaaaatagatctatatcggttaagaagctacagatcaactgattccggcacagtagtggccacgagcacaaagtgccttaaaaaaagtcttcgagaatgctgtaattgttaggcacatgcatcaatttaaagtgaactaaaaaatattctgttgtcattatcattatcattattagtgagattttcagcgagtagtgtgtgatcctttgaccgtgacgcttgctcctgcgggggcgagtgaagcggtcagacaagatcaatcttgttacgcgcgcagtgcagtggggggaagaaaagtggcgtgattcgcgagataatgtagtagtgtgtgatcctttgaccgtgacgcttgctcctgcgggggcggttgaagcggtcagacaggatcaatcttgtgacgcgcgcagtgcagtggggggggggggggggagtggcgtgatccgcgagctaatttagtagtgtgtgatcctttgaccgtgacgcttgctcctgcgggggcgggtgaagcgattatgttatgcgcgcagtgcagtgaaaaagtgtatagtatttggcggtaagctcagtgtggcgacggaaaaaaagagtattacatccaggtaaaatcgttcattattattatttactcacctattaccatttgaaactaaatacgtgccagggtcgaaaattaaattttcgattcgggaagtgtaaaaacatttcatatatccatttgatatctgggtgtttttatgcggggcttactgtatatgaaaatgacctcagaatgtgtgtgtatttactgccattcttgaaatgggtcgttggaatttcagtagagctatcacctttcatctcccgggctaaaattgtctgcagatataaagatatcgaagggtatcaaaaatacatgcatacaattttcttccataaaagcactgccggtcagtgggagatggattgtatacacacacacacacacacacacacacacacacacacacacacacacacattattagtgagattttcagccctattgctggttcggcttcgttataaaataggaaaagattaaggtgaaaatgcatcgaagtaaaacttcgaattttctagagcacaaatctagagaatcagacaaccgtttgtgctggaaactgagagcgaacttattattttggccttgtgaaatagcagaaagcttgaaattcagaagatcagaatgccggccactaccttaagttgccgtaattcagcgcaatttagaaataaaacgattcaaatgattaattaaaaattattattgcatcaataaaagagctttatgagtggatcactgtaaatctgttttatagtataggagaaatataaactaaactgtatgcataatttataattatgtgttttttgaagtacatagttcactcattgaaatttgcctagtttcgcgcatttttaaaacgcttttccatattccatgcaaaataatgcctaattccgcacactcgcgaaacaagtttctccagggattccttcagaagtttctctagggcttcctccaatagttcctcgaaagattccttcaaaatatttcttcaagaaattcctaagaagttcttccaggagttcctcctggtaccccttaaaggctttcttcaagtattcctcaagtgattttcttaggagttcctttatggattcctccaagagtatttttatggattcctccaggagttcctttagtgattcctactggaatcttttgaggaattattctaggagcttcttcaggaatacctccaggaggacttccatggattactttaagcattctttcaaaagtttcttccgttcggccgaactaaaatgaatcttaaatgcttcccgcgacgcaaaaggtattcttccagacatttctcaagttatttctccagtagttttgcaaaaaatcctccagaatttctacagggatctttcttaacatttcctacaggagttccttatggaattcctccgggatgtccttaaggaattcctccgggagttcctttagaaatgcctccaggtatttctccaggaaatccttcaggaatttcttcaggagtttcttcaggaattcctccaggagtttcttcaggattttctccaggagtttcttcaggaattcccccaggactgccttcaggaatttctccagcagtttcttcaggagttctagcagcagtttttttcaggaattcttacaggagttccttcagaaattcgtctgagtaataagcttttatgttttttgaaacactccggccgtaacaaggtcttggaacttcaaaaaacttcgttttgtaattttgagatttatatgattttttacagagaaaatcctcattgcctaatattgtatagcacacattttagtttttttgataaattcactaaacataaaaggacgaccaaataaattttatatgagaagtgtcggtccttcaaggaataccggaatatcttcaaaaccagatgatcaattgtcaatgccgatacagattaatatagaatagagttttttttttgagaatttgtgaagattgtgaaaaaatggtgcaaaaatatagaaaaacaaaattcgtcaaaacaaaaaaaatgttatcgcaatttaaatattttttgtgaaaaaaataagctgcaggtagaaaggttaattgagattcttgaaatatttctaggaacggatttggggattcttgacaaggttcattatgatatgaataagctttttgctggaatcctaacggtaatcgagtcaatagttgaacagtttctcaaaagttctttctgacactttaaagtttataagtatattgctaataaggaattagatattctagaaaatatgcttgtatgatttttttttgaaattcttgacatctctacaaaagggttgacgaaaagttgagccaaagaatatatttcttggtggatctactgaagtcatggacagactcattatgaattttcgttggcggatttcaagggttgttgacgatactgattctaggtgaagctttttctggactaattttgctatcaaggactgacaaattccttacgtagccttcaagagatattgtatagatttttagcagatttattgttttatttttattattcccaacaaatttcttgtaagattatttatgaattaatatcaagacctttggggatgaataaatagcgaggtactttaggtattcttgctccgattttgtgatttcttcattagattgttggctaaatcaatgatatactgcttaagtgctgcatttttttatttacgacaaaaaattcaaccagcctaataagagaacaagtaaatgtttttagacatactgtcccagtgcatccaacatgagtttcaacagatcaatattttcttcaggaaccatccataatccatatctacctaggcttaccagaagaatatttcagaaaggaggacattttgtcttaccgcttttgaaaaaggaggacattttaaaactttgccatgccagaaccagaattgacttttagcaaaaaaaaaaggagagaatgtcgttggaaaacactgattattgaatcacttgttcaagaaacaacaaaaatttatattaaatgttccaaaaaaccttgtttctgcaccaaaagtttaagtggcggacacttctatgacgaaaagtcacttcaatagaaacaactataaacatcaagccttatagttctacgtactttgatacaaaacttaagttgacttttccgttttgctctttgaaacgaaattttttttttgttttttgaacatatgggtgaattatttaatatgataattctttgattttttcaaaataattattgaataaggatctcttatttagttacataacttgttttcaattgaagctcttagattcaattattacaatataaagtattagaagagatttaaagattgtgtgtcccttttcgaaaaagatattcatagcaaatcactcaaaacaatgttttcctcttccaaatttttgctaaatggtgttagtttggctgacaacattgcttaatgtattcccataataagattattataatatattcgtaagtaatatgcaaaaaatgtttattggattacccaaaagcatttccgcccacttaaaagtcccacgacagcatgcaagttttcactattgattgaacatacacaacgaggagtcgaaaatatatcatgaaggtatcctttttgaggctaatcaaacattatttagaaaagaaacaaaaaaaaaaattaatcaaattataacatatcaaacatttaacaaaattttcaaattgaaagttcacaaacggtggaaatttaccaaacttaacattgggtttcaagcaaaacatcccttcatccttatacaagactaatgaatagccagagagattctaacgaatttgtaatcagaaaacttatagatgtaaaattcaatattagattaatttggaaaaggaggacattttcagtccaaaggaggacaggaggacatattatcaaaaaggaggacatgtcctcccaaaggataccatctggtaagcctatatctaccccatagtttcgaagacattattaaacggtaatgggttagctattgaactttactattttacggaaatatagtcttaattaagatgcaccgagcaaaaaatctgtctgaacttcccatagattctaggaggtggacggtcttttaaatatttcaacaaattgtgtgtatctttttgtccaaaactccttcgaaattcaaatagttagatcaagtattccaaatttgaccattttgtatttaaaaatgaaacagaaaatattaaatcaagaatcatttatcaatccgttttttacctttttggaatccgggaaaaatccgggaaacggaaaactgattttgaatggacaccctgagtctagtacacgacactgaagacggccttacagttgaggtcgaaatacgcgtgtctgttaatggattcagactcttatggaataaaatggtatagggaaagtgtaccagttatggccatagtggttccctatttgaccatatgcaaaatatggataacttttacatttttaatctttctgaatgttttaacatcaagatttatcctttatcttactgctaaaacacaaaagttttttcaaaatgtgaaggcattcaagatatcacgtatggtgaaatagggaaccactatggccataactggtacacctaccctagtactaaattcggttttttcatctacttataaattttgcaattttcagaaaaaaaacaatcattaatgaatctatgatatttggtcgaaagacatttagtccaataacatttagtcgaaagacgtttagtttaaagtacgtttggtcgaacggacatttagtggaatggacatttggtcgaaacgtttgattgcattagaaagcgtgactaggacatttcgtcgaatgacatttggttgaaagtatatttggtcgaagggacatttggtcgaatggctttagaatagttcgtcgaatgacattagttgaacgtaaatttggccgaaagcaggggcaaaaggtatattgaatgatcatttggtaaaatttattattgttgactaagtttcgcaaagttggtaagttgaagtattctgtttatattttattttgaacttctaccaatatccaggatttcaatgatcattcaaattaacttttaaaaagtaccttttttctgtacattgactgaaatatttagctcctgtgattttttttctttaccaatatcatcattctttgaaaaagttattttattactcaaagattataacattataattttttgaatttattattctttgttattgatctttgtaatgaactgctgatcttcatctaatggatgcaattggagagaattctctgaatctttttttttttttgtaacagcttacagacaagggtgagatttgaatcgaacgacagaaaaaattgctttaagcgaaacttttacggcgaaatgaatgctggatatcggtaattctaattatgggcaattggcttattgtgacttccaggttaacacattcgtcaagcaaatatatgattttgctgatgatcgatagaagcgatagaagcctttgatgatgaaacaagaaaattgtagttattatgtatcgggtaaaagtagacgaaggtgacaaacgtcggcttgcttccatataagatcagcttatcccgactcacagaacatgctggaatgaaaaaagcaacatggaacgtcgaaaacgcaataggttgatcaatatgttgggagtgtagggtccatcaaattgaataacacaattttgccaaccgcacatagattgttggtaaaatggttgatatttttttctactattcaagcactctgtatattatcaacaaaattttaatttcgacaataataggacttaaggtaaaactttgtttccatactacttagattcgaccacatatcctttccacgaaatgtcggttcgtatgctttctgttgtaattaaaacttttcgatcaaatgtccattcgacgaaatgtccgttcgaacaaacgtcattcgactaaatgtcattcgaccgaatgtctttcgaccaaacgtcatagattcgaatagcggtcgaaccgacatttagtcgaatgtaaatagtatgaaaacgacgttattcgtttagtacgattatagtcaagcaagctaacttcagtcactgcagtcaactcttcttacctcatccgatatacagaataagcacaattttctaatttagctattttcaacaataaattcaaaagaacattatgtttacatggactacgcagaagaatttctttatgttgagattactatcccgttaatttattttacttacgaataaaaagttgtttcgaagtaaaattaacttacgccaacactaattaacgtcaaattactatccgataacattcacgttcctagacttgtcatgctcacaaatctacttacttttaacttgcaaagaaaagtgtaggtgctaagatgaccccctctcatgcaggagaccacctatccagtttgccgacgcgcactttgttttgatttctgcaatgtttttttagatcgataaagcagcagggaatcatttcagatatgtggataaagcagaacaaaatgctgagtaaacagtgctaattattctaaactcaatataaaatttacttcgagtccaccaaattatagttgaattttgacgtttgacgtatgttagttcaataaaaaatatagttgtcaacaactatatggcatagttattttcaacaatatactgtcaaatcaactatatttattgaccagaacaatcgaagttgcaccggcagcttcatttttgtaccgctgaaaaacattttcaaatcacgatattgttttttgcttctcgatttttgcattattttttccaagttcacaaaaaattcttctagttttctaatatgtgtcgatattgataattggtcatctggatccggagatattccaaaattcgacgcgtagtcataacccacgtaaatatctcaggctacagattttttttatcgtattcagatatttactccccggaatgatacattaatgcgagtatgttgtaaaaaaaaatatgaagcaatttgatgcagccgtctttgagtaatgagaatttatgtttctggtaccacgctggacaaataaagttcttgaaaactttaaaaacttcatatcgtaatttttagatttctccaagaatactgaaacgatttatatgatttcgtcagagtagctccttattacctggcattgtagtacatattttatattatttttgataaagtgatcaaaaacgaaatggccgcaaaagacatttaatatggagaatgtcggtcccccaaggaacatcggaataccatcaaaactagatcaccattgattaatatcgacacgaattaatctcttaatctagaagagtcttttgagatcttgtgataaaatggtgcaaaaatatcgagaaacaaaaaagttatcgcgttttgaatattttttttagcggtaaaaaatgaagctgccggtagaggggttaatgaatggggcttagaattagcttaccattcttcaatgtgcacaaaatgagagctcaaatattaaaagtcaacaacggcgtcaataagggttagacaacccttgttactagagaccgagtatacctctgcatctccacagttgtcatggaaaggatattgggttagtgggataaagtagagatctgggagttccgtgttgtctattgcctaatgttcgtgattgttcagtctgtgcagcccttggctgaagacggtgtaaattgtcttgagaaactctttgtaatgcttgtaacaaactactgcaattgtatgtttcaaggaatttctagaaccttttttggtagaattgttaaagaatttcgaagagattgctgcgtgtatttcataaaggatttttttttgcattaatgcctagagtgagtcctggtccaatcctagaatgaaagcctggaaaattgttgagcttatccataattgattgcccattttttgatggaattctcgaaaacatctggaaggaataacggagataaaacgcaagaaaaacccagtacatattcgtcaatgaagcgctggaagaatgttcgtgtacccgagcagaagaaaataactactgaaccttaaattgaggtattccataccagataatttccaatactgacaacctgaatgagccctgcataagaggtaaaatacctcaaataataccttctgcatattctacaaataccaagctgataattagatcaggtattgtaatccataaataatacttgatggattttcatataaaagtgaaatttttcaatagtagttcaatacctacagcagtcctcaatagctatcgaattccaaaatgaagtatttttaattgtttaacacatttttttcaaataccatttgaataccaaaatgaggtattaataactgaaaaatacctaattgtggtatgataccaaaatatggtatgcataagttattgcgagttattctttcctcctcggatagtagttacttgtgttctgaagggatggcagtagattgtctaatagaatctctgtaacaatcactgaaaaagttcttgaaggtgttttctcaaataactaagcaggaatattttccaaaaaaaaaaatcttgttgagttccgcaactagggttgtcatgtctattacggcttaaaccagccgatggtgtttttgaaaaaacctgaagttcgtagacacaaaagtcaatttggacaaaataatatgtaaaaatcagcccttagatgcccaattcgactctcctaagcatgcctacgaacaacagtgagaattttatttttagcgtcgcactgtctagtgtctagtcgtggaatcgaagcccaccagaacgattccattatttttcacaattttacatctcaatttgtccaaattgatctttgtgtctacgaacttcaggttttttcaatcttgatgagttgccggagattacccaagaataaacattttagaaataatgctttgatgatttaattaagttgtttctgagtaatacttggcactaaacgctgctctggtttgaatcctaggttactgaaataactaatacgattcatacatcaatgcacttcctgattcttgaaacacattatttggcgaaacacgttgaatcatcagaatactttcttgagagattttatcagcacaaatatttaccagaatgaatcattggggaatatatagaagaaactctgaagaaatagccggagttatgtctaaatagattactttaggataaatagcagttttgtttacaaggtcaatgacaaaagcctgtggagcattgcataacgaatttatatcgggttgtttggtggatttgcgccagagcatggagaagcatggtgtttttgtacacaccaagcattatcgaagggttttcgcatgaagcaattattttattatacctggcagtagtttcctcactccactctggatacgcctatgtagtcataacaaattgatacaatcgttttagaataatgagcatttttgtatatggtactactctttttttttttgttttttacaagggggaaatctgcaaacagatcccctgagacggtaactcagggaatgctcatcctcgcaccaacgacgacccgcttaaaccagcctatgcactgtgcttgagcaattcatttagaattgctcaagtggtgaacagtgcatcgacatgacccttggactcagacccttatcgccccggaaccaccttacggtatttcttcggggaggtatggtaccactctcgataaagaggatatacatatcattggaaaaccaaaaaaaaaaaagaaaaaatctgttttccaaattccctagagacatctcatcggatttgattttttttcgtagagaagctcttcaaaatctgacaatttacatatctaattattttaataaatttattaataacaaatcaattcagatgatcaattctcaatattcatatttattttaaagataaatgaattttttaagtacttatggaaacatggtgccaaaaaattaatgaaattaatgtttaagagatttgaatagtgttacttgtggtaaaaataatgcaaccgatagagagggtaacaaagatattatatgcgcaacatatgtaaaaactaatttctaaaagaagcttcggagtattttgattggaagacaaatgcatcgaaatccaacattgggttataagctggtgttaaagcaaatttggttattgtttcattagatgatcctttgtttaattctgggaaagtatggcaattgtgttttcattatataatttctatgacatagcttctgacgcaaatgttttatatttttctctcttgcatcacaatctacgcaggtgaaaattctcatgaaggccctcggtattgtggaaagcgaacccccactgattgatgtcatcgataggtgctgcccgcaggtaagtgattgatatttctattttgaattggtatactgtcgcgatacaaagtcaacagctcagttaggcgaatcaattattttaattagaattctagtaaaagtttttgtaaaaaaaaaaaaaacgctgggaatcgataacacggcgtaggttgttgttacagtggctgaaatttatattcgtacagggtactgttttcacataaagttggtaaaaaactatcaaaatatttgtatggaccttggtgattgtcaagttccctctccccctcttttatgtatgaccacctagtttatgggcgaccacaaagagtttgagttgaagtgtattcagtttacagaaaatacaaacagttcttgtcaagttttcaaaatattttggcctaatttcaaacttattgtcacacatattgagatgttcggtaatccaaaccgcatagtttttaaattaaaaaaactcattacgcgtggtaaaggtggataaattgtgagtgaaattatgaaaaaaaaaaacgtgctcagttgggttgcgaacttataactcttgtatgctagacgagtgctttaccaactaagctaccgagccacttggtgaatttcgaattcaaaacccaacatttcacgcagaccctgcttattttccgtaaccatccatctcatgtatactacatacacgcgcagagcgagtggcaaaacctagaatttcttggctcaaataacgtatgtccttaagctattgaacaattttgacgcaatctttctaaatggtcaagctcctgatatatttgcaaaacaaaaatccgaaactgaacaattacctcatgtcagcccttgagctcctaaacaacttggtcgaagatgtttcttctatatttaatctagatcacgaggtgatatttcatgttgaacatgaaaaaccaagggagttctacaaagtgcaatgcgcgactactcgcgtttcgaaaattagcacgataaccgaaaagctaataaagtaaattcttcatatcttttgatagtttttaccaactatgtgtgaaaacagtaccctgtacgcatataattttgagttcctgtatgtattttgccactcaatagcacaatatcatctggtgtttgttgtttgctttccatccaggtgctggagagatgcctccacatgctaccgcaggccgaccgaaccgctatgctgaacgccaacgtaatcgacctgcagtggatagtggaccgcaacagtggggtgtggacggtcgggcatatcgaagattctgcgaaggcttcgacgctaaccctgtgccactcgcagtcatccggccaaacatacgatccgtggagtgtttgcttgttcgggtttatggagcgtcaacatgtgctgcaacattgtccgacggcggtggcacaggcgtggccgatttgctaccaacgagtgaccagtttgttcaacgtgattgatccgacgtaagttgtttgatggacgctcgaaattgagtggcatggttttattggctaatgtgattccttgtttttcacacacacatatccacagacccgttagtgacaaccgggcatcgttgttgcgtagctccgctccgccgaagaaaccaatatctgaagctcagcgtgattggcttgcccatttgtggaagaatcaggtagcgctggccatgcgtcttgtcccgcaaatgcccagcgttgccgttcgatgtgcgtcgccggatctcagcttaaggtaggacctttcaaggatacatatttgattcaatgtttagcgtggtgtagcatttcggattgtgtttctacatttttttatcattgttttcctgatgttactgatatttatgtgtttttatatgttttgtgttggaatcatacctatacaactctgcttaacaaatttgttttagttacataggaccaagatcatattgataatgcattaggatatggacagtccacaccttgtattaaaaagcattcaatatgtatgctttcatatctacaccctaactagtgcgatggatcactggagtgaacgtgcgaataacacatttaaattagaaatcaaattataccttggaataccagattagagtgtgtacatgtgcaagctttgtgtgatttatgtgttattttcattcataggacttttgttaattctcaactaataaaaaatgttgtaaatatgccgtttaccttctcatccgaatttggcatgacttcggacactgtttagtatacatagagagacaataaaattctaacttgcgtgattgcgttttgatttacttctctaccaacagctacatttttatccacaaaaatattcaaatcctgataactttcttgattctcgatatttttggactattttttcacaagatctcaaaaaaaaatccaaaatattttatggatttgtgtcgatattgattggttgaggttcgttgggagaccgactttccatttataaaatttctttggccactattatatttttactcaatttatcaataaaatagaatgtgggctatactgtattaggtagtaaggagcatctctgaaaaaaaaacatagaaatctgttgagttttctccaagaaatctgaaaattacaggcataggcgtaaatagccagcagacctaagggaaggggtcgttaacggtgatcattgaaaacatcatttatagctcatcatcgatctagaagcaagttttatctatttttctcacaagtaacgtcgtgtcttataattacatacattttacatgaatgcggaaatgagagaaacagtttgttcgaaacagactcgatgtaaagtatatataattgttatcagacatctcaaagtcctgacatttaaaaaaatgacgtgttcgatgaagttgttcatagctcaaggtttgtcattaatttagtcatgaaatatgaaattttgaaacaaggtagcgttagtgagcaataaacgtttgtgtgaggtctttggcaaagttattcagtagctcaagggctagaattgtttgaaaaatgagctcttcagcaacttttgaagaatgagttttcactatgggctggaaagtttgtctttacatttcatttttaacgtgtttggaatatttttcaaagtttctccatagtaatttttatatccacctccattgactttgaaccatctttaaatcaccacctaggaagctgaaaatttcacagaacactatttttctgataaggatggtaaaaaagatattggatatgggatttaaggactttttttttaaattttgaaccgcccttatgtacaacattattacgataaagttagtaataactctaatcaagcccattaaagttatattatttaaaaaaaaaactataaagttacaaatgttgaccaataatataagcctacaaaaaaagctatagcaccagaatggcaacaagctcctttgattcaatcttagacagaaaaatattattatcgataacttgaaaaaaccatttgtgaaaaatatctcatttaaactggttgttggcaaaaaatgaaaaattcaaataacaaatagtgtaaggcaaatgttaaaatttttgaacatatttttgcatcgattttttatctaaatatcgacttcacctctcatataagaacgggaaaatttttgtaataccgggaaaacagggagaaaaccgggaaatgaaaatcagtttttcgctggccaccctgataatcctgagagtttggaatttgttttgtaatagatgtttggagattttcgtaaaagttcagggttgttgaaaaagtgtggggattctaagaaaacgcagaaatttcagtgagaaatctgggattccgggatagaaggacattcaccttactctttcttatgcagtgtgcaagttgcagttcaaaacttaaataagttcgatttcatcagtagttaacgagtccagttgatggtttggagagatctcttcaggggcataatagacacattgagcatatgctaattttaagaccatacaatggcaaaatttttatttaagccccggctagtttccaattttgatattagtacgacgtgctacattcattcatacaaaatcatataatatgtcagaaaagtgagatagaaaattatcggggcaaaatgaacgcaagtgcaatttagtaattcttaaatatttaatgactgtcaatcgttccgctatgcaaaaggcctcaatcacaatagctaaaaagttctgcacgcacaaaaattgtgcggtaaaaactaccattttagggggttaacttaagcgctcgcaccgacaattttaagcagaccagaaatgcgcttgattttaccatgtctgtagttggaatcagattgttgtaaattatttcagtcgaatgtaccagtaatgtggtgtggtataccgtaaacatagtaaattggtctgaatttccatggtagttttaagaatgggcgtcagctaaaatagttatttttaccacagaattttttcccgtgaagggagaacacgaaattattgcgactcatttaacagggcataacttttctaccattgggtaaaaatcaatcaaattttgcacactttctcattgatgtgtattgtttacatgccgtcaaactcgaagtcgtgtttttcgatccaacgagaatggaggtgaaccaacgcgagtcgggaaaaatgttgaacattcaccattcaaccgtctccagagtggtgaagtagttaacagggtggccaccgaaccgggaaaaacgggaaaagcgggaaaaaggcgggaatttgattccaccgggaaaaagacgggaaaaaccgggaatttgagatgactaccgggaaaatcatgttgaacgaacattttggagctacagaccagaagtcgtagaaaaccgttatgtttgaataacacattggaatgcttaattttttttaatgatttaatttctactttctacactatgcgtcttaaaaatgttcgactattcccacaacgtcgctaaccatgtttcgaaatatttttcaaatctttccaatactgtcaaaattacatttattttaaccttttctctaacatttctgactcgatgttttgaatcaaggttcaagttttattttcttacaataaattattttaaaaagtatctaatatttcattctttaaataatcgtcaaaaaaataataaattaagtagagatacattcttctacatgtgtggcttcgtttaatttccagcttaaacttcacacttggaataaatcacaaatttctgtgcaattcaaccgaatattgatgttttatttcatcgatcgatccatgaagctggaaaagctcagctgtcaaaagtattgaatagttcggagatattttatgaatttccggtccagtatatctatataaatacacacaaatataaattttagcggaattcgcaattataaatacgccggccaaacatgatttcacagattttcagtgtaattttcggtatatggtaaaaagactgattttcattgtcaattcatgtcaatttttcccaaacttttgtaaaattttagctttcaccgaagttttgacagttatgtagaaaccactgttgttccatagaaaaatctgtttcattctaagtgtgttgtttgcttttgagaactctttattttcatgaagaaaaaatcaaaagattggaaattgagttgaaatgattaagctatcaaaaaccgggaaaatgttggcgattgtaccgggaaaaccgggaaaaaagcgggaatttcaaaatggaaatttggtggccaccctggttccaggagcggttcacgttggaccacggcaaaggagctggaaaaaactgggaccggagaacaaaaagacgaagggaaaagtgaagcggatgattaaagcaaatcccaacgtctcaagccgtgatttggctaaaaagatcggcatatcgcagagctacgtccagaaagcaaagaagagagctggactacatacatacaaggtacagaacttcccaaaccgcgatgagcggcaacaattgatggctaaaattcaggcacggaagctctacgagaagatgctgacaaaatattgctgctgtgtgatagacgacgaaacgtttgagtttttcaccggcaagagcaagttcgatgtggacgacaaatttaagaagaagaaaatttcgaagttcgcctccaaatatctcatttggcaggccatctgctcttgcggactgaggagtgagcctttcgtgacaaagggcacagtaaatgtcgagatatacaagtccgtgtgtggtatgaggccaattctgtccattttgttccaaaggacatgaatccgccacactgtccagagctgcgcccggtggagtagtactgggcaaatatgaagcgggaacttcggaagagcaagaagacagtcaaagacgagaaggacatgttaagaaaatgaaaaaaaaaaaaactcagaaactggtaccggatgacactgtaaagattttgatggagggcatcaagtgaaaatgccttcaattttacactcaaggctccatcgattaacttttcttttgatttttgaagtaaatatatgtataaaactgctctaaaattttggtttgattctaaacattataagaaaactggcatgacattttcggtgtcgcaataatttcgtgttcgccttctatgtcaatttgaagctgaggaaatcttaaagtcaaatttcaaaggacaattgaagaaaaaaaaaattcttttataccgtcaaacgcaatacggatttcatgcagtgtatgaacatttgatgaggtatgcacattctcagagcttaagggggtgtctattttgccccgtgtgttcaatatgtccctaatccagctattcagaaattttaagtaagattcttgaaagtttcgctttaacaaagtataattctaataattgaggggcccagatagccgtagcggttaacgcgcagctattcagcaagaccaagttgagggtcgtgggttcgaatcccaccggtcgaggatcttttcgggttggaaattttctcgacttcccagggcatagagtatcttcgtacctgccacacgatatacgcatgcaaaaatggtcactggcatagtaagctctcagttaataactgtggaagtgctcgtaagaacactaagctgagaagcaggctctgtcccagtggggacgtaacgccagaaaagaagaaagaagaagaagaagaattctaataattcttcaagatacaactcatgctcaaactgttgtggctttgcgatgaactccttagataattttacggtgtactgctttcctgacgatttgttctaaagttcactgaagtttagatatttcttccaatattcatctagagattctaaaggtacctttgaaagcaactcctagaattctttcaaagattcctgtagaaaatctttcaggcatgccatttagtactagcagatataggatcttgcactaccagagtggtgccagacatataaaattctcattactcgaaattgtttccaccactttgatccacgtttcccaacaaacatgcaaaaatcatgttatttttaatcaggaggccaaacatgagaaaattgctggtatcaatggtgggacatgtccccctagaaacatcggaatatatccgaaacactcttactgtagaattgtaattgggattttgcttaatatttgaatttgtggtgaagggtatattttgaagagtctcgtgcgttttgttagtatggaatcaacataaatagctggtcaactgaaattgtattccaaacatgtcttttttttctaggatgtaaataatgatgctgtttgtccttcactcaaatgtacatactattgagccatttagggtggactcataatttcttgtttgacctacacgtcacctgtgtaacaacactcacggttatggttttggtttggattatgttattttgcttttggatacttttccatcaattgatttaaatactcaacaattaactttaattctctttttctttctttatttatgaccgcggctaaccgacatgaattccccggggtcgatcgccatattttaaccaacaaaacaaatactccgctactatcaactactactgcctctactgttattactctgcaatttcttctattgccaccaccaccaccaatacttctcccgatactactattgtttacaactaccatctctaccaccaccaccaacaccaactactactactactctagtctgcatgaccagtcggactcccgatcgctgtccgactcgttggacaacattccgtcatccgtgtttggaccagaaggaatcgtaacacgtttcaccttacctctatcctatgggcgcaaagatgccagacataagagacaagggtaaagtttcggaagtagttcatttcttatattattaagttatcatttccgtatttcacctacgttaagcgaccttgtttgagttatttttgatttagagtgtacatgcgtagtgcgccagcagcgtcatcatccatccttcatctgcgttgggttaggaattattggtactgaatttctcgcaatgagtaccttcaataacacctgtcattgagaacatggaaagaatgctcacgtttcatactcattcactcatcgtcatcgttggaggagtggcatttcttgactattcgctaattggaatcatgagagttgaaaggtgaaaatgaaaatgttgtgatctgatattagtttcaggttccaattagcgaatagtcgctgtcgtcatcaacatctcgctagtttgttatgatctgggcagtttgaaagcaaatgcttcgatatgtttccatgcagtttggaattagattagcagctattagaaactagatcaattttgaattgcaaatggatgtttaggctctagagcattgatacttagatgtagattatgttattgaatcacgcggaatattgaactttttgaacatcacgtacagaggtttgtgaagatgggttattggtgtggtgggttacgtcgttgttttcaagtttaaataagaatttcatcacctttatgatattattcccaatcgatgttcgtttgaaacctgaagaagactttttagtaaaaaatcaccaattaaaataaccgtttggagacatatttgctgatgcgtacacgaatgggatggtatggtttcgaaattttgcaaaccttagagaaaaagttactttgtcaaacgaagcaagtgggacacaatcaatgttattcattgacacacactatataaacatcaatcaacaatctgttttcagatcctgaaagtacacacttatactgcaaacccgcattaaaatttggtacttcattttgaaacttggaatttagccctttttcaatttttcagtttgatttttttccttattaaacgcttacagggtgaccagcaaaccgggaaattaggaaagaaggggaattttaattcaccgggaaatccaattattatcggaaaaatgcttaattttggtgtatggtctagacctgggagggagaaaccaatacaaaatttctgtacgtcatagtgagccgagattccgctgtcacgaactgccactgtgagcccagatctcaaacattggactaacatggaaaaagcgcgtaactgattaaaacactttttcgcatttcatcaaaagtggcaaaaattgaatgaaaatcaattcatacacaaaatgtaagtaatgtcacgtgagcaccttccaactgattgaatataaagcattgaaaaacgcatagttttactttttcaaatgaaaattattagggaaagtgtaccagttatggccataatggttacctatttggctgtatgggaaattttgtcaactttcacattataaatatttttgaatattttaacatcaagatatatttttaaacctaacttctacaacacacaaaaattttcaaaattcgaaggcatcaaagtaatcacgtatggcaaaatagggaatcactatgtccataactggtacacctaccctatttattgcatagaaaactgtggcccattttccatgtttgtcaggaaagatcgaaagtacacaacaaaagaaaactagcggttttccccaagcctgccttgattgttgttggcaagctggagttatcttgcagttcaaacaaacgttgttctatatttcgtgtgtagtatcggtgcctccctcccaggtctagactagatatatcttgaccaggtccttgcgactgggaaaatagtttgctcgacatttgtttaaggacatcaagtataattagctgattacatccaacatttcaatgacgtcataaccgtatttcaagcagccataataattaacattgatctttagactcgaactggatatgactttttcaattagtctggtagggatccggttccaatacttggcactctttggctacaatgtgcgtcgtattgaactgcatcttattgcatagtttcaattgcataattcaaccgagaaaaaaaaccatgcattcacggaagtagttctttcaactacattgttttttttttattacgcatttcattttttctttttaaatttattttattaggaactttttaattagcagtcagccaatttctttgctagcgatgttcttgtgtgaatattttccagaaataaccagaagtaacctgaattacaatggatttttacgacttaaaaagttattatagttttacataaatattgatattatttggcattatttggcttactatggtgtaccgtaacaaagctcaggatcggtagaacaaaatcatactcgaaaaacctgtaaaatctaataccaaaaatatgtgtagtgatgaagtttgcggattttgacatgatgtagaagtttgcatatataatgctatagactagagataaattgttgattttttgctttaatcgtcgcttctgttgaatcgttgtaatttttgaatctatcaaaagatatgaaaaatatgtttttgaagttaaatttacatttgggtagtataaaaaaagcctacaagcaccgagctattacatcagaatggcatcaagcctctttaattcaatcttagtcgagaaaactttattacaatcggttgttttaaaaaccgaaaaattgcaaatgaccaagattattacaatttttaaaacatctgaaccgttgtttttttcaaaataaaggtttttatccgttatttacgactggggaaatttaaaatacctggaaataaccggaagaaaaccgggaatttgactggccaccctgcacttaaaataaatcgcagtgtcctgtgaaataaatcagtgaatttgaactgtaaacattgaaaattgaaagtgaaatcttctgttttaccggaaaaaatccgtgaaagaaacaaatttactgtaaccctgtgacatactaacgtacagtacggtaacagcattatttttacccattagctccttttatgtcagtttttacacaccacttacaagcagtgttgatagactcacactcaaatctcaatcaatacgctctcccgtgagagcaaactcattagagatgtgctttgcaaatctcacgcttaagattttgatgcaaaatcactcaatcaactcaaaccgtaaaaaatgattcggtcgcaaaacccgtcaaaaactcgtgaaaccccaatgttgtttctaacgttagaaaggattactataattttacctgactaacaagaaatcattgccgtatgtgagtaaactgtggaaatacgagacaatgagtcaaaaaggtgagccaactcatccatgattttttgactgctgagttgcgtgattgacaattcacgcatgaaagatctcaagcgtgagttgtgagaaattgagtttctcacaacactgcttacaagcagtgaaagctggcttagtggtaacaagcctgcttacagatcggttggtcgggagtttgattcccggtaggaccattttcgagtttttctttatgaatttgttcaaagattttacagattgttctgtgatttttcaccgaactttcggttgttgagattacggtgaaatttcagcgtaattcatttttttcaagtttgtactagtagaaatgcacatacaaatacatgtacgtaccactacaattttcaaaccaatcaattcgattttttttttaattaaattacatcgaaattcatgtcgctatttaacctatttatgtccctaacaaaaagttaaaaattgtgacttagggtcgttttcgacccgaaaattcaaacagcgcgccaacatcagtgtgttaaccgaatttagttctgtttggcttaaatgaagggcacacatgtctagtttcagaaaccctcccggagatcccggatgtggtcactgtggccactgggaacctgctacatatgaaaaataaaaatccctttagagacccttactttgacgacttgtagtttcgtaactaaacaagtaatctgaaccgtcctcatattgttgaacaggtattcacgtagactgtgaatagagattctccaatcacttagttattcatacccggttgaggaaacccggaacatccgaaaagtaagtttccatcgcagttctgtatatgtaattcacatcggtactattcggttgatggatgttttgacatatttttttctgtagtaaggaaccaattaccggcgcacattccctgaaaaattcggtccagtatggttcatgcggaaccaattcctggagtctcgggaggtggccaatctggacaattctataaaattactcagatttgaattacaaaaccaaatgaattgtgtctaattctttacgattttttatgtttggatgtattttgccaaaagaatgaatggatagttattctggtccctttggagcaccggaatggccaccgggaaacccgtaatatgggaccacaaggtcttagcaccaaaattaggcatgcgacggcgaaatattcatgattttgaatacctgtgactttgctagttcaattattgatgaatgcctcttaagttcttcccaatcaaataattaaaatgcgagttaacattgagcatatgaagctatcttttcacccataagtaatgttccggaatcagctagagatgccctggtaaaaacggtcatatgcaatttctaagcatcaaacttcgttgctttcaataaaactttggcgcgccaaccattacatgatttactagagtgatgcaaattttgaaattttggctcccctatgcttaatcgatttctcttatagtaaatagcattcttccaaagtttgaaatgatttggaagaattttgactgtgcacaagccatttgaagtttacatggagattaatatggaaaacgccaacattttgtgttcagccttctatctctttatcataaaattttatggaaaagtgaacaaactcttcttatatgaaatccttttgactgcaactttgccgaagaccatattttgattggacgtctgtataaattgttattcgtcatcataaagtgggcttgcattttacatgcttcaccaactgttcggcaggcgggaagaatagatcaaagtaattcaggctactatgttctacaacaaaaaggcaatgttgctctgaaagtaatggaatgatcatctcagcatgatttagactttgttatcaaattatccttacgtctcatcaaaatgtggtctttgtcaaaattgttgctgggaaaatttcacaatagaagagtttccatagattattatgactagcagctagagtcacattgaagaatggtaagctaatcccaagccccattcactaaatccctgtgcaacttcgattgctctggtcaatcatggagtagcagctacgaattgtacggtcatttatgctcatgctcatgctcatgctcattattatgactagcagctagagcactgaacacaaaaagtttgccttttccatataaacttcaaatggcgtgtgcacaaccaaaacccctccaaatcacttcacattttgggagaatgagtttcatcataaatgacaccgttaaagcataggggagcaaaaccttcaaaatttgcatcagtccaatgatttacctttatctgtaatatcaattcgtacgctgctacttctaaacctacgacaactagattaaaaataaccagtttgacactccatggggaatatttcatttgacatatttccttgctgtagttacgcagatttgcattttacgcgactttaagtgaatacacctagtgtatttttttttctagctaaagtgcagtacacgatttagagcataggagttatttgataataaatcattagggatatcctagaaaagccaaaatttgataatttccgagagagttttataaaaacaacgttcacgtttgtccaaaattgtcgttattgtgaaatttgtaaaataaatttcaaggcagcatggcactaattggctttttacagtacagtacagttaccgtgggttcccactcaaattctgaccccggccaccttcaaaggtaaacccagccctgtcgttttcgtttacattttgaggtacttgtgcaaagaattagcgatgtagagaaaaactatatttagaaggcaccctctacgtaactaaagctgacaaattcatcctcgtcaagccatcttttgacggaacgaaattctccaatgtcgaaacccaattactattctttatattttggcttattcacaaacgagtatccccgtcttgaatagaatgaagccctatttttccattgttgtaagactcatagctttctcttggtcataaaattctataggaatgtcgtatcttttcctcggttgaaattttacgttctacgctatcctttctcgtcgacaattcaacgtaaatatcgtaactaacgaaacgctttggttgtccctcggaattcgccagcatcaatgctgagggaaccagttgtattttgtctgccataattctacgataaatcgcgggaaccatgtttccaggaaaggagcaagaagattattgtcatagcacatcagtggcacgttttatttatttcagctgggttgaattcgatggttgtttgatttggcttaatatctttaacgttttaaaaaatgtaacggtgctattcatattactttaacgcgatatatgtaatagctaaaagaaaggattttaaatatgaaactgactgtctcaaattgtgaacgaatttgaaataaatgtattagggttttttttaaacgaaagaaattgtgccgaattctagtactaatcaattaagtctttattgaaatataagtcattcttcaccttgaaaccgattgtcaccaaatcttaaattatccaatagtttaaatagctttaaagagctccagcttcaagaacttaaacgcctgcaataaataaatatataataaaataaatcaaattcagatgcttcgaaatagagtaaatatattgttttaaagctcatattcaccacagtgtaacattgaaaaggagttttcattgagttacataagtgcgaacaagttaataaataaaattatattaacattttcgaaaatgctgttagtcagtgttaattagttagctgtattgtaatggatagtaaccaaattcattgcttttcactaatgttatcattttaatgttattaaatgatctgaaacccctattcggattctgtgatacttgggctcaggacctcataaaaatttttggttaagattctttgaaaactcagtccgagattacgcaagaacacagtccagtaatacttaagaatcccttttcaactccccataacttaatatttattgaagggaccatcgagtatgggatgtatcaagttattgctgtttgcgtttgacgtgcaaatccagtctaactgagcttcaaatgcggtaacacaaagtaaccaaaggatacttagcaaccatgacccatatcaccgccaacccagcaaaagaaaaaaaaaatcaaattttgatttgacttccttgttaaaaatcttaccgcgtttggtattcccgcatttgatattttcattttaaacgcacacagcaatatttatagaacacaaaacatgtgcaaatgcgatccaaaggactgtctaggatgccatgaaatccaactttcactatggttctctaactcgttaccgagaaacggaatatagttgagtgaagtggtgtaaaagctgatttctagcttaattcaaaacaaatgttataaatttcatggtggttcgaataatattcaagtcttacactttcactttaaatattgtagaaatcgattgagatttggaaaagttatgactttttgttgtttttagacgtgaaaattgtaattttcggtcggaccaaagacaaattaaagacccccatgtcctttgcagttgccctaaattttatggctcataaggtaatctagaatgccattcaaagtgtactgcgatctgtcaaacttgggtaccttttgcactaccgagggaccaaatgcagtactagaagtggtacccaatctgagcccgagtgggacggacctggtcggattttcattgcatggaacacaatgaaaataaaatctcattcgcatttttatgtaatggaatctggttggtaaatggctgggcatggcctaccattggcacctctcgtacctaaaaatggataaaatgaactcctctgtgccatccgtagcctcgtaggaggtagggatatgactgctatgatactggttaagtcatatccctacctcctcgcgatactgggcacggtacgagcaaccctagggaagatcgggtaaccaacctcggtgggaactctggtcgtatgcttacagggaatggggcggttgcttctgcaaatctggagcgtctgtagtccatgttaggagtggctcacaacagcgtctgttccccatgtcagggacggttgatcatcgtccgagtgccagagaaggactctaagctaaactgtgcactatgtccctccgatcattcagagcagcggtttcatatcgtgctccgcgaagccttgacaggtgctatttaacaagtgtataattaataaattattgattagtaacttgttctctagatttgtactcttgaaaatttattttcaccatatgatgttttcaacgttgtggtaaatgacaaaacacaagtctgtgtgtatacggtgtagaaatctccttcattattgaacgttcatgttacgaggtacatttttacgaaaacgtttagcattttgggctaagattttgtaattggaagcctaaaaatatccagtctgttaaaatttccctatacattttgtatttaacagttttagcagcataattggattgaatttgcaaaaccactcttaaagttgaagaaatgtccgaaaatttcccaaccaaagccattttatcgttttcaatacatcaattttgaaatattaaaccataaaccatgcgggccaccctaatttcacatcactggagaaatgtctgaaaaatatggagaaactttgccgaagacaccatctttctatatggacaggctcctgagatatctgtaaaacaaaagtagaagtttcattcttactagtgtcacctagcggccaaattccgaatgaggtaccataagattgcgcttcagttccgaaacaactgaagacttggggtctgtttctatattatctggattttgagatgttcttcttctttctggcgttacatcccaactgggacagagcctactcattagcttagtgttcttatgggcacttccacagttattaactgaaagctttctatgctgattgaccattttttgcatgcgtatatcgtgtggcaggtacgatgatactctatgccctgggaagtcgaggaaatttccaacccgaaaagatcctcgaccggtggattttgagatgtaccgatttcaaattgtggtcttctcgaatcgtatatagtgcgttcattattatgcgacttctatgtagagttacatatttcttaggagcacataaatgtactgacgagcctcctaccaaaccgtctttcagctcatcggaatcctagtgtgctgcgctagccggaggctcacgaaaattctgaaagcgcgcgctaggtgatgtgcacccggggagactcgtctcatgcgctactcggcgctacggctcgttatcgaagaacctctacaagtattttcgtctcattatacttgtgtctagatggcctacatgatatggtcgaagactcgcgatccaagaattacaattccggtccttgttgaatacttttgtaatccctttaattattgcgctgaattttaaacagcacatgtgacggagcgcatgaaaccgcagtgagacacatctcaagaaaaatgaggcgcaccaaaaaaggtctcacaatgtacagcgcgcccgtgcgcttgcaagcaatgaggctcctgcacctaaggctacagtacgtgcacagtaactctacttctatatccattggttgattttacacattataaagggtcgtttggtgtcaatagatatctttgttgcaaaatgatagcttataaatcacaactgttgtacaaagtacaacaccgcgatagcccaatggttaaatttggaaatatatatgacaatagcagttaatttcagattgttgctaatgaaaatggtttttcattttaagtcgaggttccatcagataggttctaatcatttagtttcaagttgcaagtccttctgggctgctagttttgtttaaaattttgcattcacgatatgatatcaaacttatcatctcaatttgtaaaataaaaaaaaagtttaacgaaatttcgttaaatttacacatatatccagacccacagttctatactgtttgatatagaaataaataaatcacaaacttttcacatcagcacaagtttttacttgcaattggaaaccatgcatgatgttccataccaaaactcgaaacccgattcaaacaattcgatacacaggaaattagaatagctatccattcagcacatcgagccgcccgcagaaacgataaagtagagctattactttcttgccagttcatttgcttcatcgccatatagataaaccatttggccgcagaatttcacaaatgcactctaaccattattcgatcttctactctttccttgctcttttgcagctcatcgccggattcgttgtcggcggatcgtagcgacaagtccagcggtacggctgcatcgccggtggctctttacaaactcgtcatcccattgctgcgctgtgaagtgaccgacatccgtgatgccgctgttaacgccctcggaatgataaaccacgacgcattgaagtaagttggaatcctcagttgttcctttttgaacatccacggtactccccagaccgttattattagaaagaaaaatctccatcaaatatttatatatacttaccgctccagtcgatatctatagctaaactgcatgcctgggggaaaaaaagaaacgtggtgcccgttttgaaattacgcccttttgatggcataagtccacacattttaaggaaatcagtgatattcatacgagttttcatttgtcgttgttatcagatgaaatgtatcaccaaaaattgattcaaaatgggtttgtataagcacactgctgtacatttgttttatgtcaagcaccaaaataccgccatttacttcatgttcttgaaaatatcataacacataacacatatcataacaattttgtatgcacactgcatgcatggtcaaaaaatcgatttaatcaaaattcaatcgcgcaatttaaactaaattataacttacatgaaagtttaaatcctactctgcgtgcttggtgaagttttataaatcctactttaaattttatataatcattagaaaaaaagcattttttacaattttggcgaactgtagttcaaaacagtgacgtgctgcaacattttcaagagcggcattagactcaccaactaattcactagagccagtgttgtgagcaattacggtagtcgacagtttttcgttgacatgcattaccttcagcattcacaacacaagcgcaagcggtcaaacgaacgtacgaaagaaaaatgtcaattaaatgcagctgaccacgatagcgccagaaaacgtttcatttttgcttatatctatcttttttcctaacaaaatttgctttcactgtatgagtatcacatttagcattataagcaagatttatactattcttgttatttatattttacacatttttttttatttaacaaaatgtatgatatatgaaaatgtcaacgtatcagacgacattcattccacagtttttgtgtctctcgatgttcattctgcccctcgtgccgtgtaggacgctagcggatgagtttagaaaaatcaattgactgctgaccatggaagcgaaacgaacgtcgcgagaaatgtcgaatgtttacagcgctactagagacctataatttgattcttgaggtacgcaaaaggaaactggatagacttgattcccggtaaagattgatcccaccatattttctctaaaaaggttttattcaaagtaatctcatacacaacaatttcagagttgaaaatccatctaatggaataaagatgtttgttggaattaactcaaatatatttcatgggaatattttcgaacagcatagttttttttaaaataaattagcgtatatttcaaaaatgtcttacattttcagaatttggacattcaaattagtaaaatcaaacgcaaaacttaaaattattttattttatattaattacctcattacgcgtggtaatgatgaataaattatggatgaaattatggaaaacatccacgtgctcggctgggatttgaacccaggactcttgtatactagacgagcgctttaccaactaacctaccgagccacttggtgttattcagttattcaataaataaatcgtacatatccttttttgacccattctcaccccaaacaacggtactaataaaggacatacaaaacacccaacagaccaatggagagtgctccgattgacgaaaagctttttctaactggaaagggaaggatggtttactgcgttacacttacaatgcgtgtaagttactgccgccgttagcgcacggttatgatgcccacaatagaacacattttcctatgggaagcgtggtcaccggtttttcagttctgtcgcctaaacggtaaaggataccactttggcgtctatggacgaaagttggtgaaacaaaaaatattttttcgaaaatttttcatgatacagacgatagttttttcgctatttttccgacaattttctccatagtgaaaatttttctgggaaatgcttttatttttatgtttgtaatagattgctgaggaaatttcctttcaatttcactaaaagacttttgttctacgatgcatagttcaggagatatgaagtttgaggtatatagggaaatcttgaaaattcatctaaagttttccgggaaaataggccactataattttttttgaatttcacttttggtcatgtatccacgagctctacctctggtgaaaatttcatgcaaatcggagaacctctggcccaaacctgtccgataatttaaaaaaatgcccaacttgcaaacatattggaaacctatagtgtcttgtagcttttgagtaaaacgaatttttagtgtaatcaataatttacatttgtacccaaaaatgttcactggactacttcggtcaaattgatgtcaatgaaactacgtatcatcgctttgaattttgttttataagcaaacagtttaaagtaaaggttatttattattatttttccagcgaaataaattttgagtgtaaccaaaacactctatttctgctcaataattccactgcaccctttctgaaagaattttcgaaatcgctttcaaaacaacagagatatgcattgtcaaagttggacttctgtgtttttaaggggttggatgtgcagctataaggtatatttgatcatactatagcgccatctggtgagtgaattccgaaatataatgtccacggagggaaagatatcagatctatgacaaagttctcgaagcaagaaatcattatattttgtgtcgttatttgcgcaaatcactgttctcaattaaggatgatgggcgttcagcgcatctgtccacaaaataagacgctgagcgttaacgggttatttacaaatacgaattatacaaatgagttttaaaatttacttcagttaaaaaaatgatccaacataaaatgttatttccaatacatgacgcaatcttaaaatatctcgaagtttttgtatttgttgtttttttaacgtttttattttttagcgaaattcgctgcaacattctcgaagtttcgctggtaccaaggcgataaattcaaaattttacggctttatcatacttgatcatattttacattaaaatgtatgtttacagtaaagacgtccttcctatgtgtaattttcaagaaaattatcttatttttgtattttacaaattgttatttaatagcattattatcaatgcaacatttgaagcaagccagaaagacgtccagcataaaactaaactattagaacatttttctaaaaaacctcgattcacaaataaataaataaataaacaaataaaattagcgaaattcgctgcaacattctcgaagtttcgctggtaccaaggcgataaattcaaaattttacggctttatcatacttgatcatattttacattaaaatgtatgttaacagtaaagacgtccttcctatgtgtaattttcaagaaaattatcttatttttgtattttacaaattgttatttaatagcattattatcaatgcaacatttgaagcaagccagaaagacgtccagcataaaactaaactattagaacatttttctaaaaaacctcgattcacaaataaataaacaattttcataggcaaaaatattaaatttacatgacaatctcataaattttatgagctcataacaatctcgcaaaatttataaacaaagcattatctaaactttacgatgaaggctaaaattcgtaaatttcgtgccttccgcgaaattgtgtatttccattgtctttaacgatgttgttctaaatgaaaattattgttatttacagttgttaattgtattgcgatatcttagtttttgatacatcaatgctttaacctttacgttgccgacctccgacaaggcattttcaaacagctgccatttcgtcaatttccattcgattttcttaaacctttcttagtttactttaaaaaggtttcagttatttgtcataaattgacaattcggaaccatgccggagatattccggattgtactggggtcacaagtgtgccaaatttgggaaatgtgtttttttatgtattgctgttacttgaagattgagatgtcgcacggtatgttttggacataaaatgaaaatgtccccaaacgggccctggcggaaccggctacgatgttccggagcggtccacttattcaaactatcttgaaatgatgacaatcaatcattatcttacgttttacataaaatcttcagtattgtaactgcaataaataaaaaaaatcacatttctcaaaattgacactctcgtgacccagtacaatctggaatatctccagcaaggttcctaattcagcattgtccatttatgacaaataactgaaacctttttaaagtaaactgagggtggtttcaaaaaactaatggaaattggcgaaatggcagctatttgaaaatgccttatcggaggtcggtaacgtaaaggttaagtaaaatgatgactgactgttgaacgctgaaacccaatttaagcccaccgcaattaatcaactgtcagtccgtcgagcatgagaagctattttcacgcatagtttgtaaacaaaatcaaacccacataaatatggtttaaataatgagatgaaacataatcaattttgctaatatgtaaattacatttatattgaattccaataagtgttgcgcctagtatgtattgcgcgatatttgaaagctccatgcaacatatttatatgtacgcttgtatgcactatggcttatcaggtggccaataatcaaaaaagtgatgtgcctcaaattttatttcttgttcgccatttcattgtaaacatgtctgctaagaaatccccaaaatattagcgcatgatttgcattgcacactcagatatgaggtgccaaagttgagcctatgaagaaaaacttgtttttattaacaaaaactatggtttactcaaatgaatataactttttttctataatacttacgtaaaatatttttacaccatttgaaagcttacaaaaacggcttcctagaaacaataaaaaaaataaaaaaaaagcttcaaaatagtggcttttatgatgtttttttatgaagcggttcgaaaaatcgaataagcttatagttaacacatcgagtacttttttgtcccaagttgtcccaggcttaaatccagttccaagggtactttgagatgtaaactaaaggatcgtgaagaacttagctgcacaaatttgcacttttttaatttaaggcttcttgaatttttccaatatttttaaccattttctattaaaaacagctaaaaactaattcagaaaataactgaatttcgctaaatcattcatatcatcatttctatgtaagttttaatatatataatggtttgcacaacgttaatcgcataaatggcttatatgaattataagtaacaaagtttaatatttcgctataggccctattcaaaagttagtctcgaaaacttgtttttgaaaataaaacatcaaatttgtatcataacactcataaatacgacatgaaatggaaaaaatatttttggccgccagtctgtatggaaaccgcccatagtggtatgtcgttgtcgcttccgcttccaacagttgcgcgcgctttctgattctcgcaaaccgcgccgtcgacaatttctctctcgggtgcacaaattggagtgcaccagattttacctataggggaagaggtggtaaaatgaacatcgtaaggataccatcctgtatctgatagaaccaggaatctgtaaagttctatcgcataatatcaaaaataggggtgttatctaaagtagcgacacgaattcaggttatagctaaattttaacatataactatgtgggtaaaatagctgttggtgttaaaatgaacatcatgcaatgaaatccaaaggtataagatttgacatcatatcataacgatattcactcactgaaaaacctcaagattttcgagctaaaagttacgtcagctcgtattttcaaacgtggtgttctaaaaacttagtgttcgtttatatctgggggatgcgaaatggaagtcaacaagcagccaggctgctgtcaaacaaaacttttcgtaaaaatgatccgagtatgcccaggaatgttcggtcatgatttcgtcacgcttaaaagtgttatgcaatttatataacagtctttggccaactgttaaagaaaagttgtgtttggttcaaattatgcagaagtattttacaaatatgtatctttttagcataaggcctgaaactttctgcacagttaaaaataacgaagattacaacgccatgtaaacttcatttatgcgatgtaaacttgacgtcatgtaaatttaattctggaatcatgtaaatttgtgttatatgtcatgtaatcacacataatcctgctggattacatgacatataattgaagtttacatgacatatcatgtaaatatccattatataccacgctccaattatttgcattatatgtctcagaaatttacacgtttcgttcgaactgtgtgattaagtctgtttattgggtaaatcgtcagcattgaattgttgatactttgtgtgaagtgctttaagagtgcactttgaatgtggtttcctgcgagacaagcgaacaaacaacggttagcactcacggaaaaaatgtgttcaatttgaacaattaaaatattctagtccgcaccccctaggttgatatattcacttcagttgacctccgtatcaactcgaacactctgatttatggtgcaaatcgtccgcgcgtgataaaaaatcattgaaatttgtttttttggtaaaacgcacggtgttcattttaccacccctgttcatttttccaccactttccctactaagtcattgttgatctagaaatcccaacacaaataaacattcctgttgtgttcacacccgctattttcgtgctttttacgagctgtccggaattcgaatcaaagcgtccggaataagaagcaaaagtgaggtggtgtccggaataagaattttgaagaggacatccatttctatcaattcatcttatgtgatatcaatccatcttatgatggatgtgatagtacagtccaattcaatttccgaaagacttatgaaaagaattgcttctgtacggatactttgcgttcttcatgtatggcacgtttcgggttccatactagatgacagtattctagtattattaataatatttagttaggattatttaccatttatgtgacattcgtgtcgtttccaaaattggtttctattgtatgtaactcacaatagtctaatagtatattggtcttcaaaattattgctgaacctcttaatgaagccattgtttactttgttcattgtggaattgtaatgttccataaaagtgagttctgagtctaggattacacccaaatgccttacaattatacaattttgcactaattgatttccgaaaaaaattcattgaatgtattacattttttggctagaagctattgagttggagtagattttttatagcaagtgattaaagggacagcattcgtcattggttttaaaattttccaagtgtgatcttttgattccattacacagttcaagtagttttaagtaacagtcgtatttttcctccttatccatgaatcgcataaccgaccaaaggtgacttccagatctgtttcctcctcccctaatcaataccattcccgtggtgattgtggagatgcagaggtactctcggtctcatttggatcgaagtgcaattataaccggagtggcattgacatttacagtctgtatatgctatgctctgctataaaaaagggttttaaagtttttatgataacaatgacggatttttgatccttgatacattacttttgttcatgtacaactcataatgagatttatatgttctttacatgaatatctatagatacacatgatgtgcatcggatttcaattatcgtaagagtatgtgaggttgttaatattttctatggtgtttcttgattagtggttggtgatactcacaatgtcaatcaaaatttattactgcttcatttaatagtacacaataattgattaccgtacaagaagttgacaataaaaaaaatacactaatattatttacttagctgattttcgtgattaagtgcttgatatgccatccaaaggatgtaagtttagctgtagaaatcgagtgatgcgcacacatgtgatggtattttttctgctaataacggtctggggagcaccctgacaccataatctcaactaatttctcgccccacgtagggatttgatggaggagctggtggtgtacatccgtgaggcaatcgaccgcaaacaagagaacatgcgtcgccgtcgccgccgtgatgccctgaggctgcagctggtccgggtgctggagagcattgccgagaacggcactttcggaataagcccgtttgttctagaacgggagaccatgtcgctccatccgacctttgtggagtatatcgatggggcccggctctacctggaagccgaaacggacaaggataatagcagcatgcgtgaggtgaaaactcatttctgtgatttcattcggaaaatgattaaaaacttttcgttggaatcgtgtgttacgctgctgtcgcgagaactgaagcggaatctagttaatttattcacttcttggagcggaactcatgccataccgtttggcagtggggtgggagggggcagtagcggaacgagccaccatgcagtgagcagtagcactatcagcagcatttcggctgacgaggaaaagttgcagtacagtgcgctactggtacgtatcgctcgcaaaaggaaaataggttatctgaaattaacagctggaacgatatgctcgctcacgtgctcgatatcctttgggtttgaattgctcgaagatgggttaattatcatcatggtaacccattagtatgtggtgatacacgccatttgcactcaataactacctactttctaattactttctaccgtaaatggagcttgttctgcatagatccggaacaattttgtacacgctcttttgtaattgttatttctatgtcgaatttgaaattaactgagtcaagtatggagcattgacggtaatcctgttgataggatttatttacccgttcgtaccaattaagaaggtgtttatttattgcagttggcagattgttggcctgactttaccattctggtttcactttgtgcatctacagtggcccaatttcatattcgtacaggatactgattccacatcaagttagtaaaaaactattaaatgaagtattgagctacaaatattttatccacactgaaggtaataggtgccatctattgtttgccaatcacaaaatgtttccattttcattcatctttggattaatagaaaagtattgaattgatgtctcaaatccacccaattccatattcgtacacctaccaaaattcaaacgcacaacgttcaaaactaaatttagaagctctatttgattactgaagtgctttattatgatgttcagatgtagtgaaatacatttggacaatttattagtggacatatataaaatttaggtaaaattatgagaaatgccagttttccaatgatttttgctataaaatccaataattcgaacaattacgtttatttttgtcattggatccaatctatacattatactcgtaagctctgatagaaatttagttgaaatatatacactttacagaaatcattatcagtttttatcccttttgagttcagaaaattgttgtgccataagttcaaaactcttctaaaatgatatttttaatcaatgtaaaccaaattttcattctaaacaacaagtaaatgttaatttcgaatttgtctgtaaacataatttgaactacgaacttcgttttacaataaagtaccctaaactacgctgtacatacctccacataattgatgtcatcgtaatattcaattatctttgaaataatatttaaattatattcaaaatagcaccctattttgcaatttattgattttataagaaaaatacaaaataacttgaatgagcagaaagcattgatacactatttaatagaatatttcctcttgttttcatcattttaaaaacacgtttgtgttgcggttatggcaataatatttattctataaatctctataatcatgtttggtagtaaaatgtaaattaaccttccagtcgtcgcgcgaccgtcagaaccaccacgctgctgttatgcgcgaaaagcgagctttttccacaagtgttgtacaaaatacaacagcgcgacgactgaagtgttaaaaatgataattacgcaatgttttgataggaacattaactatggattatgtatatacatttaggagccaaacataaagaaattgactaaaatttttggttttggatttgttataaatattatattacctaagattcaaaagtataagttgtcgatatccactcttagctactctaaaactgattataattttttgaaacttgtgcaatattcgcaattatcattcttaaggaagtgatgatgaaaaaaatgcaatttattgttcgacttaccgaatattttagcaaaaaacatgggaaaactggtatttttcttaaatttacttaagtttcaaatatatccgtttataaattttccaaatgtattctactgcatctgaacaacacaacgaatagcttaagtagtcatctagtccattaaaaattagttttgaatgctgtatatttcttttttgttaggtgtacgaatatggaattgggttaattatagacacaatctcaatacttttccattattccaaagatttaagcaaatgaatacagtttgtcattgccaaacaatagatgacacctataaccttcattattgataaagtttttcgaagtccatgcaccatttaatagttttataccaacttgatatgaatacagtgccccgtacgaaaatgaaattgagccactgtatatctaagaaatggcttttttgtgcacacattatagacgtgtgaaatgaaaattcctcggtttgatagtgatgagaagcaattattgttccatattctaatatcgaatcttgttttccacttttgttcgttcttattcaacaggcaacgtccgcactgctctgctgtggcccctgtttcgatcataacttgttggcggaagagggtgcgatctacaactggctagacatgctgatggagtccaaggaagacaaggtaagttttgcatggagggcagtgttttatatcacgatatcataaattaagatgttttttactcctgtaaatttaattcacattcacattaaaatcaaacttacagtgcctgtacgaaaccaccctcagtttattttaaaaaggtttcagttatttgtcatgaatggacgatgctaaattcggaagcatgtcggagatattccgggttgtacttgggtcacaagggtgttaaatttgggaaatgtgatttttttttatttattgcggttacaatactgaagtttttatgtaaaacgtaagataattatcgattgtcatcatttaaacataatttgaataagtggaccgttccggaacatcgtagccggttccgccagggcccgtttggataataagcatgatcatagatgaccgctttgtagttgcaatccgtgattgacgagaacagtcgaagttgcacagagatttaattaatggagcttgggattagcgaaccattttcaaagcgcacgattcgagagttcaaagaccgaatacacctctgcgtctccacagttgtcttgaaaaggacattgggtgagtgggaaaaggtggtgataatgatgatgcgatccatgatatagtcacgcctaaccggactcccgatattactcgagtatgcattgcatgtcaaatttgttgtgtgtttctgtcccatcgctcgcttccgatggagcaagtgacacaatagatggatcgagcactaaactgtaggaaaaacccttgcggataatagatgaaatctcgaatgggttccaaattctataggtttattcctcatttattgacatgtcctgtcgaactcatgaaggttgagacgttgtccaataggttttggccatgaaactgaaatgtcccgtaacaagccttggcggaacaagtaccaggtgctcaggattgacctaattagttgatacctagttcattcttcattaacccctctaccggcagcttcattttttaccgcaaaattcaaattcaaatcgttataacttttttgtttttcattatttttgcaccattttttcacaagttctcaaaaaactcttctagttttctgtgtcgatattgatcattggttatctggtgttgaagatattccaaaattccttgggggaccgacccgtaactagaaccccccgttaatttctcaggctacagaattttaatcgtattcggatattcactcttcggatcaattcattaatgagagaatgttgtgaaaaaatgaagcaatttggtgcagccgtctttaaataatgagcatttaggtttctggaaccacgctgaccaaattaagatcttaaaaacttcaaaaaacatcttatcgtaattttcagatatctccaagaatactgaaccgatttgcatgattttttcagagtagcttcttattacctggcgttatacagcccacattttatttttttgataaattgatcaaaaacaaaatggtcgccaaagacattttataatgaaaatgtcggtcccccaagaaacatcgaaatatctttaaaaccagataaccaataatttatatcgacacggactcctaaactagaagagttgtttgagaacttgtgaaaaaatggtgcaaatatattgaaaaactaaaaagttataacgatttgaatatttattttgcggtaaaaaatgaagctgccggtagaggggttaattgacatattcttattcgacagtggatacgagtaactgacactgaataagactgcaagtggtagtcgaaatacgcgtatctgtcaaagataaaaatttaggggcggaattaaaaggtacaaggtactccatctacttttaggtctctctattgaaattctgctcagagaatacaaatacattaataagagacattttctttctaattcacgaaaattgacacgtcatacggtttgttttggataaaaaaaaaatattcccaaggaagacctggtggatcctatgcttgaagctatggagtggcctcattcttcttcttcttcttagcattacatcctcactgggacagagcctgcttctcagattagtgttcttatgagcacttccaaagttattaaatgagagctttctcattctcttcattcgtatatcgtgtggcaggtacgatgatactcttgccaagggaagtcaaggatcgaccgggaatcgaaccaagacaccttcagcatggctttgcttggtagccgcggactctaaccacacggctaaggaaggccccatggagtggccacatcagttgataataacttgattcttcttcaattgacattcatttttctcaaagcttgagacgtcgcacggtatgttttggacaaaaagtggaaatgtccccaaagaggccctcgtggaacttgtgccaggagatctggagtggccacatctgtttgtaccgaggtttttcttcttttattgacatgttctcccgaattcatgagaaactacgtgctccggtgggtattcttttcgtagtttcgatttcaatttgtacatttgagacgtgattcgccgtgtacatgtaaacttcaaaacgtcaaaaccttatgacattcccataggaattaaatttagtatttttattcgaacgatttcaacacggaagaaaattagcttgctaattacacgatgggtatggttattaatcactaaaaatgagaattgttggagattctgcctggggaattccgactacgaaacatgttgccgttcatctgcctggtacgaatcgtttgcgcgaacggcaattccaaaagttagacttatggctgcccccgcaatttgctcatataaactttttggtatcttccttcacaggccagacgtccttagcgtgagaagaaccttggcaaattatgcaaacatttagcatacaaacggcattgttttgtaacatgacccaacttttggcaccgacggcactgagtggggttctggaaatttcctccaggtttctggaaatgttcccatgtcacacggatatcaaacataagtcttgctttttctaaagctttaatattgtttagatcttttttattaaagtggaataaataatattcttgagaaagccctttccgagcaatgccagattgggttctctttttcataatgattacttggagtggggaaaatccaagtaaatcatttaatccatttttgatctcttcatatgacttatagtcatttgagagacctttcagggcaaccttgaacaaacgttcaattgtggttcaactcaaccggacttagaccaaaactaaaacttaaagcgttaaagcacgccttgtccaataaattacgccttcctccttgactttatggagcttctttctctttttacagatttacgacttggcgaaggaaaccgtagtgctgctgctcgagtctaaccccgacatcggccaactgctggaatgggttattgatcggtgctacaccgcttgcccccgacaagccgatgcctgcttccttacgctggcagttatcttcagcgcgcggtaagtgcttcgatatgggttctttttctgcgcttttcaaacaaacaaacccatcacaaaaggtggagagggttttcttcaagagggcttgaagggtagatgagacagatgtcactattattatcgcggtcgatttaatcggctcactgttatgtattgcctattcatagtgtttgcaaacacagttcatacccattatggttaattttatctatgtactacaaatataacagaaacttatgtaaaatttatattttgcataagcttctcagatgaatatcgatatcattggaagcacaccccaccattcggtgttgataaattgataacctttcattcataacttcggcaggggaaattgtttcagtatgtaactactaagattttctgacatttcaagctcttcgagctaaacaccatgtagaagataagggcgagtatttaggtatgtgatatttgtaaagggtcgatcgacaattttcacattattcgctaagcaaacaaattgactgaatctattgaaaaccgttcccagactgcagggcttaattaagagactaggtggtcattattttagtgaggttctttgaaaagtttcaatttt

SEQ ID NO: 143 - DNA, 73501 bp, Aedes aegypti
  misc_feature (64164)..(65151): n is a, c, g, or t
  misc_feature (71615)..(71714): n is a, c, g, or t
gtcataatagtacgtgccccttctcatccctcgtgctatcattatgaaaaaaaaagaacataatgcaacccgatgaaaccgcacgatagcatattacgaacggtatcactttgtatgactatatgaatgtatggtgtcggtgtgggtgtgcatgcttaggcaaggtgtgtcagcagcaataaggaagcgtgtgaaaatttaacacgaatgaatgaattaatgcacagtattgaaacaaatttggcaccgattgatcaatttaattagcgtttgggtttgaaaccgtgctctcactaaacagttggccatgggatggaccgattcattggcgaaggccaaggttcataggggcaagttgcacgaacggtccacgtgcagcagcttacttcgattgactctacttgaatgcgatttctgagcttgaagatttctatcgatatcttctagcgactataatcgtagaaatagaaaaaaaatatatcatcaatatgctttcgcactcgaaaacaaacatttctgcattgatgatagaagacaggatgcaaccctcgataccagtgcactaatgttctttcttttctccggtttttcctctttccgtacaggtctctacccaagttgagcagtcaggatgaagaagggggggcggcgcacggttttgggggaggccatactcattttgaaccaataccgcatgatcacgacttctgcgaaagagttgttataaacgtaagtacataaagctttcaataataattttacttgtatgtctcattccgtttcattttgatatctgcactcatattgaacatatgagttgttacatacaatttgtttgctgtacaaaaacataaaacaaacattaaaagattctattttgttctttttcttcttctttttgacatttcgtccccacagggacagagcctgttcatcagttaatgctcttataagcagttccaaagttctcgtcgaatgacgatttctcgcgttaagagaaatctatcactgtggacacgatatatgatatgatactcaacgcgagatatttgcatgaattccattacaaaaaacttgaacggtggggttcgaagcacggtcttgctaaataactgcgtgtttaccgcttaggatatgtgatctctttctactcaatttcctcataatttcatgaagaattcttacggagaatacagtgaattcgaaaaatttacagaatatccttcttcttcttcttctttctggcagtacgtccccactgggacagagcctgcttctcagcttagtgttcttatgagcacttccacagttattaactgagagctatctttgccaattgaccattgttgcattcgtatatcgtgtggcaggtacgaagatactctatgcccagggaagtcgagaaaatttccaacccgaaaagatcctcgaccggtgggattcgaacccacgaccctcagcttggtcttgctgaatagctgcgcgttaaccgctacggctatctgggtccccttacagcatatcctacttttttcatatgttcgctaatggtctgctccagaattatcaaaattctgagaagaatcgcagaacgaatccgctcagaatactttgaaattgttgaaaggcttcctagaggaatttctggaagaattcttgaaaaaatcttcggagcaatttctggaaaaattgcttgagaaatctgtgaaatattttacggcgaattctctggtagaattattcaagaaatccttggcaaaattccttcgtggatcctctggaggactcctctcttccttctgaatgagttcctggcgaaaatcgtaaaatttttcaaaaatgttctcgaggaatctctgtaggaatccttcgaaggaacttttataagaatactgattaaatcccataaggaattaatcgagaaattgttggagaccatgaaaataagtaaaaagggaattcagctgagattctgggattttcatatgatttctgaagtatttccgagggattttctcaggaatacaatttgttcgacacaaatctccaacaggattttctttgaactcacaccgaatcctctcagaatttccacaggacattcacacgaatcacagtatttcagtaagattccaaaggtattttaaaactatttggtcacttccctcaacatttgcacggtactgcaacataactctcacaagattcccacagtattgcctctgaaaggcaaggatattcataggaattccatgattcccatttaatcaatcccactggaatccttactagaatatcatcatccacactggaataactgaattctcactggaattccaggatctacactgaaatcccagaatccacacttgaaatccaggatccacactggaaacttaaaatctttactgggcttactccaatgcccacaatgaaatcctatgatccacatcggaaatttcaaatcccaatatccatactagaatcctagggtccacactgaaatacaacaaactacattggaatcccaatatcctcattagtaacctagggttcacaaagcagttacacaatctatactagaatcccagaaactatacgacaaccctaggctccagattcaaacaccaggatgtacattgcaatcctagaatccacactgaatatccagcaatcacactggaatcctcgaatccctagtgaattcatactggataacccagatacatactgaaatcccagggttctaaatcctcactggatttccagaacccacactggaactgtctccgcagtggaatctctggatccacactgaaataccagaagtaattgtaaacccagaaacactggaatcagatgttccacactagtatagtaacacaaatccacattggaaccccatgatccacactggaatctcagctttcacactggaatcccaggcaaaacactgaaatcttttgatccacactggatttccaatatgcacactggaaccaatagatccacaaaacacactaaaatccacactagaatctcaattccatattccaatccaaagatccacactggagtcccagaatccacaatggatttccaggatacacactggaatcccagtatccatactgcaatattaggacccacactggaaactcaaattccactaggataccaggatccccacgggaatctacggatcacacaggaaacctgggatccttgctgaaatccactgaaattctgtgattcacaatccctggatctacacagaattcccagcatctagactgtaaatccacaatccacactggaattccatgagttacacggagatctcaaggttcacaatggaataccagatcctcactggattcccaatatccgcactagatttcaaggatccacactggaatacttgatcaacactgtcaccgtacgatccacatcacagtcccaggatccgctctgaagtcctaccatttacacaacaatctaacgattcatgctggaataaagggatcaacactgcaatatcacaatatgcgtaggagttctgcgatctactctggtatcccaagatccacactgaaatcatctgtccaaactaccatcccaggaactttacaggaattctacaatccataataaaataccacgatccacactgcaatcactgaagttccaggatccacactagaagtctagggttcacattagaattacaagttccacactgaaattcggcgatccacattacaatctcacgatccgaactgaaatcctactatctacactacaagctcaatatccacacgggaatcaaaggatccacactgaaatatcaagatgcacactaaaatgctacaatccacaaaaaaaaatctaaaaacctgtcattagattgctcttgagttttttttaacatagataccattgtctaaaaagttaacagtattcataaaagtgactgaactcaaaatagaccattgaatgaatagcaaaacgctgtaaaacgtttgacagtgctcaattagctattgagtaagtatttaataacaaattaatggccaacaaggctattgagatggcatttaacaacaaatcaagctatttaaaattttaagaaatcattattcttgatttaattgcaaatatttagaagatttatgagtaccaaattccatcataatagcccgtaacttggtcttcataaggtttccatactttaccatatacacccagaccactttttacgaccgttatgggggggcgtaaatataatcggttgtaaaattattattatgtttttgagaaatgcaacgtctagatatggaaatactgattcgagatattgatattcaacaaagttgaagcatggattgagaacttttcaatatgaccattcaagttttcatagtttgataatagatggcaacactgctcgattgttatcaaaggagtcatttatatgggggtgttatatgcagataccgatatattttatagataacgatatcgaatgttcaccaaagttgaaggaagtgttgcacgccatacattcggccgaagcacaaatgatcatgtggtcggcaacactgtttaagaagaataatgacttgaacggaatagaagaattatgaacttgaacggaatagaaaatataatgcttgacaacgtatgagcactcttcaatccagtttttcatgaagggttcaaaactttgtagtagctggcaacactgctcaagtaaaaccaagaaaactcaatatcaagcgtgtgctagaataagggcgtaagtcgcatgatcgatttctcttcatcgatcctctcttctgtgaataaaggtgacaatatgcaagtttgtcagcattttttcacctcaggacgcaagaatgcatcgctgcctagcgtcacattgcacattgagttttacgctggcaacactgataaaacagttcgaataagctaaatacagtcaggtctcctgtaatgcccctttacaggaggcccagggtatatgggatttcattaatatggggatgttgtagaatatctcgtatgcattatagatagttagcacagtactgacttcggtgaagtttcagtactcagttcgatttacctttatacacttaaattatttcaccgacctcagtaaaagttttcgccgagaatccaacagctgagtattcggtaattttcaatgccgaatttcggtacttatttaaccgagatttcggttatccaaattttttgccgaaatctcggcgaacgttaccaagattcggtaaacgtttaccgagatctcggtaaaagtttcaccgagaatcgtcaaattattaccgatattcagctgttgggttctcagcgaatccgtttaagtgtgtaggagttgaggattatcctttttgttgagaacttggccggtaggggtgcattgtcaaacttgcactacagacgcctctccacatctcgatatcgaagggaccatcgagatagggagagatcgagaagaagaacaataatttaatgaacactagattgaaaattactccgttactaggaaaataataaacaaacaaacttcattacgagtttccaaattgttctgaatcgctgaaatctggtctagtacacacttggatttaatatcgttgttcggtaaattttataaccgaaaacatactgtaaaaacatatttaaccgaagtttcggtactgaaaacgagatttaccgaaaaaccttaaataaatcaaaaaatcaaaaaaatatttgtccaattttaccgaaatcgttgttttatttaccgaaatcaactgtaatcgtttagattcgccgtagtctgtaactttttaccgtacatcagttcaaagtgctataacgcttcaccgaacaaacggtgaacggtactgaggccgccatatttgttttgaagtgctagttgatgcaatcgtattgcatccggttctgttcatcattttttgattgagaaactgcagcagcaggatgggcgtctaatacttcttttccgtaagtaggtatgacctgagtcattctattaaaaagcttatttttaaaatggaataaaatattttcgaggtggcatacaaatgccgttacgtttccggatggccagattccggattctggatcatgcgttttttgattgcactttcaaacattgtagctatggaagtttttatacgctcaagagacatattttagataaacatcctgccggaagttatcagcaacctcagaatgagtgcgatcacagcaacctgcttttttcggatcttcccgatcaatctccggaagaagcattcacggaacgcatgaagaatttggattcacaaaatcaaaatttgattgttcttagtatctgcagaatatcctacgatgtgggtctaccgctatcataagtaacaataagaatttacaaaaaatattaaatttcacatcaatatgaacttgtacttatttattattgatcactctattctattccgactgcatgctgttacgaacaatgtgttcggtaatttattcaacaattcgctcggtaataattaacgaacgttttgtaattttttgacaactgcgtgtcgattcgaattacagattgttcggtaatgcataactttaccgaaagcattactgagcgctcagcggtttttatttcggtaaaaaaattaccggagtcggtgatattttctaagtgtgtaacctttgattaggttcatatcgacatatagagagaaaattgggaacaaaaaatcaacaggaacacattgagatatggagatatcgagataaggaggatatcgagatatggagagagaaatcgtatgcagaatgaagggaccgaagcaatcatcgacatagggagagatatcgagatgtagaacatcgagatgtggagagtcgactgtatatgaactaatgtaacctttggaacatatgatatctctagatcctgatgatttgaagattggtgtcttggaaagagttattcaatacctaaagggctgacgtacggtaatcattgaactatggaattccaccatcaggcagcgctagtgagcatgaaactttcgttttgcggatatctcaagatcctggccgcctaaacagatggcgttttcggcggagttgttcagtagctcaaaagctttcattattctagcttagagattcgagattttaccaccagacgacgctagtgcgcatgcaacttttagtttgcggttatctcagaatcctaaccagagacgaatagagacagagtagtcgggttcagattgggtactgaatgtgccataatattttgggcaactgcatggaacatggaggtcttcatttccaagcagcacaatttgtttcaactcaagaataaagttatctcttgaagcttatcagagttagcaacgcaaaaagctcaagaggcggagtctgtttgcaacatatttaagttatatcgaaattgcatatttgttgcaaaatacttaagagaaaaaaaaatgtttttacttatcttgtttatttggcaggctcgagagccgtaaggtataaaagagccaaaatcttttgtttttttttacattatttacattttaaaatatatattaatttagaaaaccaacggagacgaaccagccactggctgaaagtctccttaatcaagatataaaaaataaaaaataaattagaaaactatgttagtttggggaggaacaaaaatataaacaagaaattccgacctcaagatcaccagttcatggaaaaatagcttcgcaacacatgagaaacaacattaaaacaaacaaactgtgggtaaaccatgtttccattgttagatgatacgtaaggtgacactcaaccatattgcaactggattgaaacaaacaatcttctagctgtcatacacgtatacgttactatagtttaatgcaactctcgcgcaactgggatgaatcttcttgagttgtggacataggaacacaaactgcatgcaagctgcggatgcttcaatcgaaagaaatttgaaacaaagcattaaaatcggaattttaggagaagtttcaagagtttgtttgaaaagttactgaaaacatcctgataaacttgacttcattgttatttgtgaaggacatttgcagtaaatcttgtcgtttcaaaatttttgaacgtcaaacacggagtgaaatgcatgttcatttgaacggcaatgaaacttcatgagcttttgatattaagtagcacacgaaacatcttccaaagagatgctttcaaaaatggtttcaatctcgtatcattaaaagcatctgtaacttacatggttctagttcggttgcatatcaatatacaggctcataaagtttgatttccgttccaatgaacacgcatttcacttcttgtttgacgttcaacattttttaaacgacaagatttgctgcaaatgtcctttgcaaatagcaatgaagtcaagtttgtcaagatttttccagcaacttttcaaacaaactcttgaaacttctcccaaaatgccggttttaatgttatgtttcaaatgactttcattaaaagcatccgcaacttgcattcaattttcgtttccatacccacaactcaagaagattcatcccagttgcgaccaagttgcactaaactacgtgtatgacagctagaagtttgtttgtttgaatcgagttgcaatatggttgagttgcaccttacgcattatctaacaatgaaaacatggtctagcaacagtttgtttgtttgaatggtgttgcacggaagtttttgtaaaaagtttagattatttcaggcgtggtctaatatcgacagtaacgaacttgtattccgaagggtgcagtaaagttataagcaacaagctttgattaatggaccatgtggtcgcttttatagtgcattggcgtagcaattgttcgaagagctggtggagtagtgagtagaggagaagtttggtgatcttgaggtcggaagtttggttttcgttcatatttttgttttcattttttttcccaagtattttaccacaagttagcaatttcgatataacttaaatatgttgcaaacagactccacctcttgcgctttttgcgttgctattcagtgcaattgaaagtcatattttcaaccattgacaacttggattagttgcaagagattattttattcttgagttgaaacaaactgtgctgcttgggatatgtaatcaaattagaactatgtaagttacagacgcttttattgatacgtgcttgaaaccatttttgcatatcttttgaagatggtttgcgtgttatttgggtttcgtctttgttctgaccacgcagaaagatggtgtcttcgaaaaaaatatttgttctagccaagaggttcgagattttgccaactttctaagtggtccggatcctgagataatcacaaaacaaaagtatgatgctcactgacgccgcctggtggcaaaatctcaaatcatcgaatagaataatgataatccttgagttactgaacaactttgccgtgacgccatttttctcagtagtcaggatcctggaggtttgagtgaaatagcaagtcaattagaagcctagtataatccctcattctggtatgtggttgttataggtttgctattttttccggtcgggatacttgaccacatattcattctcttttctcagcattcttctagaaattcttggtggaatttttgggaaaaaaatctgccccggtaaggattattataaaaccctttcgaataactcctagataaatattttaagaaattcctgaaggtagttattagcaagtatcaaatatatcttcgagtaacttttgaggagaatccctgaaaaaaaaacatcataaggatttttgaacaatgcctggaggaatttctgaagaaactattggaatttcttgaaaagtttgctacggaatagtttaaagagctcttgaaaaaataaacttggagaaactcctgtacgaaaccttaaagggactcttgaaaaaaccctcaaaggaatttttggaggaatccctagcagaattcctgtccctaaaaataaaatcaaattcctgaagttatccctgtaaataattatgaaaaaacttgctaagggaccttgtatcaaattcttggagttattccacaaacagtattggtggttttcttggatgtgctcatgttgatctaatcggtgtagtggttggatcacacgcctctcacaccgaggatctggaattgaattgttaggtaaaaaaacatgtaattagtattgaatgtattcaattattcatttgatttgaagttttcaaaattggatcatccttcctataaaacaacatatgtttttctttttgaatataatcaataagccctcgatccatattcaccccgctttcattaaaatataatcaacaatcaataacatgttttcccgttactttcttctactccacaggtcagcggtttaaggttcgagacgcagttgcgaacgttaaaccaattccccgatactctgctaggcgatccggatcgaaggttaaggtacttcgatccgctgcggaatgaatatttttttgaccggaatcgaccgagctttgatgccattttgtattattatcaaagcggtagtatatatcaattcaatttccccatcagcgaattaatggatttgtttgaatttcatcttttccctcttcttttctctctttatttttcggttctgtttctccggtatgccatcaaccaaccaccaccaaaaaaaccaccatttattgccaaacaaccaaccaaccaacaaaaatcgatcaccaccgccacgttctgtactttggtttgatttttcgtttcggcttgcgtccttctgttccttgtcaacgaaaataaaatgtgtaccaaaatgatgtgcaaaaatctctccatcaattgcctcatcacttctctcatctgtctctcacccgcttgctcttgcacgactcgcctcgacgcccattcgtcgcgtgtccttctttacattacttccgtttcttattattactactacttcaaccctaccacctcgcctactaccactctgtctctctatcaatgcttgctatgtttccatcatttccttctcacctcttcttcttctacttctgcttcgtctgcttcttcactaccccctattgctatttctattacttcttccgttggcaatccgttgccgtcccttccgaacttcttcttcttctactttcgaacaaataaaaaaaaacaacccaactccgatatcgaatggaattgctgccggaattttcgcactggcgaatggaaaaatcaaacaaaactatggaattgcgcactgcgtgtaccaaacaaaaaaaaatcgccccggacaaacaacgcaaccgtgctgctcatggataactacaaggcggtcggttacggagaccagtcaacgtacctttagatgtatttagcgaagaaattaagttttatgaattaggcgaacaagcaactaataaatttaggtgagtaccgctcggggtcccgaaggttttttcccatttcggtgctgtagatgtgataccatgctcttacttttattttattttaaccgagtgtgacgcacacatgtgtctatttatgcgttattttatttttttccttttcacccttttgtggtgtacacgttttcccccgttcaacgtgtgttgtgtaattttttttgccttcgcattaaagtggacgctgcgataatcctacagatacaaatatgtccttgtacatgcaaaatctgatgcccgagtcggccaagattctcaaggaaatgccgtaacgaaatcgatttttctggctactttttagcgtgtcccaccacatggctagatgaagaaattggttttagctggaacttatgaaacgctagaaacaaactctaaattaaacctatttgatctgtagtagatgtattgtaagccgatgcttagtggaagaaactcgaaaagaattaggcttttgatgtatgttttttttttgttaacaacggaatatttaagttcgcctttgcattttgtaggaaatcgtcgattaaggcttgatttgaattagaacaaatgccaaaactgatggatcagttttctatgtaataatcgacaaattgtttgctctgtgttgttacttttttggatttgttacttattacggagaaacctgcctttcaatatttgacatttgctcgaatttaagttgggccttcctaagcctattgcataaaactcaatttattcgatgaaggtgtctattgtaaacagggggtatccctgttaagcattgcatagactgactgttcatggtattggtcagacctggtttaaactacggagagcagctcccaaattatgaatcaacaacgacggccaagtccttacaatcaactgggataaaaaggaaattttactgtgcagtgatcgttgctactagggatcgagaatacctctgcatctccacaatcaccacagaaaggttattgtatttgcaaaaaggacaaaatgctgtaagtcatttttggtggatgatacaacccgtgggtataaattggttgacaagacgagataatcgaaacaaatctcgtcggtcgaacggcgatgcgataaaaataaacttgggtaccattcaaaaattacgtcacgctttaggggaacagataaagaaggctcaatcgttaagagtcatacaaaacaatgaaaatggttgtacaaaaagtattactaattggatggaggatgtcaaaattagtcaattttagtgctagcctttggtttactcgcttcatgcttatcgagccacgtctttggtattatagctaatagttgtatctaaacgatctataaaaaaaactgcatctaaacaagcatgacgtcacgattacaatatcaccactgaaataaacgtactgaattatgcatccgcagatatatcagcaggccatatcattaaaattcattttttatcactgctcgcttgaacacatcaaaactaaaagaaaaatgtttttgttgacttaaattcgtggacccctcgaggggtcgagagccactaagctaaaaaatatgcgaaaaaagactatatagctaccaaattgttttacactccaaatgaaagctacacccttccacattatgatgacactatgttttcattgtgtttcaaggaaaatacaagacaagaaatacttatggtttagctttctggatcacagggtggccactaatttaagttgactaaaacacttcacctctagtttcaacatattctagtaagcaacgacaaaaatgaattctgattacgggggccaggtttcagcgagaatttctctgttataaactagatgaaacaacttaaatcgacaaatcacgtcgtagcatgcatgttgttacaataattaacattacgcaatagaatcatgaggcgattgatatccatccaaaaggacgtgatattataatttatgttttgctgtgtatagtcggtccacagttcgatgctcatcatctatgttcattcatcttgtttctcacaacatttctatactcacagttaaacaattgctctgagtactacttcaatccgacagccactcagttatatccgtcaacagatcccctctcgaccattgcaaattggaggcacatacccggtatcgtgccgtgcaccattattgacctttacataaaacctccacatatcgttccgctcaatgcgcttcagctatcgtgtttacttcatattgcttttattctgcatgagattcgcttttctttagctctcgctaccatgtaccgcgctattggaagccatcctgacagcaatattcatgtctgtcattcgctggcactctttattgaaccagtctcttcgtcatcacggtgaacctgaatcaatcatgttccatgcagttatagtcacttcatgcaaagtatccatgaagctgttagcagttactggcgacactgcgtaagtacttcattatttgatcaggatattggatattgacgtatgagaaatgtcgcatagcagataggagttgacacaggtttgtttgcaatatacctcaatacactacattttttattagatacaaccagggtttttgatcgataaataattgtcaatgccgataaaataaacgtttatcgatatcgtcattaacgattaagtcttcagacgtcaattttaacggtgataacatatttaattatatgttatgttataactatggagattatcgacacgttaacgtctttggaaaattgtctttgcaagctgaactgttgatgatgtcatcactagtaactaggttacgcaggcgcgttgaatatgaagttaatttatcgttaggttttctgaaaaactttatcattatcgagtaaacgttgagttatcgaacgaatttttttcacttttaacaatcctcggaatgaccacctaaataattaagatgttggcagatattccacgaagtctcaaggtcaatattttttcaaatgtataaggtaattattttacgttgagaaatcttgttcaaaataaaaacaaaatagaatcaaatgctcaatcattcagaaaataggacttctgaaaatgatgatgatgaccacgttgagaaaagaggtacaggtcggacacgattatccggcgactctattaagcgggattcgattatccgggattttagactcgattatccgaagcttttaagaattttgagatgaatcgttttgaatttatcgtcgaaaattacacttgagttaaaccgttatttcttttaaattcgtgattggaaaaattattcaaaaatatattttaaaatttcagttatatccgatgttttgtgaaaatttcattcgaatcggtccataaacaactgagatcaagcttaccaaagttggtcattttgtatggaaaatcgaaaaagttgcaaatgttttgtccaatactgtaggatcgattcaaaatcttgttccgcagtgttataaaatttacctcagttcaatatgctaattgtgtatctgactcctattgtataatggggttagaatgcctgaatggaatgaaatcgattaatggaacccaacccttagggtttaataaataagtttcataatcgtgaaagttcatacgaaaatgttcttccaatttaaggaaaacaattattgaagcctaacaagtttgaaggtttgtttgagttaaaaggttgtttatgtattcgagagctcttttgagtacaagcacagctaaaaatatgttgtaaatttaagtttatttccatgcacatatttggagcatcaaaataaacgtaaattttaacgaccaatccattatttttcaattgaatacactttaaatttacacgatcatgtaatattcaaccatttttagttgaaaattattttaaatttacatgatactgtagtaacacacgaatttgctttatttttacagtagacttcagtttgcatcacatataaaattaaatatttttttctgtgttttgggttcgtccttaaatgacgtagcattacagggggatagtgaacttcaccaatttgtaacgatgtgtgacgaaggggatcaggtatcagaaggtatcagaaggtcggctccagaggcacgttccccgccagttgggagatttgtgccatcgccatatttgagcctatttcatcatctacccgatgggagaggaaagagaagggaaagatgggaggaaataggagtggggtcctttttttttgttttttgcaaggaggaaatctacaaacagatcccctgagaaagtaactcagggaatgcggggatgacgcaccaacgacaatccgctaaaaccagcctatgcactgtgcttgagcaattcttttagaattgctcaagtggtgaatagtacatcgacatgacccttggactccccagacaaccaaaatgtacgtagaacgaaatcatctggagtaaagtgtccatcccgggacatcccgggacttgatgaatttcttccgtttcccgggaatttatttctgacatcccgggaatcccgggattcccaaaatgtacgtaaaatgtgatgagaaccactaaattttaatgaaaaactgaaatttttcctcactagcaatcttttttgataaagtagaaaagcataatgaaatagagaataaacgacttattattttcatgagaagatcaatttaccaagtaagaaacacatatttttatttgtctagttgcaaagttttaatgctttgcttttgaacattattccagcgaagcagcaataatattttttatcaaggatgcgggactttacaacaaaatttgacaaatattatcacaacaagattcaaaactattgaacgatatagtatgactatgctgacacactctgacaaaggatattgaccaatgagaaactttgtaaacgatactcgatgacgactatgctgaccagggatggctaccgaattggaccgaatggacttcggcgcttgaaatatttaaatatataatctgcaaaatgtgttcattaactttgtttgacaggggagcctctcaatacgaagccctcttttacccaacgatggagacgaaccagtcaccggctgaaagtctcgataataaagataataatttttaacattagccgttttgataagcctatgctgagataaaaaaattgaaatacacctaaactgccgcaaatcgcaagtcagtaccatctgtaaaaagtaggctttgaaaaaattgactgagaagttttcaatctcgttttccatacaaataggggaaggggtagtaaaatgaacaccttaaggaaatcatctcgtttctgatataaaaacgaggaatttgtgttgttctatcgcacaacatcaaaaatagggatgtaatctatagcaacgacatggattcagactaaaatagctaaattttcacatattttcatcgctatcaaaaaagcgatgcaaatgttcattttacctgcactatgtgggtaaaatgaacagcggttggtggtaaaatgaacaccacgcaaaaaacatgagcaaaacaaatatttctgaaaattttcattgcattccagaaaatatatccaataatgattgtaacccattcaaaaaaaattctaaaggtatcagatctgacatcatatcataacaacattcacctcactgaaaaacctcaagtcttccgagctaaaagttacgtcagttctaatttccaaacgtggttttctaaaatcttagttttcgttgatattttcacttcaattgagctacgtatcaacccgaacactcagatttatactctaaatcgttcgtgcgtgataaaaattcatcgaaatttgttttttctcggtaaaaggcacggtgttcattttaccacccctgttcattttaccaccacttcccctatccaaaaaatttctggagattggaacatgtttcgatctcaatgaaactttcataatttgcttttccatttttgtgctacacgatgcgtaaatctgcagtgggactggtatcaggtatcttttcattatgggacaatcgacttggtgttttttcctaattttactgaacaaaaactgatttctcgttagtgctgctgaaagatcattacactatgtaatgaaaacagatatcaactcaattttgactaaaatgcagatgggactggcttgcgattcacgacaccaaactttagtcaataattttaagaaattaacttttggcatgatctacaataccttcaatgatctttaatcgtttattttgttctaaagtatttatgacttttcaaatgtttgaagcaatttgctttaaaattatgacctaagtttttattatacttccatttataagtattatagtgaattggaaaaaatccatagcagacccttaattaatcaacctaagttttgattgttgttaggttacttcatcaaaataagaaagtcttatctgaaatgtgatttagtataattaatatattattttaaaaaattacattatctgtttatttcattgaaaaaaaaagttgtattgttaaatttttacttccatttcaaccgaaatgctagttttattgaaaattttatgaatcccgggatcccgggatttcccgggacaagcttaaaattttatcccgtatcccgggacgagcaaaatggccgggaaatggacactctaatctggaggctttgtatgtgacggattccatgtcaaatcggtcagtcacagaactcaaccatcttcgatttggattaaattttgcacatgtttttggtatggcagaataagtgttttccatagaaaaattgattattttgactcaagtgtaacttatgaaaatggcctataaattattgcatgcaacttatttgaaaaattccaattccgaaactgttgattgtagagaaaactgttctatgaagaagttgtagtgaaccgtttggactataagaaaaaaatatacactgaataaatattttatttattttcatagaaaaatcaaaaatagaaattaaattttaaattacacaaaaaccccattttaaatattttttaaattttctccttagaatcttgatagttagaagatgtttgggacaaagtttcatgatggagaaattttaaatgaaaaagtttttctaagaacaacttttggccgattttcaaaattttgattgtttgtcaaaataaatactttctaatgatacagttagcatcttgaaatgattctaagccataatgatcatatgaataatttctcgagaagtagccattttcgaattatatcgagtttaatgcaaaaaatattgtttaaatattaaaataggccattttcataagttattcacgtttctccatttattaaaatacgttttcgagagtaaagaccatatttctttccacttacttaatttccctgatgcagaatcacgaataactaattaaaatggccttatgtatcagtatttgggctcttcagatgcattgtggatgcatttcgaacacttattcctgacgaaaagacgacaaactaatttcaatgttcattgtttctgtgtatattcttcataacagcatgcccaaactgcaaactttgttggatgctgcttggttaccatgaaaagcgaaaaaaaaaagctgcatcatcttcaatcagcatttgttatggcaattttacatccacaaatgccgaatcataacaatgtgcccttatttgtgtatttatgatgacaaaacagcatttgtcgatgacatcaatcaattatggttccgccatattaatttcactccggttgccacaatttcacattttcaaatcatattatttccatgaattcgcgcattgtgatgattaaactgactgaatatagtttaaggggtctattttataagtcgagtcgatcaaaatgactcgactggaatcactgtcgaccgaaaaattcgctcgactcagctctgtcactcgagtttttcgacagttgtcactctatgtgactggattactatgggagtcgacgggtgacatctgaaatatgcatgcttgctttgatcgacaatgaatacagacgagtcacatgaatctgctcgatttataaaataggcccctaaatatacctttttcagaggaggcatccgccatttcacttttttttatcacatttcacagtaaatctcactcggcactaaatatttgagcgcaatatatccaaataaatcaatacgaaattaattatcacagatgtgtttctaatcttattttgctttgtttacgttgtaataaatccggccaggtcgacgttatgataaaatcattttcaagataatgcgacattcatccagaacaggtggcctcaaaatagctaccataaatgctattttgctttattcgtgtgacataattatacacttcatagcctctttcagagtgggccaactagtcacgttctaatctacaagaggttttggggcaacagtgccttgaccgtggttttatgggcgtttatttatagcaccctggaagtaattcgtaaaactaaaattgttacttgggcgtgcatatactatgtgatgaataatagcatacagtatggcccatggaaaaatgcgaaaatcgtcgtatcatgtgttatggtagtttttacatataaaatatgaatgaaacattaatattattcattacttgtattgtttaatccatttagactcagtttttcgctttggacatgatttttatctgttactttcaccttaccagagaggaattggaagcatacctgcaaattttatcatgcggacgtcgagttcaatatctgtgtgatgaaagcttctgaaacatcaacgacggcgtgagattcttcacaggccttgtctttagcatacgcccatatccgtatttatttttaattcgaccttaacaaaatataaaggcatatcaaacctataagacgctaatgccttcaaaactgtgaccctggcaaaatattttattgtggtcatgaaggaaccaaggtcctttatgggcatctaaatatttcatagtttttcgcttaaatttgcttataacttcaaaatcacaagaattgcaaacttgcgatgttcagcaaaaatgtgtatctttacttcctctgcaactcttctgaagaccacattcacgtaaagctgaaaataaaaaagttagaccaaaataactgattttttgggtccaccctaagttaaaactttccaaatcaatttacttagctcaaatgaagagtaagatcaaaagtgtcttcgacaaagttgttcaaaataacattttctaaaagtttgcagcagagggcagacacaaatttcatcaaacaaaaaagtttgagtcaaaattcatattcaacttttttcttaaaagatgcgaaactcaattacgaataacttctctgaagacatcgaacgtctaaaatcgacgagagcagagaaaacacttttttccggctaaattgtcgattcggttcattgtgcaatgcaagaatagccaggacaaggtttacagagtttattgaatgcagttcctcaaattgagttcgacatgcgaaaacaagctctgaccctgagttggccgaagcatgagctttcaaagtagccagactatctgacatattcctttacaaatatctgagctgctccagatgatgtgatgagtattggcatcactgccccttttcgtaggcagtgtacgacaagtcgtttgaaatcatccgttggggatggttcatcatatggtaagtataccgaacaataaacgtatttcctattgaggtcaccaacagaaatatcaattgtgacagcacatacagggtgtccgcaaattatccgtacaaactttgaagacatggctctatacaatcaagaataatcaattcaatattcttgcatggttttaaacattggcttattatattcttcagaagtaagtttgacacatttccgatttcaaataattgcacaaccaaccaaaatgtattgaggtgtcttaaaggaagctgttttccgagctttatgacggaagagaaatgtccatacaactcactggatttgaaccgtacaattttctatttccagtctaacttgaagccactaacctgtagattacttcaaataataataggacatttggattcatctctcttaggttttagggataacgcatctccagtatgactagcggccctcagcaaaaacgtctccgacaaatttaaatttgcctatctcagtaacaagcaattatttcgaaatttttcaaagttgtgttttgtgttaacatatagatatattataaaaggtacgtggacattgatttttcattgttttcaatgcgagatcatctttccaatattttgctgttcggataatttgcggacaccctgtacatctctggtcgtcaactcagaaaatgagtgtagcaacgatagcgctatttacgagcacgcatgcacgatgcctgacacgcgagtttgctatttcatgtttatgaaagtagcaaaaactgggcccacaaggttacctagataaaagttccccttacgaaagtaaggcttttgaactagcgccacttgagcaatatcattttgcatgagtctaccaagattgatcgttgctgatattttatgccaaagattgatttaagctatcctaaccgtagccactacccaaactaggcaggattaagctttttgcaatctcaacccgaaaaagaccagcagaaaaccagatcggtatctattagaaatcgccaaaggcaaaaatcacaaaatacactgcataaaacgcataatgcgaaaccataaaggtgaatatttaatctaaattacaacgtataaataacactatctttatttagcctcaggcttgaaactgaagaaggacagccggttatctcggaaaaacactgcaccattgctccgagtagcgcagaaagggcacaatactgcagagggcgccctggtactccacaggctccgttcgcggttaggttttatttagacccccctaaccattcattcttatgcacggtaagcttaaagcttaggggtcaccagtgaggtggacttttaccaccggaacaggcagtccgtagtgttaattcttagccaattgatacaactgctaccgacactatctaagctgatcgggaaaaggaaattaacattgatgatcaactcctgacgttcccaaacagcccgaaaaatgtgtgacgaaggggatagaagcccaagtaaccaaaagcattataacataacacgcattataacaaattgctttatgaattgcttggttgctttataaacattattgcattatttcgactataaaagggctcttttccacttttaaactacttcaatggtagacttacggcaatgcagctgctttatataagcaatgatataatgctccatgattacttgggagggttcttaactggcggacgcagttttctaaatcatatggaaagtagctctcaacttgacagacagttttataaaattttttgattgcaattattgaatttaacttcaatatttattttcaagagataaatatttccagattgacattctctctccaaaagattgatattttcagattagaattcattatgagctttacaaaggccctatctcgatatttcacatgtttcaaatccgaacccgacccgtacccgacttattctattttgtttcaaacccggacccgactcgaacccgaaaaagaaccgttgttcaaccccgaacccgactcgaaacctgacaaaattgttagaaaaacccgacagaaaccctagtttcaaaaagtggtaaatttgtcgtttttgatgaacaaggaagctttaagattgtggctctgttcactatactcaccatacccgacccgacccatacccgatagtagccttttaaatccgacccgaacccgaacccgaaaatatttcaaattttcaaacccgaacccgttgggttactcgattttctaatgttctgcattgattcaagtccaaatgcacacccctagatttaaactcaaattttggttgcattatgttttccgtgtaattcacgaaatgtcagatgagaacaaccctagtgtcaaaggaaatccccagtgtttttttgtcggcgaacatcagtggtttcatgtcgggaaacataaaacatgataaaaaagtgacaaggtagaaattttatttttttaataaacttcaaatatggataagttatgatttgagcgggaaaaattgctgcaagctcttgctctttcgaacctaggcttttagaaccctattgaattaatttcttgaagttcaaaaattaaagttaaaaatgataatcttcacaacttgaagctcaaatacattggttggaatagcatgaggacataaaactagattttttttattgaaatttagtcaactctcctatatttaatatttccctccgctcgatggaatgtgcgatcccttctacctagtcgatacctctctaactcgatgttccttaacttgatgttagttgtattagctgccactaattaagtttcccatgcaagtgtaaccttctgactctgaaatgctcatcctaggaattcaggttgaacaaaattttattataaatgtaatttattagacgtaaaattacattggctgtggcatttatgaagctaggttagttatatgctaatttgtttaagtattcttcataaatacaagtgcaaaactgaattgattgattgtgctctcaattgttctatgaaaaaaggttgaattgttttgtgatgagtgttttctaaagatggtatgtatcaactattagagttaccttagttctatttgcccatgtggttgtgtatcagaaacgctgttgtataacggactttaaatgcctgaaaacttaacagagcttacacgtttcaactctcgggctctaaattattgtagtttgaccaacataattttccaatggtaactgcagttatttttctgccataatatcactgccggacatataggtcataaaatctatgagcgtgcctacccagtgatcttttatggtttaaacgagtaagtttcgtaatcttgaagaacttttaaaaattaatcctgagaattctctcgggattttgctttcctaaaatccttggaagatcccttcagaaaaccactttcttatattttctcaaaaaatccctaacgatatgcaatcaaaaattttgttcatagaagcctctgggatctcttctaagataagtattgaaaactcttccagaatctcaatatccctcttggaattaatacaaaatttactccaaaccatgaattctgctcagaacactctaagcgttgccttgggcaatgattttccaacaaattacttcgaggattttcacaataatttgctttgagtaccgtaatccgaggtatcattgatcagtggggtaacattgatcggaatgactcatctcgtaaaaagttcttgggggtctattttgtaaatcgagttaggattcatgtgactcgcctgtagtcattgtcgatcaaagtaagcatgcatatttcagatgtcatccgtcgactcccatagtaatccagtcacatagagtgacaactgtcgataaactcgagtgacagagccgagtcgagcaaaatgtttggtcgacagtgactccattcgagtcatttttggtcgactcgacttataaaatagggcccttaatatcattcattgaggggtctattttgtaattcgagcgaattcacgtgactagtctgaagctgagagagactcgcgaagaggaaaaatatcaatgtcatatgcagcccagattcccctctcacgaaacgtcaaatgcagcccaccgtttttatggctgaaaaagtgaaaagtattgtgttcaaagtaaactgtcataaagaacctcagtcggcggagcagttttttccaaagttgctgataaatctaagcagaagattaattatttctaatgtctgctacgtttgctggcatgacatttcactcaaacgactatttatgattcgatgtgatgcaaactcaatcattttttgctgagaggttcatgtgaggatttgaacagcatgcgcattattggtataaacgcaaagtggaatatgaaaaaaactcagcaatcacagaaaaagaagaccgtcttcacgagtctcgtctcaggtctgaagtcattgtcgatcaaagtaagcatgcatatttcagatgtcacccgtcgactccaatagtaatccagtcacatagagtgacaactgtcgataaactcgagtgacagagccatgtcgagcgaaatttttgatcgacagtgactccagtcgagtcgtttttgatcgactcgacttataaaataggaccctgataaaacatttccaaataatgtatgatgcttctcttttttatattaataagctaaaattgcgattaccttacgcgtaaatttgacaacttttcgaaacaatgatttcaatggttatagttgacactaccgaagattcatgtctcacataagttctataaacgatatgagccagaaaaatgcagttcttactcaaaacgggatcgttttcggcgatgcctttcataagtatgctcaattaggcaacattaccgaattactgttgagaatgtaaatttctcttaggcagttgcctacatttaggcgtattccgtggttcgaggtgttttaattttaaaataactcaaaaagtaaatgacttgtaagcatttggccatcatattcggcttcaggggccatgattaaagtgagtaacgacattttcaatataaccgaacgttgattacataggtgatcaatgttaccccatatcatctaaataaaaaaatcgcttaaaatattttttttaaacatgcttaaattttccataaaacaaaatacagtatatagtcacgagctatgggtggcagtacttgttttaaaaatatcaaatttgcaacatctgcattatcaaacgtaaaattcaagaaatatttaaaaatatgaacactgttaacccgaattacggtagtttcaagatattatcctagccatttctccagaactgctgattgaacttctttaagaaagtttgcagaattattcagataattgaaattagtttaggaaagtttcctgaacatttttccaaaccttccttctcgaattattctagtattgcggtgtgcatttgaggtgcaaatcttcactaaatgtccttcaaatgcggtaaggcaaaacaatcaaaggacacctagcaacgattacacacatcagcgccaacctagcatagaaaagcttactttgacatcggattgcctgtggaaaatcttatcgcgtttgatgttcccgcatttgatatttgcgtttcaaacgcacacagcaataattaccctgatatgacatataaaatcttataacgattctttcacgattttttccaggcatctctttgggattccatcagagttttcctagaagtttatctagatttttttttaatatcccaagggtttcttgaaaagttcttcgaaagttcatgatttttatatatatatatttccgaaattaggaaactttcaagattttcaagaatttaaccaacagtttcttcagtgttatgctttcattttctccaggtactaaaacaaagtttatctaaaccatcatgcattgatttctctaggaatttatcctgtaacttccctagaattcctcaatatattgagacaggaattcttccaaggtttcttttaaaaacagttcagagatttttaagaaattattttttgaatactgtaaatttccctaagaaatattcttaaacaacaaatcctagctaaattcttgcaggaattctttcttaaataataattgtagataaaaatatggaatttttataaactttccattatgcttaaaggatacaaaataagtgtaaggaatctttaaataaataaaccattataggaattttggtgacctaagggtaatcttgattcatggagttgatgctaattcttaaagaatattaagcataagaattaaagtaccgtaatttcgggtgaaattgatcacttttcactgttttccatgtctgatttctattacgttgccaattccaaacaagtacgacgaagatcctcatgggtttatatactcaaattttcatacagttgtgattttagtgctgaaaatcgtctctaaaataaaaaatcaaggaattccatttcggggtgaaattgatcacctgtcaaaacaattattgttagctttgaaaacaacttttcttattcaatttgggcctcctgaatccaattatgcttgccaaattcttaacaatgcaaaatttatggaaataataagcaattaattttcaacaataccgcagaaaacgcctaaatgtaggcaatttccgaaggaatcttctgaaatctataaaaaatcaattattaccaaaaaaggacaaattggtacgaattttgatgataaaattcgttttggggatatatttcaagcatccttacaaattttcagggtgacaccatgtccaaatccttgttttaaactataagttcattgatgtctgccaataccacacagaacacgaatatggaattttctattattttcatagaaataaacattccttaacacaaaaaggcttcactacatgcaattcgacaatagttaagacaaacaacgttcatttacataggttgcattgatttctgtgctctattagagggaaataaaatcgtgtgacagagtgatcaatttcaccctactgatcaatttcaccctactgatcaatttcacccgaatgtacggtaacaaataagggaattttacaatttttctcaaggatatctctgaaagaaatctttagatgtatttcattaaaaatttctaacaaatcccataaagagatagataaaaaaaatccttcatagaattctaataacccatataaaatatttggcgtaatgtctaaagaatttcttcacgatatcccaagaaacagaactagattcattttataagaaaatcttgatataattttgaattgaaataaacattgacaataatcctagagtccaagtggatctgtagagaaatttaatgtatcattagaagaactcttagaaaaattacttgggaaatatttggaatggtttatggaggaatttttgcttgcaacaagctattcaaaatcttaataaaaaaaatacaaaacttatgccttgtcttatgagacttctatatttcattgaatacataaccggaggaaaaaactgttaacaaatactgaaggaatctatatttgaatccaacattttctggaggaattcctgatggattctcataaggactacttcaaataaccattttggggatgccgtgcaaaatttcgggagtttttttttggaataaacgttggaatctatcttagaaatcctaacccaaggtgatatgaataaaaaactttgaactttactacatgtagcatctactcaaaaacaaaatccacaaagtttactacacttttggaatgaataaaaaacttttcgaacatgtagtacttactactttcgaacatgagcagtgactgaagctgcacgttaagaaatttccattcagagtgcagagtgattctgcacgtaaagaataatctattcagagtgacgcttaaaattaatataatcatgcatatgaagaaaatgcatggaatctaatcgattacgcgacaatttgcacaaatcatgaaggtgctgttatttgacaagatttgtagtgtaattttgcgattagtctggtattctctctatgtctatgattttatgatgatggaacatcaaagaattttctgggtggttttcggccttcgccaacgccgatgattttttaaatactagcttaacatttatgaagagatcttgagattacagctatcaaattaggaaccacatattttctagcaccagtactgagattctggtgaaattgcggtagaattttgatgctccccgtgtgttttcttaacagcatgttgaattccgatgttctaagtgtttctgtgatattctcgttattttggtggggtttctgatagcatccttggaatgtctagaacttagaatgtagagatttttatgagaattgtagtgattccattggtagtcgttagaattcaatgaggattccctttgaaattattaaaattcttaacgattccacaaaaaatcccattgaaatctataaaatatttaccgacattcaaaacgtttatattgaagctttactttgaaattccaacggaactggagatcaacggaatcttaaaggtttttacaataattacaaagattgattttcggaattacaaatattcacacaataattcgcaggaatcccaccgcaatctcatagattcttacagaaatatcgtctcaaagatacccacagaattccaagagattaatattcggaatcccattcgcaccccaattctagagtttttaccagattcctaatatttccgcaatattcctagaatggtatttaaattttcagaattatcataaaaaatccgacatccctatcggaatctcaaagttcctacaggaattccggaattcaaaaggaaatctgagatgtcacaatttacacgtaaaattcagaattactttatcaatatctgaattcctaccgacatcttaaaattcctagaaaataacataattatcgtaatgccagaattcacacggatattacaaattgctaatgccggtaatcttaccggaatctcagaattggcggagcgaaagttttcgtaacctcagaattcctttgcaaaactcaaaataccttccgatatatcaaaactcatatcgttttcccatgatttttactcaaaagtaaattattccattcaattccgcaaactcaaagcatgtgtagcaacctctgaagctaactaccagtagctttgtagtaaatgctacctttattcatagcaatgcgttgtttttagtatgttcgaaaggtgtagaaaggaaaatgacacaaacatgttccactcgtgttccacatatagcgtttactaccgagaatgtagtaaactcaactttactacattttattcatacggcccactgtatcaacatgttttatttcgagccaataacttgccaaggtaaaattgccgggcattaggatctctaccaatccaatcgtcaaactttttccaatctggaattttcaaaaccaattgtggacctgtcactaaaaaaacaaattgaatcaaggcgtattttcaacttctcatggtgaaaggaaatggaagatatatgtccattatagcataaagtttcatgcaaaaaggatgcagaggttgtgtataatgctctttttgcgtgaactttgcgaagatctttcaagatgactagacctccccttggctaggcccatgaacaagcatctacatcgctgatttatctattggagattcgttcattaaccaccggtagatattaagagctaacttgtagatttgaagacttataccgtcattggggggtgaaatagagccacaaatgcgtaaatcctgatttgtttttatacaactttcgcaactttactagaaatagtctgataaatattagaatacgtttaagggttatgtgtctgcagatacggaagaaaattcgtttgttttcctttgaataggaaacgcacgaaaattggcccaatcaagcgaattttcttccgctcaagatttcaaaatagtattcatccacctaaaagtgagattatctatgaaacattaaatgcaaaaaaataaaaaggccttattttcaagctttttttgttaatttatttaaaaaatcgactagctccaggtatctaattgtttgatggtagctgtagataacttcaaggaatactacattaaaattttatattaatattctcaacacttggtgagataatccagattatgttttggcctaatatcaccctcgatgacggtactacaataagcaagttatgttaagcagttgttaaattcaataaggcattatattggggacattttgggaatgtaaaaaccatgttcactgacgtccgctaattacagtcggattcaacattacccagattccagtcggactctcaatcgctgattccaacaaaaattaaaatacagtcaacatcttctttcgaaagagactccggacagcaattatcttggcccaaatccctcagtaatatgaaagctcattcttttcgagatcctcttatagtttttagtgttcaatactcaaatacagcttattaggtgttagttgtttttaaattccatttcaaaattattaaatcatccatttttttttctatcttctcatcacgtcacgattgcaatcggcacccaacagggaggatgaaggttttatcaaggaggaggagaaacctttgccttcgaatgagaatcaaagaaaagtgtggttattatttgagtatcccgagagttcgcaagccgccagggttgtagccataattagcgtatttgttatacttttatcaattgttatattctgtctagaaactttacccgaatttaaacattataaggtgagtttgttgctgcaaatgtttatttagaaacgattctgaaaaatgtgttttcttttcgaaacttccaggtgttcaatacaacaacaaacggcacaaaaatcgaggaagatgaggtgcctgacattacggatccattcttcctcatagaaacgatatgcataatatggtttacgttcgaacttagtgtcaggtgagaatcgttgaaacgcgatgatcttcagaacacttactaatgcactccactctctccccaacaggttccttgcttgtccgaacaaattaaatttcttcagggatgttatgaatataatcgatataatcgcaatcattccttatttcattacattagcaactgtggtcgctgaagaagaggatacgttaaatcttcccaaggcaccagtaagtcctcaggtgggttgtctccgtccgacgattgcgaatgatcatccacttatcgaactttttctctttcttccccaacaggacaagtcaacgaatcaggctatgtccttagcaatattgcgggtgatacgtttagtgcgagtgtttcgaatatttaaattatctaggcattcgaaaggattacaaattctaggacgaacattgaaagcatctatgcgagagttaggtttactaatatttttcctgttcataggtaagtaccgacgggggaaggcccgtgagctaccgagattcgtgggaaaaacggatgggaccttatctttttaatacattctatatgcgtttgcgatcggtttccgtgcgaatggaaaacggtgcctttggtttgttcatttccagttcgcatttcttcgtttttgagaaatactagttaagtaactcgtacgagcgtgagtgtgtaaataggtatgacctgagagagactcgcgaagaggaaaaatatcaacgtcatatgcagcccagattcccctctcacgaaacgtcacatgcagcccaccgtttttattgttaaaaaaagtgaaaagtattgtgttcaaagtaaactgttattaaaaatctcagtcggcggagcagttttttccaaagttgctgataaatctaagcagaagattaattatttctaatgtcttctacgtttgctggcatgaaatttcactcaaatggcgatttatgaatcgatgtgatgcaaacttaatcattttttgctgagaggttcatgtgaggatttgaacagcatgcgcataattggtatgcgcatgcgccgaattggtatgcgcatgcgcataattggtatgcacaaagtggaataagaaaaaaactcagcaatcacagaaaaagaagaccgtcttcgcgagtctcgtctcagggtatgactacacttcaaatacagttgaaatatatcccagtaggctattacttcgttctcccccagtatttgaaggcaatgcctactccgtcagtgactatttctagaacaagatatttgtatttgccaataatgtctacacgcaacaataatttaggatactgtaccccgaattgtccataaatatgttttttgtgtctctcaaggtgtggtcctcttctcatcggccgtgtactttgcggaagcaggcgccgaaatgtcctatttcaagtcgatcccggatgccttttggtgggctgtcgtaacaatgaccacagttggatacggcgatatgaggtacacactcacaaccaaaatacacccgttcctcacaccacccacacacatacacattcatctgcattcatgaccatcatctcaaataccgacccccaattggaacacaatcggtgtacgaaagcgtgtccaaattctagtccacgatccaacacggtaaaaaataagcaccatgctatcaatagttctgcacttggatttgcactactgttgaatcttgataaaatcaaggtaacagcacttgaattcaacgttgcatgttttgatttgaaataaaaaaaagttaaaataaacatttccgcctgacccagatttgaaccaccaaccttcggagtgcaggtctagtgtcttacctcgacaccaactcgtatctgttgaaagggatcgaattgatctcaattactttctacaacgagctgtcaatgattgcttccatacaaaagacatgatgatcaaaatcaacaacttttcacttcagagtctagttctagagacagtagagcaaatccaaagttgaaactctttaaatcatggtgattagtgttttgaattgagtcaagtgatcaatctattcaatcgaacgtgctgattttttaccgtgaataatggcaacgaaacagtacaccttcggtgattggaacctgttccaatgcagcgaaggcttcctgttggattcctctctcatcaatacagaccaatccaaacagtacaaaaccgaatcatacacgtgcctcctatcacttcatccgcccttttttaaaacctcaaatcaaaaaaatatacgatcttcttttcagtgtcaatgtcaagctgtgtactttctagtgtgtatttttcccctattgtgaatactctctttatattgaacatatgaatattgctactctcgaattggtgttgtttctcttgcagtgttttaaattgacaaaataagaagaaaaaaatttaaaatcatcgaactaaaccgttggtgaatccctaagcatatataggtacagtcaactctccttaactcgatattgaagagaccatcgagttagggagatatcgagttacaggacacaaaaccagtgcaactacgatccaagggatcatcgaggtaaccatgaaaatcaacttttgctagggtcgttttactcgatatagagatacgaaatatcgagttagggacagttaactgtaataattttgaaatatttgctcaacgtaaatattagattatctttattcattttgaacatcatttagttttacacgaaacagtttcttgcgaatattgtcgttcaagaccgtcatgctgaagctgacctgaaatttttacctcagggtcttttttgactcatttcaaaattcaaatcgtcttctgaattatgtaggagtctatttcataagtcgagtcgatcaaaatgactcgactggagccgaaaaaatcgctcgagtcagttctatcactcgagtttttcgacagttgtcactctatgtgactggagggattgaagtcaccttgcaccaagggttgctagatgatttttttcgagtgtcttccaaaaaatgtcactttaatgtttttaattctcaagacaatgtaaaatgagttctgtttgatctttcgaccttgatgcttgcttttgccggagcgagcgacgagggcaggatcaaacatgtcgcgcgtcggtctagtaagtgaaaaagtggcgtgatcggggagttcggttggagtaagtgaaaaagtgccgcgatcggttagttctgtttgatctttcgaccttgacgcttgcttttgccggagcgagcgacgagggcaggatcaaacatgtcgcgcgtcggtctcgtaagtgaaaaagtggcgtgatcggggagttcggttggagtaagttaaaaagtgccgcgatcggttcgttctttttgatctttcgacgaccttgacgcttgctcctgggcagtgcgtcaagaaagcccgagctgtcgtccgtgttttttttctcgagtcgcgcgcccttttttttttttttttttttttttttttttttttttttttttctgggtgctagccgagcaaacgagtgaagctgaaaatggattgtggccgctcagtcaaggataacggatcaattggtgagctcgtttcatgctactatttctaatctataaaatatgtatgactgcacatttaatcgttacaatggtgggatgtaaatatgatgtttcaacaaactatggatggttcgtcactgtgagtgtcgacacaaactctgattcatgatttatttatgtttaacatttttttttttcagaacaccccttatatacctttatttttgtaattaaaaaaactttgaatggttcgacactacaagtgtagacttgcgaaaggtccactttattcaacaaactttggatggttcgccactgtaagtgtcggcataagaataagagtgttctatgatgtcccaaccaattgagtcttttgtttcttttcaaatgagtaaaatataataacacatgctttcgtactgacagctgtaggaatgttacatttaggtatttgttcaacaaactttgaatggttcgtcacctcaagtgtcggcataattttcctctacatagaaattatatgaacaattatatttacgtataagcatgtatatatctcacaaatcattgtttatcatggtctaatcgcttatcaaagtgaatcctttgacccaacgatcctccccattaacaaacatccctcccagtaacctttgtggagatgcagagacaaacacggtctccaaatagcaaaggttacacactaacattccttccctcaatcccacctgactgcaaggacgtggccggcgccgttattgaccttgtataaatagaggcactgaattatgcacactgaagaagattatggcctatcccagctgaacttctagttgattctttgtgcattttcactgacttcggtcaatcacggaatagcaaccattgatatgtgtagtcagtctaagctaagctaagctaagttgtcactctatgtgactggattactatgggagttgacgggtgacatctgaaatatgcatgcttgctttgatcgacagtgaatacagacgagtcacatgaatttgctcgatttacaaaataggccccgtaatctatgaattagttgttttctgacaattatttatatgataataagaacattaaataattccctgagagaggtatcataaaaagtcgaaaataaggccttatctactgtatgtgccaaaaaaagtaccgttttctgtgatttggtcatatggaccaaaaactcgaatcattataatttatccaaatatttgttattttacctcaaatcctcctgaactgcaaaaagccatctggtgcgcggtctgccaaggatccgacggcctctccctggttagctacatgcccatcccaccgcagcctgccgtgttttatacgcttaacaatatccatttctctatagacttggcataactcgtgattcatgcaacgccgccagatgccgttgtccaagttacagaattgtacgcagcactgaacgttcaaagacccccaaaagctttccggtcgaccccttcaaagtccaagattcatggccgtacagagcgaccggaagaacaagaatcttgtacaacgcgagtttggtcttcgtttgtaagcttcgtgactttggctgattacgaaatccgtaaaagccctacttgcaggtgcaatacgctattttacctcgctggtaacattactatcgcaaacaaactcttcaaaagtattgccacctaacaccacctcattaccaacattacctatgggcccacgatgtctactagcgattatgtactttgtctttgtggtatttataatgagcccaattcgcgttgtcttctttcaaaaaggcacgttgaaatctcatccgcatcccgtatagttgatttcaatccttccaacgttgcacgattcagtctaatcagcttcgtcagaaaaccatggtccatcattatttcccacaactcgtttcttttgactgaatcgtacaccgcctttaaatcgatgaacagatgatgagtcggcaagttgtattcccggaatttatcgaggatcgaggataggcccttacgaaaaccggctattgctcacaagcgtgcttgagaagttcagctgagagctcatccttcccccaacatccgtgttgttcatcagctttttaatcgtcttcttaacctcatctagtgacacacaggctttattttgctcatcttgatcagatagatggagcaacctcgtacgctcacaacaattatgagttatgcgatgatggttgaataatccgtggctgagagaatggaaagaaacgttggctctatccaaacgcacaccttccatttggcagctctagcttactgcgaagttctgcaaacacatcatcattgcttttgggatgaactgaggttggtttctccgtcaacgcaagagcatgatttcgctttcctctttgccctacaaagagacaacgaagagctgtctggaaatgctcttccccgaactgagaaatcggaaaaaaatgctctcctcctaactgagaaagggagaagataatctctttctcttttaagcacttaggttgtcaaaacaaactctgtaccactgtgggaatgaaaataagcaaacacaaacgtgtaaactcttcatcccgcagagctcgtacgctcagtttgtgtgtgggtaaaatcgcttctcttttgtagttgatcattaaaagggagagaaagatgataagtcaagagcaaggaagaagcctggtgatacaagctccacagccttaccatcgttctctatgattattctgttctttgatgttctatcattcccaacattcagtaacgtttggaagtgttctctccacctggtagtcaccatcattttatctgtcagtaaattaccttcacggtcgttgcacatgatgagagacggcgctgactttccacgcacgccattgacagtttcatagaatcgtcgcatatcgttctgttccacacaattttgcgcctcggctatcacattttcatcatacttatttttctttctgcgatggattcgcttttcggctgcttccttataccgctctccgttcagtttgataacagccactaccatccgacgtctgacaacgttcttctcattcgtcaccctctggcactcttcgtcaaaccatccgattcagatctatctgattgtaaatatcaccatttggttggctccaggtgtgcttccgaacatccttgcgtgcaaagtaggtgctgctgatggccatccccctggcagcagcgaaagtcactagtcgtaggccgttgtcattagtaacggattgaaggccttcatagaacgcgtccttcacgtcatcgggtagataatggtagatatgggatcaaccacccggaattcacgttctccagatcgaggccaccgcacttcttgaatggcggtcacacccactccaattttctgcagttcacgagccagaagactcgctcgtccgggttcctttaacgtcctgacattccaggtaccaagtttccattcattgttcttatttcgctttcttgttcatcgaactcatcagggtaatccctctataattggcgcactccagtctgtatcctgtcttgcatattgagcgaatgatgccattcaaccaaccggtggacaactcttcagccttccataccttatggaataatcgatggatcgattggtaaagctgctcccctccatgctagaaaaactcgtcaaggatcccgtctttaccagcagcctccgtgtatcactccggttcatgctatcttgtacctcagttgtaacacattttcttcatctctcactgtcctgtaccgctcttagatcactgagcagagattgctcagattactgaacagagattgcttagattactgagcaagaatttttcagattactgagcaatgattgctcagattactgacgaggattgctcaggttactaagattgattgctcagattactgaacagaaattattaagataactgagcaagaattccttagattactgacgaggctggctcagatcactgagtaaggattgcttagattactgagcaaggattgattagggtactgagcaaggattgctcgtattactgagcctggattgctcgtattactgagctcagattagtaagcaaagattgctcagattagtgagtaaaaattgctcaaattactgagcaagtattgctcagattgatgagtaaggattgttaagattagtgagcaaagcttactcagattgctaaacacatattgctcagtttgctgagcaaaaattgatcagattgcgcggtaaagatttttcagattgctgagtgaaaattgctcagattactgagcagggattgcttagattactgaacaaagattgctcaaattactgagcaaagattactcagattactgagcaaatattgctcagattactgagcaaatattgctcagattactgagcaaatattgctcagattactgagcaaatattgctcagattactgagcaaatattgctcagattactgagcaaatattgctcagattactgagcaaagctggcatagattgctcaggttactgagcaaatattgctcagattgctaagcaaatattgctcagattactgggcaaaaaatgcttagactactcagcagagattgctcagagtctactgagcaacgttgatcagattactaaacaaaaattgttcagattactgagcaaagaggctactgagcaaacaagcctgcaatgattgctcaggttactgagcaaagaatgctcagattactgagcaaagattattcagattgctaagcaaatattgctcagattactgagcaaatattgctcagattactgagcaaagctggcatagattgctcaggttactgagcaaagaatgctcagattactgagcaaagattattcagattgctaagcaaatattgctcagattactgagcaagtattggtcagattactgagcaaggattgctcgttttactgagcaagaattgctcagattactgagcaaggattgctcgttttactgagcaaagattgttgaggttataaagcaagaattgctcgttttactgagcaaggattgctcaaattactgagcaaagactgctcagattactgagcaaggattactcagattggtgagcaaggattgctcagattactgagcaaagttgctcagattgctaagcaaagattgctcagattgctgagtaaaaatttctcagataactgagcaatgattgctcaaattactgagcaaagaatgttcagattgctaagcaaatattgctcagtttgctgagcaaaaatcgctcagattgcgcagattgctcagcaaggattgctcagattactaagcaaagattgctcatattactgagcaaggattgttgaggttatggggcaagaattgatcgttttactgagcaaggattgttaagattacagaataattgatcagattactgagcaagaattgttcagattgttgaacaattattgttgagattacttaacaaagattgctcagattactgagcccggaatactcgaatagccgagcaaggattgttcagattactgagcaaagattgctcagattaccgagcaaatattaaccagattactgggcaaaaaatgcttagactactcagcaaagattgctcagggtctactgagcaacgttgctcagattgctaaacaaaaattgttcagattactgagcaaagctcgctcaggctactgagcaaacattgctcagattgctgagcaaagattgctcacattactgagcaaatgtttctcagattactgaccaaaaattgcttcgattgttgagcaaagatcgcacagattactgagctaagattgctcagatttctgagtagagattgtttagattactgagcaaggattgttcgaattactgagcaaagactgctcagattactgagcaaggattgctcagattattgaacaaagattgctcataatttgcagcaacttcttaacagatttgtgagctaatttggctcagtatcatcctgtgcaattgatgcatcagtttctgaacaagtcaagaagagtatccggacaattctgagcaatgtcttttgaggattttctgcgaatcccacacagaattctgcgcagtaattgatttgaattctgcggaattcgtgctcatgcttctgagtcactttggctcaagcaagaaaaaaacatgtgagcatatttggcttaaggttctgaaaatttcctgataaaacttctaattactgcctcaaattaagatggattctaactcaagataatgaccagttcagttttgttttattcaactcagtaaaggtaatgccacttctcaggtcattgctcgaaactctgagcaattccaactccacagtcttaacaatataagctcaggactttcatcaacttttgatcaagattttatagtagataatattgcaattgattctgagaaaagcaggactcgcatagaattgtgatttgagtttgttctgaacatgacgaaaattttctcacaaatattttctgtgattgctcagaatgtacaaattgctctgattagaaattgttcagaattctcagtcgaaatcttcccaaatcctcgccacgaattgcgcagcgtgctcatcagaaaatgctcagaattatgagcagaaaatgcgaagaatggaaggtaaggattgctggaaagagaggcttagaattctgaggataaacagttagaaactctgtcaaaaagttcagaccccctgagcaaaaattttggttcaaaacccggcgtgacattcatctgcaaatttgaacaagattatcaagctaacaatacacagtgtcgactctaacagcattttaaaattattgtttaaaacttcaagaatttcttcagtgtcaaataattgttttgattgctttgaggccaaatatgacgtcatttgacaacaaattttgacagtcatgatgacctagccgctagcaatcatcaaaaaatatacaaggacccaaattaactgtcacgaaacggtgctaaaaattagcgttgcacagatttttaaacagccattactctcaaactagtcattcgatttcaaatcttctttcacagtcatgaagcttgactcttcaactgctaaataaaaatatactacatagtcgtagcaaggaacaaagagttttaagcagggggtgtgaaaatatgtcttcccaaaaaaacagcgttacaatggttgagagctcaaatctcagccatcaggcaaaaatattataattttatttcaccgctggaaacattcaagaccagcattgcagggaaaaatatcaaacatagtcgtaccaaggcaaatgaagaatgagggactcctatctgaaatgtttaccaaacctataaaaaaatatttcagtgccactatgcaatcaattttcgattttgtttcagaattcaacacttccagtgcagatcttcaaatgaaaaatactcaacatggtcgtagctaggaaaaacagtaataaggggcttccattaaaaaaatgcccaaaaacttcaaaaatccataactttgtaatgagcaaaccgattttcgattttctttcaccatttggatgcatatagttgtgcctttcaaagaaaaataatattacacatagtcgtagcaagatataaggtttttaaggggtatgccctatttcttggtcccgtttgcctgtaaatcaaaattcaaagctatgaaatgtaatttttctccatgtcgttttgaacttgataaatttaagtaaagatatacatttttgtaaacactaaaaatttattttacctaaaaaactgcagaaaacccttttttaacctggagcttaaaattcaaagcagtggcatgtacttttttcgctattaaattaattgcacgaatcaagtgaaaatgtttgaataagaaaagaagcttctgattacacacaaaatttattttaccaaaaaaactgctttaaggcgaagtaggccgtcattagaatttgtacgcgccgttgatgattgttgctaattcacctcacgatttcaaattaaagaaaatcagttggttttgcactgacacgtctgaaaaagtatcagcatactctatgcatgttagcgcgtacagtgatactttttcaagtctatataaactatcaagactgagttttatcacttttaaatgcaagctgaaaagtcatcattattgccaaaacgaatgacgggctacttcaactcaatttaataagtatgtgtgcctgctaatcgaaatccaaagcaatgacatgtattttttcaacatgaacttgctgatagaagttaagtgaacattttttagaagaaatagacattttctgataacacttcaaatttattcagccgaagtaactacaagtgggcttcgtagccgtgtggttagtgtcaccgaggcatttagccgcatcgtgctatggagtgtgggttcgattcccgcctcaggccgaaaaattttttcgagaggaatgttttccgactgtgccactgggcgttgcatgctagtccgttgtctagtgtggtgcttccttcaaagggcaaatagcccactggaagcattaacgtgtagtgtctttttaaaaagaaaccctatttcatgagcttgtttgcctgtaaatataaattcaaagcgataactcgtagctttttcgaaataattttgcctatagaagttaggttaacatgtttgagtagaaatcgacatttctgattacactaaaaatgtattttacccaaaaaactacgtaaaatcctgcttcataaacatatatggcttcaaatgacaattcaaagtgatagtgtgttatgtttttaagcataaaattgttgatcgaagtcaagtaaacatgtttgagatgtaatagaaatttttatttatactcaaattttattttacattagaaactttgtagaacatgttaaataaacatttctgcctgtgaagatatatttaaggcgatgatatgttggttttccagcataaaatttagtgtagaggttaacttaacatgttaaataggaaatgtaaatgtttggttacactcaaaatttatttcacctaagaaaatatgaaaaaccctgctgcacgtgcctgtttgagtgtaaagcacaattcaaagagatgacatcaattttttccgacataaatttcttcactgcagtttagttaacaagaacgaggaaattacacttaaaaattatttgacttagaaccaaaaaaaatcccagattagaaccttaacatgaaaacaaaatgggattttcatagtttttaaagtataataaattttgagtgtagtaaaaaatatgattttaactaaaatatagtaatatagtaataacataaaaaaatgctttcgttttgaatttttattcaaaggaaaatagggtattgatagaggggtattcttagatactaaggtgaaataaattttgagtgcaaacaaaaatttccattacttctcaaacatgtttacttaacttctgcgatcaattttatgttaaaacaaaaaatatttctttgaatatttcttcacaatcataaatatgcattgtacttagttttacgtagtttttgggtaaaataaattttgagtttattcaaaaaaatggtataacttctcaaacctgtttactgcacttctaaaatcaatttttcgttaaaaaaataacatgatatcgatttgaattttaatctacaagcatatatgtttattaaaagggtttcacgtagtttattgggtgaaatacattgtgagtgtaattctttttttactcaaatatgtcaacgtaacttctataagctaattcattctgaaaatgccaagtgtcatcgctttgaatttagagttacactcaaacaagctcatgaaataaagtttcccgtagttacttaggctaaataaattggaagtgttcgctttacttttataagcaagttaatgccaaaaaaaactacttgtcattgctttggatttcgattcacatgcaaacagtctcatgaaataaggtttttagcagtttcttatattacttaagaaactgcttgaataacttgctaattttgagtgtaatgaataatttatatttccactcattaatgttaacttgacttgtacaatcaatttattgtcaaaaaagtacatatcatcgccttagattttgtttagagaagtacaatttgaaatatgatatttttcatagtttttaaagtataataaattttaagtgtaatcaagcattatatgtaagtaaaacttctttaagtaaattcataacgtaaatattaaatgtcatcgctttaaattttgattcacaagaaaacagaatcatgataactgggtttacttagattcttatgtgaacaaaattttgagtgtaatgaaaaaattccaatagttcttaaacatgatagattaacttctacaatcaatttggtgttgaaaaaacaaaacattattgctttaaatagtttcttctaagcatatatgtattttttttttttttaaataaattttaagagtaatccaaaaatagttttactcctcaaacatgttaacttgacttctcaaataaattttatgtttgaaaacaatgtactaccgatttgaattttaatttacaagcgtatatgtttattaaacagggttttacgtagtttctttagcaaaataaatttggaatgaaatcagaaatgtctatttctactcaaacatggtaataacacttctacaatcaatttgatgttgaaaaaaaaatgaaatattattgctctgaatattttttacaagcataaatatctattgaatttggttttgcgtagttttttgggtaaaataaattttgggtgtaatcaaaaaattgtattactccccaaacatgtaaacttgacttctaaaatcaatctcatgttggaaaacataaaaactatcgatttgaatttttatttacaatcgtatatattcagttaacagggtttcacgaagtttcttgggtaaaatacatttttagtgtatctaggaatatctatttctactcaaacatgctaacctaacttttataaattatctataacattgttttccgaaaaagctatgacccatctctttgaagtcagatttacaggtaaacaagctcatgcaatagggtttctcgtagattcttaggttaaacaaatttgaaatgttatcagaaaatgtctatttctactcaaaaatgtttactttgcttccacaagcaagttcatgtcgagaaaactatatgccattgctttggatttcgatctacaggcagacatactcatgaaattgagtttttagcagtttctttggtaaaataaattttgagtgtaatcagaagtttcttctcttattcaaacatcttcacttgacttgtgcaattattttaattgtgaaaaacgtacatgtaattgctttttattttgagctacaggcaatcaagttaaaaaaaaagtttttccgttatattttaggtacaataaatttaaagtgttttcaaaaatatatatcttcattaaaatttttcaagttcacttcgacaatcaacgatatgcagaaaaaactacatgtcatagctatgaatttcaatttacaggctaactggacaattaaataggggataccccttaaaaaccttatatcttgctacctctatgtgtaatatttttttttttctctgaaagacacaactgtaggcattcaaatggtgaaagaaaatcgaaaatcggtttgctcattataaagttatgaatttttaaagtttttgggcattttttaatggcagccccttattcctgtatttccacgctacgaccctgttaagtatttttcatttgaatatctgcactacaagtgtcgatttctgaaacaaaatcgaaaattgattgcatagcggcactgcaagattttttcatagatttggtaaacattccaaatagaagccccccattctctatttgccttgctacggctatgtttgctatttatccctgcaatgctggtcttgaatgtttccaacggtaaaatgaaattataatgttgttgtctgatggctgagatatgagctctgaaccattgcacattggggaaatccgaacccaaaggtggaaaaaattgataacttttacaatagaaagataaaaaataagttttatagctcattcgaaaggaaattttctcaggaatcgattggtagtggttttatgaatgtgggaccactctgggataagctatggtgcccgttttgccccaattccttgaaaattatagattttcatgttgttttgagtaaaactgttttattgtggagattatttcccatgaaatccatcatttctagtccattcaacaatttttcacagagaaagttataaaaacatggaaattttggggattatggggccaaatgtacaatgaaatatttttgaagaagaatttttgttttaatttttttcaacgtgtttttatattgaaataaattctaaaatagggtagaagtaccaattatggctatagtaccaattatggcaatagtggaaacaaaaagagatttttcttattttttcactagactataatggcttatattcacaggaatgattaaactatttgtttttgatggtaactaaaccttgaaaagaacaatcgtgcaataagcttcgaaaaatgaacatttgaaaattttgcctcacatatatgtcaccttcttagcagttggctaagcccagtaaacacaaactcgtatacgatagcacataacagtataaatgtggaggcgatatacgtacatgcgccattaggctgcatgcaaaatgcacgtatatcgcctccacatttgtactcttatatcacatcatttacgaccatgtgtttactgggagggacctccgttacgaaatgtatgttttcatccggataaactgtttcaaccgatgaatgtatgttaactagtgatacaaaacgaataaatttagctggtatgcaatcaattctactgttttaagttggaaatcgtgttattttcactatgtcgataactggtacaaagagtgtatgagagcccaattatggcaatactctggaggcggtttgtttacattttttgatcagtaaaataaaagaagtaaagctattttactggtgacttccacgacgggacggttcggtaagacattatcttcatgttttgtactcaattactaagatttttcaatcacacgttcgaaaacgtttgcgagcggaagatgctaatttcatgatagagaggggttttcagcgacactcgatttttgaattttccccctttttttcgttaaaaattggcactggaaagctaatgtgagatcattaatgctgttttgtatcataatttgcatttacactacattttgacttctttttcgaaaattgattttctcccatgaacccattgcaaaaaattgatttaacatatatttaacccaaaatttttggaaaattttatgagcgatatcttcattacatataagcgttgcattatcattcgctcttcatggcgtttgagttcatctcgtgcaaatattcgatagtccataattggtacacttttatgtcgaatgctaggaacgctattgccataattggtacaaagacaacgctttttaaaatccatttttagatgtttaaagtcaatttagtactaaaactgtttaaatcaacagattcgcaaggctttaaacttgtaattgacaccaacaagtcatgcttgcgttttagaaacgcagttacaatttgatttttattactactgttgacatattgcatccataattggtacacctaccctagtcaaattatcatgaatatagcttgcagaaataagttgtattaaaatttgtagaatatgtatgatcattatttatgctctatgcaaaacattgtgaataatttaccttctaatatcacaaattccaaacatttccaaacgatgtgcgatagtttgggtaaatgatattgatctaaatgatcgattgccattagcctcattgatagaagatagtgggagcatatagttttttggctatgtttgccccaattcccctaaaaacgatttctttcataattaattgaaaagatatctccgaattaaatgtattatgtactaaattgtttattcagtagttgatacagtatttaaatcctaaaacataggagattatggggatcttttacacataaataaatgaaaaaaaaaaactcaaaaacggatccattaagcagagccgtagcgtgggttcatggcgcccttggcgaacttccatttaagcgcctctcaatcaaaactgtacacatctatttaacatggtgagagttaacgtgaactatgtcattagaattcattagaaaagaatcgtaggatgctagaaatttagaacatatttgattattgagttaattcctgcaggacaaaacgcaaattcttttatctattagggcagattgccaactattgcacagactaaaaacgtgccaattattgaacaacccgtgtattccttatggatgtgcaataattggagtgtttttagtctatgctatattttgctatttatcctaaatgttatttgaaaaattcccaagaatattacaatttatataataagaaacaaatatgaaaaatcggtgttctaacaattttttggtgccaattttagtaaaatgtttatttgaagaaaaattcttctaaacattttaaaagtattgattaaaaaaaataaaagcttctttatccgatatttatatcatatgacactaatagtacaaccttgaaaaaaaaccaaagccatacgcttatgtgttacacttttcaccacactgctgccgtatgaggcttgcgagcttttcttaacagtgttgtacaaaatacaacagcacgactactgaagtgttaaaaacgtaaataaaaaaaatcatttttcataaaaaaaaaattagtgctaaaaagatttttttttcaattcacgttgtcttggccaagacattttcataaagtatcatttaaaaaagtaattttaaatgattttttaaggaaaggtacgatgggttacgtcatctatagctttctgaaaaccaaaaatgagtatattaattctactgattccattttttttgtaaaatcaaatggctatcagctagcgtacaatatttttaagtgttattaaaaatgtaccactgatttgggaagaataattcgcagaatgctgtgcggatttggccggagttaaattcttagaaaaccacaccctggattgaatatgtcatcaagatggtttaaaaagttcaaaagtgtcggtgaaccgcaaagcgttctatcataaccacacatagtttatatagaagaccttgattatttgagaatctcgacaattttttggttgaatccagtcaaatactatgttagattcatgctcagtatttcatgaaaatttctttcaggatccatattgtgattcatagagattgtgtttgaattcaatatgtattttcaaactttaccatttgtgtcacgcgtgttggcgcccccttaaggctggcgcccttggcgggtgccaacctggccaaccgcacgctacggcactgccattaagtacccatctgcagattttttttttttattgaaacaaatcactcagaattaaattagttacacaatcatacctgaagaaatttcatgataataaaatagcgtggaagtgccctagtagctctgcctgcaccctactactgaaaaagtgatcataaacaaacaaaatcttccatatatttcaatatggcacattttgattgaagatgtagtagttaataatgcttaattcaaaatatttttcaaaatcagttatgcatttcattagtttatttttttgttattatgttgttatgttgcctggtaaagatggacaaatcgcgtggtaaagatggacaattcatgggtgaaattatgaaaaaaattcacgtgctcggctgggatttgaacccaggactcttgtatgctagacgagcgcttacgggctcggtagcttagttggtaaagcgatcgtcatgatttgtccatctttaccacgcgtaatgagttaattaatatgaatttcttcatgttatgcattttagaaggctcttgataattactgtttacaatattaacaatgtatggtaacatagtaacaataaattatattaatgaatgatcgattttggaaaaatctaaaattgagcattattaactactgcattttcacttttatgatatttttttctgtagtgtatgatggcaattggaatattgtaataccaaatatatataacaagacaaaattatttctcgaataatgtcttgtaaaatgcaatttgactctcacgaaattgctacagtaatgattgagtaactaacctgatcctgagtaatttgttgcaatcagaaaaaaaacggctgatggtttcttgatagattcatttttgattttttatttgattatttttttttttttgtttatgtgtaaaagatccccaaaatcttcaatgttttatgatttaaatactgtatcagatacagaataaacaattcagtacataataaatttgattcggaaaaaaagttcaatcaattacgaaagaaatcgtgtttaggggaattggggcaaacatagccaaaaaactatatgctcccactatctcctatcaatgaggctaacggcaatcgatcatttagatcaatatcgtttacccaaactatcgcacatcgtttggaaatgtttggaatttgtgatgtaaaaaggtaaattattcacaaaatgttgcatagagcatacataattatcatacatattctacaaattttattacaacttatttctgcaagctatattcatgattatttgactattttaaaagttatttcaataaaaaaacatgttaaaaaaatttaaaacaaaaattcctcttcaaaaatatttcattgtacatttggccccttaatccccaaaatttccatgtttttataactttctctgtgaaacattgttgaatggactagaaatgatggatttcatgggaaataatctccacaataaaacagttttactcaaaacaacatgaaaatctataattttcaaggaattggggcaaaacgggcaccatagcttatcccagagtggtcccacattcataaaaccatcaccaatcgatttctgagaaaatttcctttcgaatgagctataaaacttattttttatctttctattgtgaaagttatcaattttttccacctttgggttcggaattccccaatgtgcattgtaacgctgttttttctgagtttgaccatctttgctcagcccctcacggaccgtctaccttgctacgaccatgtgtgttatttttctataagcgtttggccacaatgtttttgttagtgaaaaactttcagcatttggacaaatatttgtgaagttatgatttttcgaaaagtccgtgtaacgctgttttggggtcaccgtcgtctacgggggtttttttctcacagtagcgtgacagttaaacaaagttgatcatagttgaaattgatttgcaacagcatccccctgtttacatttgcttgtgcaaaattagcttatatttttttagttaggacagtgcgagacgaaaaagcaagaataatcattgacgcgtacaaatttcaatgacggcctacttcacctttaggtacagcaaaacctgttttaggctgtttgttttttaagggttcacaggtatcgccaagctgttcctgaagggctccaaggggtcagcaagggctacccaacaggtattctttgtaatttccggagattcccttaagggagaacttcgcggagacccttgagaaacgtttggtagcttataggcaaatcttctgagagtttttggaatgctatgagaattccatggaactcatgagattgctttggaaacccctgctaaactcttaaaatcttttgtgatctaaaagtatctaaatgagaaactctttggaaccttatttaaacctttggaagcccctttgaattcctaaaaccatttcaagagtctctgggaactctttgagatcccctgagcaggctaaagaccgcttaagaatcattgaaaagctcttgggtttcctaaaaactacctggtaaattagggaaatacatccattgttgtttatcaccaatcgatcaagctttcagctttaacgaatgttcgattctgcagatttgggctttttaaacgttgggttttggcttcgatttttcttcaccttaacggtgcgatgcaatcaaggaacttgcagttaaatgttgaccaaaattgacctaaacgtacttgtagggaaaagtattttgcaccacactgcccatgttcacaaggatgacgtaaaagccactgaaattttcagcatatttaagttagaacaaacgtcatatcggtatcaagtcgtagtatttacaatcatacgctgaacaatgtagttggaatgctgaaattgtcaatagcgcttacgtcgatcttgcgaacatgagcagcacaaccttctttaagatctgcactgaaactgtcattttttcaaaatatgttagatactctagaatatcactcaacaaactcttctgcggcaaacagaggaaactgcaacttcgtgagatgtaacgataatgagaacatagataaactgagaaatgtcgaaggcttttgtaactcgtgttcactagttctatgaactattgtaaaaatcaattaaactgcattatataccttcttgaattctactagatgtttctgttacttcgttactctgactgaactcgatgttgttcgatatcgtcaagtaaatgtgtttttttattagtttcatttcaaaagccatacgtttcgttgaattttgtttctttcatactttctggttccaatttggttttagtgcttcacaaattagtttaacacagtacaaagttttatgttttctgaaaagtaggtttctgcggcaatcgttaatagattgccaaaattttgacgaaaaagtatccctacgttagaaagtttctccacaattaacgaatagttttgttttcgcatgccaaagtatttttatggtggggttagaacaagtaaaatagaacatgagaacaacttttccgaccagtaatagaatgtattaaaagtgataaaagtgagcccgtgtgtgagtgtgattgcgagaatcggtgacaacaaaaaaaaaaacagaaaactactcggaaacaaagatcggtcattcgatgcaagtgaaatgtggaattcccagtggtcaataaatcgatcgtttgagtaatggtcgcttccctttctttctctctttctctccgatgctttctaggcgttgtgctcttctcatcggctgtttattttgcggaagcaggaagcgaaaattcattcttcaagtccataccagatgcattttggtgggctgtggttaccatgactactgtgggatatggtgacatgacgtacgtttcgctcaataactctcattttttgctgtcagtttgtttctgtcatcgcctactaccatacatccgttcataccacacatgaaaacacacatatcgttttgtattctgtcctgattttcggtgcatttaaatcgtgattccctttctctactaatttttctactcccagtctcatttaccgtatcaacgacacatctgcattacaatccacattataatatttttctctctatacttcatacatctggcatcctctcgttcctgtcatacatacattctatacaaatatcaatatttgctcatattccatccaactcgcgcgaaaacgattcaattatatttgccttacacttttcacgtcctcgtcctcgttatcagccgtcgtttctcacactcttgcgaatatgcaaggtagaactgaaatgatgtctatcgcataaaatggattcacgtgacacatgtccaccccctcaatcatacaacccaaaaaaaagaacatacacaccactcgtcattgtccgttttgctcatacaataatgaaataacacaatgtcctggtagaactctctcgtcatctgttagtagtactagaatcggtcgcgcagcaacccactcattatccgaatgtcctgttctttctgtatccggacatggaaaaaaactctcgccgttcgtcatcaccattccatgtgcaatcaaagtaggctcacctaataacaaaatcagcaaacgtagaatagatcatgtctaacccgaaaatcaattcaactgcttcgattgagtatttcgatgcacattccaatgcaaaaatattccattgaggcagttccactcgcagcatgcaatttttgctctcaaatcgcagcaatccgaattggcttacattatgccaaaatttaatcccgcaaattggccatcacgttaagacttgaattgcacccagctggatttacctcctaccacgtacttcatagccgctgttttacttatttcatgtaggaaagcaaattctttccagttttgataaaaaatatcttgtggagaaaaattagctcattttcatctttaataacaagaataaaccattggatctattttgtttctttgaaattaagttgtttgcttttagtttccatttcgcatttacttcaaattgtagttagccatgagttttgaatgcattcatttgcttccgttgttcagttcgctcattcccagcctgctattctcgactgtcctatgcaatgtgtcagcatttttgagtgaaaatcgatgttttcgttcacagccgcgtagcctgcactctatccaacttcctcaaaccctgccatgcatcatagaacccaatgtagaaatgctcgttggccgtatgctcactttccattttcgccccttagcctcttaagtatgcttgtactctcttattcctccacaatatgtatgcaaaatcgctacaaattgcatgaataatgtcacctgtcttcatcccatgtagttgcgcgtgtgtgtttttgtgacacaccccctgtaaatcatcccccgtcgcagacatccaatctctctcaaaacaccttggcttgccctcgtgcagccctcccattcgccataagtacacacatttcaacagcattagagcatatgttttactcctgaatggcgcgagccattcagaaacgaatcattttgcgttcttttcttcgccggctcaagaacccactttcctaacacgtttcgtattgtcaacgttctcatttctcgtgtcttcttcgacgcaatccccggcgacattgcattgacggcaccgtctcaacaggccggtcggagtgtggggtaagatcgttgggtccttgtgcgcgattgccggtgtacttacgattgccctgccggtaccggtcatcgtcagcaacttcaactacttctaccatcgcgagacggatcaggaggagatgcagagtcagaacttcaaccatgtcactagctgtccgtatcttcctggcactttgggtgagtaacgaattatataaatgatggaaacactttttagaagccgaagattttgtaacaccacttgacgccaattagataactatgaaaatgtttcgataaacgatgacccataacattggaacactttcaaaaatccattattgaatccaatatcgttttttcagctttatataaaagatatgaaaccgattttaacagttcatagtttttttttaacgcaaatgattaatttgaagtatcagtaggtttgcgttttaagtaagttccggtgaacccaaacttttcatggtgtctactcatttacagaaaataaattccctgatatttccaggtttttccagataaattccaggtttaataaatgctctaaaaaatacataaatgacgaatgattaaattcaggtgactaaaaatttattttaggaagtttggcttcgaaacacttaaaatattttaaaaatatttgtaaatgtatatacaacatacgaaaacaaatatagaaatttgatgatttctatttaattttcacaaacaataagaatgtttataaaatgatctgacagagtctttaatcatcgaaatcagttttaaaaaatattttatttgatcttaactataaaataacttttccctttaaatgggattcagatttatagacatccagcgacgtacccagaatactgtcgaaaattgcaagtcagtcccacatgtaaaaagtaatcattgagaaaaggagacgtgaagttttcaaactcgttttctgtataattttccgattttattgaacaaaaagttttttcacgctagcgcatatgaaagatcattggataatatgttgaaaactgatatcaactcaattttggcaaaaatgtagatgggactgacttgcgattcacagcagaatatgtctcgcgttttttattttttcctagttaatattttagggaaatcagggcttgtagggactaatagtcttgaccgttgcctgaaaaaaataacatgaaccacgagtttgattccccatttgaacatacatttcactaagacttttttgaatatctcgtgacattacgacaagtattactgctcgttttgctgtaaatttcttccgaatattactctaaagacctcttcaggagtttgttttgtgatttttacgaactttttatgtaatccttacaagaaatgttttgattctttaaagaattcaatctggattttttataaaaaaacgcactttttttcattaaaacttcactccggtagggtttcgttctacttcgtcgtaagcgctataattcgtcgtatcaaacttaaaatgttccactacggcggatattccaacttacctgcaacatagattcatcttccgtgtgtttttttttttgtgaaagctgtcatggtttgtacacttctatacaaaaaaattcaataaaactactgtatttcgttaactaacttcagttcaatcatccactttgcactttttctctgaaaatgtatggacgaacacgatttgagagaaatgcttaacgatcgacaccagtcacatcactttatgatacaagtttcttcccgcctcctatgtgacttacttcgccagctactcattttcactatggaaaaccttcttcactgaaggttttcattccaatcgcacgccgtaaaagttctataattcacgaaattttatgaaatttcctcgacgaccgcgtaaaattgagaatgtaaacaaagttcaatccgcttatgcgcatcaacgtgtgcgcggagctcgacgtaaaaaaaatggttcctttgattgtgttgttttcgctgcactgtgagcaaatgtcataattgtacggaaaaaaggaattgtgttcatatgtttgggctgaatattgatgacgaacaatgaattttaaaggaaattagtatcttccatcatcctgaaggaatggagggagatgcccgtagatttatatatttaagtaaaactgtttattatagcgttgatatgttgtgttttgaccactcaaacacaacttacgggtgagacgaatctggaaacttattgcgacagaaatgaaaacgatacgacggattgagaatacggcaaaatgcattttctttccattatttccaaaaagagatcaacatcaaaatcgtattgtacaatgctaaagccgttttgagaaaaaaatgtttggcatcggtttgtatcagcatcattcactgcaatactgggaaaattgcagttctcactgatcaatgctcaatacgatggatactagcacatcaccctatatatcatggctggttttcttagtacaaaccatggttttagctcaaaaggtcatcatattggttgtttttttttatcatggcaaagaaatttcttcgaagattccatcaggaatccctctacagatcgtatcagacaattttcaagaaagtcccacgttcttcagaaaattatctattgatttccctaggatttattcattttttttataaactcaagaaaatcttcaaagattttttttccaggaaaacgtcaagaaaatgtttcagaattatttgcagaaaagtttgaaaaatccgcaaagaattttaaaaagaaaatcccagagtaatctctaatgaaacttgtatgagttctatgtatgccttgatgaaataatgtcctacaaggctttttgaagaaattcgggcagaatccctgtagaaacttatctaaaaacgattggagcaataactgtaataattgctttttgaagaatccatagagatttggaaattgcatttgagacattattagtggagtgcttgaaccgcagcaattatgctatgataaaatgctggagacatttttagaagaaaacaatgaggaatcacaggttgaatttatcaaagaattcttggacaagtttataattaacaactatcgaaaagctaaacattacatataatttgcaattggattagatggacaaattgatgtgaagatttgcgaaaaccacgattcataattcataattaaaaacaagtaagtttataattgttttcataaaataattgggtttattctgcgcggcgtgtgaggtgagacgagtcgaatgaggtgacaattgtcgactcgctgccatttgattaacattagtcgtctcacgtcactcgcggtgaaagcgattcgccacgactcactcgccgtgcagaataagcacaaatgtattaatatgtcgaatgatttttttttttttttcaaagaatccttatagaaatgtttggattaaaagaaataggtcgtgtgaaatattgtagtttcttggaaaaatgtcgttaagaattttaaaaaaactatggaatgtgtggaagaacttctgtagtacctggactagaagcaacacttgaagaaatttgtgaaagaatcagtagaaaaacatctggaggaaattctgtttttttagaataatctctgtgaaaatgactgaaagtaggcgctggaatgctccaggattttctggaccaaattctatagaaattcctctaagcattcattgaaaaattactggtggcattcctgatggagttcctgaaagtgtctcagaaggtttctctggagcagattatccctctttttcccacgactttgatcgaatatttctttataaaaaaaggttaaaaaaatatgtacttgaacaaacaatgtttgttcagtaaaataagttaaatcagtattttttttgttttcataagtaaattgtttgtttatcaatagttctaccacagagatgtgctttagataccattttgatcaaaatgtctttagagaccttctaacaaaatgcagagatttcttagagacttgcattgaaatagtgactacaactaagcctacttgaaaacgtacttttcatcgtacctgttataatttttacacttttcctacaaaatttgttacttcatatgctcataaaagatacccaactggaactggaaaatgtacttgcctttaccaacttggcaatcttaggtcctacttccttgtttagacaagttttactaggaatatataaatcactaaaatgaaaagactgaatatctgaagtagcattttacaatcggcgcagccgcaaaaaaaattcattgaaaaaatattgtattacgaaaaggacataatctatttttttattactatttcgcaataatttccctgaatgtaatcgaaattccctgagaattccaggttttttccaggttgaagaaaattccctgataattccaggttttccaggtttttccaggtagtagacaccctgattttgcacgatggcttgaataactgtttctttgattttggatagctttcagatgtttcagtcaaaattttgtgggtgctcttcaaataatataagattacgcttctaatgacacattgatttgaattttttgccgatccattgctgaggaaatcatccatgttttttcagtgtgtttttttgaaaaatgtctcaactttaagtaaaaattatttttggaaaaatatatataaacttttgcacggaagtgtacaagtgcatcaagaggaccaataactagatttggctggattagttcggagtatttcggaaccggacattttcagaccatcatattgttccatcatgtgacagctcaaaattcaagatttttcattcagatctaaacagacatttatttaagagaacttctacagtcatttactgagagcttcctttgttgattgctcatttttgaatgcgttaatcgcgttgcaggtacaaatatactctatgttctggtaaatccatagaatgtccaatccaaaaagatcctcaactggtgagattcgaacccacacccctcagcttggtcttgctgaagagctacgcgttaaccgctacggctatatgggcctcccaaacataaaatgatcatactcgaatgacatttccgttacggccaaagtaaaaaaaaatagaatataaggaatcgacatcactcgacaagccgtaattcatgggtttttcttatctataagtaaaacgacatataatcgctaatgaatcataacttttgacagcaatcgcaattttgggacccatttgaggctccaggaaaacctccagagattccttcaaaaattcctcacgaaacatctccagagatttctccaggaattctgtaaaaaagtcatctcgaggttcgtccaggaatttgtgtggcatgtgccagcctagagaatggactagtctagaatgacactccgcgagtccgcatcaaaggacgacggcctttgttcacccagtacaggaatgcaaggttgttggttgtgctttggcatgccgggtgatttgctagcgctcttcgttagtttccacagaattatcccgaagattttgttttttttttctggattcttccacgaggctccaggaactttaccaggaattcctctagggtttctattgaaaattcctccaggtgttctacaactcacgtactcttgaggaatcaagaattccaggaattctcccagagctaccgccaggaaaatcgcttatgacttactccaagaatcactccagataatcctacaggggtttcccagcgatttctcgggagattcgttccgggcttccgaaaaatcatccagagattcctccaagagttcctcttggaattcgtccagagattcttccatgaattcctgcaggaatttcatcagaaaccatgctagaaatttctccaggatttttccaggaattccaccgtggattcgtctagagattactctagattttttttttcagaagttctaccagggatggctcaagaaatccctcccggaacttatccaggaatttctcaaacaattttttcaggaaaggagttcctggaagagtcttcaaaaaatcgaagttacttaaaaaaatgcggcgttaggaattattttttctgtaaaattcttggaaaaatgcatgggtgaaccaaactcctggttagaggaattcttgaaggaatccccgtaggattttttgagacccagaacgaatcactggaaaaatttcaaagaggatccctgaaggattacctgtaaaaatcaataaaataattcaagtaacgattttcctgggaaaatttttgaaggaagctcttgagaaatctataaaaatatatgaaataatttcttgtagaatccctagatgaattttctgtaaatttccggaagaattcttggaacgatcgctggagtaaaatcaggtaaaaatttaaagtccgtacgtggacgctgagtggtcccccaacggcccgagctcgctactctagtgcacgcagcatgagtacgaaaagccaccagtaacacattgtcctgcgcgcgttgataatgaacatagaagtttgttttctttaggatgattcaatattacgtaacgcaaaatttgccaatttagacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcagaccaccatttgaacctcgcgtttttgagaagggcgtatcggaaaatgcatggcaaatctttaaaaactgtaactcgaaaacggtttgtccgatcgatttgagatcttctacaaagttgtaggtattgcttaggactatatggaaaaaaatatgcacgggaaaaaaaagttacagattattttttatttcaaaaacaaaattttaaaatcgattttctccagaaacgcagtttcgattttttttttatttttggatatgttttaggggacaacttatgtgatttattgcacaatgtttcaaaatggaagaattatggacaaaaaagttatgaaattgaaatagaggaaacaataatttttatgtgattatttgaaagtacagattgcaatcgaaaattacttaagtaaattttttctaggttgcatcaatttcgagatatactcttatttatataaaattttcaaatgaaaaaagaaaaataggcccttttcaagcatatttcgtgtttctccattccagaaaaaaatattttgattgagcgaatcgtagctaaatcgtttatcgtttgatcaaaacatttatgcttaagtattgaaaaagagtgcacggtaaaaaatataaacgatattttcaaatgaaaatttgaagctaatggttcttaaaaaccgcaacattgatgtttttaatttttggatatattttgcggttgttgtaggtattgtttaggactatttggaaaaaaatatgcacggtaaaaaataatgacagatttttttattaaaaaaaattaaaatcgattttctatgaaaatgcatctgtgatttttaggggacaacttatgtgatttattgcacaatgtttcataatggaagaattatggacaaacaagttataattttataaaatattacaaattttgaaaaaaaaatagaaataaagttctaagttgaatggcatttttttgcaacatcacatgaaaaagggccatgcgatgccataggagggacactaaaacgtatggctaccagagccagtcttgccaaaaaacgtgaaaatccgataaaaaatgctaaggaactatatgattgggctcaaaatcggaaagaagagcagcttacacaaatcttcgtttgttattcaactactgaggaatatgatatcattgcacaagaacttaaccaactattttcaagtgcaaaaacagttcaaggcactcagaaatatcactcgtttatccatatctctgaaacacaaattgaagttagacaattttcgagctgtgacgataacaagaaagtagttgatataattaagaaataaaattgcagggtatatatatatatatatatatatatatataaaagagaaaaaaaaaacaagaaaaaacaaaaaaacaagaaaaaaacaaactccttcttcatggttgtacgatcttgccgcgatgagagggctttacccattagccgggcttagccctggggaccaaaggtacaccgttgtgatagaatcacatttttaatgccacgtttagatttaccgtgtatatctcgaaagtgatgcatctcagctaaattttacttgagtatttttcgatagaaattattcatatttaaaactatatagttatttttctgtactcaaacaaacattgtgcaataaatcacataagttgtcccctaaaacatatccaaaaataaaaaaaatcgaaactgcgtttctggagaaaatcgattttaaaattttgtttttgaataaaaaataatctgtaactttttttcccgtgcatatttttttccatatagtcctaagcaatacctacaactttgtataagatctcaaatcgatcagacaaaccgttttcgagttacagttttttaaagatttgctatgcattttctgatacgcccttctcaaaaataaggcgaggtccaaaatggcggtctgaaggtgcaaaatggcatttttggtcataaagaatctgtatgcaaattttcaggcaattcaaaatatactaaaattaaatttaaaaaaaaatttaaaaaaatcgtcatgttcggtggaattgctcatgaggaaattcttggatgtattgctggagccctatttagtacccgtcttaaaaatctgtaagattctctgcaggaattcttgacggaacccctggagaaattccaggagaaattcttgcttttaaggtgagccacacctcaaattttcaagtgcacaagactggagaatctgacaacaattcgcgttaaaaatcaatcaaattgcttgtttgctggtggtgaccaatgggataaattttcaatgcggagcgctgtttggttctcaagtcttgtgctcttgaaaatttaaggtttggcttaattctataatcaccttaagtccaccctgagcatgtttcatgtctgtaaaggacctccgaagaagacctgactgcttctgatgatgcaccttagtaacatcagctatcagcaaggatcaacgtaaacgaactcgtccccacctcaaaagtatatccttatatcgttataatattgcataggtgagcccttttgcaagccggttagcccttcgaatatagggggtgccttcggcgtttaccacgagttttggtttttcacgcgggtgaaccagtctgcatgtgtttcatatgatcgggcaacaatctacatatcatataaagcattattattttgcttatagttaggggacggacctggtgtagtggttagaacacacgcctctcacgccgaggacctgggatcgaattccatccccgagatagtcacttttaacaaaaagattttagtgacgacttccttcggaagagaagtaaaaccattggtcccgagatgaattagcccagggctaaaaatctcgttaacttaaaacagataaaaccaaaatttgcttatgaatttttccttcttctactactccttattatgctaaatgaccttatgccaaacggggtaagatcctccagggtatcttctaggaattcctccatggatttatccaggattttctttcgagaatttcttcaagaattcttacagaggtttcttcaaaaattattccaaaaattcttcctatacttccctcggtgatattttaagttcgcaagggagtattgttgaatttctgcaagaatttctccgaggataccctcacagatttctacagaggtttctctagggattctttcaggaaatcctacaggatacaggtatacagttattttatgaatgaattcttctaacacgttttccaggaaccctctttagtaattcctccagggttttctacagggcttccttctgggggtttaccatgaattttccaaacctttcttcagggagagaagtaatccttcagtaatgaattcctggtggcattcttgcaggaatacttgaaagaacccccgggaagaatacctagagaaatctctggggaactcttgaaagaatttctgaagaaagtcctgagggaggtattcattgagcccaatttagcaccggtctcaaaaatcctgtgtcggaatccctgtatcaggtttcagaaggctggcttcagagacacattccccgtcaattgggcgatttatgccatcgtcatatttaagcctatttcaccatctactcgatgggaaaggagaaagaaaggcaagataggaggaaataggggcggggtacctttaacaggaaaaatcacatgagagcatgtagttctataccataatgggttctgcaaaacgatgagcgcaaagagagcctatgtgccaactgccaacgccacagcgagctgaaagtaacagtatgtcctgaagattcgagcttctgaaatcactttacttgtcgcccaacaattggtctgtagcttaacccagaactttgaaataagaataaatggtacatggactccattcatgcgaagtcattccgtaggtatcaaggatggaaaaaattgcctctagcgactaacaacatagtatttcaatggtctaagatggtctggaaatccctagaagaatttttgaaggaatttttggagaaatttttgaaggaatgtcggctaaatgaatccctaaaagattcctcgtagaagttcttgacggaatctgtggaagaattccaggagaaattcttggaggaacccttggagaaaaatccgcacaggaattcctgaaggaaatgtttaagaatttttcacagttattcatgaaggaatccctggaggaattcctgaagaaatcccaacatttccaaccctccatattcttctactattcactaccttctctgaacattgtttgttttcattgtagagtttggcgtactcgtggcttgtttttgtcgcgtcaacccgtcaaagctcctgaaaaccgccaaagccagcccggtgctaggcagccatgttttcgaggtcagcatcaaactcaagaacaacaacgtacattggcgtaatcatattggggaaatttttctccgatattttaatttgtttcacgcgaactgtttcaactctaattaacttgctgtactgcaaacgaatagtgtgcaatcgtttgtttgtgctaatataactgttgttgtgagaaaaaatatttttttcgacaaaaaagatttcaccttcctcgattgttagtccttaaacgactacttgtttacaaacattaagctgtcagtgggaaccagagatgtttgccgttattttccaatggggttgtatgggcgctgtcaggaggctggccaaagcaagtccaccctgagcacatttcatattctaaaaggaccacaggtcgtacggtcgtctacagatgtatcacatgcacggccaacaatctctaaatccgcgaagcaaacacattgactggatatgataaatataggaatccagctcttacgtgtttattgcaatatcgaacaacaaaaacgaaatttcaccattcagttctctcgtagtcgagataaatgatatctttttttaactccttcttttttccggcattatgctcaaactgggacctgattgttcttatgagcccttgcacagctatgaacaagatttcctgggtcaacttgatgagttcagccctgatgctgtccttatcaattgcatttgcgtccgtaacttccatacaatttcacccactttggaaaataagtggttttgctaatgacgatcccaggcactacaaatgtggaggatgacacgtgattgccacgctcttcggccatattggggaattgcagacacgggtatccagtgttgcaaagacctcaagaaaaaaaatcccaaatcatttagaaattctcccaagaatcccttcagcaatatctttagaaattctttaaatgaaattctttaatatcctttataaaatacttcagagttcttgcgcagatttctttattatattcccaacaggtattgccaaaagaattctccatttgaaatatcttttgagattcttcaggaaatttatctctggattattccaaaatttctccaagcaagctttgagttatgactaaagaaatctactccagaacacctacagaattttatttttttgtagaagtacatcttataggaatgtctttagatatttgataaaaatgttttagggattcctccagaagttcatgcaaagattactccattagttccttcgggggttttgaagtactttttcaaagttttccgaaaattcatccgaaaaaaatcctaaagatcctgcatgatattctctagaattttcttcgctaatttctacatcaattcattaagtattttcaagctatttgtccctaaattattcctgcaattctaccaaagaattattcaagatctaacaacgagacacctccaaaagctcatctggaggtccttgcaagtgttttttcgtagaatcctacaggtacctccgcatatatttttttccggagtcactccatgtaattgagcattatcaacttatcttatatacactcccgtgcataagtttgggttcaccccctaaaaaacatgcaaaagtgttctgtccatatctctgtgattacacgtccaattgaaactctctaagtcgcattcgaaaggcaaagagttattcttacttcgtatgtatttttccaaaaacattctttgaactttgtatactaaatttttacttaaagttgtgacatttttccaaaaacacactgaaaaatcatatttaatttcctcaggattgggtcgaccaaaattttcaatcaaagtgtcattagaatcgtaaacttatattctttgaagaaacgctacgaaattttggcggaaaaatctgaaaagtattctaaatcaatgaaacagtcagtcaagtcatcgtgcaaaagtttgggttcacccctcagtatggtgtatcgtgcaaaagtttgggttcacctaaactgacttaaatctgtgaaatctcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgcggctcaggtgacccaaacttttgcacgatttgcatcatactgaggggtgaacccaaacttttgcacgatgacttgactgactgtttcattgatttagaatactttccagatttttccgccaaaatttcgtggggtctcttcaaagaatataagattacgattctaatgacacttcgatttaaaattttggtcgacccaatgctgaggaaattcaatatgatttttcagtgtgttttttgaaaaatgtcacaactttaagtaaaaaattagtatacaaaattcaaaaaatgttttttgaaaaatacatacgaagtaagaataactctttccctttcgaatgcggcttaaaaagtttcaattggacgtgtaatcacagagatatggacagaacacttttgtatgtttttgagggggtgaacccaaacttttgcacgggagtgtatgaccagtaggcgagtttcggcgcgtattttcttagaagaaaagagaattttgttgctggtgagtaatggaagaatttcttctctttcaagaaatttttcgcctacagatctggtcatatatcagtttgataatgcttaattataacatatgtgctgttcgttcagagatttccagaaaacttgtctagagacttgtcaagcgttcactccagaaaataattcaaaaaacctttagaatatcttgcaatgattacttcagggatatttttaaaaggttagtttatgcatgtgttacaaaatttcttatgttcctacataaattatttctggaattcctcatgttatttccacaaaaaccctccaaattcttcaggagtggtcatgataacaatccaatggccatttcgggaatcaaagaattgtcggtctaactttcagatgaaattaaggtttataattttgatccaatagttttcactagatagacaaatgtgaacagtaccttcaacgaggaacaacatattctatcataaatgcagttacgtaacattactaatattcttttctattttccccttacaggtcaacatctaaagaaaaacaactcgttgtccgaatcgtcgtccgacatgatggacctggaggacggaatcgagacaacgccgaacataggtgatcaaaatcgaatggttccattttacggaacgcatcttaccgataaacaacaattgcagcagcagcaaaactgctgtaagcaaccgtcgaacggcggcgggggtggtgttgggggcggtggcctccccggaagtggtgggggtggcggtggtggcgccggcggtggaaccaataataacttacaacaacgccacaatagcgcattagccgttagtatcgaaaccgatgtctgactactgggtatgattattttctgctagtttatcttcttgatttcccgatttatagttgatccacccccacacgcggtgacgacgctcggtggctgttaaaatttaaatgaacacaatgttcaacttactttggaaactacaaccaccaaacgtccgagccagtactgcattgctccttcattccatgcacttacacaccgaaaaaaaaactaattgattacgcttcaccccacacgaacaacacaccgctcacctatctatcaattcgaaaatttgaaatttcaatccgtacttaacgctaaaataacttcgaacgaaacacgttgagacaaacaccaaatgctccctcgcagtaggctaccgacctcgatccaagtaaagcccatcagagcctactactatatgagtagaaatcgcttttcgttgcgttcg

(The sequence listing continues in the following parts.)

We claim:

1. An interfering ribonucleic acid (iRNA) comprising a nucleobase sequence of 21 nucleotides that that is perfectly complementary to the nucleobase sequence of one of SEQ ID NO: 261, SEQ ID. NO: 262, and SEQ ID. NO: 273, wherein the iRNA is capable of inhibiting the expression of *Aedes aegypti* Gene ID AAEL000242 by RNA interference.

2. The iRNA of claim 1, wherein the iRNA is a small interfering RNA (siRNA), a short hairpin RNA (shRNA), double stranded RNA (dsRNA), an RNA construct, or an anti-sense oligonucleotide.

3. A DNA construct that encodes and can express the iRNA of claim 1.

4. A yeast, bacterial, algal, or plant cell engineered to produce at least one iRNA according to claim 1.

5. A mosquito-ingestible composition comprising (i) the iRNA of claim 1, (ii) a bacterial cell, a yeast cell, an algal cell, or a plant cell expressing the iRNA, or (iii) the DNA construct of claim 3, and at least one suitable carrier, excipient, or diluent.

6. The mosquito-ingestible composition of claim 5, wherein the composition comprises the yeast cell.

7. The mosquito-ingestible composition of claim 5, wherein the yeast cell is heat inactivated.

8. A method for inhibiting the expression of *Aedes aegypti* Gene ID AAEL000242, or an ortholog thereof, by RNA interference comprising exposing at least one mosquito larva or adult to the interfering ribonucleic acid (iRNA) according to claim 1 in an effective amount to inhibit the expression of the gene or ortholog, wherein the ortholog comprises a nucleobase sequence that is at least 85% identical to the entire length of SEQ ID NO: 261, 262, or 272.

9. The method of claim 8, wherein the at least one mosquito larva comprises larvae from two or more mosquito species.

10. The mosquito-ingestible composition of claim 5, wherein the composition comprises:

a) a yeast cell engineered to produce the iRNA;

b) a bacterial cell engineered to produce the iRNA; or c) an algal or plant cell engineered to produce the iRNA.

11. The mosquito-ingestible composition of claim 10, wherein the iRNA is an shRNA.

12. The composition of claim 10 further comprising a sugar bait optionally including nanoparticles, yeast, bacteria, or a combination thereof.

13. The composition of claim 10 further comprising a dried inactivated yeast.

14. The mosquito-ingestible composition of claim 5, wherein the mosquito-ingestible composition is formulated as a sugar bait composition or as a chitosan nanoparticle composition, optionally wherein the sugar bait composition or chitosan nanoparticle composition comprises yeast, bacteria, or both yeast and bacteria.

* * * * *